US007687616B1

(12) United States Patent
Bentwich et al.

(10) Patent No.: US 7,687,616 B1
(45) Date of Patent: Mar. 30, 2010

(54) SMALL MOLECULES MODULATING ACTIVITY OF MICRO RNA OLIGONUCLEOTIDES AND MICRO RNA TARGETS AND USES THEREOF

(75) Inventors: Itzhak Bentwich, Kfar Daniel (IL); Amir Avniel, Rishon leZion (IL)

(73) Assignee: Rosetta Genomics Ltd, Rehovot (IL)

( * ) Notice: Subject to any disclaimer, the term of this patent is extended or adjusted under 35 U.S.C. 154(b) by 1074 days.

(21) Appl. No.: 10/709,577

(22) Filed: May 14, 2004

(51) Int. Cl.
C07H 21/04 (2006.01)
(52) U.S. Cl. .................................. 536/24.5; 536/23.1
(58) Field of Classification Search .................. None
See application file for complete search history.

(56) References Cited

U.S. PATENT DOCUMENTS

| | | | |
|---|---|---|---|
| 6,432,639 B1 * | 8/2002 | Lichter et al. ............. | 435/6 |
| 6,573,099 B2 | 6/2003 | Graham | |
| 6,582,908 B2 * | 6/2003 | Fodor et al. ............... | 435/6 |
| 6,720,138 B2 | 4/2004 | Sharma et al. | |
| 2002/0086356 A1 | 7/2002 | Tuschl et al. | |
| 2003/0108923 A1 | 6/2003 | Tuschl et al. | |
| 2003/0228691 A1 | 12/2003 | Lewis et al. | |
| 2004/0053411 A1 | 3/2004 | Cullen et al. | |
| 2004/0086884 A1 | 5/2004 | Beach et al. | |
| 2005/0227934 A1 * | 10/2005 | Stoffel et al. .............. | 514/44 |

FOREIGN PATENT DOCUMENTS

| | | |
|---|---|---|
| WO | WO 01/68836 | 9/2001 |
| WO | WO 01/75164 | 10/2001 |
| WO | WO 02/44321 | 6/2002 |
| WO | WO 02/094185 | 11/2002 |
| WO | WO 03/029459 | 4/2003 |
| WO | WO 03/070884 | 8/2003 |
| WO | WO 03/070903 | 8/2003 |
| WO | WO 03/070918 | 8/2003 |
| WO | WO 03/074654 | 9/2003 |
| WO | WO 2004/009779 | 1/2004 |
| WO | WO 2004/031412 | 4/2004 |

OTHER PUBLICATIONS

Honda et al., 1998, J. Cell Biology 140:1383-1393.*
Krutzfeldt et al. (2006) Nature Genetics 38:514-19.*
Bentwich (2005) FEBS Lett. 5904-5910.*
New England Biolabs 1998/99 Catalog, cover page, p. 121 and 284.*
Bentwich et al. (2005) FEBS Lett. 579:5904-5910.*
Martin et al. (2007) J. Biosci. 32:1049-1052.*
Maziere et al. (2007) Drug Discovery Today 12:452-458.*
Smalheiser et al. (2006) Methods Mol. Biol. 342:115-127.*
GenBank Accession No. BD247503.1 "Maize DNA ligase I orthologue and uses thereof", as published online Jul. 17, 2003, retrieved from the Nation Center for Biotechnology Information [online] on Oct. 22, 2008 at ncbi.nlm.nih.gov/entrez.*
Kim et al. (1996) "Construction and characterization of a human bacterial artificial chromosome library" Genomics 34:213-218.*

The International Human Genome Sequencing Consortium (2001) "Initial sequencing and analysis of the human genome" Nature 409:860-921.*
Buck et al (BioTechniques 27: 528-536, 1999).*
GenBank Accession No. AC_096504.7 "Rattus norvegicus clone CH230-167O14, Working Draft Sequence", as published online May 10, 2003, retrieved from the Nation Center for Biotechnology Information [online] on Oct. 22, 2008 at ncbi.nlm.nih.gov/entrez.*
U.S. Appl. No. 10/293,338, filed Nov. 14, 2002.
U.S. Appl. No. 10/310,914, filed Dec. 6, 2002.
U.S. Appl. No. 10/321,503, filed Dec. 18, 2002.
U.S. Appl. No. 10/345,201, filed Jan. 16, 2003.
U.S. Appl. No. 10/604,985, filed Aug. 29, 2003.
U.S. Appl. No. 10/535,164, filed Nov. 16, 2003.
U.S. Appl. No. 10/707,975, filed Jan. 29, 2004.
U.S. Appl. No. 10/708,204, filed Feb. 16, 2004.
U.S. Appl. No. 10/708,953, filed Apr. 2, 2004.
U.S. Appl. No. 10/709,572, filed May 14, 2004.
Lee, R. C., R. L. Feinbaum and V. Ambros. The *C. elegans* heterochronic gene lin-4 encodes small RNAs with antisense complementarity to lin-14 Cell Dec. 3, 1993 843-854 75.
Wightman, B., I. Ha and G. Ruvkun. Posttranscriptional regulation of the heterochronic gene lin-14 by lin-4 mediates temporal pattern formation in *C. elegans* Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus-infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.

(Continued)

*Primary Examiner*—Louis Wollenberger
(74) *Attorney, Agent, or Firm*—Posinelli Shughart PC; Teddy C. Scott, Jr.

(57) ABSTRACT

The present invention describes a novel approach whereby small molecules may be used to modulate activity of microRNA and GAM oligonucleotides. This mode of therapy allows inter alia up regulation of a disease-related target gene of novel GAM oligonucleotides of the present invention, by countering the activity of a GAM oligonucleotides which naturally inhibits expression of that target gene. Nucleic acid molecules are provided respectively encoding 122,764 GAM oligonucleotides and their respective precursors, and 18602 GR polynucleotides, as are vectors and probes both comprising the nucleic acid molecules, and methods and systems for detecting GAM oligonucleotides and GR polynucleotides and specific functions and utilities thereof, for detecting expression of GAM oligonucleotides and GR polynucleotides, and for selectively enhancing and selectively inhibiting translation of the respective target genes thereof.

4 Claims, 42 Drawing Sheets

OTHER PUBLICATIONS

Engdahl HM, Hjalt TA, Wagner EG. A two unit antisense RNA cassette test system for silencing of target genes. Nucleic Acids Res. Aug. 15, 1997 3218-27 25.

Dsouza, M., N. Larsen and R. Overbeek. Searching for patterns in genomic data Trends Genet Dec. 1997 497-498 13.

Moss, E. G., R. C. Lee and V. Ambros. The cold shock domain protein LIN-28 controls developmental timing in *C. elegans* and is regulated by the lin-4 RNA Cell 1997 637 88.

Fire, A., S. Xu, M. K. Montgomery, S. A. Kostas, S. E. Driver and C. C. Mello. Potent and specific genetic interference by double-stranded RNA in *Caenorhabditis elegans* Nature Feb. 19, 1998 806-811 391.

Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.

Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.

Verma, S. and F. Eckstein. Modified oligonucleotides: synthesis and strategy for users Annu Rev Biochem *No date in Pubmed* 1998 99-134 67.

Wuchty, S., W. Fontana, I. L. Hofacker and P. Schuster. Complete suboptimal folding of RNA and the stability of secondary structures Biopolymers Feb. 1999 145-165 49.

Mathews, D. H., J. Sabina, M. Zuker and D. H. Turner. Expanded sequence dependence of thermodynamic parameters improves prediction of RNA secondary structure J Mol Biol May 21, 1999 911-940 288.

Chang, P. L. Encapsulation for somatic gene therapy Ann N Y Acad Sci Jun. 18, 1999 146-158 875.

Zhang, M. Q. Large-scale gene expression data analysis: a new challenge to computational biologists Genome Res Aug. 1999 681-688 9.

Grisaru, D., M. Sternfeld, A. Eldor, D. Glick and H. Soreq. Structural roles of acetylcholinesterase variants in biology and pathology Eur J Biochem Sep. 1999 672-686 264.

Fire, A. RNA-triggered gene silencing Trends Genet Sep. 1999 358-363 15.

Tabara, H., M. Sarkissian, W. G. Kelly, J. Fleenor, A. Grishok, L. Timmons, A. Fire and C. C. Mello. The rde-1 gene, RNA interference, and transposon silencing in *C. elegans* Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in *Caenorhabditis elegans* by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in *Caenorhabditis elegans* Nature Feb. 24, 2000 901-906 403.

Pitt, J. N., J. A. Schisa and J. R. Priess. P granules in the germ cells of *Caenorhabditis elegans* adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in *Drosophila* cells Nature Mar. 16, 2000 293-296 404.

Slack, F. J., M. Basson, Z. Liu, V. Ambros, H. R. Horvitz and G. Ruvkun. The lin-41 RBCC gene acts in the *C. elegans* heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in *Drosophila* Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. *Arabidopsis* SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995 1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale *C. briggsae-C. elegans* genomic alignment Genome Res Aug. 2000 1115-1125 10.

Kennerdell, J. R. and R. W. Carthew. Heritable gene silencing in *Drosophila* using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in *Nicotiana benthamiana* Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed small dsRNAs may mediate sequence-specific mRNA degradation during RNAi in *Drosophila* embryos Curr Biol Oct. 5, 2000 1191 1200 10.

Anandalakshmi, R., R. Marathe, X. Ge, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22-nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in *Nicotiana benthamiana* using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of *C. elegans* adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in *Drosophila* using a GAL4-driven hairpin RNA incorporating a heterologous spacer Nucleic Acids Res Jun. 15, 2001 E55-55 29.

Vance, V. and H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control *C. elegans* developmental timing Cell Jul. 13, 2001 23-34 106.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and high-throughput gene silencing in plants Plant J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: it's a small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in *C. elegans* Genes Dev Oct. 15, 2001 2654-2659 15.

Ruvkun, G. Molecular biology. Glimpses of a tiny RNA world Science Oct. 26, 2001 797-799 294.

Lee, R. C. and V. Ambros. An extensive class of small RNAs in *Caenorhabditis elegans* Science Oct. 26, 2001 862-864 294.

Lau, N. C., L. P. Lim, E. G. Weinstein and D. P. Bartel. An abundant class of tiny RNAs with probable regulatory roles in *Caenorhabditis elegans* Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in *Drosophila melanogaster* embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K. M. Routzahn, D. S. Waugh, D. L. Court and X. Ji. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Benarie and H. Soreq. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in *Drosophila melanogaster* Genetics Feb. 2002 637-648 160.

Martens, H., J. Novotny, J. Oberstrass, T. L. Steck, P. Postlethwait and W. Nellen. RNAi in *Dictyostelium*: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K., L. Tang and E. G. Moss. Two genetic circuits repress the *Caenorhabditis elegans* heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic ARGONAUTE (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.

Boutla, A., K. Kalantidis, N. Tavernarakis, M. Tsagris and M. Tabler. Induction of RNA interference in *Caenorhabditis elegans* by RNAs derived from plants exhibiting post-transcriptional gene silencing Nucleic Acids Res Apr. 1, 2002 1688-1694 30.

Pasquinelli, A. E. and G. Ruvkun. Control of developmental timing by micrornas and their targets Annu Rev Cell Dev Biol Epub 2002 Apr. 2, 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes Cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. BLAT—the Blast-like alignment tool Genome Res Apr. 2002 656-664 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwarz, D. S. and P. D. Zamore. Why do miRNAs live in the miRNP? Genes Dev May 1, 2002 1025-1031 16.

Brantl, S. Antisense-RNA regulation and RNA interference Biochim Biophys Acta May 3, 2002 15-25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.

Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.

Tabara, H., E. Yigit, H. Siomi and C. C. Mello. The dsRNA binding protein RDE-4 interacts with RDE-1, DCR-1, and a DExH-box helicase to direct RNAi in *C. elegans* Cell Jun. 28, 2002 861-871 109.

Bettencourt, R., O. Terenius and I. Faye. Hemolin gene silencing by ds-RNA injected into *Cecropia pupae* is lethal to next generation embryos Insect Mol Biol Jun. 2002 267-271 11.

Hooper, N. M. and A. J. Turner. The search for alpha-secretase and its potential as a therapeutic approach to Alzheimer s disease Curr Med Chem Jun. 2002 1107-1119 9.

Liu, Q., S. Singh and A. Green. High-oleic and high-stearic cottonseed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins Rna Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates *Drosophila* growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the *Arabidopsis* FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002 2591-2598 148.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.

Park, W., J. Li, R. Song, J. Messing and X. Chen. Carpel Factory, a Dicer homolog, and HEN1, a novel protein, act in microRNA metabolism in *Arabidopsis thaliana* Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of *Arabidopsis* miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A *Drosophila* fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short INTEGUMENTS1/SUSPENSOR1/Carpel Factory, a Dicer homolog, is a maternal effect gene required for embryo development in *Arabidopsis* Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and downregulation of micro- RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446.

Jones, L. Revealing micro-RNAs in plants Trends Plant Sci Nov. 2002 473-475 7.

Schauer, S. E., S. E. Jacobsen, D. W. Meinke and A. Ray. DICER-LIKE1: blind men and elephants in *Arabidopsis* development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.

Dennis, C. Small RNAs: the genome's guiding hand? Nature Dec. 19-26, 2002 732 420.

Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.

Tang, G., B. J. Reinhart, D. P. Bartel and P. D. Zamore. A biochemical framework for RNA silencing in plants Genes Dev Jan. 1, 2003 49-63 17.

Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.

Ashrafi, K., F. Y. Chang, J. L. Watts, A. G. Fraser, R. S. Kamath, J. Ahringer and G. Ruvkun. Genome-wide RNAi analysis of *Caenorhabditis elegans* fat regulatory genes Nature Jan. 16, 2003 268-272 421.

Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the *Caenorhabditis elegans* genome using RNAi Nature Jan. 16, 2003 231-237 421.

Tuschl, T. Functional genomics: RNA sets the standard Nature Jan. 16, 2003 220-221 421.

Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.

Shi, Y. Mammalian RNAi for the masses Trends Genet Jan. 2003 9-12 19.

Cerutti, H. RNA interference: traveling in the cell and gaining functions? Trends Genet Jan. 2003 39-46 19.

Zeng, Y. and B. R. Cullen. Sequence requirements for micro RNA processing and function in human cells Rna Jan. 2003 112-123 9.

Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.

Reiner, A., D. Yekutieli and Y. Benjamini. Identifying differentially expressed genes using false discovery rate controlling procedures Bioinformatics Feb. 12, 2003 368-375 19.

Doench, J. G., C. P. Petersen and P. A. Sharp. siRNAs can function as miRNAs Genes Dev Feb. 15, 2003 438-442 17.

Gupta, V., A. Cherkassky, P. Chatis, R. Joseph, A. L. Johnson, J. Broadbent, T. Erickson and J. Dimeo. Directly labeled mRNA produces highly precise and unbiased differential gene expression data Nucleic Acids Res Feb. 15, 2003 e13 31.

Boffelli, D., J. Mcauliffe, D. Ovcharenko, K. D. Lewis, I. Ovcharenko, L. Pachter and E. M. Rubin. Phylogenetic shadowing of primate sequences to find functional regions of the human genome Science Feb. 28, 2003 1391-1394 299.

Kasschau, K. D., Z. Xie, E. Allen, C. Llave, E. J. Chapman, K. A. Krizan and J. C. Carrington. P1/HC-Pro, a viral suppressor of RNA silencing, interferes with *Arabidopsis* development and miRNA unction Dev Cell Feb. 2003 205-217 4.

Carmell, M. A., L. Zhang, D. S. Conklin, G. J. Hannon and T. A. Rosenquist. Germline transmission of RNAi in mice Nat Struct Biol Feb. 2003 91-92 10.

Dostie, J., Z. Mourelatos, M. Yang, A. Sharma and G. Dreyfuss. Numerous microRNPs in neuronal cells containing novel microRNAs Rna Feb. 2003 180-186 9.

Lagos-Quintana, M., R. Rauhut, J. Meyer, A. Borkhardt and T. Tuschl. New microRNAs from mouse and human Rna Feb. 2003 175-179 9.

Wilson, J. A., S. Jayasena, A. Khvorova, S. Sabatinos, I. G. Rodrigue-Gervais, S. Arya, F. Sarangi, M. Harris-Brandts, S. Beaulieu and C. D. Richardson. RNA interference blocks gene expression and RNA synthesis from hepatitis C replicons propagated in human liver cells Proc Natl Acad Sci U S A Mar. 4, 2003 2783-2788 100.

Lim, L. P., M. E. Glasner, S. Yekta, C. B. Burge and D. P. Bartel. Vertebrate microRNA genes Science Mar. 7, 2003 1540 299.

Maniataki, E., A. E. Martinez De Alba, R. Sagesser, M. Tabler and M. Tsagris. Viroid RNA systemic spread may depend on the interaction of a 71-nucleotide bulged hairpin with the host protein VirP1 Rna Mar. 2003 346-354 9.

Ambros, V., B. Bartel, D. P. Bartel, C. B. Burge, J. C. Carrington, X. Chen, G. Dreyfuss, S. R. Eddy, S. Griffiths-Jones, M. Marshall, M. Matzke, G. Ruvkun and T. Tuschl. A uniform system for microRNA annotation Rna Mar. 2003 277-279 9.

Findley, S. D., M. Tamanaha, N. J. Clegg and H. Ruohola-Baker. Maelstrom, a *Drosophila* spindle-class gene, encodes a protein that colocalizes with Vasa and RDE1/AGO1 homolog, Aubergine, in nuage Development Mar. 2003 859-871 130.

Hershberg, R., S. Altuvia and H. Margalit. A survey of small RNA-encoding genes in *Escherichia coli* Nucleic Acids Res Apr. 1, 2003 1813-1820 31.

Zhou, A., S. Scoggin, R. B. Gaynor and N. S. Williams. Identification of NF-kappa B-regulated genes induced by TNFalpha utilizing expression profiling and RNA interference Oncogene Apr. 3, 2003 2054-2064 22.

Brennecke, J., D. R. Hipfner, A. Stark, R. B. Russell and S. M. Cohen. bantam encodes a developmentally regulated microRNA that controls cell proliferation and regulates the proapoptotic gene hid in *Drosophila* Cell Apr. 4, 2003 25-36 113.

Lim, L. P., N. C. Lau, E. G. Weinstein, A. Abdelhakim, S. Yekta, M. W. Rhoades, C. B. Burge and D. P. Bartel. The microRNAs of *Caenorhabditis elegans* Genes Dev Apr. 15, 2003 991-1008 17.

Xu, P., S. Y. Vernooy, M. Guo and B. A. Hay. The *Drosophila* microRNA Mir-14 suppresses cell death and is required for normal fat metabolism Curr Biol Apr. 29, 2003 790-795 13.

Xie, Z., K. D. Kasschau and J. C. Carrington. Negative feedback regulation of Dicer-Like1 in *Arabidopsis* by microRNA-guided mRNA degradation Curr Biol Apr. 29, 2003 784-789 13.

Carmichael, G. G. Antisense starts making more sense Nat Biotechnol Apr. 2003 371-372 21.

Yelin, R., D. Dahary, R. Sorek, E. Y. Levanon, O. Goldstein, A. Shoshan, A. Diber, S. Biton, Y. Tamir, R. Khosravi, S. Nemzer, E. Pinner, S. Walach, J. Bernstein, K. Savitsky and G. Rotman. Widespread occurrence of antisense transcription in the human genome Nat Biotechnol Apr. 2003 379-386 21.

Boutet, S., F. Vazquez, J. Liu, C. Beclin, M. Fagard, A. Gratias, J. B. Morel, P. Crete, X. Chen and H. Vaucheret. *Arabidopsis* HEN1: a genetic link between endogenous miRNA controlling development and siRNA controlling transgene silencing and virus resistance Curr Biol May 13, 2003 843-848 13.

Ambros, V., R. C. Lee, A. Lavanway, P. T. Williams and D. Jewell. MicroRNAs and other tiny endogenous RNAs in *C. elegans* Curr Biol May 13, 2003 807-818 13.

Liang, X. S., J. Q. Lian, Y. X. Zhou, Q. H. Nie and C. Q. Hao. A small yeast RNA inhibits HCV IRES mediated translation and inhibits replication of poliovirus in vivo World J Gastroenterol May 2003 1008-1013 9.

Grad, Y., J. Aach, G. D. Hayes, B. J. Reinhart, G. M. Church, G. Ruvkun and J. Kim. Computational and experimental identification of *C. elegans* microRNAs Mol Cell May 2003 1253-1263 11.

Abrahante, J. E., A. L. Daul, M. Li, M. L. Volk, J. M. Tennessen, E. A. Miller and A. E. Rougvie. The *Caenorhabditis elegans* hunchback-like gene lin-57/hbl-1 controls developmental time and is regulated by microRNAs Dev Cell May 2003 625-637 4.

Lin, S. Y., S. M. Johnson, M. Abraham, M. C. Vella, A. Pasquinelli, C. Gamberi, E. Gottlieb and F. J. Slack. The *C elegans* hunchback homolog, hbl-1, controls temporal patterning and is a probable microRNA target Dev Cell May 2003 639-650 4.

Zamvil, S. S. and L. Steinman. Diverse targets for intervention during inflammatory and neurodegenerative phases of multiple sclerosis Neuron Jun. 5, 2003 685-688 38.

Ambros, V. MicroRNA pathways in flies and worms: growth, death, fat, stress, and timing Cell Jun. 13, 2003 673-676 113.

Moss, E. G. and L. Tang. Conservation of the heterochronic regulator Lin-28, its developmental expression and microRNA complementary sites Dev Biol Jun. 15, 2003 432-442 258.

Smalheiser, N. R. EST analyses predict the existence of a population of chimeric microRNA precursor-mRNA transcripts expressed in normal human and mouse tissues Genome Biol Epub 2003 Jun. 18, 2003 403 4.

Kawasaki, H. and K. Taira. Hes1 is a target of microRNA-23 during retinoic-acid-induced neuronal differentiation of NT2 cells Nature Jun. 19, 2003 838-842 423.

Lai, E. C., P. Tomancak, R. W. Williams and G. M. Rubin. Computational identification of *Drosophila* microRNA genes Genome Biol Epub 2003 Jun. 30, 2003 R42 4.

No author listed. Whither RNAi? Nat Cell Biol Jun. 2003 489-490 5.

Bartel, B. and D. P. Bartel. MicroRNAs: at the root of plant development? Plant Physiol Jun. 2003 709-717 132.

Dykxhoorn, D. M., C. D. Novina and P. A. Sharp. Killing the messenger: short RNAs that silence gene expression Nat Rev Mol Cell Biol Jun. 2003 457-467 4.

Saunders, L. R. and G. N. Barber. The dsRNA binding protein family: critical roles, diverse cellular functions Faseb J Jun. 2003 961-983 17.

Steinman, L. and S. Zamvil. Transcriptional analysis of targets in multiple sclerosis Nat Rev Immunol Jun. 2003 483-492 3.

Qi, Y. and B. Ding. Inhibition of cell growth and shoot development by a specific nucleotide sequence in a noncoding viroid RNA Plant Cell Jun. 2003 1360-1374 15.

Jackson, A. L., S. R. Bartz, J. Schelter, S. V. Kobayashi, J. Burchard, M. Mao, B. Li, G. Cavet and P. S. Linsley. Expression profiling reveals off-target gene regulation by RNAi Nat Biotechnol Jun. 2003 635-637 21.

Bashirullah, A., A. E. Pasquinelli, A. A. Kiger, N. Perrimon, G. Ruvkun and C. S. Thummel. Coordinate regulation of small temporal RNAs at the onset of *Drosophila* metamorphosis Dev Biol Jul. 1, 2003 1-8 259.

Sempere, L. F., N. S. Sokol, E. B. Dubrovsky, E. M. Berger and V. Ambros. Temporal regulation of microRNA expression in *Drosophila melanogaster* mediated by hormonal signals and broad-Complex gene activity Dev Biol Jul. 1, 2003 9-18 259.

Heetebrij, R. J., E. G. Talman, M. A. V Velzen, R. P. Van Gijlswijk, S. S. Snoeijers, M. Schalk, J. Wiegant, F. V D Rijke, R. M. Kerkhoven, A. K. Raap, H. J. Tanke, J. Reedijk and H. J. Houthoff. Platinum(II)-based coordination compounds as nucleic acid labeling reagents: synthesis, reactivity, and applications in hybridization assays Chembiochem Jul. 7, 2003 573-583 4.

Borodina, T. A., H. Lehrach and A. V. Soldatov. Ligation-based synthesis of oligonucleotides with block structure Anal Biochem Jul. 15, 2003 309-313 318.

Johnson, S. M., S. Y. Lin and F. J. Slack. The time of appearance of the *C. elegans* let-7 microRNA is transcriptionally controlled utilizing a temporal regulatory element in its promoter Dev Biol Jul. 15, 2003 364-379 259.

Carrington, J. C. and V. Ambros. Role of microRNAs in plant and animal development Science Jul. 18, 2003 336-338 301.

Smale, S. T. The establishment and maintenance of lymphocyte identity through gene silencing Nat Immunol Jul. 2003 607-615 4.

Bridge, A. J., S. Pebernard, A. Ducraux, A. L. Nicoulaz and R. Iggo. Induction of an interferon response by RNAi vectors in mammalian cells Nat Genet Jul. 2003 263-264 34.

Seitz, H., N. Youngson, S. P. Lin, S. Dalbert, M. Paulsen, J. P. Bachellerie, A. C. Ferguson-Smith and J. Cavaille. Imprinted microRNA genes transcribed antisense to a reciprocally imprinted retrotransposon-like gene Nat Genet Jul. 2003 261-262 34.

Zeng, Y., R. Yi and B. R. Cullen. MicroRNAs and small interfering RNAs can inhibit mRNA expression by similar mechanisms Proc Natl Acad Sci U S A Aug. 19, 2003 9779-9784 100.

Schramke, V. and R. Allshire. Hairpin RNAs and retrotransposon LTRs effect RNAi and chromatin-based gene silencing Science Aug. 22, 2003 1069-1074 301.

Wiznerowicz, M. and D. Trono. Conditional suppression of cellular genes: lentivirus vector-mediated drug-inducible RNA interference J Virol Aug. 2003 8957-8961 77.

Lau, N. C. and D. P. Bartel. Censors of the genome Sci Am Aug. 2003 34-41 289.

Houbaviy, H. B., M. F. Murray and P. A. Sharp. Embryonic stem cell-specific MicroRNAs Dev Cell Aug. 2003 351-358 5.

Aravin, A. A., M. Lagos-Quintana, A. Yalcin, M. Zavolan, D. Marks, B. Snyder, T. Gaasterland, J. Meyer and T. Tuschl. The small RNA profile during *Drosophila melanogaster* development Dev Cell Aug. 2003 337-350 5.

McManus, M. T. MicroRNAs and cancer Semin Cancer Biol Aug. 2003 253-258 13.

Baner, J., A. Isaksson, E. Waldenstrom, J. Jarvius, U. Landegren and M. Nilsson. Parallel gene analysis with allele-specific padlock probes and tag microarrays Nucleic Acids Res Sep. 1, 2003 e103 31.

Boutla, A., C. Delidakis and M. Tabler. Developmental defects by antisense-mediated inactivation of micro-RNAs 2 and 13 in *Drosophila* and the identification of putative target genes Nucleic Acids Res Sep. 1, 2003 4973-4980 31.

Palatnik, J. F., E. Allen, X. Wu, C. Schommer, R. Schwab, J. C. Carrington and D. Weigel. Control of leaf morphogenesis by microRNAs Nature Sep. 18, 2003 257-263 425.

Klein, R. J. and S. R. Eddy. RSEARCH: finding homologs of single structured RNA sequences BMC Bioinformatics Sep. 22, 2003 44 4.

Caudy, A. A., R. F. Ketting, S. M. Hammond, A. M. Denli, A. M. Bathoorn, B. B. Tops, J. M. Silva, M. M. Myers, G. J. Hannon and R. H. Plasterk. A micrococcal nuclease homologue in RNAi effector complexes Nature Sep. 25, 2003 411-414 425.

Lee, Y., C. Ahn, J. Han, H. Choi, J. Kim, J. Yim, J. Lee, P. Provost, O. Radmark, S. Kim and V. N. Kim. The nuclear RNase III Drosha initiates microRNA processing Nature Sep. 25, 2003 415-419 425.

Sledz, C. A., M. Holko, M. J. De Veer, R. H. Silverman and B. R. Williams. Activation of the interferon system by short-interfering RNAs Nat Cell Biol Sep. 2003 834-839 5.

Bergmann, A. and M. E. Lane. HIDden targets of microRNAs for growth control Trends Biochem Sci Sep. 2003 461-463 28.

Khvorova, A., A. Reynolds and S. D. Jayasena. Functional siRNAs and miRNAs exhibit strand bias Cell Oct. 17, 2003 209-216 115.

Schwarz, D. S., G. Hutvagner, T. Du, Z. Xu, N. Aronin and P. D. Zamore. Asymmetry in the assembly of the RNAi enzyme complex Cell Oct. 17, 2003 199-208 115.

Abbott, A. L. Heterochronic genes Curr Biol Oct. 28, 2003 R824-825 13.

Hake, S. MicroRNAs: a role in plant development Curr Biol Oct. 28, 2003 R851-852 13.

Carthew, R. W. Making and breaking with nucleases and small RNAs Nat Struct Biol Oct. 2003 776-777 10.

Krichevsky, A. M., K. S. King, C. P. Donahue, K. Khrapko and K. S. Kosik. A microRNA array reveals extensive regulation of microRNAs during brain development Rna Oct. 2003 1274-1281 9.

Mattick, J. S. Challenging the dogma: the hidden layer of non-protein-coding RNAs in complex organisms Bioessays Oct. 2003 930-939 25.

Nelson, P., M. Kiriakidou, A. Sharma, E. Maniataki and Z. Mourelatos. The microRNA world: small is mighty Trends Biochem Sci Oct. 2003 534-540 28.

Michael, M. Z., O. C. SM, N. G. Van Holst Pellekaan, G. P. Young and R. J. James. Reduced accumulation of specific microRNAs in colorectal neoplasia Mol Cancer Res Oct. 2003 882-891 1.

Allinson, T. M., E. T. Parkin, A. J. Turner and N. M. Hooper. ADAMs family members as amyloid precursor protein alpha-secretases J Neurosci Res Nov. 1, 2003 342-352 74.

Kawasaki, H. and K. Taira. Retraction: Hes1 is a target of microRNA-23 during retinoic-acid-induced neuronal differentiation of NT2 cells Nature Nov. 6, 2003 100 426.

Saxena, S., Z. O. Jonsson and A. Dutta. Small RNAs with imperfect match to endogenous mRNA repress translation. Implications for off-target activity of small inhibitory RNA in mammalian cells J Biol Chem Nov. 7, 2003 44312-44319 278.

Basyuk, E., F. Suavet, A. Doglio, R. Bordonne and E. Bertrand. Human let-7 stem-loop precursors harbor features of RNase III cleavage products Nucleic Acids Res Nov. 15, 2003 6593-6597 31.

Stevenson, M. Dissecting HIV-1 through RNA interference Nat Rev Immunol Nov. 2003 851-858 3.

Wienholds, E., M. J. Koudijs, F. J. Van Eeden, E. Cuppen and R. H. Plasterk. The microRNA-producing enzyme Dicer1 is essential for zebrafish development Nat Genet Nov. 2003 217-218 35.

Gibbs, W. W. The unseen genome: gems among the junk Sci Am Nov. 2003 26-33 289.

Chang, J., P. Provost and J. M. Taylor. Resistance of human hepatitis delta virus RNAs to dicer activity J Virol Nov. 2003 11910-11917 77.

Wang, D., A. Urisman, Y. T. Liu, M. Springer, T. G. Ksiazek, D. D. Erdman, E. R. Mardis, M. Hickenbotham, V. Magrini, J. Eldred, J. P. Latreille, R. K. Wilson, D. Ganem and J. L. Derisi. Viral discovery and sequence recovery using DNA microarrays PLoS Biol Nov. 2003 E2 1.

Aukerman, M. J. and H. Sakai. Regulation of flowering time and floral organ identity by a MicroRNA and its APETALA2-like target genes Plant Cell Nov. 2003 2730-2741 15.

Finnegan, E. J. and M. A. Matzke. The small RNA world J Cell Sci Dec. 1, 2003 4689-4693 116.

Enright, A. J., B. John, U. Gaul, T. Tuschl, C. Sander and D. S. Marks. MicroRNA targets in *Drosophila* Genome Biol Epub 2003 Dec. 12, 2003 R1 5.

Rosok, O. and M. Sioud. Systematic identification of sense-antisense transcripts in mammalian cells Nat Biotechnol Jan (Epub Dec. 14, 2003) 2004 104-108 22.

Yi, R., Y. Qin, I. G. Macara and B. R. Cullen. Exportin-5 mediates the nuclear export of premicroRNAs and short hairpin RNAs Genes Dev Dec. 15, 2003 3011-3016 17.

Cao, X., W. Aufsatz, D. Zilberman, M. F. Mette, M. S. Huang, M. Matzke and S. E. Jacobsen. Role of the DRM and CMT3 methyltransferases in RNA-directed DNA methylation Curr Biol Dec. 16, 2003 2212-2217 13.

Ye, K., L. Malinina and D. J. Patel. Recognition of small interfering RNA by a viral suppressor of RNA silencing Nature Dec. 18, 2003 874-878 426.

Johnston, R. J. and O. Hobert. A microRNA controlling left/right neuronal asymmetry in *Caenorhabditis elegans* Nature Dec. 18, 2003 845-849 426.

Xayaphoummine, A., T. Bucher, F. Thalmann and H. Isambert. Prediction and statistics of pseudoknots in RNA structures using exactly clustered stochastic simulations Proc Natl Acad Sci U S A Dec. 23, 2003 15310-15315 100.

Lewis, B. P., I. H. Shih, M. W. Jones-Rhoades, D. P. Bartel and C. B. Burge. Prediction of mammalian microRNA targets Cell Dec. 26, 2003 787-798 115.

Robinson, W. H., P. J. Utz and L. Steinman. Genomic and proteomic analysis of multiple sclerosis. Opinion Curr Opin Immunol Dec. 2003 660-667 15.

Gibbs, W. W. The unseen genome: beyond DNA Sci Am Dec. 2003 106-113 289.

Stark, A., J. Brennecke, R. B. Russell and S. M. Cohen. Identification of *Drosophila* MicroRNA targets PLoS Biol Dec. 2003 E60 1.

Stein, T. D. and J. A. Johnson. Genetic programming by the proteolytic fragments of the amyloid precursor protein: somewhere between confusion and clarity Rev Neurosci *no date in pubmed* 2003 317-341 14.

Szymanski, M., M. Z. Barciszewska, M. Zywicki and J. Barciszewski. Noncoding RNA transcripts J Appl Genet *No Datein Pubmed* 2003 1-19 44.

Griffiths-Jones, S. The microRNA Registry Nucleic Acids Res Jan. 1, 2004 D109-111 32.

Chen, C. Z., L. Li, H. F. Lodish and D. P. Bartel. MicroRNAs modulate hematopoietic lineage differentiation Science Jan. 2, 2004 83-86 303.

Kim, J., A. Krichevsky, Y. Grad, G. D. Hayes, K. S. Kosik, G. M. Church and G. Ruvkun. Identification of many microRNAs that copurify with polyribosomes in mammalian neurons Proc Natl Acad Sci U S A Jan. 6, 2004 360-365 101.

Ohno, M., E. A. Sametsky, L. H. Younkin, H. Oakley, S. G. Younkin, M. Citron, R. Vassar and J. F. Disterhoft. BACE1 deficiency rescues memory deficits and cholinergic dysfunction in a mouse model of Alzheimer's disease Neuron Jan. 8, 2004 27-33 41.

Vella, M. C., E. Y. Choi, S. Y. Lin, K. Reinert and F. J. Slack. The *C. elegans* microRNA let-7 binds to imperfect let-7 complementary sites from the lin-41 3'UTR Genes Dev Jan. 15, 2004 132-137 18.

Kao, S. C., A. M. Krichevsky, K. S. Kosik and L. H. Tsai. BACE1 suppression by RNA interference in primary cortical neurons J Biol Chem Jan. 16, 2004 1942-1949 279.

Hofacker, I. L., B. Priwitzer and P. F. Stadler. Prediction of locally stable RNA secondary structures for genome-wide surveys Bioinformatics Jan. 22, 2004 186-190 20.

Ruvkun, G., B. Wightman and I. Ha. The 20 years it took to recognize the importance of tiny RNAs Cell Jan. 23, 2004 S93-96, 92 p following S96 116.

Bartel, D. P. MicroRNAs: genomics, biogenesis, mechanism, and function Cell Jan. 23, 2004 281-297 116.

Han, M. H., S. Goud, L. Song and N. Fedoroff. The *Arabidopsis* double-stranded RNA-binding protein HYL1 plays a role in microRNA-mediated gene regulation Proc Natl Acad Sci U S A Jan. 27, 2004 1093-1098 101.

Hartig, J. S., I. Grune, S. H. Najafi-Shoushtari and M. Famulok. Sequence-specific detection of MicroRNAs by signal-amplifying ribozymes J Am Chem Soc Jan. 28, 2004 722-723 126.

Nishitsuji, H., T. Ikeda, H. Miyoshi, T. Ohashi, M. Kannagi and T. Masuda. Expression of small hairpin RNA by lentivirus-based vector confers efficient and stable gene-suppression of HIV-1 on human cells including primary non-dividing cells Microbes Infect Jan. 2004 76-85 6.

Ota, T., Y. Suzuki, T. Nishikawa, T. Otsuki, T. Sugiyama, R. Irie, A., et al. Complete sequencing and characterization of 21,243 full-length human cDNAs Nat Genet Jan. 2004 40-45 36.

Colciaghi, F., E. Marcello, B. Borroni, M. Zimmermann, C. Caltagirone, F. Cattabeni, A. Padovani and M. Di Luca. Platelet APP, ADAM 10 and BACE alterations in the early stages of Alzheimer disease Neurology Feb. 10, 2004 498-501 62.

Boden, D., O. Pusch, R. Silbermann, F. Lee, L. Tucker and B. Ramratnam. Enhanced gene silencing of HIV-1 specific siRNA using microRNA designed hairpins Nucleic Acids Res Feb. 13, 2004 1154-1158 32.

Sempere, L. F., S. Freemantle, I. Pitha-Rowe, E. Moss, E. Dmitrovsky and V. Ambros. Expression profiling of mammalian microRNAs uncovers a subset of brain-expressed microRNAs with possible roles in murine and human neuronal differentiation Genome Biol Epub 2004 Feb. 16, 2004 R13 5.

Scacheri, P. C., O. Rozenblatt-Rosen, N. J. Caplen, T. G. Wolfsberg, L. Umayam, J. C. Lee, C. M. Hughes, K. S. Shanmugam, A. Bhattacharjee, M. Meyerson and F. S. Collins. Short interfering RNAs can induce unexpected and divergent changes in the levels of untargeted proteins in mammalian cells Proc Natl Acad Sci U S A Feb. 17, 2004 1892-1897 101.

Xie, Z., L. K. Johansen, A. M. Gustafson, K. D. Kasschau, A. D. Lellis, D. Zilberman, S. E. Jacobsen and J. C. Carrington. Genetic and functional diversification of small RNA pathways in plants PLoS Biol May (Epub Feb. 18, 2004) 2004 E104 2.

Cawley, S., S. Bekiranov, H. H. Ng, P. Kapranov, E. A. Sekinger, D. Kampa, A. Piccolboni, V. Sementchenko, J. Cheng, A. J. Williams, R. Wheeler, B. Wong, J. Drenkow, M. Yamanaka, S. Patel, S. Brubaker, H. Tammana, G. Helt, K. Struhl and T. R. Gingeras. Unbiased mapping of transcription factor binding sites along human chromosomes 21 and 22 points to widespread regulation of noncoding RNAs Cell Feb. 20, 2004 499-509 116.

Dandekar, D. H., K. N. Ganesh and D. Mitra. HIV-1 Tat directly binds to NFkappaB enhancer sequence: role in viral and cellular gene expression Nucleic Acids Res Feb. 23, 2004 1270-1278 32.

Hutvagner, G., M. J. Simard, C. C. Mello and P. D. Zamore. Sequence-specific inhibition of small RNA function PLoS Biol Apr (Epub Feb. 24, 2004) 2004 E98 2.

Schmittgen, T. D., J. Jiang, Q. Liu and L. Yang. A high-throughput method to monitor the expression of microRNA precursors Nucleic Acids Res Feb. 25, 2004 e43 32.

Stremlau, M., C. M. Owens, M. J. Perron, M. Kiessling, P. Autissier and J. Sodroski. The cytoplasmic body component TRIM5alpha restricts HIV-1 infection in Old World monkeys Nature Feb. 26, 2004 848-853 427.

Bohnsack, M. T., K. Czaplinski and D. Gorlich. Exportin 5 is a RanGTP-dependent dsRNA-binding protein that mediates nuclear export of pre-miRNAs Rna Feb. 2004 185-191 10.

Demidov, V. V. and M. D. Frank-Kamenetskii. Two sides of the coin: affinity and specificity of nucleic acid interactions Trends Biochem Sci Feb. 2004 62-71 29.

Maquat, L. E. Nonsense-mediated mRNA decay: splicing, translation and mRNP dynamics Nat Rev Mol Cell Biol Feb. 2004 89-99 5.

Nijholt, I., N. Farchi, M. Kye, E. H. Sklan, S. Shoham, B. Verbeure, D. Owen, B. Hochner, J. Spiess, H. Soreq and T. Blank. Stress-induced alternative splicing of acetylcholinesterase results in enhanced fear memory and long-term potentiation Mol Psychiatry Feb. 2004 174-183 9.

Sengupta, P. Taking sides in the nervous system with miRNA Nat Neurosci Feb. 2004 100-102 7.

Zerhouni, B., J. A. Nelson and K. Saha. Isolation of CD4-independent primary human immunodeficiency virus type 1 isolates that are syncytium inducing and acutely cytopathic for CD8+ lymphocytes J Virol Feb. 2004 1243-1255 78.

Jin, P., D. C. Zarnescu, S. Ceman, M. Nakamoto, J. Mowrey, T. A. Jongens, D. L. Nelson, K. Moses and S. T. Warren. Biochemical and genetic interaction between the fragile X mental retardation protein and the microRNA pathway Nat Neurosci Feb. 2004 113-117 7.

Lai, E. C., C. Wiel and G. M. Rubin. Complementary miRNA pairs suggest a regulatory role for miRNA:miRNA duplexes Rna Feb. 2004 171-175 10.

Metzler, M., M. Wilda, K. Busch, S. Viehmann and A. Borkhardt. High expression of precursor microRNA-155/BIC RNA in children with Burkitt lymphoma Genes Chromosomes Cancer Feb. 2004 167-169 39.

Doench, J. G. and P. A. Sharp. Specificity of microRNA target selection in translational repression Genes Dev Mar. 1, 2004 504-511 18.

Liang, X. S., J. Q. Lian, Y. X. Zhou and M. B. Wan. Inhibitor RNA blocks the protein translation mediated by hepatitis C virus internal ribosome entry site in vivo World J Gastroenterol Mar. 1, 2004 664-667 10.

Calin, G. A., C. Sevignani, C. D. Dumitru, T. Hyslop, E. Noch, S. Yendamuri, M. Shimizu, S. Rattan, F. Bullrich, M. Negrini and C. M. Croce. Human microRNA genes are frequently located at fragile sites and genomic regions involved in cancers Proc Natl Acad Sci U S A Mar. 2, 2004 2999-3004 101.

Juarez, M. T., J. S. Kui, J. Thomas, B. A. Heller and M. C. Timmermans. microRNA-mediated repression of rolled leaf1 specifies maize leaf polarity Nature Mar. 4, 2004 84-88 428.

Kidner, C. A. and R. A. Martienssen. Spatially restricted microRNA directs leaf polarity through ARGONAUTE1 Nature Mar. 4, 2004 81-84 428.

Zamore, P. D. Plant RNAi: How a viral silencing suppressor inactivates siRNA Curr Biol Mar. 9, 2004 R198-200 14.

Wang, J. F., H. Zhou, Y. Q. Chen, Q. J. Luo and L. H. Qu. Identification of 20 microRNAs from Oryza sativa Nucleic Acids Res Mar. 12, 2004 1688-1695 32.

Jack, T. Molecular and genetic mechanisms of floral control Plant Cell Epub 2004 Mar. 12, 2004 S1-17 16 Suppl.

Roth, M. E., L. Feng, K. J. McConnell, P. J. Schaffer, C. E. Guerra, J. P. Affourtit, K. R. Piper, L. Guccione, J. Hariharan, M. J. Ford, S. W. Powell, H. Krishnaswamy, J. Lane, L. Guccione, G. Intrieri, J. S.

Merkel, C. Perbost, A. Valerio, B. Zolla, C. D. Graham, J. Hnath, C. Michaelson, R. Wang, B. Ying, C. Halling, C. E. Parman, D. Raha, B. Orr, B. Jedrzkiewicz, J. Liao, A. Tevelev, M. J. Mattessich, D. M. Kranz, M. Lacey, J. C. Kaufman, J. Kim, D. R. Latimer and P. M. Lizardi. Expression profiling using a hexamer-based universal microarray Nat Biotechnol Apr (Epub Mar. 14, 2004) 2004 418-426 22.

Rajewsky, N. and N. D. Socci. Computational identification of microRNA targets Dev Biol Mar. 15, 2004 529-535 267.

Winkler, W. C., A. Nahvi, A. Roth, J. A. Collins and R. R. Breaker. Control of gene expression by a natural metabolite-responsive ribozyme Nature Mar. 18, 2004 281-286 428.

Kuwabara, T., J. Hsieh, K. Nakashima, K. Taira and F. H. Gage. A small modulatory dsRNA specifies the fate of adult neural stem cells Cell Mar. 19, 2004 779-793 116.

Chen, X. A microRNA as a translational repressor of APETALA2 in *Arabidopsis* flower development Science Mar. 26, 2004 2022-2025 303.

Carmell, M. A. and G. J. Hannon. RNase III enzymes and the initiation of gene silencing Nat Struct Mol Biol Mar. 2004 214-218 11.

Davidson, B. L. and H. L. Paulson. Molecular medicine for the brain: silencing of disease genes with RNA interference Lancet Neurol Mar. 2004 145-149 3.

Kawasaki, H., R. Wadhwa and K. Taira. World of small RNAs: from ribozymes to siRNA and miRNA Differentiation Mar. 2004 58-64 72.

Meister, G., M. Landthaler, Y. Dorsett and T. Tuschl. Sequence-specific inhibition of microRNA- and siRNA-induced RNA silencing Rna Mar. 2004 544-550 10.

Nelson, P. T., A. G. Hatzigeorgiou and Z. Mourelatos. miRNP:mRNA association in polyribosomes in a human neuronal cell line Rna Mar. 2004 387-394 10.

Floyd, S. K. and J. L. Bowman. Gene regulation: ancient microRNA target sequences in plants Nature Apr. 1, 2004 485-486 428.

Lee, Y. S., K. Nakahara, J. W. Pham, K. Kim, Z. He, E. J. Sontheimer and R. W. Carthew. Distinct roles for *Drosophila* Dicer-1 and Dicer-2 in the siRNA/miRNA silencing pathways Cell Apr. 2, 2004 69-81 117.

Tijsterman, M. and R. H. Plasterk. Dicers at RISC; the mechanism of RNAi Cell Apr. 2, 2004 1 3 117.

Macdiarmid, R. RNA Silencing in Productive Virus Infections Annu Rev Phytopathol Apr. 12, 2004.

Chen, J., W. X. Li, D. Xie, J. R. Peng and S. W. Ding. Viral virulence protein suppresses RNA silencing-mediated defense but upregulates the role of microrna in host gene expression Plant Cell May (Epub Apr. 20, 2004) 2004 1302-1313 16.

Yekta, S., I. H. Shin and D. P. Bartel. MicroRNA-directed cleavage of HOXB8 mRNA Science Apr. 23, 2004 594-596 304.

Lamontagne, B., R. N. Hannoush, M. J. Damha and S. Abou Elela. Molecular requirements for duplex recognition and cleavage by eukaryotic RNase III: discovery of an RNA-dependent DNA cleavage activity of yeast Rnt1p J Mol Biol Apr. 23, 2004 401-418 338.

Barrick, J. E., K. A. Corbino, W. C. Winkler, A. Nahvi, M. Mandal, J. Collins, M. Lee, A. Roth, N. Sudarsan, I. Jona, J. K. Wickiser and R. R. Breaker. New RNA motifs suggest an expanded scope for riboswitches in bacterial genetic control Proc Natl Acad Sci U S A Apr. 27, 2004 6421-6426 101.

Pfeffer, S., M. Zavolan, F. A. Grasser, M. Chien, J. J. Russo, J. Ju, B. John, A. J. Enright, D. Marks, C. Sander and T. Tuschl. Identification of virus-encoded microRNAs Science Apr. 30, 2004 734-736 304.

Dorsett, Y. and T. Tuschl. siRNAs: applications in functional genomics and potential as therapeutics Nat Rev Drug Discov Apr. 2004 318-329 3.

Mallory, A. C. and H. Vaucheret. MicroRNAs: something important between the genes Curr Opin Plant Biol Apr. 2004 120-125 7.

Ogita, S., H. Uefuji, M. Morimoto and H. Sano. Application of RNAi to confirm theobromine as the major intermediate for caffeine biosynthesis in coffee plants with potential for construction of decaffeinated varieties Plant Mol Biol Apr. 2004 931-941 54.

Storz, G., J. A. Opdyke and A. Zhang. Controlling mRNA stability and translation with small, noncoding RNAs Curr Opin Microbiol Apr. 2004 140-144 7.

Kim, V. N. MicroRNA precursors in motion: exportin-5 mediates their nuclear export Trends Cell Biol Apr. 2004 156-159 14.

Jabri, E. RISCy business Nat Struct Mol Biol Apr. 2004 300 11.

Nakahara, K. and R. W. Carthew. Expanding roles for miRNAs and siRNAs in cell regulation Curr Opin Cell Biol Apr. 2004 127-133 16.

Ota, A., H. Tagawa, S. Karnan, S. Tsuzuki, A. Karpas, S. Kira, Y. Yoshida and M. Seto. Identification and characterization of a novel gene, C13orf25, as a target for 13q31-q32 amplification in malignant lymphoma Cancer Res May 1, 2004 3087-3095 64.

Marillonnet, S., A. Giritch, M. Gils, R. Kandzia, V. Klimyuk and Y. Gleba. In planta engineering of viral RNA replicons: efficient assembly by recombination of DNA modules delivered by *Agrobacterium* Proc Natl Acad Sci U S A May 4, 2004 6852-6857 101.

Pooggin, M. and T. Hohn. Fighting geminiviruses by RNAi and vice versa Plant Mol Biol May 2004 149-152 55.

Bartel, D. P. and C. Z. Chen. Micromanagers of gene expression: the potentially widespread influence of metazoan microRNAs Nat Rev Genet May 2004 396-400 5.

Dunoyer, P., C. H. Lecellier, E. A. Parizotto, C. Himber and O. Voinnet. Probing the microRNA and small interfering RNA pathways with virus-encoded suppressors of RNA silencing Plant Cell May (Epub Apr. 14, 2004(2004 1235-1250 16.

Doench JG and Sharp PA. Specificity of microRNA target selection in translational repression. Genes Dev, 2004;18(5):504-11.

Lai EC. Micro RNAs are complementary to 3' UTR sequence motifs that mediate negative post-transcriptional regulation. Nature Genetics 2002;30:363-4.

Stark A. Identification of *Drosophila* MicroRNA Targets. PLoS Biology 2003;1(3):397-409.

Lai EC. Predicting and validating microRNA targets. Genome Biology 2004;5:115.

Vella MC. Architecture of a Validated MicroRNA::Target Interaction. Chemistry & Biology 2004;11:1619-23.

Brennecke J. Principles of MicroRNA—Target Recognition. PLoS Biology 2005;3(3):e85.

Lewis BP. Prediction of Mammalian MicroRNA Targets. Cell 2003;115:787-98.

Enright AJ. MicroRNA targets in *Drosophila*. Genome Biology 2003;5: R1.

Taniyama Y et al. Role of p38 MAPK and MAPKAPK-2 in angiotensin II-induced Akt activation in vascular smooth muscle cells. Am J Physiol Cell Physiol 2004;287:C494-9.

Li M et al. The Myeloid Leukemia-associated Protein SET Is a Potent Inhibitor of Protein Phosphatase 2A. Jo Biol Chem 1996;271(19):11059-62.

Al-Murrani SWK et al. Expression of I2PP2A, an inhibitor of protein phosphatase 2A, induces c-Jun and AP-1 activity. Biochem J 1999;341:293-8.

* cited by examiner

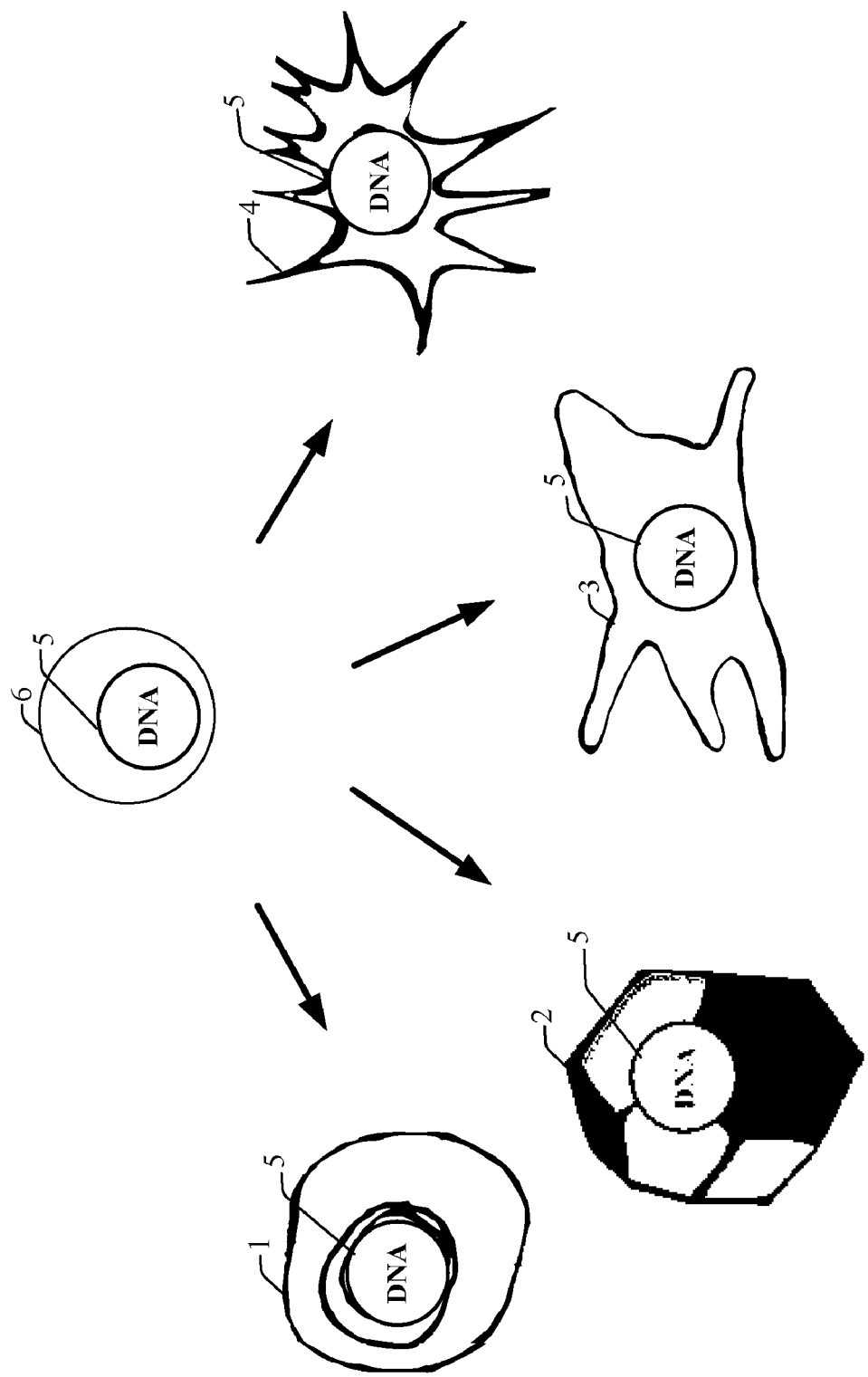

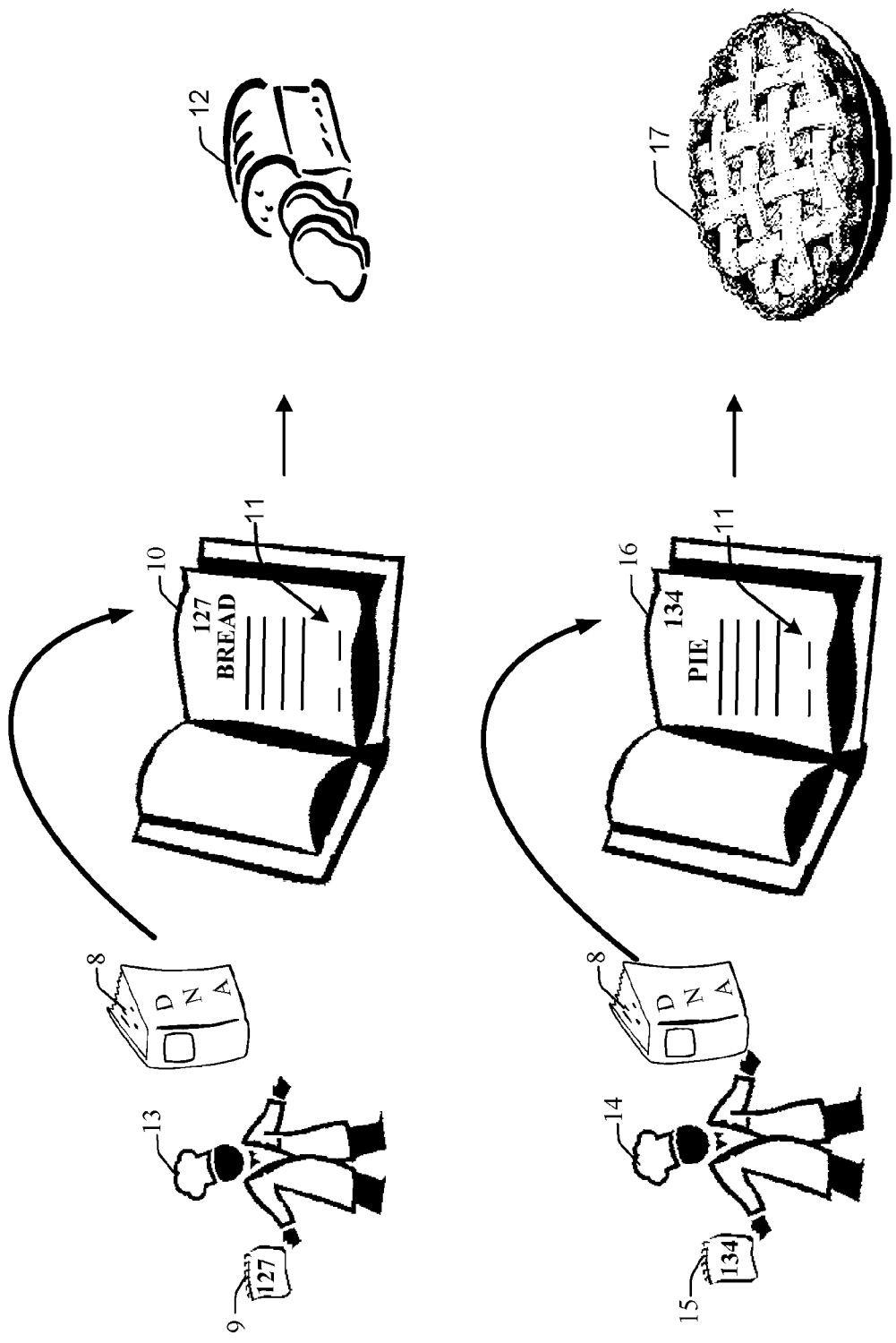

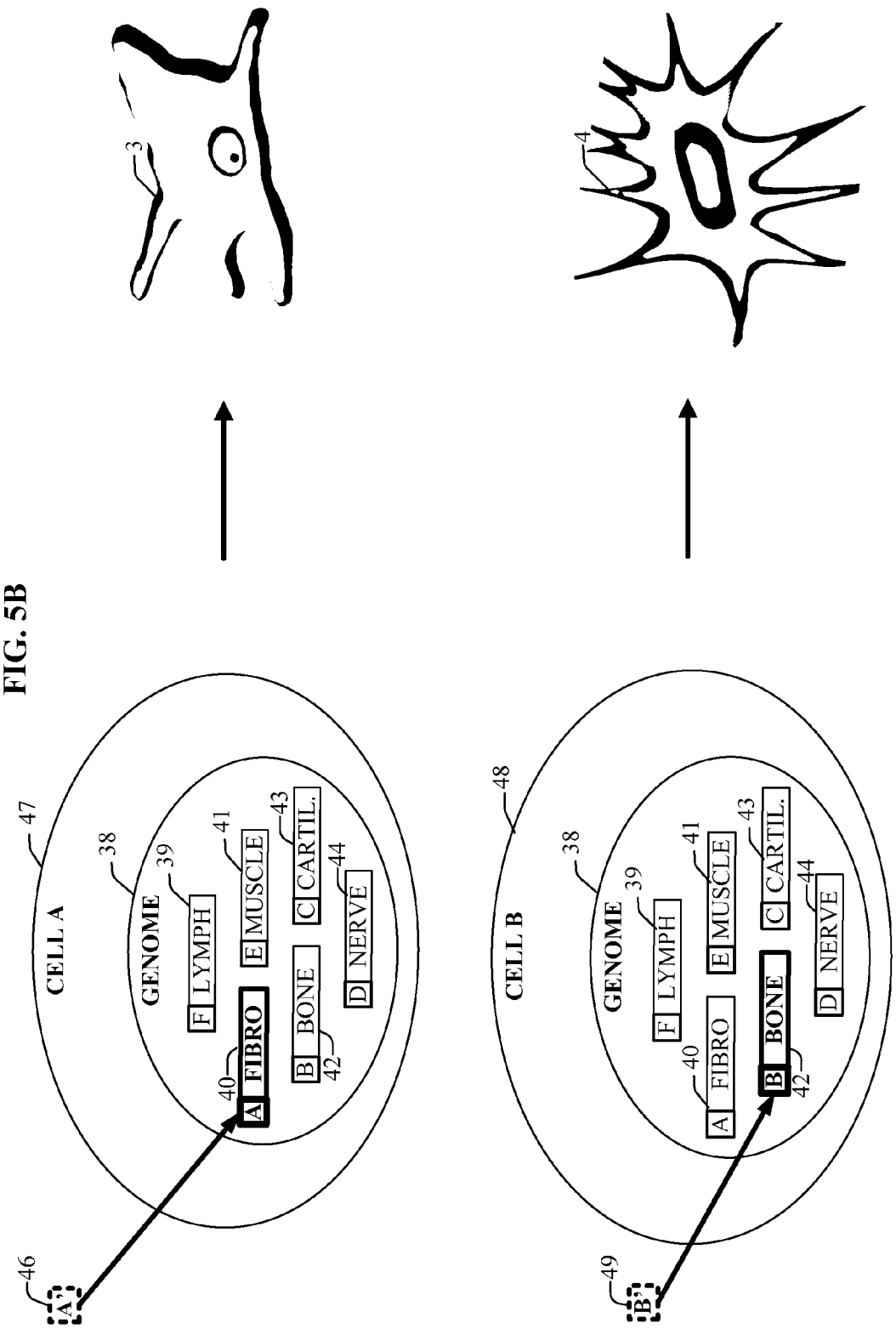

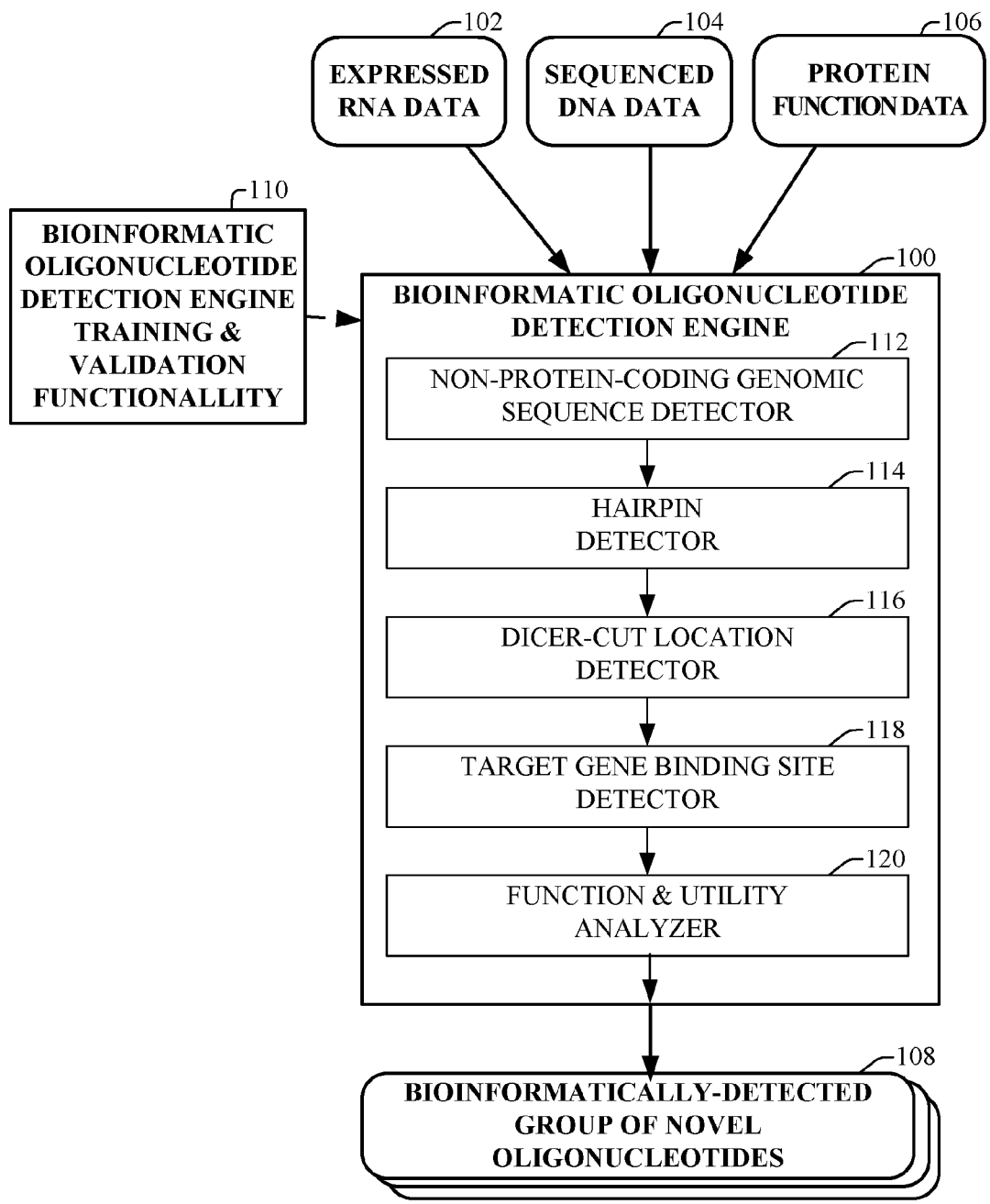

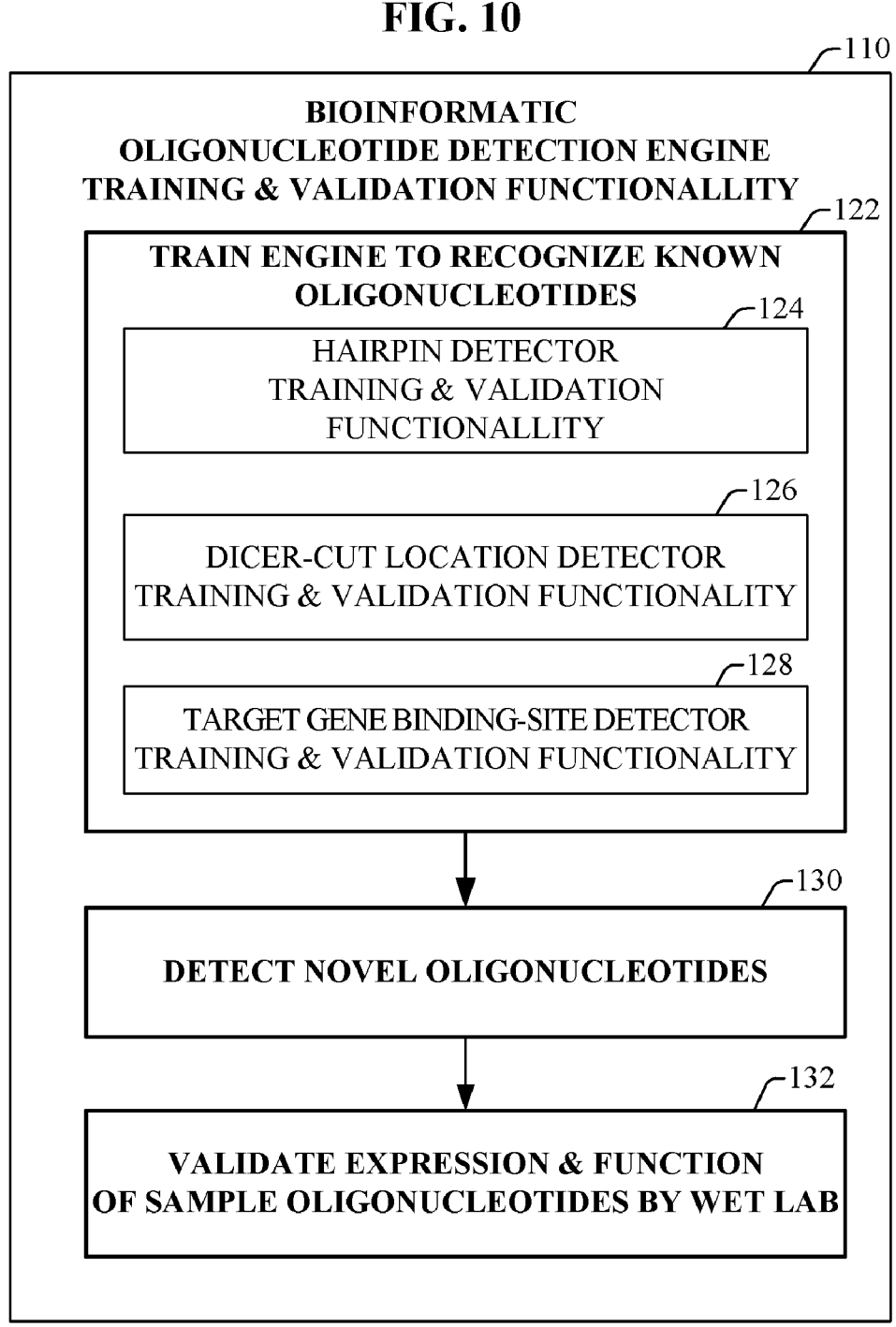

FIG. 22

| ROW | PRIMER SEQUENCE | SEQ ID NO | SEQUENCED SEQENCE | SEQ ID NO | PREDICTED GAM RNA | SEQ ID NO | DIST-ANCE | GAM NAME |
|---|---|---|---|---|---|---|---|---|
| 1* | AATTGCTTGAAC | 10,068,194 | CCAGGAAGTGGA | 10,068,223 | AATTGCTTGAACCCAGGAAGTGGA | 10,068,252 | 0 | 25-A |
| 2* | ACTGCACTCC | 10,068,195 | AGCCTGGGC | 10,068,224 | ACTGCACTCCAGCCTGGGCTAC | 10,068,253 | 0 | 351661-A |
| 3 | CACTGCACTC | 10,068,196 | CAGCCCGAGCAACA | 10,068,225 | CACTGCACTCCAGCCCGAGCAA | 10,068,254 | 0 | 351946-A |
| 4 | CTAGACTGAAG | 10,068,197 | CTCCTTGAGGAC | 10,068,226 | CTAGACTGAAGCTCCTTGAGGA | 10,068,255 | 0 | 352759-A |
| 5 | GAAGTTTGAAG | 10,068,198 | CCTGTTGTTCA | 10,068,227 | GAAGTTTGAAGCCTGTTGTTCA | 10,068,256 | 0 | 4426-A |
| 6 | TCACTGCAAC | 10,068,199 | CTCCACCA | 10,068,228 | (TCACTGCAACCTCCACCACGTG), (TCACTGCAACCTCCACCAGCCT) | 10,068,257 | 0 | (357950-A),(352721-A) |
| 7* | TCTAAGAGAAAG | 10,068,200 | GAAGTTCAGA | 10,068,229 | TCTAAGAGAAAGGAAGTTCAGA | 10,068,258 | 0 | 337950-A |
| 8 | GGGCAGTGGA | 10,068,201 | GCTGGAA | 10,068,230 | GGGCGTGGAGCTGGAATGATGT | 10,068,259 | 1 | 351996-A |
| 9 | AATTGCTTGAAC | 10,068,202 | CCAAGAAGTGGA | 10,068,231 | AATCACTTGAACCCAAGAAGTG | 10,068,260 | 2 | 351874-A |
| 10 | AGCAGCCCA | 10,068,203 | GGGTTTTGT | 10,068,232 | AGCAAGACCAGGGTTTTGTGTT | 10,068,261 | 2 | 352083-A |
| 11 | AGGCAAGACG | 10,068,204 | GACCAGA | 10,068,233 | AGGCAGAGGAGGACCAGAGACT | 10,068,262 | 2 | 351944-A |
| 12 | AGGGAAAGAAT | 10,068,205 | TAATGTGAA | 10,068,234 | GGGAAATAATTAATGTGAAGTC | 10,068,263 | 2 | 353325-A |
| 13 | AGGGAAAGAAT | 10,068,206 | TAATGTGAG | 10,068,235 | AGGAAAAAAATTAATGTGAGTC | 10,068,264 | 2 | 352649-A |
| 14 | ATTCAGTTG | 10,068,207 | CCCATGTTT | 10,068,236 | (ATTCATTGCCCATGTTTG), (TATTCATGCCCATGGTGA) | 10,068,265 | 2 | A),(352957-A,352960-A) |
| 15 | CTAGACTGAAG | 10,068,208 | CTCCTTGAGG | 10,068,237 | CTGGACTGAGCTCCTTGAGGCC | 10,068,266 | 2 | 352288-A |
| 16 | TTCAGAGTGGT | 10,068,209 | TAAGTTCTG | 10,068,238 | TTCTGATGGTTAAGTTCTGTCA | 10,068,267 | 2 | 353875-A |
| 17 | TTCAGAGTGGT | 10,068,210 | TAAGTTCTGC | 10,068,239 | TTCAAGTGTTTAAGTTCTGCTT | 10,068,268 | 2 | 351940-A |
| 18 | AGCAGCCCA | 10,068,211 | GAAGGAAGC | 10,068,240 | AGGCCAAGAAGGAAGCAGAGG | 10,068,269 | 3 | 352496-A |
| 19 | AGTTTGCCTTG | 10,068,212 | TAAGAAAAG | 10,068,241 | AGTTTGTGTAAGAAAAGC | 10,068,270 | 3 | 352518-A |
| 20 | ATCAGAGGGTG | 10,068,213 | GGTGCTAA | 10,068,242 | ATTAGGAGAGTGGGTGCTAAGT | 10,068,271 | 3 | 352511-A |
| 21 | ATGGTGGGAG | 10,068,214 | AGTTTGTCAGT | 10,068,243 | TGGAGGAGAGTTTGTCAGTATAG | 10,068,272 | 3 | 353484-A |
| 22 | CCCAGGAAG | 10,068,215 | TGGAGCCTGGGC | 10,068,244 | CCCGGGTGGAGCCTGGGCTGTG | 10,068,273 | 3 | 351990-A |
| 23 | GGGCAGTGGA | 10,068,216 | GGTCCGT | 10,068,245 | AGGGACAGGAGGTCCGTCCCTTC | 10,068,274 | 3 | 353880-A |
| 24 | GGGCAGTGGA | 10,068,217 | TCTAGAC | 10,068,246 | GTGACAGTGAATCTAGACAGAC | 10,068,275 | 3 | 352810-A |
| 25 | TCAAGCTCATTC | 10,068,218 | CACTAAA | 10,068,247 | CTCAGCTCATCCACTAAATACCC | 10,068,276 | 3 | 353184-A |
| 26 | TGGAAAGTT | 10,068,219 | GGTTGTATGGTT | 10,068,248 | GGAATGGTGGTTGTATGGTTG | 10,068,277 | 3 | 353855-A |
| 27 | TGGAGAGTT | 10,068,220 | CCATATTTTG | 10,068,249 | TGATAGATCCATATTTTGGTAA | 10,068,278 | 3 | 352004-A |
| 28 | TGGAGAGTT | 10,068,221 | GTTTGTACAGT | 10,068,250 | TGGGTTTTGTTTGTACAGTGTA | 10,068,279 | 3 | 353160-A |
| 29 | TCACTGCAAC | 10,068,222 | CTCCACC | 10,068,251 | TCACTGCAACCTCCACCTTCCG | 10,068,280 | 0 | 353856-A |

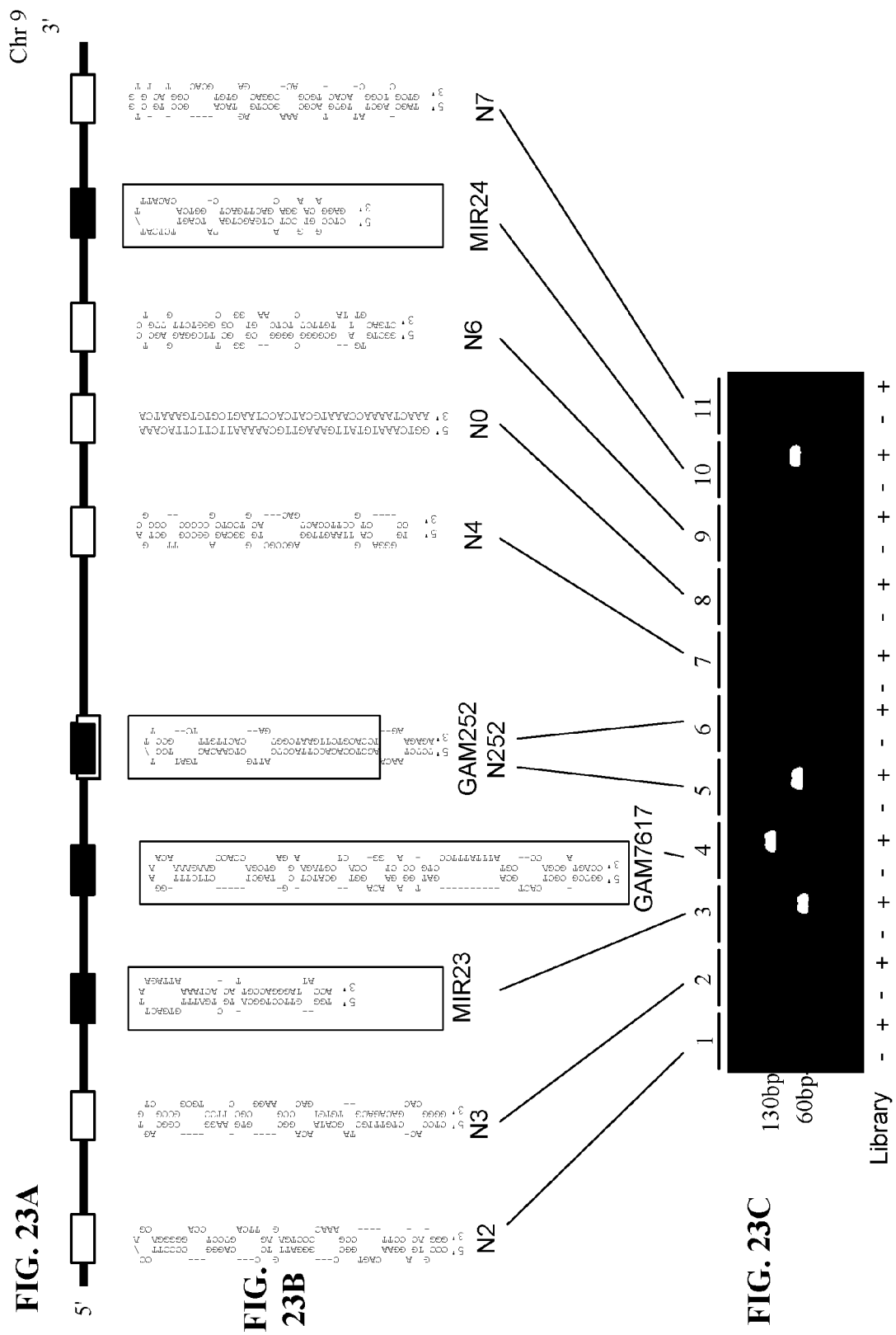

FIG. 24A

EST72223 (705 nt.)

Chr.X

5'─────▭──────────────────────────▭─────3'
     MIR98                                              GAM25

EST72223 sequence:

CCCTTATTAGAGGATTCTGCTCATGCCAGG**GTGAGGTAGTAAGTTGTATTG
TTGTGGGGTAGGGATATTAGGCCCCAATTAGAAGATAACTATACAACT** MIR98
TACTACTTTCCCTGGTGTGTGGCATATTCACACTTAGTCTTAGCAGTGTTGCC
TCCATCAGACAAAGTTGTAGATGTTCCTTGGATAATTTGGACTGGAAGAAAAGA
GACATGGAAGGGGACAGATGGTGTTTAGGGTGAGGCAGATGTCATTATAAAGT
GACTTGTCTTTCATTAATTGGAGCATATAATTATTTTACCTTTGGGCATGAACTC
ATTTTGCTATTCTTCAACTGTGTAATGATTGCATTTTATTAGTAATAGAACAGGA
ATGTGTGCAAGGGAATGGAAAGCATACTTTAAGAATTTTGGGCCAGGCGCGGT
GGTTCATGCCTGTAATCCCAGCATTTTTGGGAGGCCGAGGCGGGTGGATCAC
CTGAGGTCAGGAGTTCGAGACCAACCTGGCCAACACGGCGAAACCCCGCCTC
TACTCAAATACAAAAATTAGCCAGGCTTGGTGACACTCGCCTGTGGTCCCAGC
TACTCAGGAGGCTGAGGCAGGAGAATTGCTTGAACCCAGGAAGTGGAG GAM25
**GCTTCAGTGAGCTGAGAACACGCCACTGCACTCCAGTCCTGGGCAAC
AGAGCAAGACTCTGTCTC**AGGAAAAAAAAAG

FIG. 24B

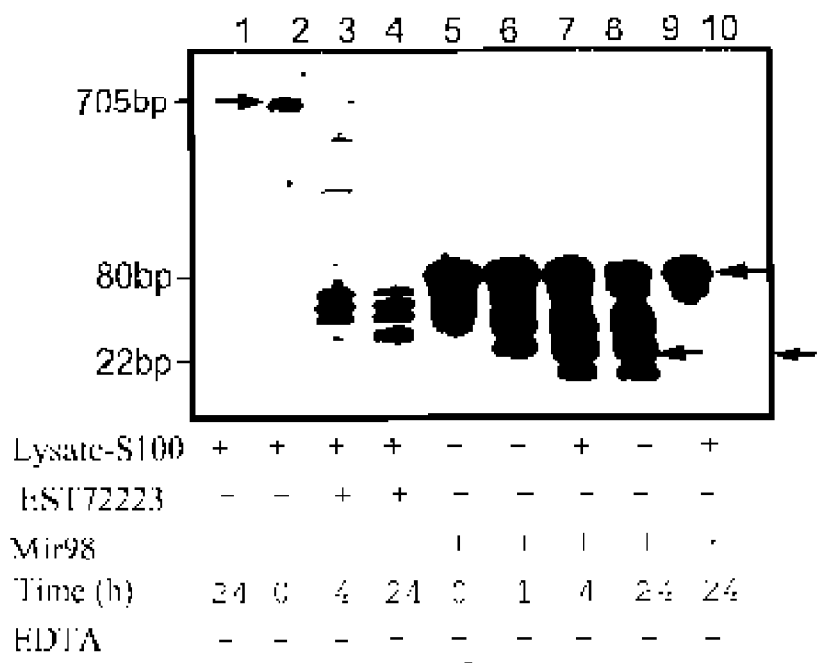

FIG. 25D

| P R E # | PREDICTED PRECURSOR SEQUENCE | SEQ ID | PRIMER 1 TYPE/NAME | PRIMER 1 SEQUENCE | SEQ ID | PRIMER 2 TYPE/NAME | PRIMER 2 SEQUENCE | SEQ ID | METHOD | OBSERVED SEQUENCE | GAM NAME |
|---|---|---|---|---|---|---|---|---|---|---|---|
| 1 | AATGCTGAGTCCT GTGAGTCTTCCTA GCAAATCAAATCT GGAAGGGGTCTTG AGGACTCCAGCATT | 10,068,297 | F STEM 1 3 | GAGTCCTG TGAGTCTT CCTAGC | 10,068,300 | R STEM 1 3 | TGCTGGAGT CCTCAAGA CC | 10,068,303 | A | | |
| 2 | TGAGCCCTCAGCC CTCATGGCTTTCC CGATGCTCACCGG TGCAGAGGAGCC AGCTGGGGAGCCT CTGT | 10,068,298 | R LOOP 2 1 | AAAGCCAT GAGGGCTG AGG | 10,068,301 | R STEM 2 1 | GTGAGCAT CGGGAAAG CCA | 10,068,304 | B | | |
| 3 | ACTGTTGGTCTTC TGTTTAGCCATTA TTCTCAGTTCTGT GCAGGAGTGAGCT GAAACAAAGTTGT ATAGCCCAGAGA GTGAGAAGCTGCA TTTCATGTCTCCC AACAGT | 10,068,299 | F STEM 3 3 | TTCTCAGT TCTGTGTCA GGAGTG | 10,068,302 | R STEM 3 3 | CTTCTCACT CTCTGGGC TATAC | 10,068,305 | A | | |

FIG. 27C

| MIRNA NAME | HELA | BRAIN | LIVER | THYMUS | TESTES | PLACENTA | REFERENCE |
|---|---|---|---|---|---|---|---|
| HSA-MIR-124A | 1879 | 65517 | 7025 | 3099 | 2672 | 2498 | 1,3 |
| HSA-MIR-9 | 642 | 42659 | 3504 | 4455 | 4485 | 2313 | 2,3 |
| HSA-MIR-128A | 2015 | 27701 | 4940 | 4876 | 5166 | 2495 | 3 |
| HSA-MIR-129 | 503 | 22573 | 1175 | 2213 | 5364 | 2017 | 3 |
| HSA-MIR-128B | 1168 | 21969 | 3954 | 4819 | 5383 | 2027 | |
| HSA-MIR-122A | 1051 | 447 | 65518 | 2644 | 617 | 570 | 1,3 |
| HSA-MIR-194 | 501 | 910 | 65518 | 4737 | 2342 | 7952 | 3 |
| HSA-MIR-148 | 413 | 620 | 38436 | 5250 | 6204 | 2711 | |
| HSA-MIR-192 | 452 | 606 | 20650 | 1628 | 1263 | 2607 | |
| HSA-MIR-96 | 887 | 3100 | 1477 | 44800 | 2266 | 5466 | |
| HSA-MIR-150 | 648 | 1463 | 5295 | 65518 | 29728 | 5280 | |
| HSA-MIR-205 | 551 | 615 | 1646 | 65518 | 2645 | 39072 | |
| HSA-MIR-182 | 662 | 1944 | 1091 | 25771 | 2034 | 3683 | |
| HSA-MIR-183 | 1026 | 1123 | 1286 | 8754 | 1681 | 2138 | |
| HSA-MIR-204 | 525 | 3898 | 1757 | 6535 | 64859 | 6233 | |
| HSA-MIR-10B | 410 | 433 | 477 | 3871 | 23083 | 738 | |
| HSA-MIR-154 | 438 | 733 | 1914 | 3309 | 14750 | 9637 | |
| HSA-MIR-134 | 448 | 617 | 698 | 763 | 2250 | 997 | |
| HSA-MIR-224 | 3233 | 11061 | 7684 | 32305 | 5377 | 65518 | |
| HSA-MIR-210 | 844 | 2280 | 10703 | 6864 | 15288 | 62452 | |
| HSA-MIR-221 | 625 | 9325 | 3520 | 20212 | 10608 | 54287 | |
| HSA-MIR-141 | 696 | 805 | 1220 | 4063 | 2000 | 46845 | |
| HSA-MIR-23A | 1312 | 3492 | 2990 | 6021 | 11173 | 40076 | |
| HSA-MIR-200C | 556 | 595 | 1027 | 10636 | 1478 | 33532 | |
| HSA-MIR-136 | 465 | 725 | 709 | 776 | 3100 | 8840 | |

1 LAGOS-QUINTANA ET AL., CURRENT BIOLOGY 12:735 (2002)
2 KRICHEVSKY ET AL., RNA 9:1274 (2003)
3 SEMPERE ET AL., GENOME BIOLOGY 5:R13 (2004)

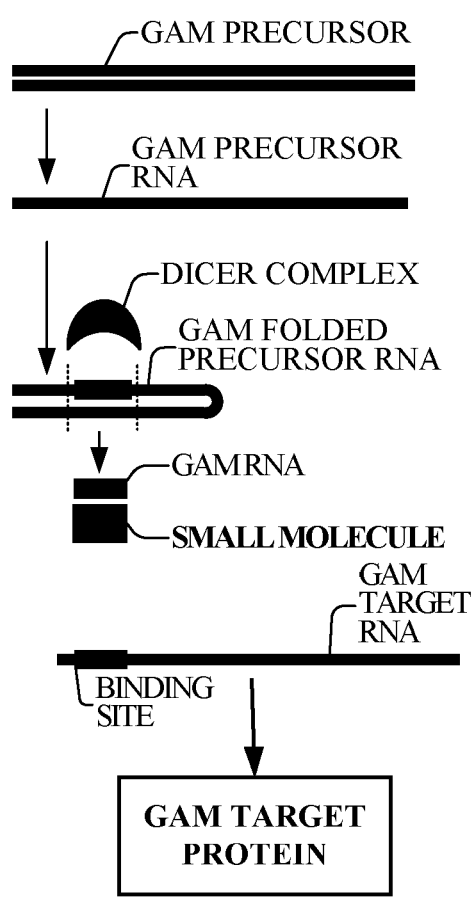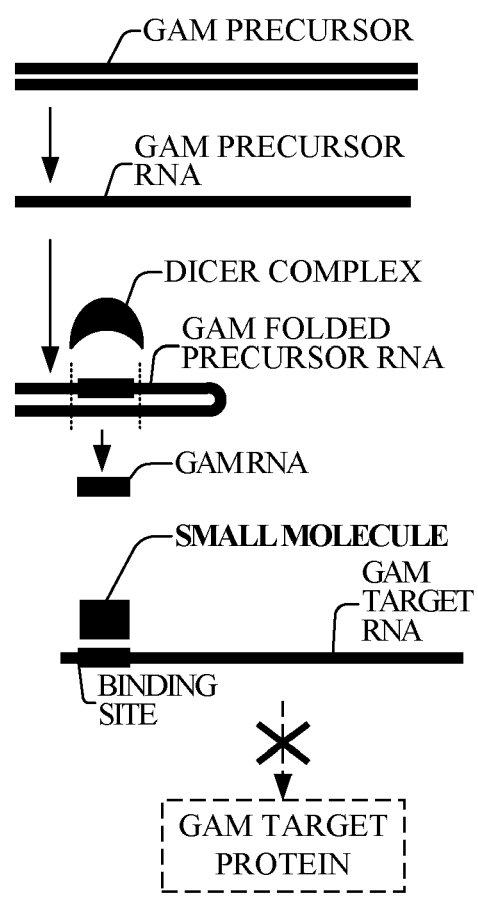

SMALL MOLECULES MODULATING ACTIVITY OF MICRO RNA OLIGONUCLEOTIDES AND MICRO RNA TARGETS AND USES THEREOF

REFERENCES CITED

Altschul, S. F., Gish, W., Miller, W., Myers, E. W., and Lipman, D. J. (1990). Basic local alignment search tool. J. Mol. Biol. 215, 403-410.

Dan Gusfield, Algorithms on strings, trees, and sequences: computer science and computational biology, Cambridge University Press, 1997.

Elbashir, S. M., Lendeckel, W., and Tuschl, T. (2001). RNA interference is mediated by 21- and 22-nucleotide RNAs. Genes Dev. 15, 188-200.

Gussow, D. and Clackson, T. (1989). Direct clone characterization from plaques and colonies by the polymerase chain reaction. Nucleic Acids Res. 17, 4000.

Hamosh A, Scott A F, Amberger J, Bocchini C, Valle D and McKusick V A. (2002). Online Mendelian Inheritance in Man (OMIM), a knowledgebase of human genes and genetic disorders. Nucleic Acids Res. 30: 52-55.

Jenuth J. P. (2000). The NCBI. Publicly available tools and resources on the Web. Methods Mol. Biol. 132, 301-312.

Kirkness, E. F. and Kerlavage, A. R. (1997). The TIGR human cDNA database. Methods Mol. Biol. 69, 261-268.

Lagos-Quintana, M., Rauhut, R., Lendeckel, W., and Tuschl, T. (2001). Identification of novel genes coding for small expressed RNAs. Science 294, 853-858.

Lau, N. C., Lim, L. P., Weinstein, E. G., and Bartel, D. P. (2001). An abundant class of tiny RNAs with probable regulatory roles in Caenorhabditis elegans. Science 294, 858-862.

Mathews, D. H., Sabina, J., Zuker, M., and Turner, D. H. (1999). Expanded sequence dependence of thermodynamic parameters improves prediction of RNA secondary structure. J. Mol. Biol. 288, 911-940.

Reinhart, B. J., Slack, F. J., Basson, M., Pasquinelli, A. E., Bettinger J. C., Rougvie, A. E., Horvitz, H. R., and Ruvkun, G. (2000). The 21-nucleotide let-7 RNA regulates developmental timing in Caenorhabditis elegans. Nature 403, 901-906.

Southern, E. M. (1992). Detection of specific sequences among DNA fragments separated by gel electrophoresis. 1975. Biotechnology 24, 122-139.

Tom M. Mitchell, Machine Learning, McGraw Hill, 1997.

Wightman, B., Ha, I., and Ruvkun, G. (1993). Posttranscriptional regulation of the heterochronic gene lin-14 by lin-4 mediates temporal pattern formation in C. elegans. Cell 75, 855-862.

BACKGROUND OF THE INVENTION

1. Field of the Invention

The present invention relates to a group of bioinformatically detectable novel human oligonucleotides, here identified as "Genomic Address Messenger" (GAM) oligonucleotides.

All of abovementioned oligonucleotides are believed to be related to the microRNA (miRNA) group of oligonucleotides.

2. Description of Prior Art miRNA oligonucleotides are short ~22 nucleotide (nt) long, non-coding, regulatory RNA oligonucleotides that are found in a wide range of species. miRNA oligonucleotides are believed to function as specific gene translation repressors and are sometimes involved in cell differentiation.

The ability to detect novel miRNA oligonucleotides is limited by the methodologies used to detect such oligonucleotides. All miRNA oligonucleotides identified so far either present a visibly discernable whole body phenotype, as do Lin-4 and Let-7 (Wightman, B., Ha, I., and Ruvkun, G., Cell 75: 855-862 (1993); Reinhart et al. Nature 403: 901-906 (2000)), or produce sufficient quantities of RNA so as to be detected by standard molecular biological techniques.

Ninety-three miRNA oligonucleotides have been discovered in several species (Lau et al., Science 294: 858-862 (2001), Lagos-Quintana et al., Science 294: 853-858 (2001)) by sequencing a limited number of clones (300 by Lau and 100 by Lagos-Quintana) of size-fractionated small segments of RNA. miRNAs that were detected in these studies therefore represent the more prevalent among the miRNA oligonucleotide family and cannot be much rarer than 1% of all small ~20 nt-long RNA oligonucleotides.

The aforementioned studies provide no basis for the detection of miRNA oligonucleotides which either do not present a visually discernable whole body phenotype, or are rare (e.g. rarer than 0.1% of all of the size-fractionated, ~20 nt-long RNA segments that were expressed in the tissues examined), and therefore do not produce large enough quantities of RNA to be detected by standard biological techniques.

The following U.S. Patents relate to bioinformatic detection of genes: U.S. patent Ser. No. 10/348,935, entitled "Statistical algorithms for folding and target accessibility prediction and design of nucleic acids", U.S. Pat. No. 6,369,195, entitled "Prostate-specific gene for diagnosis, prognosis and management of prostate cancer", and U.S. Pat. No. 6,291,666 entitled "Spike tissue-specific promoter", each of which is hereby incorporated by reference herein.

BRIEF DESCRIPTION OF SEQUENCE LISTING, TABLES AND COMPUTER PROGRAM LISTING

Reference is made to the appendix submitted herein. The appendix contains the following:

"Patent25_US_10_709577_Sequence_Listing_Jan_2007_Amended_tmp_1001.txt" (550,001 KB), "Patent25_US_10_709577_Sequence_Listing_Jan_2007_Amended_tmp_1002.txt" (550,000 KB), "Patent25_US_10_709577_Sequence_Listing_Jan_2007_Amended_tmp_1003.txt" (439,301 KB), which were created Jul. 27, 2008, which altogether are a sequence listing in accordance with 37 C.F.R. §§ 1.821-1.825, the contents of which are incorporated by reference herein.

Tables relating to genomic sequences are attached to the present application, appear in 21 files (size, creation date), incorporated herein: TABLE_1.txt (572 MB, 13-May-04), TABLE_2_A.txt (619 MB, 13-May-04), TABLE_2_B.txt (619 MB, 13-May-04), TABLE_2_C.txt (111 MB, 13-May-04), TABLE_3.txt (22.1 MB, 13-May-04); TABLE_4.txt (62.3 MB, 13-May-04), TABLE_5.txt (27.4 MB, 13-May-04), TABLE_6_A.txt (619 MB, 13-May-04), TABLE_6_B.txt (50.3 MB, 13-May-04), TABLE_7_A.txt (619 MB, 13-May-04), TABLE_7_B.txt (571 MB, 13-May-04), TABLE_8_A.txt (619 MB, 13-May-04), TABLE_8_B.txt (619 MB, 13-May-04), TABLE_9.txt (10.2 MB, 13-May-04), TABLE_10.txt (123 MB, 13-May-04), TABLE_11.txt (79.8 MB, 13-May-04), TABLE_12.txt (75 KB, 13-May-04), TABLE_13.txt (285 KB, 14-May-04), TABLE_14.txt (68 KB, 13-May-04) and TABLE_15.txt (75 KB, 13-May-04) all of which are incorporated by reference herein.

LENGTHY TABLES

The patent contains a lengthy table section. A copy of the table is available in electronic form from the USPTO web site (http://seqdata.uspto.gov/?pageRequest=docDetail&DocID=US07687616B1). An electronic copy of the table will also be available from the USPTO upon request and payment of the fee set forth in 37 CFR 1.19(b)(3).

A computer program listing constructed and operative in accordance with a preferred embodiment of the present invention is enclosed on an electronic medium in computer readable form, and is hereby incorporated by reference herein. The computer program listing is contained in 6 files, the name, sizes and creation date of which are as follows: AUXILARY_FILES.txt (117K, 14-Nov-03); EDIT_DIS-TANCE.txt (144K, 24-Nov-03); FIRST-K.txt (96K, 24-Nov-03); HAIRPIN_PREDICTION.txt (19K, 25-Mar-04); TWO_PHASED_SIDE_SELECTOR.txt (4K, 14-Nov-03); TWO_PHASED_PREDICTOR.txt (74K, 14-Nov-03), and BS_CODE.txt (118K, 11-May-04).

SUMMARY OF THE INVENTION

The present invention discloses 122,764 novel human regulatory microRNA-like (miRNA) oligonucleotides referred to here as Genomic Address Messenger (GAM) oligonucleotides, which GAM oligonucleotides are detectable using a novel bioinformatic approach, and go undetected by conventional molecular biology methods. Each GAM oligonucleotide specifically inhibits translation of one of more target genes by hybridization of an RNA transcript encoded by the GAM, to a site located in an untranslated region (UTR) of the mRNA of one or more of the target genes. Also disclosed are 18,602 novel microRNA-cluster like polynucleotides, referred to here as Genomic Record (GR) polynucleotides.

Accordingly, the invention provides several substantially pure nucleic acids (e.g., genomic DNA, cDNA or synthetic DNA) each comprising a novel human GAM oligonucleotide, vectors comprising the DNAs, probes comprising the DNAs, a method and system for bioinformatic detection of GAM oligonucleotides and their respective targets, laboratory methods for validating expression of GAM oligonucleotides, and a method and system for selectively modulating translation of known target genes of the GAM oligonucleotides.

The present invention describes a novel approach whereby small molecules may be used to modulate activity of microRNA and GAM oligonucleotides. This mode of therapy allows inter alia up regulation of a disease-related target gene of novel GAM oligonucleotides of the present invention, by countering the activity of a GAM oligonucleotides which naturally inhibits expression of that target gene.

The present invention further represents a scientific breakthrough, disclosing novel miRNA-like oligonucleotides the number of which is dramatically larger than previously believed existed. Prior-art studies reporting miRNA oligonucleotides ((Lau et al., Science 294:858-862 (2001), Lagos-Quintana et al., Science 294: 853-858 (2001)) discovered 93 miRNA oligonucleotides in several species, including 21 in human, using conventional molecular biology methods, such as cloning and sequencing.

Molecular biology methodologies employed by these studies are limited in their ability to detect rare miRNA oligonucleotides, since these studies relied on sequencing of a limited number of clones (300 clones by Lau and 100 clones by Lagos-Quintana) of small segments (i.e. size-fractionated) of RNA. miRNA oligonucleotides detected in these studies therefore, represent the more prevalent among the miRNA oligonucleotide family, and are typically not be much rarer than 1% of all small ~20 nt-long RNA oligonucleotides present in the tissue from the RNA was extracted.

Recent studies state the number of miRNA oligonucleotides to be limited, and describe the limited sensitivity of available methods for detection of miRNA oligonucleotides: "The estimate of 255 human miRNA oligonucleotides is an upper bound implying that no more than 40 miRNA oligonucleotides remain to be identified in mammals" (Lim et al., Science, 299:1540 (2003)); "Estimates place the total number of vertebrate miRNA genes at about 200-250" (Ambros et al. Curr. Biol. 13:807-818 (2003)); and "Confirmation of very low abundance miRNAs awaits the application of detection methods more sensitive than Northern blots" (Ambros et al. Curr. Biol. 13:807-818 (2003)).

The oligonucleotides of the present invention represent a revolutionary new dimension of genomics and of biology: a dimension comprising a huge number of non-protein-coding oligonucleotides which modulate expression of thousands of proteins and are associated with numerous major diseases. This new dimension disclosed by the present invention dismantles a central dogma that has dominated life-sciences during the past 50 years, a dogma which has emphasized the importance of protein-coding regions of the genome, holding non-protein-coding regions to be of little consequence, often dubbing them "junk DNA".

Indeed, only in November, 2003 has this long held belief as to the low importance of non-protein-coding regions been vocally challenged. As an example, an article titled "The Unseen Genome—Gems in the Junk" (Gibbs, W. W. Sci. Am. 289:46-53 (2003)) asserts that the failure to recognize the importance of non-protein-coding regions "may well go down as one of the biggest mistakes in the history of molecular biology". Gibbs further asserts that "what was damned as junk because it was not understood, may in fact turn out to be the very basis of human complexity. The present invention provides a dramatic leap in understanding specific important roles of non-protein-coding regions.

An additional scientific breakthrough of the present invention is a novel conceptual model disclosed by the present invention, which conceptual model is preferably used to encode in a genome the determination of cell-differentiation, utilizing oligonucleotides and polynucleotides of the present invention.

Using the bioinformatic engine of the present invention, 122,764 GAM oligonucleotides and their respective precursors and targets have been detected. These bioinformatic predictions are supported by robust biological studies. Microarray experiments validated expression of 2,534 GAM oligonucleotides out of a sample of 8,244 tested. Of these, 1,114 GAM oligonucleotides scored extremely highly: over six standard deviations higher than the background noise of the microarray, and over two standard deviations above their individual mismatch control probes. Thirty eight GAM oligonucleotides were sequenced.

In various preferred embodiments, the present invention seeks to provide an improved method and system for specific modulation of the expression of specific target genes involved in significant human diseases. It also provides an improved method and system for detection of the expression of novel oligonucleotides of the present invention, which modulate these target genes. In many cases, the target genes may be known and fully characterized, however in alternative embodiments of the present invention, unknown or less well characterized genes may be targeted.

A "Nucleic acid" is defined as a ribonucleic acid (RNA) molecule, or a deoxyribonucleic acid (DNA) molecule, or complementary deoxyribonucleic acid (cDNA), comprising either naturally occurring nucleotides or non-naturally occurring nucleotides.

"Substantially pure nucleic acid", "Isolated Nucleic Acid", "Isolated Oligoucleotide" and "Isolated Polynucleotide" are defined as a nucleic acid that is free of the genome of the organism from which the nucleic acid is derived, and include, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other nucleic acids.

An "Oligonucleotide" is defined as a nucleic acid comprising 2-139 nts, or preferably 16-120 nts. A "Polynucleotide" is defined as a nucleic acid comprising 140-5000 nts, or preferably 140-1000 nts.

A "Complementary" sequence is defined as a first nucleotide sequence which reverses complementary of a second nucleotide sequence: the first nucleotide sequence is reversed relative to a second nucleotide sequence, and wherein each nucleotide in the first nucleotide sequence is complementary to a corresponding nucleotide in the second nucleotide sequence (e.g. ATGGC is the complementary sequence of GCCAT).

"Hybridization", "Binding" and "Annealing" are defined as hybridization, under in-vivo physiological conditions, of a first nucleic acid to a second nucleic acid, which second nucleic acid is at least partially complementary to the first nucleic acid.

A "Hairpin Structure" is defined as an oligonucleotide having a nucleotide sequence that is 50-140 nts in length, the first half of which nucleotide sequence is at least partially complementary to the second part thereof, thereby causing the nucleic acid to fold onto itself, forming a secondary hairpin structure.

A "Hairpin-Shaped Precursor" is defined as a Hairpin Structure which is processed by a Dicer enzyme complex, yielding an oligonucleotide which is about 19 to about 24 nts in length.

"Inhibiting translation" is defined as the ability to prevent synthesis of a specific protein encoded by a respective gene by means of inhibiting the translation of the mRNA of this gene. For example, inhibiting translation may include the following steps: (1) a DNA segment encodes an RNA, the first half of whose sequence is partially complementary to the second half thereof; (2) the precursor folds onto itself forming a hairpin-shaped precursor; (3) a Dicer enzyme complex cuts the hairpin-shaped precursor yielding an oligonucleotide that is approximately 22 nt in length; (4) the oligonucleotide binds complementarily to at least one binding site, having a nucleotide sequence that is at least partially complementary to the oligonucleotide, which binding site is located in the mRNA of a target gene, preferably in the untranslated region (UTR) of a target gene, such that the binding inhibits translation of the target protein.

A "Translation inhibitor site" is defined as the minimal nucleotide sequence sufficient to inhibit translation.

The present invention describes novel miRNA oligonucleotides, detected using a bioinformatic engine described hereinabove. The ability of this detection engine has been demonstrated using stringent algorithmic criteria, showing that the engine has both high sensitivity, indicated by the high detection rate of published miRNAs and their targets, as well as high specificity, indicated by the low amount of "background" hairpin candidates passing its filters. Laboratory tests, based both on sequencing of predicted miRNA oligonucleotides and on microarray experiments, validated 2534 of the miRNA oligonucleotides in the present invention. Further, at least one of these validated miRNA oligonucleotides binds to 1953 of the 2031 target genes described in the present invention.

There is thus provided in accordance with a preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the oligonucleotide has at least 80% sequence identity with a nucleotide sequence selected from the group consisting of SEQ ID NOs: 1-380 and 6894883-7033873.

There is further provided in accordance with another preferred embodiment of the present invention a bioinformatically detectable isolated oligonucleotide which is endogenously processed from a hairpin-shaped precursor, and anneals to a portion of a mRNA transcript of a target gene selected from the group consisting of genes shown in Table 12, Row 1, wherein binding of the oligonucleotide to the mRNA transcript represses expression of the target gene, and wherein the oligonucleotide has at least 80% sequence identity with a nucleotide sequence selected from the group consisting of SEQ ID NOs: 1-380 and 6894883-7033873.

There is still further provided in accordance with another preferred embodiment of the present invention a bioinformatically detectable isolated oligonucleotide having a nucleotide sequence selected from the group consisting of SEQ ID NOs: 1-380 and 6894883-7033873.

There is additionally provided in accordance with another preferred embodiment of the present invention a bioinformatically detectable first oligonucleotide which is a portion of a mRNA transcript of a target gene, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 1-380 and 6894883-7033873.

There is moreover provided in accordance with another preferred embodiment of the present invention a bioinformatically detectable first oligonucleotide which is a portion of a mRNA transcript of a target gene selected from the group consisting of genes shown in Table 12 row 1, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOs: 1-380 and 6894883-7033873.

There is further provided in accordance with another preferred embodiment of the present invention a bioinformatically detectable oligonucleotide having a nucleotide sequence selected from the group consisting of SEQ ID NOs: 5054808-6757247.

There is still further provided in accordance with another preferred embodiment of the present invention a bioinformatically detectable isolated oligonucleotide which anneals to a portion of a mRNA transcript of a target gene associated with Multiple Sclerosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 2.

There is additionally provided in accordance with another preferred embodiment of the present invention a bioinformatically detectable isolated oligonucleotide which anneals to a portion of a mRNA transcript of a target gene associated with Alzheimer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 3.

There is moreover provided in accordance with another preferred embodiment of the present invention a bioinformatically detectable isolated oligonucleotide which anneals to a portion of a mRNA transcript of a target gene associated with Prostate cancer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 4.

There is further provided in accordance with another preferred embodiment of the present invention a bioinformatically detectable isolated oligonucleotide which anneals to a portion of a mRNA transcript of a target gene associated with Respiratory Syncytial Virus, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 5.

There is still further provided in accordance with another preferred embodiment of the present invention a bioinformatically detectable isolated oligonucleotide which anneals to a portion of a mRNA transcript of a target gene associated with Inflammatory Bowel Diseases, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 6.

There is additionally provided in accordance with another preferred embodiment of the present invention a bioinformatically detectable isolated oligonucleotide which anneals to a portion of a mRNA transcript of a target gene associated with Chronic obstructive pulmonary disease, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 7.

There is moreover provided in accordance with another preferred embodiment of the present invention a bioinformatically detectable isolated oligonucleotide which anneals to a portion of a mRNA transcript of a target gene associated with Myasthenia Gravis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 8.

There is further provided in accordance with another preferred embodiment of the present invention a bioinformatically detectable isolated oligonucleotide which anneals to a portion of a mRNA transcript of a target gene associated with Nephrogenic diabetes insipidus, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 9.

There is still further provided in accordance with another preferred embodiment of the present invention a bioinformatically detectable isolated oligonucleotide which anneals to a portion of a mRNA transcript of a target gene associated with Carcinoid, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 10.

There is additionally provided in accordance with another preferred embodiment of the present invention a bioinformatically detectable isolated oligonucleotide which anneals to a portion of a mRNA transcript of a target gene associated with Esophageal cancer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 11.

There is moreover provided in accordance with another preferred embodiment of the present invention a bioinformatically detectable isolated oligonucleotide which anneals to a portion of a mRNA transcript of a target gene associated with Polyposis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 12.

There is further provided in accordance with another preferred embodiment of the present invention a bioinformatically detectable isolated oligonucleotide which anneals to a portion of a mRNA transcript of a target gene associated with Allergic contact dermatitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 13.

There is still further provided in accordance with another preferred embodiment of the present invention a bioinformatically detectable isolated oligonucleotide which anneals to a portion of a mRNA transcript of a target gene associated with Myopathy, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 14.

There is additionally provided in accordance with another preferred embodiment of the present invention a bioinformatically detectable isolated oligonucleotide which anneals to a portion of a mRNA transcript of a target gene associated with Otitis Media, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 15.

There is moreover provided in accordance with another preferred embodiment of the present invention a bioinformatically detectable isolated oligonucleotide which anneals to a portion of a mRNA transcript of a target gene associated with Lung cancer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 16.

There is further provided in accordance with another preferred embodiment of the present invention a bioinformatically detectable isolated oligonucleotide which anneals to a portion of a mRNA transcript of a target gene associated with Enterovirus, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 18.

There is still further provided in accordance with another preferred embodiment of the present invention a bioinformatically detectable isolated oligonucleotide which anneals to a portion of a mRNA transcript of a target gene associated with Stroke, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 19.

There is additionally provided in accordance with another preferred embodiment of the present invention a bioinformatically detectable isolated oligonucleotide which anneals to a portion of a mRNA transcript of a target gene associated with Hodgkin Disease, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 20.

There is moreover provided in accordance with another preferred embodiment of the present invention a bioinformatically detectable isolated oligonucleotide which anneals to a portion of a mRNA transcript of a target gene associated with Amyloidosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 21.

There is further provided in accordance with another preferred embodiment of the present invention a bioinformatically detectable isolated oligonucleotide which anneals to a portion of a mRNA transcript of a target gene associated with Depressive Disorder, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 22.

There is still further provided in accordance with another preferred embodiment of the present invention a bioinformatically detectable isolated oligonucleotide which anneals to a portion of a mRNA transcript of a target gene associated with Clostridium, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 23.

There is additionally provided in accordance with another preferred embodiment of the present invention a bioinformatically detectable isolated oligonucleotide which anneals to a portion of a mRNA transcript of a target gene associated with HIV, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 24.

There is moreover provided in accordance with another preferred embodiment of the present invention a bioinformatically detectable isolated oligonucleotide which anneals to a portion of a mRNA transcript of a target gene associated with Ventricular Fibrillation, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 25.

There is further provided in accordance with another preferred embodiment of the present invention a bioinformatically detectable isolated oligonucleotide which anneals to a portion of a mRNA transcript of a target gene associated with Hyperlipidemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 26.

There is still further provided in accordance with another preferred embodiment of the present invention a bioinformatically detectable isolated oligonucleotide which anneals to a portion of a mRNA transcript of a target gene associated with Lymphoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 27.

There is additionally provided in accordance with another preferred embodiment of the present invention a bioinformatically detectable isolated oligonucleotide which anneals to a portion of a mRNA transcript of a target gene associated with Atopic dermatitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 28.

There is moreover provided in accordance with another preferred embodiment of the present invention a bioinformatically detectable isolated oligonucleotide which anneals to a portion of a mRNA transcript of a target gene associated with Pagets Disease, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 29.

There is further provided in accordance with another preferred embodiment of the present invention a bioinformatically detectable isolated oligonucleotide which anneals to a portion of a mRNA transcript of a target gene associated with Emphysema, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 30.

There is still further provided in accordance with another preferred embodiment of the present invention a bioinformatically detectable isolated oligonucleotide which anneals to a portion of a mRNA transcript of a target gene associated with Ventricular tachycardia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 31.

There is additionally provided in accordance with another preferred embodiment of the present invention a bioinformatically detectable isolated oligonucleotide which anneals to a portion of a mRNA transcript of a target gene associated with Hepatocellular carcinoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 32.

There is moreover provided in accordance with another preferred embodiment of the present invention a bioinformatically detectable isolated oligonucleotide which anneals to a portion of a mRNA transcript of a target gene associated with Kidney Failure, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 33.

There is further provided in accordance with another preferred embodiment of the present invention a bioinformatically detectable isolated oligonucleotide which anneals to a portion of a mRNA transcript of a target gene associated with Addisons disease, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 34.

There is still further provided in accordance with another preferred embodiment of the present invention a bioinformatically detectable isolated oligonucleotide which anneals to a portion of a mRNA transcript of a target gene associated with Herpes, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 35.

There is additionally provided in accordance with another preferred embodiment of the present invention a bioinformatically detectable isolated oligonucleotide which anneals to a portion of a mRNA transcript of a target gene associated with Malaria, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 36.

There is moreover provided in accordance with another preferred embodiment of the present invention a bioinformatically detectable isolated oligonucleotide which anneals to a portion of a mRNA transcript of a target gene associated with Breast cancer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 37.

There is further provided in accordance with another preferred embodiment of the present invention a bioinformatically detectable isolated oligonucleotide which anneals to a portion of a mRNA transcript of a target gene associated with Leukemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 38.

There is still further provided in accordance with another preferred embodiment of the present invention a bioinformatically detectable isolated oligonucleotide which anneals to a portion of a mRNA transcript of a target gene associated with Alopecia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 39.

There is additionally provided in accordance with another preferred embodiment of the present invention a bioinformatically detectable isolated oligonucleotide which anneals to a portion of a mRNA transcript of a target gene associated with Hepatitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 40.

There is moreover provided in accordance with another preferred embodiment of the present invention a bioinformatically detectable isolated oligonucleotide which anneals to a portion of a mRNA transcript of a target gene associated with Cataract, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 41.

There is further provided in accordance with another preferred embodiment of the present invention a bioinformatically detectable isolated oligonucleotide which anneals to a portion of a mRNA transcript of a target gene associated with Encephalitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 42.

There is still further provided in accordance with another preferred embodiment of the present invention a bioinformatically detectable isolated oligonucleotide which anneals to a portion of a mRNA transcript of a target gene associated with Cholestasis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 43.

There is additionally provided in accordance with another preferred embodiment of the present invention a bioinformatically detectable isolated oligonucleotide which anneals to a portion of a mRNA transcript of a target gene associated with Schizophrenia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 44.

There is moreover provided in accordance with another preferred embodiment of the present invention a bioinformatically detectable isolated oligonucleotide which anneals to a portion of a mRNA transcript of a target gene associated with Hyperglycemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 45.

There is further provided in accordance with another preferred embodiment of the present invention a bioinformatically detectable isolated oligonucleotide which anneals to a portion of a mRNA transcript of a target gene associated with Megaloblastic anemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 46.

There is still further provided in accordance with another preferred embodiment of the present invention a bioinformatically detectable isolated oligonucleotide which anneals to a portion of a mRNA transcript of a target gene associated with Endometrial carcinoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 47.

There is additionally provided in accordance with another preferred embodiment of the present invention a bioinformatically detectable isolated oligonucleotide which anneals to a portion of a mRNA transcript of a target gene associated with Burkitt lymphoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 48.

There is moreover provided in accordance with another preferred embodiment of the present invention a bioinformatically detectable isolated oligonucleotide which anneals to a portion of a mRNA transcript of a target gene associated with Crohn disease, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 49.

There is further provided in accordance with another preferred embodiment of the present invention a bioinformatically detectable isolated oligonucleotide which anneals to a portion of a mRNA transcript of a target gene associated with Osteoarthritis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 50.

There is still further provided in accordance with another preferred embodiment of the present invention a bioinformatically detectable isolated oligonucleotide which anneals to a portion of a mRNA transcript of a target gene associated with Pancreatitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 51.

There is additionally provided in accordance with another preferred embodiment of the present invention a bioinformatically detectable isolated oligonucleotide which anneals to a portion of a mRNA transcript of a target gene associated with Fragile X Syndrome, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 52.

There is moreover provided in accordance with another preferred embodiment of the present invention a bioinformatically detectable isolated oligonucleotide which anneals to a portion of a mRNA transcript of a target gene associated with Anorexia Nervosa, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 53.

There is further provided in accordance with another preferred embodiment of the present invention a bioinformatically detectable isolated oligonucleotide which anneals to a portion of a mRNA transcript of a target gene associated with Bladder cancer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 54.

There is still further provided in accordance with another preferred embodiment of the present invention a bioinformatically detectable isolated oligonucleotide which anneals to a portion of a mRNA transcript of a target gene associated with Insulin-Dependent Diabetes Mellitus, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 55.

There is additionally provided in accordance with another preferred embodiment of the present invention a bioinformatically detectable isolated oligonucleotide which anneals to a portion of a mRNA transcript of a target gene associated with Sideroblastic anemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 56.

There is moreover provided in accordance with another preferred embodiment of the present invention a bioinformatically detectable isolated oligonucleotide which anneals to a portion of a mRNA transcript of a target gene associated with Celiac Disease, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 57.

There is further provided in accordance with another preferred embodiment of the present invention a bioinformatically detectable isolated oligonucleotide which anneals to a portion of a mRNA transcript of a target gene associated with Diabetes Mellitus, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 58.

There is still further provided in accordance with another preferred embodiment of the present invention a bioinformatically detectable isolated oligonucleotide which anneals to a portion of a mRNA transcript of a target gene associated with Basal cell carcinoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 59.

There is additionally provided in accordance with another preferred embodiment of the present invention a bioinformatically detectable isolated oligonucleotide which anneals to a portion of a mRNA transcript of a target gene associated with Cytomegalovirus, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 60.

There is moreover provided in accordance with another preferred embodiment of the present invention a bioinformatically detectable isolated oligonucleotide which anneals to a portion of a mRNA transcript of a target gene associated with Aids, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 61.

There is further provided in accordance with another preferred embodiment of the present invention a bioinformatically detectable isolated oligonucleotide which anneals to a portion of a mRNA transcript of a target gene associated with Small cell carcinoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 62.

There is still further provided in accordance with another preferred embodiment of the present invention a bioinformatically detectable isolated oligonucleotide which anneals to a portion of a mRNA transcript of a target gene associated with Diabetic Nephropathy, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 63.

There is additionally provided in accordance with another preferred embodiment of the present invention a bioinformatically detectable isolated oligonucleotide which anneals to a portion of a mRNA transcript of a target gene associated with Adrenal cortical carcinoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 65.

There is moreover provided in accordance with another preferred embodiment of the present invention a bioinformatically detectable isolated oligonucleotide which anneals to a portion of a mRNA transcript of a target gene associated with Toxoplasmosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 66.

There is further provided in accordance with another preferred embodiment of the present invention a bioinformatically detectable isolated oligonucleotide which anneals to a portion of a mRNA transcript of a target gene associated with Bundle-Branch Block, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 67.

There is still further provided in accordance with another preferred embodiment of the present invention a bioinformatically detectable isolated oligonucleotide which anneals to a portion of a mRNA transcript of a target gene associated with Thyroiditis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 68.

There is additionally provided in accordance with another preferred embodiment of the present invention a bioinformatically detectable isolated oligonucleotide which anneals to a portion of a mRNA transcript of a target gene associated with Urethral neoplasms, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 69.

There is moreover provided in accordance with another preferred embodiment of the present invention a bioinformatically detectable isolated oligonucleotide which anneals to a portion of a mRNA transcript of a target gene associated with Adenovirus, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 70.

There is further provided in accordance with another preferred embodiment of the present invention a bioinformatically detectable isolated oligonucleotide which anneals to a portion of a mRNA transcript of a target gene associated with Atherosclerosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 71.

There is still further provided in accordance with another preferred embodiment of the present invention a bioinformatically detectable isolated oligonucleotide which anneals to a portion of a mRNA transcript of a target gene associated with Infectious Mononucleosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 72.

There is additionally provided in accordance with another preferred embodiment of the present invention a bioinformatically detectable isolated oligonucleotide which anneals to a portion of a mRNA transcript of a target gene associated with Non-Insulin-Dependent Diabetes Mellitus, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 73.

There is moreover provided in accordance with another preferred embodiment of the present invention a bioinformatically detectable isolated oligonucleotide which anneals to a portion of a mRNA transcript of a target gene associated with Virus Diseases, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 74.

There is further provided in accordance with another preferred embodiment of the present invention a bioinformatically detectable isolated oligonucleotide which anneals to a portion of a mRNA transcript of a target gene associated with Hypertrophic cardiomyopathy, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 75.

There is still further provided in accordance with another preferred embodiment of the present invention a bioinformatically detectable isolated oligonucleotide which anneals to a portion of a mRNA transcript of a target gene associated with Syphilis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 76.

There is additionally provided in accordance with another preferred embodiment of the present invention a bioinformatically detectable isolated oligonucleotide which anneals to a portion of a mRNA transcript of a target gene associated with Thrombocytopenia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 77.

There is moreover provided in accordance with another preferred embodiment of the present invention a bioinformatically detectable isolated oligonucleotide which anneals to a portion of a mRNA transcript of a target gene associated with Cerebrovascular Accident, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 78.

There is further provided in accordance with another preferred embodiment of the present invention a bioinformatically detectable isolated oligonucleotide which anneals to a portion of a mRNA transcript of a target gene associated with Skin Neoplasms, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 79.

There is still further provided in accordance with another preferred embodiment of the present invention a bioinformatically detectable isolated oligonucleotide which anneals to a portion of a mRNA transcript of a target gene associated with Cleft Palate, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 80.

There is additionally provided in accordance with another preferred embodiment of the present invention a bioinformatically detectable isolated oligonucleotide which anneals to a portion of a mRNA transcript of a target gene associated with Obesity, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 81.

There is moreover provided in accordance with another preferred embodiment of the present invention a bioinformatically detectable isolated oligonucleotide which anneals to a portion of a mRNA transcript of a target gene associated with Picornaviridae, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 82.

There is further provided in accordance with another preferred embodiment of the present invention a bioinformatically detectable isolated oligonucleotide which anneals to a portion of a mRNA transcript of a target gene associated with Nonsmall cell lung cancer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 83.

There is still further provided in accordance with another preferred embodiment of the present invention a bioinformatically detectable isolated oligonucleotide which anneals to a portion of a mRNA transcript of a target gene associated with Dermatomyositis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 84.

There is additionally provided in accordance with another preferred embodiment of the present invention a bioinformatically detectable isolated oligonucleotide which anneals to a portion of a mRNA transcript of a target gene associated with Migraine, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 85.

There is moreover provided in accordance with another preferred embodiment of the present invention a bioinformatically detectable isolated oligonucleotide which anneals to a portion of a mRNA transcript of a target gene associated with Meningitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 86.

There is further provided in accordance with another preferred embodiment of the present invention a bioinformatically detectable isolated oligonucleotide which anneals to a portion of a mRNA transcript of a target gene associated with Renal Tubular Acidosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 87.

There is still further provided in accordance with another preferred embodiment of the present invention a bioinformatically detectable isolated oligonucleotide which anneals to a portion of a mRNA transcript of a target gene associated with Pancreatic cancer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 88.

There is additionally provided in accordance with another preferred embodiment of the present invention a bioinformatically detectable isolated oligonucleotide which anneals to a portion of a mRNA transcript of a target gene associated with Ulcerative colitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 89.

There is moreover provided in accordance with another preferred embodiment of the present invention a bioinformatically detectable isolated oligonucleotide which anneals to a portion of a mRNA transcript of a target gene associated with Epilepsy, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 90.

There is further provided in accordance with another preferred embodiment of the present invention a bioinformatically detectable isolated oligonucleotide which anneals to a portion of a mRNA transcript of a target gene associated with Cholelithiasis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 91.

There is still further provided in accordance with another preferred embodiment of the present invention a bioinformatically detectable isolated oligonucleotide which anneals to a portion of a mRNA transcript of a target gene associated with Intestinal Neoplasms, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 92.

There is additionally provided in accordance with another preferred embodiment of the present invention a bioinformatically detectable isolated oligonucleotide which anneals to a portion of a mRNA transcript of a target gene associated with Renal cell carcinoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 93.

There is moreover provided in accordance with another preferred embodiment of the present invention a bioinformatically detectable isolated oligonucleotide which anneals to a portion of a mRNA transcript of a target gene associated with Cirrhosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 94.

There is further provided in accordance with another preferred embodiment of the present invention a bioinformatically detectable isolated oligonucleotide which anneals to a portion of a mRNA transcript of a target gene associated with Peritonitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 95.

There is still further provided in accordance with another preferred embodiment of the present invention a bioinformatically detectable isolated oligonucleotide which anneals to a portion of a mRNA transcript of a target gene associated with Appendicitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 96.

There is additionally provided in accordance with another preferred embodiment of the present invention a bioinformatically detectable isolated oligonucleotide which anneals to a portion of a mRNA transcript of a target gene associated with Papilloma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 97.

There is moreover provided in accordance with another preferred embodiment of the present invention a bioinformatically detectable isolated oligonucleotide which anneals to a portion of a mRNA transcript of a target gene associated with Down Syndrome, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 98.

There is further provided in accordance with another preferred embodiment of the present invention a bioinformatically detectable isolated oligonucleotide which anneals to a portion of a mRNA transcript of a target gene associated with Nephrolithiasis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 99.

There is still further provided in accordance with another preferred embodiment of the present invention a bioinformatically detectable isolated oligonucleotide which anneals to a portion of a mRNA transcript of a target gene associated with Aortic Aneurysm, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 100.

There is additionally provided in accordance with another preferred embodiment of the present invention a bioinformatically detectable isolated oligonucleotide which anneals to a portion of a mRNA transcript of a target gene associated with Vascular dementia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 101.

There is moreover provided in accordance with another preferred embodiment of the present invention a bioinformatically detectable isolated oligonucleotide which anneals to a portion of a mRNA transcript of a target gene associated with Infertility, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 102.

There is further provided in accordance with another preferred embodiment of the present invention a bioinformatically detectable isolated oligonucleotide which anneals to a portion of a mRNA transcript of a target gene associated with Thyroid carcinoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 103.

There is still further provided in accordance with another preferred embodiment of the present invention a bioinformatically detectable isolated oligonucleotide which anneals to a portion of a mRNA transcript of a target gene associated with Thrombosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 104.

There is additionally provided in accordance with another preferred embodiment of the present invention a bioinformatically detectable isolated oligonucleotide which anneals to a portion of a mRNA transcript of a target gene associated with Asthma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 105.

There is moreover provided in accordance with another preferred embodiment of the present invention a bioinformatically detectable isolated oligonucleotide which anneals to a portion of a mRNA transcript of a target gene associated with Diverticulitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 106.

There is further provided in accordance with another preferred embodiment of the present invention a bioinformatically detectable isolated oligonucleotide which anneals to a portion of a mRNA transcript of a target gene associated with Tuberculosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 108.

There is still further provided in accordance with another preferred embodiment of the present invention a bioinformatically detectable isolated oligonucleotide which anneals to a portion of a mRNA transcript of a target gene associated with Multiinfarct dementia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 109.

There is additionally provided in accordance with another preferred embodiment of the present invention a bioinformatically detectable isolated oligonucleotide which anneals to a portion of a mRNA transcript of a target gene associated with Cervical cancer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 110.

There is moreover provided in accordance with another preferred embodiment of the present invention a bioinformatically detectable isolated oligonucleotide which anneals to a portion of a mRNA transcript of a target gene associated with Beta Thalassemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 111.

There is further provided in accordance with another preferred embodiment of the present invention a bioinformatically detectable isolated oligonucleotide which anneals to a portion of a mRNA transcript of a target gene associated with Hepatocellular carcinoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 112.

There is still further provided in accordance with another preferred embodiment of the present invention a bioinformatically detectable isolated oligonucleotide which anneals to a portion of a mRNA transcript of a target gene associated with Psoriasis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 113.

There is additionally provided in accordance with another preferred embodiment of the present invention a bioinformatically detectable isolated oligonucleotide which anneals to a portion of a mRNA transcript of a target gene associated with Diphtheria, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 114.

There is moreover provided in accordance with another preferred embodiment of the present invention a bioinformatically detectable isolated oligonucleotide which anneals to a portion of a mRNA transcript of a target gene associated with Bronchiectasis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 115.

There is further provided in accordance with another preferred embodiment of the present invention a bioinformatically detectable isolated oligonucleotide which anneals to a portion of a mRNA transcript of a target gene associated with EBV, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 116.

There is still further provided in accordance with another preferred embodiment of the present invention a bioinformatically detectable isolated oligonucleotide which anneals to a portion of a mRNA transcript of a target gene associated with Coronary disease, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 117.

There is additionally provided in accordance with another preferred embodiment of the present invention a bioinformatically detectable isolated oligonucleotide which anneals to a portion of a mRNA transcript of a target gene associated with Polyposis coli, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 118.

There is moreover provided in accordance with another preferred embodiment of the present invention a bioinformatically detectable isolated oligonucleotide which anneals to a portion of a mRNA transcript of a target gene associated with Influenza, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 119.

There is further provided in accordance with another preferred embodiment of the present invention a bioinformatically detectable isolated oligonucleotide which anneals to a portion of a mRNA transcript of a target gene associated with Parkinson, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 120.

There is still further provided in accordance with another preferred embodiment of the present invention a bioinformatically detectable isolated oligonucleotide which anneals to a portion of a mRNA transcript of a target gene associated with Hemolytic anemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 121.

There is additionally provided in accordance with another preferred embodiment of the present invention a bioinformatically detectable isolated oligonucleotide which anneals to a portion of a mRNA transcript of a target gene associated with Medullary thyroid carcinoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 122.

There is moreover provided in accordance with another preferred embodiment of the present invention a bioinformatically detectable isolated oligonucleotide which anneals to a portion of a mRNA transcript of a target gene associated with Sickle cell anemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 123.

There is further provided in accordance with another preferred embodiment of the present invention a bioinformatically detectable isolated oligonucleotide which anneals to a portion of a mRNA transcript of a target gene associated with Deafness, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 124.

There is still further provided in accordance with another preferred embodiment of the present invention a bioinformatically detectable isolated oligonucleotide which anneals to a portion of a mRNA transcript of a target gene associated with Diabetic Neuropathies, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 125.

There is additionally provided in accordance with another preferred embodiment of the present invention a bioinformatically detectable isolated oligonucleotide which anneals to a portion of a mRNA transcript of a target gene associated with Psoriatic arthritis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 126.

There is moreover provided in accordance with another preferred embodiment of the present invention a bioinformatically detectable isolated oligonucleotide which anneals to a portion of a mRNA transcript of a target gene associated with Barrett Esophagus, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 127.

There is further provided in accordance with another preferred embodiment of the present invention a bioinformatically detectable isolated oligonucleotide which anneals to a portion of a mRNA transcript of a target gene associated with Cerebral Hemorrhage, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 128.

There is still further provided in accordance with another preferred embodiment of the present invention a bioinformatically detectable isolated oligonucleotide which anneals to a portion of a mRNA transcript of a target gene associated with Cerebral Infarction, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 129.

There is additionally provided in accordance with another preferred embodiment of the present invention a bioinformatically detectable isolated oligonucleotide which anneals to a portion of a mRNA transcript of a target gene associated with *E. coli*, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 130.

There is moreover provided in accordance with another preferred embodiment of the present invention a bioinformatically detectable isolated oligonucleotide which anneals to a portion of a mRNA transcript of a target gene associated with Urticaria, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 131.

There is further provided in accordance with another preferred embodiment of the present invention a bioinformatically detectable isolated oligonucleotide which anneals to a portion of a mRNA transcript of a target gene associated with Attention Deficit Disorder, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 132.

There is still further provided in accordance with another preferred embodiment of the present invention a bioinformatically detectable isolated oligonucleotide which anneals to a portion of a mRNA transcript of a target gene associated with Pituitary tumor, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 133.

There is additionally provided in accordance with another preferred embodiment of the present invention a bioinformatically detectable isolated oligonucleotide which anneals to a portion of a mRNA transcript of a target gene associated with Enuresis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 134.

There is moreover provided in accordance with another preferred embodiment of the present invention a bioinformatically detectable isolated oligonucleotide which anneals to a portion of a mRNA transcript of a target gene associated with Osteoporosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 135.

There is further provided in accordance with another preferred embodiment of the present invention a bioinformatically detectable isolated oligonucleotide which anneals to a portion of a mRNA transcript of a target gene associated with Urinary calculi, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 136.

There is still further provided in accordance with another preferred embodiment of the present invention a bioinformatically detectable isolated oligonucleotide which anneals to a portion of a mRNA transcript of a target gene associated with Multiple Myeloma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 137.

There is additionally provided in accordance with another preferred embodiment of the present invention a bioinformatically detectable isolated oligonucleotide which anneals to a portion of a mRNA transcript of a target gene associated with Aplastic anemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 138.

There is moreover provided in accordance with another preferred embodiment of the present invention a bioinformatically detectable isolated oligonucleotide which anneals to a portion of a mRNA transcript of a target gene associated with Gestational Diabetes, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 139.

There is further provided in accordance with another preferred embodiment of the present invention a bioinformatically detectable isolated oligonucleotide which anneals to a portion of a mRNA transcript of a target gene associated with Rheumatoid arthritis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 140.

There is still further provided in accordance with another preferred embodiment of the present invention a bioinformatically detectable isolated oligonucleotide which anneals to a portion of a mRNA transcript of a target gene associated with Duodenal Neoplasms, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 141.

There is additionally provided in accordance with another preferred embodiment of the present invention a bioinformatically detectable isolated oligonucleotide which anneals to a portion of a mRNA transcript of a target gene associated with Hypertrophic Cardiomopathy, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 142.

There is moreover provided in accordance with another preferred embodiment of the present invention a bioinformatically detectable isolated oligonucleotide which anneals to a portion of a mRNA transcript of a target gene associated with Myocardial Infarction, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 143.

There is further provided in accordance with another preferred embodiment of the present invention a bioinformatically detectable isolated oligonucleotide which anneals to a portion of a mRNA transcript of a target gene associated with Left Ventricular Dysfunction, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 144.

There is still further provided in accordance with another preferred embodiment of the present invention a bioinformatically detectable isolated oligonucleotide which anneals to a portion of a mRNA transcript of a target gene associated with Postpartum depression, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 145.

There is additionally provided in accordance with another preferred embodiment of the present invention a bioinformatically detectable isolated oligonucleotide which anneals to a portion of a mRNA transcript of a target gene associated with Colorectal cancer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 146.

There is moreover provided in accordance with another preferred embodiment of the present invention a bioinformatically detectable isolated oligonucleotide which anneals to a portion of a mRNA transcript of a target gene associated with Transitional cell carcinoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 147.

There is further provided in accordance with another preferred embodiment of the present invention a bioinformatically detectable isolated oligonucleotide which anneals to a portion of a mRNA transcript of a target gene associated with Alpha thalassemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 148.

There is still further provided in accordance with another preferred embodiment of the present invention a bioinformatically detectable isolated oligonucleotide which anneals to a portion of a mRNA transcript of a target gene associated with Cleft Lip, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 149.

There is additionally provided in accordance with another preferred embodiment of the present invention a bioinformatically detectable isolated oligonucleotide which anneals to a portion of a mRNA transcript of a target gene associated with Hypercholesterolemia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 150.

There is moreover provided in accordance with another preferred embodiment of the present invention a bioinformatically detectable isolated oligonucleotide which anneals to a portion of a mRNA transcript of a target gene associated with Sudden cardiac death, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 151.

There is further provided in accordance with another preferred embodiment of the present invention a bioinformatically detectable isolated oligonucleotide which anneals to a portion of a mRNA transcript of a target gene associated with Atrial fibrillation, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 152.

There is still further provided in accordance with another preferred embodiment of the present invention a bioinformatically detectable isolated oligonucleotide which anneals to a portion of a mRNA transcript of a target gene associated with Hypertension, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 153.

There is additionally provided in accordance with another preferred embodiment of the present invention a bioinformatically detectable isolated oligonucleotide which anneals to a portion of a mRNA transcript of a target gene associated with Ovarian cancer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 154.

There is moreover provided in accordance with another preferred embodiment of the present invention a bioinformatically detectable isolated oligonucleotide which anneals to a portion of a mRNA transcript of a target gene associated with Coronary spasm, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 155.

There is further provided in accordance with another preferred embodiment of the present invention a bioinformatically detectable isolated oligonucleotide which anneals to a portion of a mRNA transcript of a target gene associated with Hemophilia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 157.

There is still further provided in accordance with another preferred embodiment of the present invention a bioinformatically detectable isolated oligonucleotide which anneals to a portion of a mRNA transcript of a target gene associated with Peripheral Vascular Diseases, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 158.

There is additionally provided in accordance with another preferred embodiment of the present invention a bioinformatically detectable isolated oligonucleotide which anneals to a portion of a mRNA transcript of a target gene associated with Bacillary Dysentery, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 159.

There is moreover provided in accordance with another preferred embodiment of the present invention a bioinformatically detectable isolated oligonucleotide which anneals to a portion of a mRNA transcript of a target gene associated with Macular Degeneration, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 160.

There is further provided in accordance with another preferred embodiment of the present invention a bioinformatically detectable isolated oligonucleotide which anneals to a portion of a mRNA transcript of a target gene associated with *Mycobacterium*, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 161.

There is still further provided in accordance with another preferred embodiment of the present invention a bioinformatically detectable isolated oligonucleotide which anneals to a portion of a mRNA transcript of a target gene associated with Cushing Syndrome, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 162.

There is additionally provided in accordance with another preferred embodiment of the present invention a bioinformatically detectable isolated oligonucleotide which anneals to a portion of a mRNA transcript of a target gene associated with Melanoma, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 163.

There is moreover provided in accordance with another preferred embodiment of the present invention a bioinformatically detectable isolated oligonucleotide which anneals to a portion of a mRNA transcript of a target gene associated with Bipolar Disorder, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 164.

There is further provided in accordance with another preferred embodiment of the present invention a bioinformatically detectable isolated oligonucleotide which anneals to a portion of a mRNA transcript of a target gene associated with Coronary artery disease, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 166.

There is still further provided in accordance with another preferred embodiment of the present invention a bioinformatically detectable isolated oligonucleotide which anneals to a portion of a mRNA transcript of a target gene associated with Dementia, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 167.

There is additionally provided in accordance with another preferred embodiment of the present invention a bioinformatically detectable isolated oligonucleotide which anneals to a portion of a mRNA transcript of a target gene associated with Lupus Erythematosus, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 168.

There is moreover provided in accordance with another preferred embodiment of the present invention a bioinformatically detectable isolated oligonucleotide which anneals to a portion of a mRNA transcript of a target gene associated with Rhinitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 169.

There is further provided in accordance with another preferred embodiment of the present invention a bioinformatically detectable isolated oligonucleotide which anneals to a portion of a mRNA transcript of a target gene associated with Peptic Ulcer, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 170.

There is still further provided in accordance with another preferred embodiment of the present invention a bioinformatically detectable isolated oligonucleotide which anneals to a portion of a mRNA transcript of a target gene associated with Cystic fibrosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 171.

There is additionally provided in accordance with another preferred embodiment of the present invention a bioinformatically detectable isolated oligonucleotide which anneals to a portion of a mRNA transcript of a target gene associated with Autism, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 172.

There is moreover provided in accordance with another preferred embodiment of the present invention a bioinformatically detectable isolated oligonucleotide which anneals to a portion of a mRNA transcript of a target gene associated with HTLV, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 173.

There is further provided in accordance with another preferred embodiment of the present invention a bioinformatically detectable isolated oligonucleotide which anneals to a portion of a mRNA transcript of a target gene associated with Sinusitis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 174.

There is still further provided in accordance with another preferred embodiment of the present invention a bioinformatically detectable isolated oligonucleotide which anneals to a portion of a mRNA transcript of a target gene associated with Diabetic Retinopathy, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 176.

There is additionally provided in accordance with another preferred embodiment of the present invention a bioinformatically detectable isolated oligonucleotide which anneals to a portion of a mRNA transcript of a target gene associated with Antisocial Personality Disorder, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 177.

There is moreover provided in accordance with another preferred embodiment of the present invention a bioinformatically detectable isolated oligonucleotide which anneals to a portion of a mRNA transcript of a target gene associated with Amyotrophic Lateral Sclerosis, wherein binding of the oligonucleotide to the mRNA transcript represses expression of the target gene, and wherein the oligonucleotide has at least 80% sequence identity with a nucleotide sequence selected from the group consisting of SEQ ID NOs shown in Table 14 row 178.

There is further provided in accordance with another preferred embodiment of the present invention a method for treatment of a disease involving a tissue in which a protein is pathologically expressed to an undesirable extent, the protein having a messenger RNA, the method including: providing a material which modulates activity of a microRNA oligonucleotide which binds complementarily to a segment of the messenger RNA, and introducing the material into the tissue, causing modulation of the activity of the microRNA oligonucleotide and thereby modulating expression of the protein in a desired manner.

There is still further provided in accordance with another preferred embodiment of the present invention a method for treatment of a disease involving tissue in which a protein is pathologically expressed to an undesirable extent, the protein having a messenger RNA, the method including: providing a material which at least partially binds a segment of the messenger RNA that is bound complementarily by a microRNA oligonucleotide, thereby modulating expression of the protein, and introducing the material into the tissue, thereby modulating expression of the protein.

There is additionally provided in accordance with another preferred embodiment of the present invention a method for treatment of a disease involving a tissue in which a protein is pathologically over-expressed, the protein having a messenger RNA, the method including: providing a microRNA oligonucleotide which binds complementarily to a segment of the messenger RNA, and introducing the microRNA oligonucleotide into the tissue, causing the microRNA oligonucleotide to bind complementarily to a segment of the messenger RNA and thereby inhibit expression of the protein.

There is moreover provided in accordance with another preferred embodiment of the present invention a method for treatment of a disease involving a tissue in which a protein is pathologically over-expressed, the protein having a messenger RNA, the method including: providing a chemically-modified microRNA oligonucleotide which binds complementarily to a segment of the messenger RNA, and introducing the chemically-modified microRNA oligonucleotide into the tissue, causing the microRNA oligonucleotide to bind complementarily to a segment of the messenger RNA and thereby inhibit expression of the protein.

There is further provided in accordance with another preferred embodiment of the present invention a method for treatment of a disease involving a tissue in which a protein is pathologically under-expressed, the protein having a messenger RNA, the method including: providing an oligonucleotide that inhibits activity of a microRNA oligonucleotide which binds complementarily to a segment of the messenger RNA, and introducing the oligonucleotide into the tissue, causing inhibition of the activity of the microRNA oligonucleotide and thereby promotion of translation of the protein.

There is still further provided in accordance with another preferred embodiment of the present invention a method for treatment of a disease involving a tissue in which a protein is pathologically under-expressed, the protein having a messenger RNA, the method including: providing a chemically-modified oligonucleotide that inhibits activity of a microRNA oligonucleotide which binds complementarily to a segment of the messenger RNA, and introducing the chemically-modified oligonucleotide into the tissue, causing inhibition of the activity of the microRNA oligonucleotide and thereby promotion of translation of the protein.

There is additionally provided in accordance with another preferred embodiment of the present invention a method for diagnosis of a disease involving a tissue in which a protein is expressed to abnormal extent, the protein having a messenger RNA, the method including: assaying a microRNA oligonucleotide which at least partially binds a segment of the messenger RNA and modulates the expression of the protein, thereby providing an indication of at least one parameter of the disease.

There is moreover provided in accordance with another preferred embodiment of the present invention a method for detection of expression of an oligonucleotide, the method including: determining a first nucleotide sequence of a first oligonucleotide, which first nucleotide sequence is not complementary to a genome of an organism, receiving a second nucleotide sequence of a second oligonucleotide whose expression is sought to be detected, designing a third nucleotide sequence that is complementary to the second nucleotide sequence of the second oligonucleotide, and a fourth nucleotide sequence that is complementary to a fifth nucleotide sequence which is different from the second nucleotide sequence of the second oligonucleotide by at least one nucleotide, synthesizing a first oligonucleotide probe having a sixth nucleotide sequence including the third nucleotide sequence followed by the first nucleotide sequence of the first oligonucleotide, and a second oligonucleotide probe having a seventh nucleotide sequence including the fourth nucleotide sequence followed by the first nucleotide sequence of the first oligonucleotide, locating the first oligonucleotide probe and the second oligonucleotide probe on a microarray platform, receiving an RNA test sample from at least one tissue of the organism, obtaining size-fractionated RNA from the RNA test sample, amplifying the size-fractionated RNA, hybridizing the adaptor-linked RNA with the first and second oligonucleotide probes on the microarray platform, and determining expression of the first oligonucleotide in the at least one tissue of the organism, based at least in part on the hybridizing.

There is further provided in accordance with another preferred embodiment of the present invention a bioinformatically detectable isolated polynucleotide which is endogenously processed into a plurality of hairpin-shaped precursor oligonucleotides, each of which is endogenously processed into a respective oligonucleotide, which in turn anneals to a portion of a mRNA transcript of a target gene, wherein binding of the oligonucleotide to the mRNA transcript represses expression of the target gene.

There is still further provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the target gene does not encode a protein.

There is additionally provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein a function of the oligonucleotide includes modulation of cell type.

There is moreover provided in accordance with another preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the oligonucleotide is maternally transferred by a cell to at least one daughter cell of the cell, and a function of the oligonucleotide includes modulation of cell type of the daughter cell.

There is further provided in accordance with another preferred embodiment of the present invention a method for bioinformatic detection of microRNA oligonucleotides, the method including: bioinformatically detecting a hairpin-shaped precursor oligonucleotide, bioinformatically detecting an oligonucleotide which is endogenously processed from the hairpin-shaped precursor oligonucleotide, and bioinformatically detecting a target gene of the oligonucleotide wherein the oligonucleotide anneals to at least one portion of a mRNA transcript of the target gene, and wherein the binding represses expression of the target gene, and the target gene is associated with a disease.

BRIEF DESCRIPTION OF DRAWINGS

FIG. 1 is a simplified diagram illustrating a genomic differentiation enigma that the present invention addresses;

FIGS. 5A and 5B are schematic diagrams which, when taken together, illustrate a "genomic records" concept of the conceptual model of the present invention, addressing the genomic differentiation enigma;

FIG. 9 is a simplified block diagram illustrating a bioinformatic oligonucleotide detection system capable of detecting oligonucleotides of the novel group of oligonucleotides of the present invention, which system is constructed and operative in accordance with a preferred embodiment of the present invention;

FIG. 10 is a simplified flowchart illustrating operation of a mechanism for training of a computer system to recognize the novel oligonucleotides of the present invention, which mechanism is constructed and operative in accordance with a preferred embodiment of the present invention;

FIG. 22 is a summary table of laboratory results validating expression of novel human oligonucleotides detected by a bioinformatic oligonucleotide detection engine constructed and operative in accordance with a preferred embodiment of the present invention, thereby validating its efficacy;

FIG. 23A is a schematic representation of an "operon-like" cluster of novel human hairpin sequences detected by a bioinformatic oligonucleotide detection engine constructed and operative in accordance with a preferred embodiment of the present invention, and non-GAM hairpin sequences used as negative controls thereto. The hairpins shown are as follows: N2 (SEQ ID NO: 10068286), N3 (SEQ ID NO: 10068287), MIR23 (SEQ ID NO: 10068288), GAM252 (SEQ ID NO: 10068289), GAM7617 (SEQ ID NO: 10068290), N252 (SEQ ID NO: 10068291), N4 (SEQ ID NO: 10068292), N0 (SEQ ID NO: 10068293), N6 (SEQ ID NO: 10068294), MIR24 (SEQ ID NO: 10068295), and N7 (SEQ ID NO: 10068296).

FIG. 23B is a schematic representation of secondary folding of hairpins of the operon-like cluster of FIG. 23A;

FIG. 23C is a photograph of laboratory results demonstrating expression of novel oligonucleotides of FIGS. 23A and 23B and lack of expression of the negative controls, thereby validating efficacy of bioinformatic detection of GAM oligonucleotides and GR polynucleotides detected by a bioinformatic oligonucleotide detection engine, constructed and operative in accordance with a preferred embodiment of the present invention;

FIG. 24A is an annotated sequence of EST72223 (SEQ ID NO: 10068281) comprising known human miRNA oligonucleotide MIR98 and novel human oligonucleotide GAM25 PRECURSOR detected by the oligonucleotide detection system of the present invention. Additionally annotated in EST72223 are the miRNA-98 hairpin in bold (SEQ ID NO: 10068282), the sequence of the mature miRNA-98 in bold and underline (SEQ ID NO: 10068283), the sequence of the GAM25 hairpin in bold (SEQ ID NO: 10068284), and the sequence of the mature miRNA of GAM25 in bold and underline (SEQ ID NO: 10068285).

FIGS. 24B, 24C and 24D are pictures of laboratory results demonstrating laboratory confirmation of expression of known human oligonucleotide MIR98 and of novel bioinformatically-detected human GAM25 RNA respectively, both of FIG. 24A, thus validating the bioinformatic oligonucleotide detection system of the present invention;

FIG. 25D is a table of exemplary specific hairpin oligonucleotides identified and sequenced by the specific primers designed and used under the methods of FIG. 25A, 25B, and 25C.

FIG. 27C is a summary table demonstrating detection of known microRNA oligonucleotides using a microarray constructed and operative in accordance with a preferred embodiment of the present invention.

FIGS. 28A-28D are simplified diagrams which when taken together illustrate different modes by which small molecules may be uses as therapeutic agents related to microRNA oligonucleotides, in accordance with a preferred embodiment of the present invention.

BRIEF DESCRIPTION OF SEQUENCES

Figure 2A:
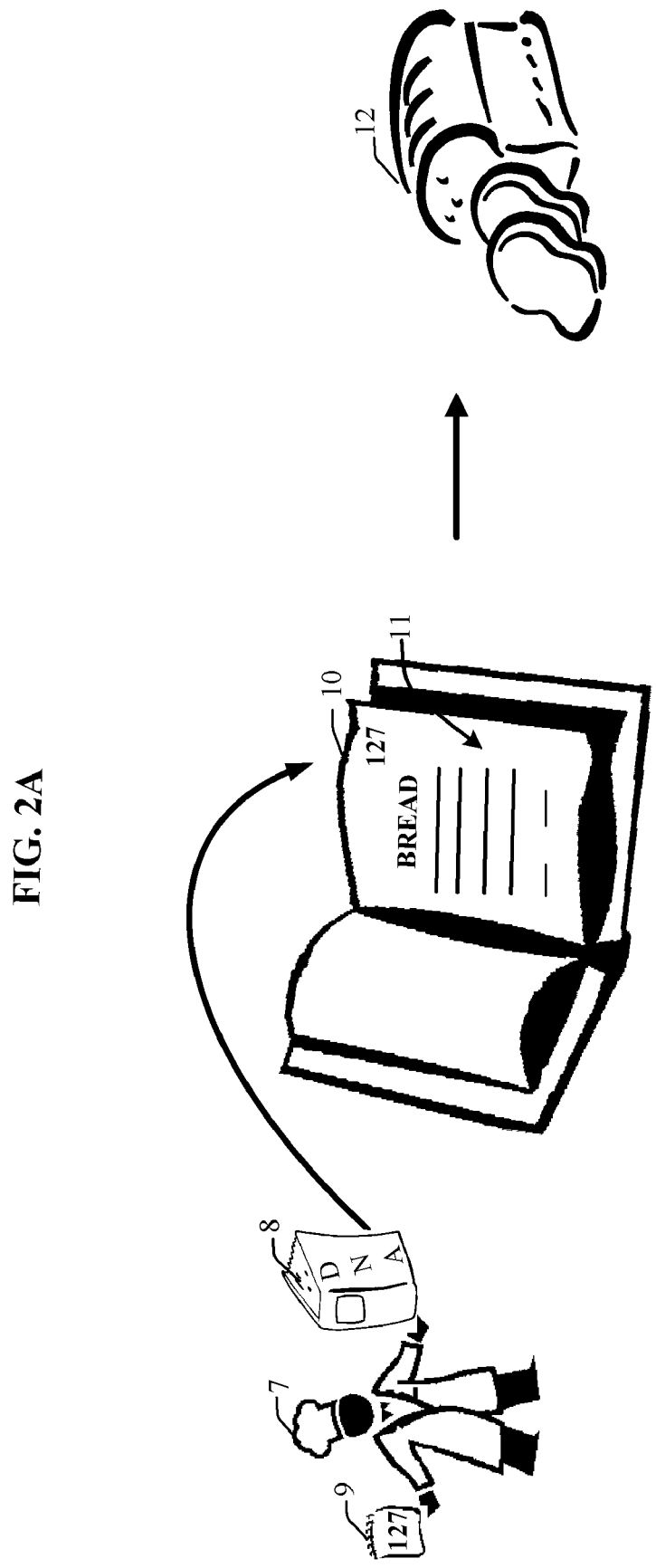
FIGS. 2, 3 and 4 are schematic diagrams which, when taken together, provide an analogy that illustrates a conceptual model of the present invention, addressing the genomic differentiation enigma.

A Sequence Listing of genomic sequences of the present invention designated SEQ ID NO:1 through SEQ ID: 10068177 is attached to this application, and is hereby incorporated herein. The genomic listing comprises the following nucleotide sequences: nucleotide sequences of 122764 GAM precursors of respective novel oligonucleotides of the present invention; nucleotide sequences of 139368 GAM RNA oligonucleotides of respective novel oligonucleotides of the present invention; and nucleotide sequences of 1709460 target gene binding sites of respective novel oligonucleotides of the present invention.

DETAILED DESCRIPTION

Reference is now made to FIG. 1, which is a simplified diagram providing a conceptual explanation of a genomic differentiation enigma, which the present invention addresses, inter alia.

FIG. 1 depicts various types of cells in an organism, such as a cartilage cell designated by reference numeral 1, a liver cell designated by reference numeral 2, a fibroblast cell designated by reference numeral 3, and a bone cell designated by reference numeral 4, all containing identical DNA designated by reference numeral 5. Notwithstanding that the various types of cells are all derived from a common initial fertilized egg cell designated by reference numeral 6, each of these cells expresses different proteins and accordingly acquire a different shape and function.

The present invention proposes inter alia that the inevitable conclusion from the foregoing is strikingly simple: the genome must contain a modular differentiation coding system. In other words, the genome of each cell must include multiple modules or records, possibly a different one for each cell type, as well as a mechanism by which each cell at its inception is instructed which one of the multiple records will govern its behavior.

This modular code concept may be somewhat difficult to grasp, since most persons are accustomed to view things from an external viewpoint. An architect, for example, looks at a plan of a building, which details exactly where each element (block, window, door, electrical switch, etc.) is to be placed relative to all other elements. Using the plan, the architect instructs the builders to place these elements in their designated places. This is an example of an external viewpoint: the architect is external to the plan, which itself is external with respect to the physical building, and with respect to its various elements. The architect may therefore act as an "external organizing agent" who can see the full picture and the relationships between all of the elements and is able to instruct from the outside where to place each of them.

According to a preferred embodiment of the present invention, genomic differentiation coding, in contrast to architectural building, functions without any external organizing agent. It comprises a smart block (the first cell), which is the architect and the plan. This smart block continuously duplicates itself, somehow knowing when to manifest itself as a block and when as a window, door, or electrical switch.

Reference is now made to FIGS. 2A-4 which are schematic diagrams which, when taken together, provide an analogy that illustrates a conceptual model of the present invention, which conceptual model addresses the genomic differentiation enigma.

Reference is now made to FIG. 2A. A hypothetical talented chef, designated by reference numeral 7, is capable of preparing any dish provided that he is given specific written cooking instructions. The chef 7 is equipped with two items: (a) a recipe book 8, designated by reference numeral 8, and (b) a small note, designated by reference numeral 9, having a number scribbled on it. The recipe book 8 comprises multiple pages, each page detailing how to prepare a specific dish. The small note 9 indicates the page to be opened, and therefore the dish to be prepared. The chef looks at the page number written on the note, opens the recipe book 8 to the appropriate page, and prepares the dish according to the written instructions on this page. In the example shown in FIG. 2A, the chef 7 is holding a small note 9 bearing the number 127. He therefore opens the recipe book 8 to page 127, designated by reference numeral 10. Since this page contains the recipe for preparing bread, the chef 7 prepares a loaf of bread, designated by reference numeral 12. Pages of the recipe book 8, such as page 127 (designated by reference numeral 10) in the example shown in FIG. 2A, contain additional information, designated by reference numeral 11. The nature of the additional information 11 is further elaborated hereinbelow with reference to FIGS. 3 and 4.

Reference is now made to FIG. 2B, which depicts two identical chefs, a first chef, designated by reference numeral 13, and a second chef, designated by reference numeral 14, both holding an identical recipe book 8. Although the first chef 13 and the second chef 14 are identical and hold identical recipe books 8, they differ in that they hold different small notes. The first chef 13 holds a small note designated by reference numeral 9, having the number 127 written on it, whereas the second chef 14 holds a small note designated by reference numeral 15, having the number 134 written on it. Accordingly, the first chef 13 opens the recipe book 8 to page 127, as designated by reference numeral 10 and, based on the instructions written on page 127 prepares a loaf of bread, designated by reference numeral 12. The second chef 14 opens the recipe book 8 to page 134, as designated by reference numeral 16 and, based on the instructions written on page 134, prepares a pie, designated by reference numeral 17. Pages in the recipe book 8, such as pages 127 and 134 designated by reference numerals 10 and 16 respectively in the examples shown in FIG. 2B, contain additional information, designated by reference numeral 11. The nature of the additional information 11 is further elaborated hereinbelow with reference to FIGS. 3 and 4.

Figure 3:
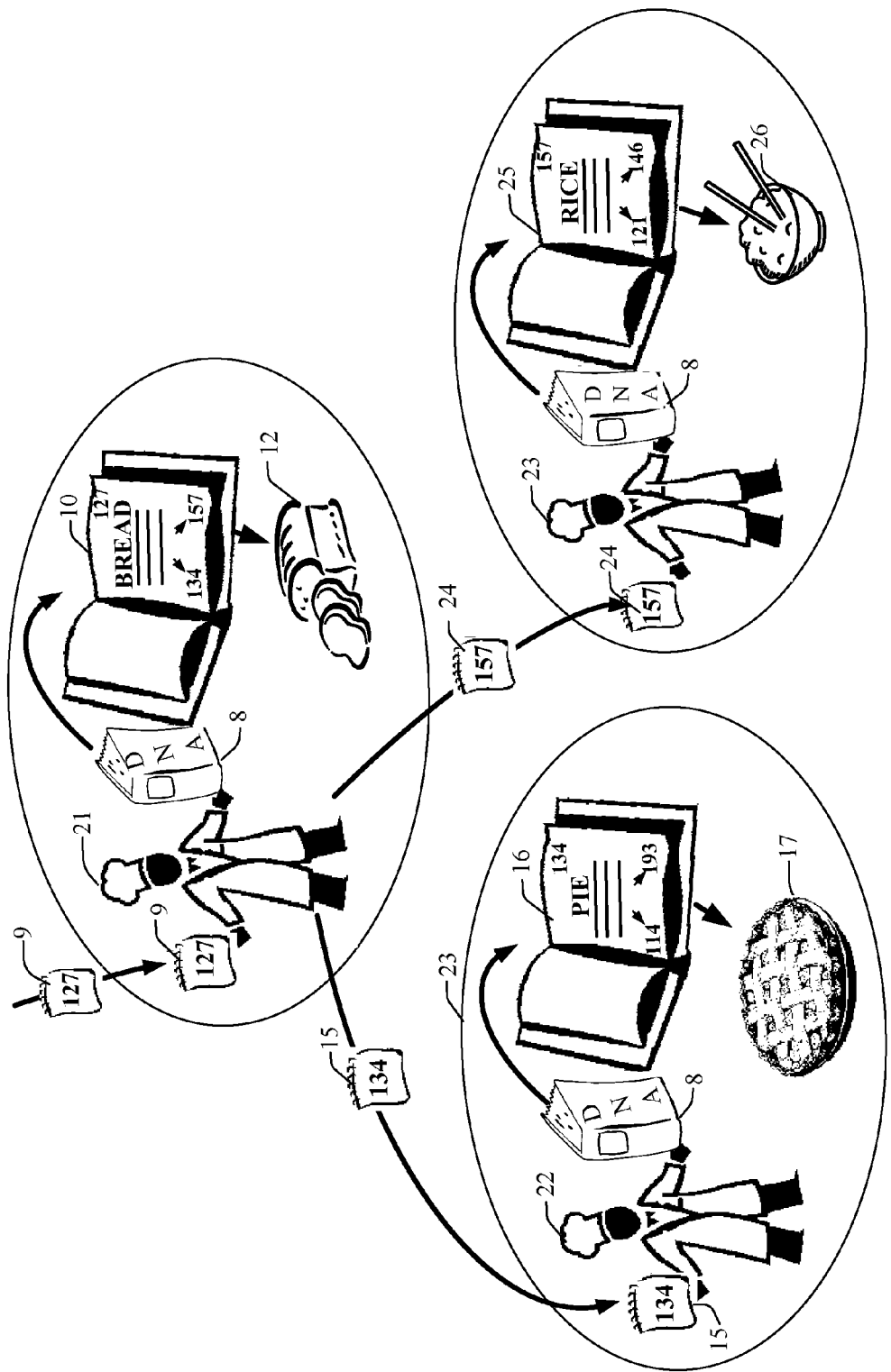

Reference is now made to FIG. 3, which illustrates a mode by which an imaginary chef can duplicate himself yielding two identical chefs, instructing each of the identical duplicate chefs to prepare a different dish. As an example, FIG. 3 shows a chef, designated by reference numeral 21, duplicating himself to yield two duplicate chefs: a first duplicate chef, designated by reference numeral 22, and a second duplicate chef, designated by reference numeral 23. The duplicate chefs are identical to each other and to chef 21.

Like chef 7 and chef 13 of FIGS. 2A and 2B, FIG. 3 shows chef 21 holding a recipe book 8 and receiving a note 9 bearing the number 127. Chef 21 therefore opens the recipe book 8 to page 127, designated by reference numeral 10, and prepares a loaf of bread 12. However, FIG. 3 also elaborates some of the additional information 11 (FIGS. 2A and 2B) found on page 127, designated by reference numeral 10: the bottom of page 127 bears two numbers 134 and 157.

Chef 21 is trained to perform the following three actions when he is finished preparing a dish: (a) Duplicate himself yielding two duplicate chefs, the first duplicate chef 22 and the second duplicate chef 23; (b) Duplicate his recipe book 8, handing an identical copy to each of the duplicate chefs 22 and 23; and (c) Write down on each of two notes one of the numbers that is found at the bottom of the page to which he was instructed to open. In the example illustrated by FIG. 3, chef 21 is instructed to open the recipe book 8 to page 127, designated by reference numeral 10, write the numbers 134 and 157 on two respective notes, a first note designated by reference numeral 15 and the second note designated by reference numerals 24. Chef 21 is further trained to hand the first note 15 bearing the number 134, to the first duplicate chef 22 and the second note 24 bearing the number 157, to the second duplicate chef 23.

Accordingly, the first duplicate chef 22 receives note 15 bearing the number 134 and therefore opens the recipe book 8 to page 134, designated by reference numeral 16, and prepares a pie, designated by reference numeral 17. The second duplicate chef 23 receives note 24 bearing the number 157 and therefore opens the recipe book 8 to page 157, designated by reference numeral 25, and prepares rice, designated by reference numeral 26.

It is appreciated that while chef 21 and duplicate chefs 22 and 23 are identical and hold identical recipe books 8, they each prepare a different dish. It is also appreciated that the dishes prepared by the first duplicate chef 22 and the second duplicate chef 23 are determined by chef 21 and are mediated by the differently numbered notes 15 and 24 passed on from chef 21 to duplicate chefs 22 and 23, respectively.

Further, it is appreciated that the mechanism illustrated by FIG. 3 enables an unlimited lineage of chefs to divide into duplicate, identical chefs and to determine the dishes those duplicate chefs would prepare. As an example, since the first duplicate chef 22 is directed to page 134, as designated by reference numeral 16, when he duplicates himself (not shown), he will instruct his two duplicate chefs to prepare dishes specified on particular pages, the numbers of which are written at the bottom of page 134, i.e. pages 114 and 193, respectively. Similarly, the second duplicate chef 23 will instruct its duplicate chefs to prepare dishes specified on pages 121 and 146, respectively, etc.

Figure 4:
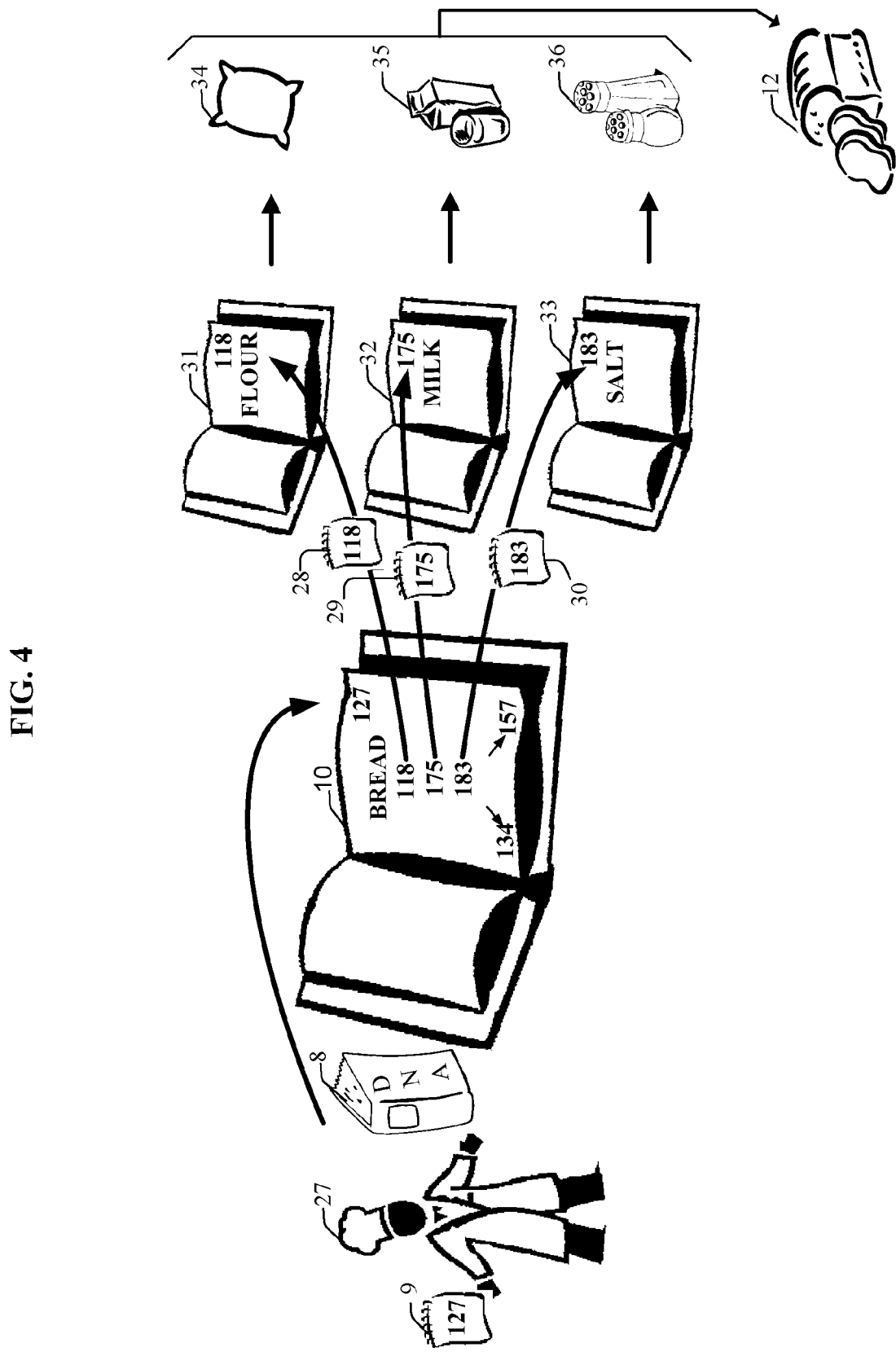

Reference is now made to FIG. 4, which illustrates a mode by which a chef can prepare a dish based on instructions written in a shorthand format: The page to which a chef is directed by a small note he is given merely contains a list of numbers which further direct him to other pages, each specifying how to prepare an ingredient of the dish to be prepared.

To illustrate this shorthand format, FIG. 4 shows a chef, designated by reference numeral 27, holding the recipe book 8 and the note 9 which bears the number 127. Chef 27 accordingly opens the recipe book 8 to page 127, designated by reference numeral 10, and based on instructions on this page, prepares bread 12. This is similar to chefs 7, 13 and 21 of FIGS. 2A, 2B and 3, respectively.

However, FIG. 4 also further elaborates on some of the additional information 11 (FIGS. 2A and 2B) that is written on page 127, designated by reference numeral 10. The cooking instructions found on page 127, designated by reference numeral 10, for making bread 12 are written in a shorthand format, comprising only three numbers: 118, 175 and 183. Chef 27 writes these numbers on three respective notes designated by reference numerals 28-30. The notes 28-30 are then used to turn to corresponding pages 118, 175 and 183, designated by reference numerals 31-33 of the recipe book 8, which pages provide instructions for the preparation of ingredients required for making bread 12: flour 34, milk 35 and salt 36.

The analogy provided by FIGS. 2A-4 illustrates the conceptual model of the present invention addressing the genomic differentiation enigma, and may be explained as follows: The chefs and duplicate chefs 7, 13, 14, 21-23 and 27 (FIGS. 2A-4) in the analogy represent cells. The recipe book 8 represents the DNA 5 (FIG. 1). Preparing dishes such as bread 12, pie 17 or rice 26 (all of FIG. 3) represent the cell manifesting itself as a specific cell type, such as cartilage cell 1, liver cell 2, fibroblast cell 3, or bone cell 4 (all of FIG. 1). Ingredients of a dish, such as flour 34, milk 35 and salt 36 (all of 4), represent proteins typically expressed by a particular cell type, such as 1-4. In the same way that the different chefs of the analogy have the same recipe book 8 yet prepare different dishes, so do different cells in an organism contain the same DNA 5 yet manifest themselves as different cell types 1-4 by expressing proteins typical of these respective cell types. Application of the analogy illustrated in FIGS. 2A-4 to the field of cell biology is further described hereinbelow with reference to FIGS. 5A-7.

Figure 5A:
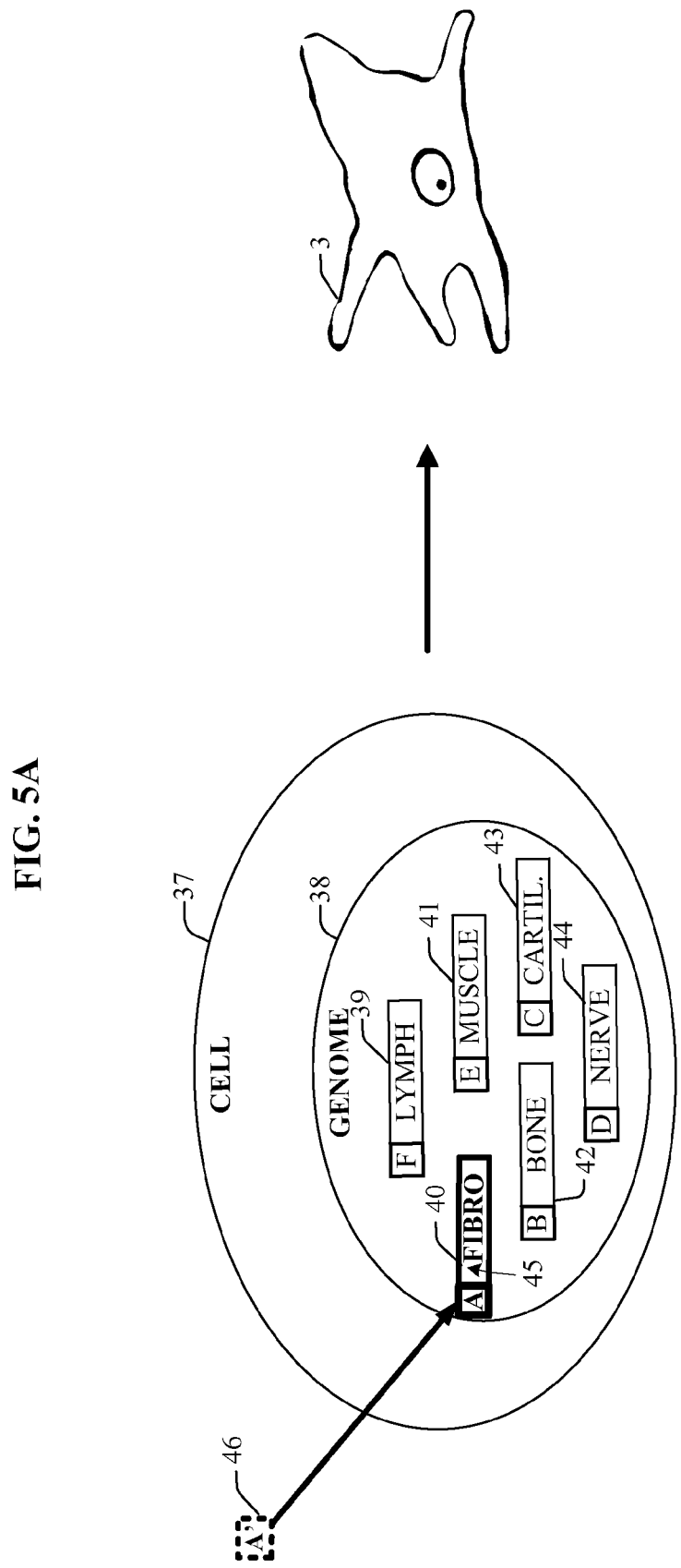

Reference is now made to FIGS. 5A and 5B which are schematic diagrams that, when taken together, illustrate a Genomic Records concept of the present invention, addressing the genomic differentiation enigma. FIGS. 5A and 5B correspond to FIGS. 2A and 2B of the chef analogy described hereinabove.

An important aspect of the present invention is the Genomic Records concept. According to a preferred embodiment of the present invention, the DNA (the recipe book 8 in analogy) comprises a very large number of Genomic Records (analogous to pages in the recipe book 8, such as pages 127, 134, and 157, designated by reference numerals 10, 16 and 25, respectively) containing instructions for differentiation of various different cell types or developmental process. Each Genomic Record comprises at least one very short genomic sequence, which functions as a "Genomic Address" of that Genomic Record (analogous to a page number, such as the numbers 127, 134 and 157 (reference numerals 10, 16 and 25) that appear in the recipe book 8 of FIG. 3). At its inception, each cell receives a short RNA segment (analogous to the scribbled short note, such as 9, 15 and 24 of FIG. 3) in addition to the DNA (analogous to the recipe book 8). This short RNA segment binds complementarily to a "Genomic Address" sequence of one of the Genomic Records, thereby modulating expression of that Genomic Record, and, accordingly, determining the cell's fate (analogous to opening the recipe book 8 to a page corresponding to a number on the scribbled note, thereby determining the dish to be prepared). A Genomic Record may also comprise multiple short RNA segments, each of which binds complementarily to a target protein-coding gene, thus modulating expression of this target gene. The Genomic Records concept is analogous to the shorthand format illustrated by FIG. 4 whereby a page, such as page 127, designated by reference numeral 10, points to other pages, such as pages 118, 175 and 183, designated by reference numerals 31-33 respectively, encoding various ingredients, such as flour 34, milk 35 and salt 36, all of FIG. 4.

Reference is now made to FIG. 5A. FIG. 5A illustrates a cell 37 having a genome 38. The genome 38 comprises a plurality of Genomic Records, some of which correspond to specific cell types. As an example, six such genomic records are shown, corresponding to six cell types: lymphocyte (LYMPH) genomic record 39, fibroblast (FIBRO) genomic record 40, muscle genomic record 41, bone genomic record 42, cartilage (CARTIL.) genomic record 43 and nerve genomic record 44. Each genomic record comprises genomic instructions on differentiation into a specific cell type, as further elaborated hereinbelow with reference to FIG. 7. At its inception, cell 37 receives a material short RNA segment 46, which activates one of the genomic records, causing the cell to differentiate according to the instructions this genomic record comprises. As an example, FIG. 5A illustrates cell 37 reception of a maternal short RNA segment, designated by reference numeral 46 and outlined by a broken line, having a nucleotide sequence herein symbolically represented by A'.

The fibroblast genomic record 40 contains a binding site having a nucleotide sequence symbolically represented by A, which is complementary to the nucleotide sequence of A', and therefore the short RNA segment 46 binds to the fibroblast genomic record 40. This binding activates the fibroblast genomic record, causing cell 37 to differentiate into a fibroblast cell 3 (FIG. 1). Other genomic records, designated by reference numerals 39 and 41-44, comprise binding sites having nucleotide sequences that are symbolically represented by F, E, B, C and D respectively, which are not complementary to the nucleotide sequence of the short RNA segment 46 symbolically represented by A' and are therefore not activated by it. Genomic Records, such as the fibroblast genomic record 40, contain additional information, designated by reference numeral 45, which is further elaborated hereinbelow with reference to FIGS. 6 and 7.

Reference is now made to FIG. 5B, which is a simplified schematic diagram that illustrates a concept of cellular differentiation that is mediated by Genomic Records. FIG. 5B depicts two cells in an organism, cell A designated by reference numeral 47 and cell B designated by reference numeral 48, each having a genome 38. It is appreciated that since cell A 47 and cell B 48 are cells in the same organism, the genome 38 of cells 47 and 48 is identical. Despite having an identical genome 38, cell A 47 differentiates differently from cell B 48 due to the activation of different genomic records in these two cells. In cell A 47, the fibroblast genomic record 40 is activated, causing cell A 47 to differentiate into a fibroblast cell 3, whereas in cell B 48, the bone genomic record 42 is activated, causing cell B 48 to differentiate into a bone cell 4 (FIG. 1). The activation of different genomic records in these two cells is due to the different maternal short RNA segments which each received. Cell A 47 received a maternal short RNA segment designated 46 bearing a nucleotide sequence represented by A' that activates the fibroblast genomic record 40, whereas cell B 48 received a maternal short RNA segment designated 49 bearing a nucleotide sequence represented by B' that activates the bone genomic record 42.

Figure 6:
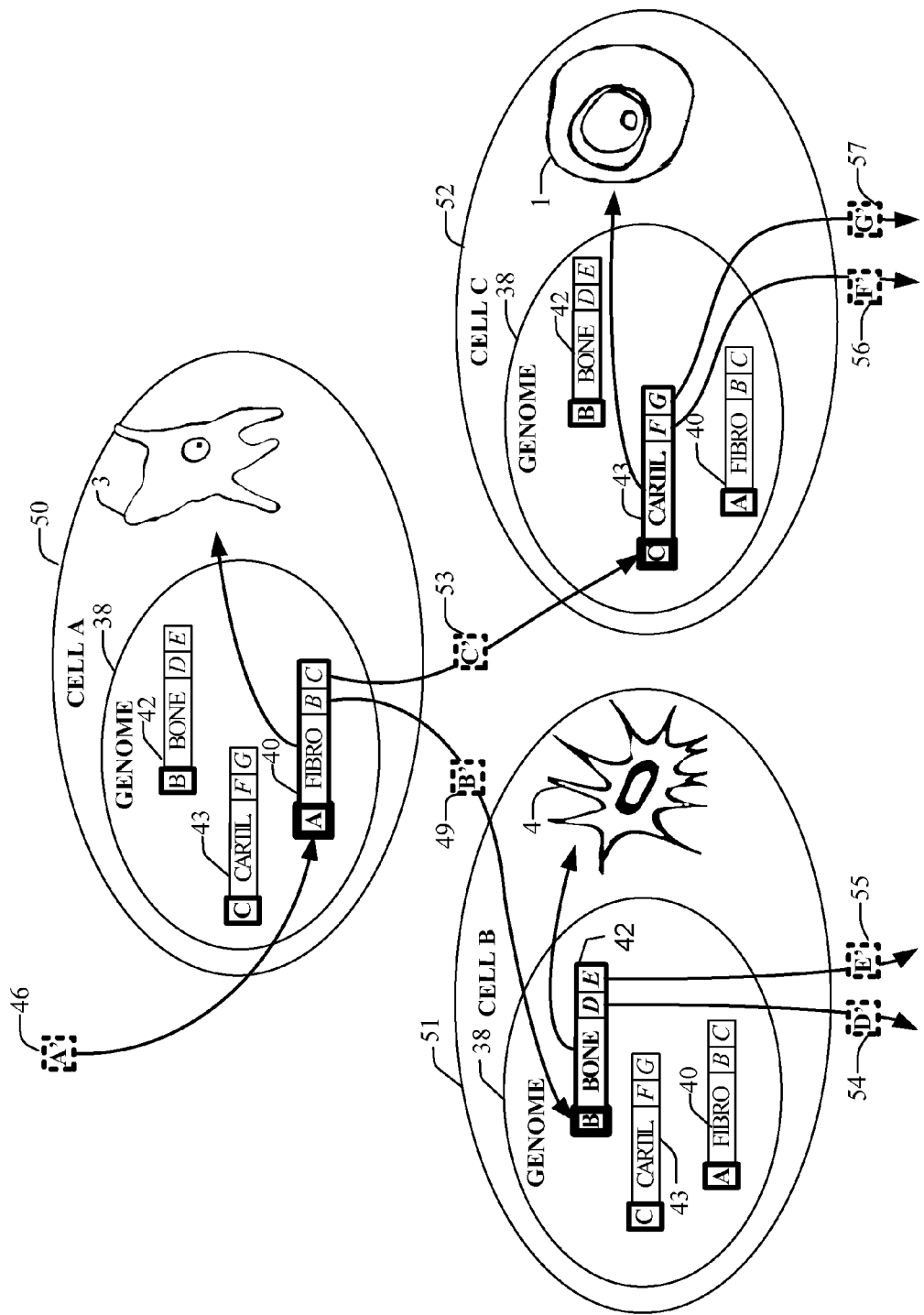
FIG. 6 is a schematic diagram illustrating a "genomically programmed cell differentiation" concept of the conceptual model of the present invention, addressing the genomic differentiation enigma.

Reference is now made to FIG. 6 which is a schematic diagram illustrating a "genomically programmed cell differentiation" concept of the conceptual model of the present invention, addressing the genomic differentiation enigma.

A cell designated cell A 50 divides into 2 cells designated cell B 51 and cell C 52. Cell A 50, cell B 51 and cell C 52 each comprise a genome 38. Each genome 38 comprises a plurality of genomic records, herein exemplified by reference numerals 40, 42 and 43. It is appreciated that since cell A 50, cell B 51 and cell C 52 are cells in the same organism, the genome 38 of these cells, and the genomic records of these cells, exemplified by 40, 42 and 43, are identical.

As described above with reference to FIG. 5B, at its inception, cell A 50 receives a maternal short RNA segment, designated by reference numeral 46 and outlined by a broken line, having nucleotide sequence represented by A'. This short RNA sequence activates the fibroblast genomic record 40, thereby causing cell A 50 to differentiate into a fibroblast cell 3. However, FIG. 6 elaborates on some of the additional information 45 of FIG. 5A of the genomic records. Specifically, a genomic record may also comprise two short genomic sequences, referred to here as Daughter Cell Genomic Addresses. Blocks designated B and C within the fibroblast genomic record in cell A 50 are Daughter Cell Genomic Addresses of the fibroblast genomic record. At cell division, each parent cell transcribes two short RNA segments, corresponding to the two Daughter Cell Genomic Addresses of the genomic record of that parent cell. The parent cell then transfers one of the Daughter Cell Genomic Addresses to each of its two daughter cells. As an example, cell A 50 transcribes and transfers to its two daughter cells 51 and 52 two short RNA segments, designated by reference numerals 49 and 53 and outlined by a broken line. The nucleotide sequences of these two short RNA segments, represented by B' and C' respectively, are complementary to the daughter cell genomic addresses designated B and C comprised in the fibroblast genomic record 40.

Cell B 51 therefore receives the abovementioned maternal short RNA segment designated 49, having a nucleotide sequence represented by B', which binds complementarily to the genomic address B of the bone genomic record 42. The binding of the nucleotide sequence B' to the genomic address B activates this genomic record, which in turn causes cell B 51 to differentiate into a bone cell 4. Similarly, cell C 52 receives the abovementioned maternal short RNA segment designated 53 having a nucleotide sequence represented by C', which binds complementarily to the genomic address C of the cartilage genomic record 43. The binding of the nucleotide sequence C' to the genomic address C activates this genomic record, which in turn causes cell C 52 to differentiate into a cartilage cell 1 (FIG. 1).

It is appreciated that the mechanism illustrated by FIG. 6 enables the determination of the cell fate of an unlimited lineage of daughter cells containing the same DNA 5 (FIG. 1). For example, when cell B 51 and cell C 52 divide into their respective daughter cells (not shown), they transfer the short RNA segments designated by reference numerals 54-57 to their respective daughter cells. The genomic record that is activated in each of these daughter cells is affected by the identity of the maternal short RNA segments 54-57 that they each receive, which in turn determines their cell fate.

Figure 7:
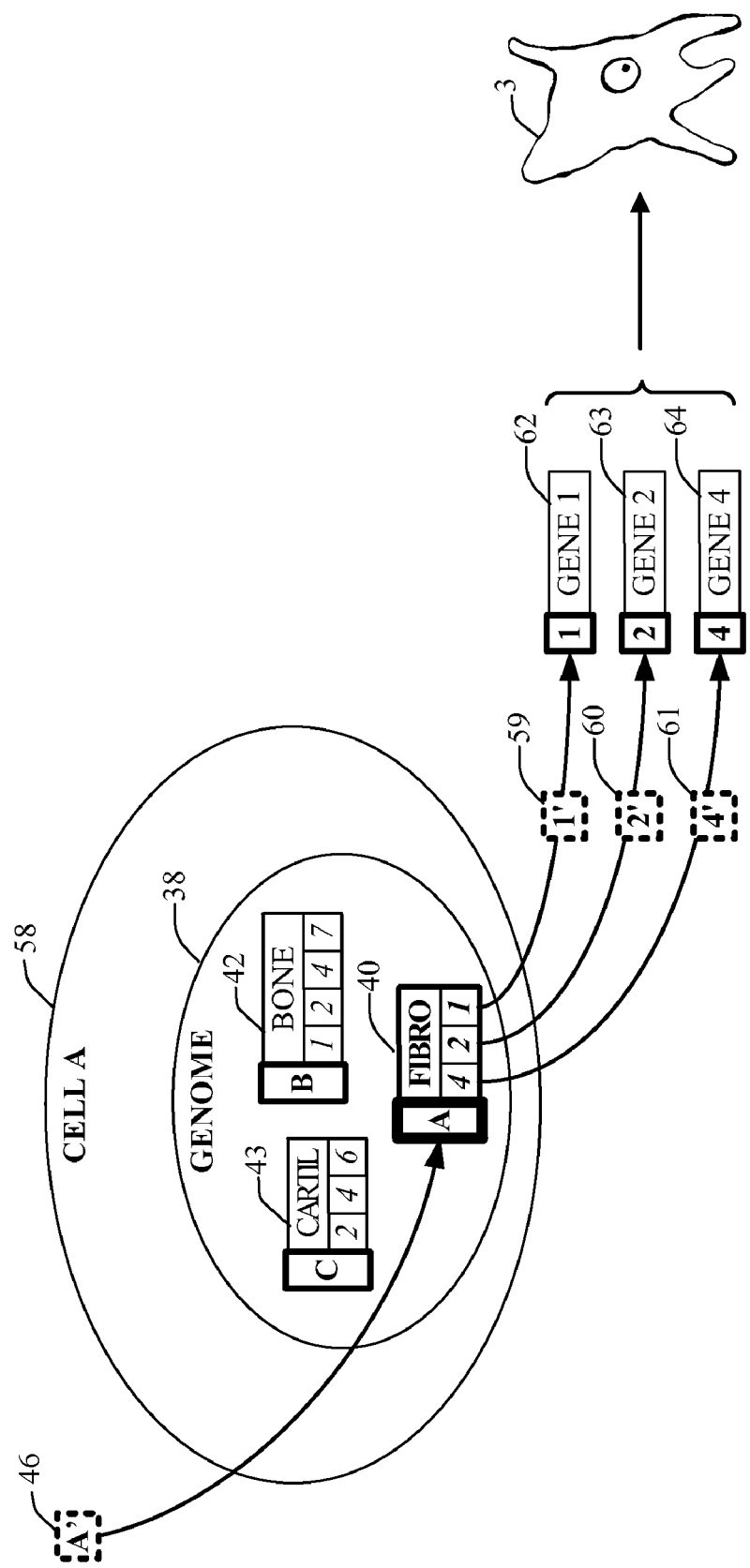
FIG. 7 is a schematic diagram illustrating a "genomically programmed cell-specific protein expression modulation" concept of the conceptual model of the present invention, addressing the genomic differentiation enigma.

Reference is now made to FIG. 7 which is a schematic diagram illustrating a "genomically programmed cell-specific protein expression modulation" concept of the conceptual model of the present invention, addressing the genomic differentiation enigma.

Cell A 58 receives a maternal short RNA segment designated 46 having a nucleotide sequence represented by A'. This maternal short RNA segment 46 activates the fibroblast genomic record 40 by complementarily binding to a binding site in the fibroblast genomic record, whose nucleotide sequence is designated A, and is complementary to the nucleotide sequence represented by A'. This is similar to the process shown in FIG. 5A. However, FIG. 7 further elaborates on some of the additional information 45 (FIG. 5A). The fibroblast genomic record 40 comprises three short nucleotide segments, whose nucleotide sequences are symbolically represented by 1, 2 and 4 respectively. These short nucleotide segments encode three respective short RNA oligonucleotides, designated by reference numerals 59-61. Each of these short RNA oligonucleotides modulates expression of a respective one of the target genes GENE 1, GENE 2 and GENE 4, designated by reference numerals 62-64 respectively, by complementarily binding to a binding site sequence associated with that target gene. In a preferred embodiment of the present invention, the translation inhibition of target genes by complementarily binding to binding sites located in UTRs of the target genes modulates the expression of target genes such as 62-64. Cell A 58 thus differentiates into a fibroblast cell 3 (see also FIG. 1) because the expression of genes 1, 2 and 4 was modulated.

It is appreciated that the concept of genomic records is compatible with features of miRNA-like oligonucleotides of the present invention. A genomic record may comprise a cluster of short RNA segments that modulates the expression of target genes and thus influences differentiation. These features of genomic records are similar to the clusters of miRNA-like oligonucleotides of the present invention, which inhibit the translation of their respective target genes by complementarily binding to binding sites located in the of mRNA of these target genes.

Figure 8:
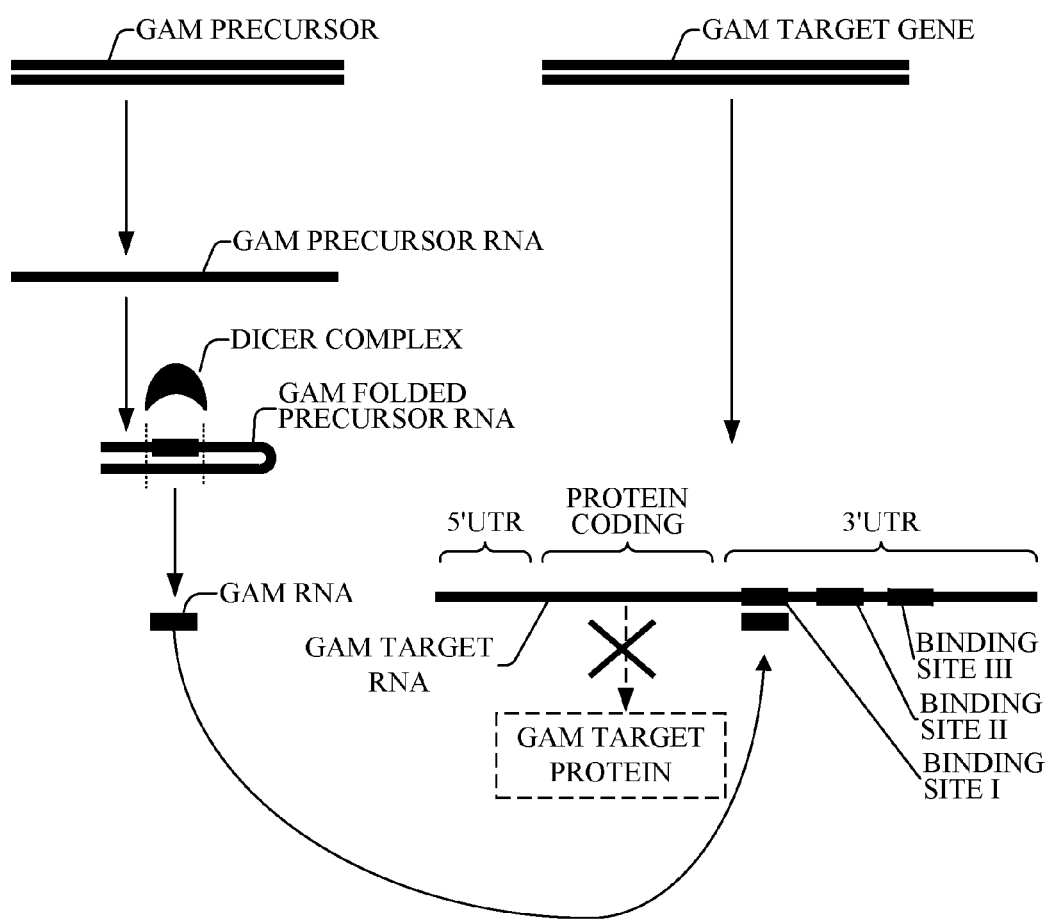
FIG. 8 is a simplified diagram illustrating a mode by which an oligonucleotide of a novel group of oligonucleotides of the present invention modulates expression of known target genes.

Reference is now made to FIG. 8, which is a simplified diagram describing a plurality of novel bioinformatically-detected oligonucleotide of the present invention referred to here as the Genomic Address Messenger (GAM) oligonucleotide, which modulates the expression of respective target genes whose function and utility are known in the art.

GAM is a novel bioinformatically detectable regulatory, non-protein-coding, miRNA-like oligonucleotide. The method by which GAM is detected is described with additional reference to FIGS. 8-15.

The GAM PRECURSOR is encoded by the human genome. The GAM TARGET GENE is a gene encoded by the human genome.

The GAM PRECURSOR encodes a GAM PRECURSOR RNA. Similar to other miRNA oligonucleotides, the GAM PRECURSOR RNA does not encode a protein.

GAM PRECURSOR RNA folds onto itself, forming GAM FOLDED PRECURSOR RNA, which has a two-dimensional "hairpin" structure. GAM PRECURSOR RNA folds onto itself, forming GAM FOLDED PRECURSOR RNA, which has a two-dimensional "hairpin structure". As is well-known in the art, this "hairpin structure" is typical of RNA encoded by known miRNA precursor oligonucleotides and is due to the full or partial complementarity of the nucleotide sequence of the first half of an miRNA precursor to the RNA that is encoded by a miRNA oligonucleotide to the nucleotide sequence of the second half thereof.

A complementary sequence is a sequence which is reversed and wherein each nucleotide is replaced by a complementary nucleotide, as is well known in the art (e.g. ATGGC is the complementary sequence of GCCAT).

An enzyme complex designated DICER COMPLEX, an enzyme complex composed of Dicer RNaseIII together with other necessary proteins, cuts the GAM FOLDED PRECURSOR RNA yielding a single-stranded ~22 nt-long RNA segment designated GAM RNA.

GAM TARGET GENE encodes a corresponding messenger RNA, designated GAM TARGET RNA. As is typical of mRNA of a protein-coding gene, each GAM TARGET RNAs of the present invention comprises three regions, as is typical of mRNA of a protein-coding gene: a 5' untranslated region, a protein-coding region and a 3' untranslated region, designated 5'UTR, PROTEIN-CODING and 3'UTR, respectively.

GAM RNA binds complementarily to one or more target binding sites located in the untranslated regions of each of the GAM TARGET RNAs of the present invention. This complementary binding is due to the partial or full complementarity between the nucleotide sequence of GAM RNA and the nucleotide sequence of each of the target binding sites. As an illustration, FIG. 8 shows three such target binding sites, designated BINDING SITE I, BINDING SITE II and BINDING SITE III, respectively. It is appreciated that the number of target binding sites shown in FIG. 8 is only illustrative and that any suitable number of target binding sites may be present. It is further appreciated that although FIG. 8 shows target binding sites only in the 3'UTR region, these target binding sites may instead be located in the 5'UTR region or in both the 3'UTR and 5'UTR regions.

The complementary binding of GAM RNA to target binding sites on GAM TARGET RNA, such as BINDING SITE I, BINDING SITE II and BINDING SITE III, inhibits the translation of each of the GAM TARGET RNAs of the present invention into respective GAM TARGET PROTEIN, shown surrounded by a broken line.

It is appreciated that the GAM TARGET GENE in fact represents a plurality of GAM target genes. The mRNA of each one of this plurality of GAM target genes comprises one or more target binding sites, each having a nucleotide sequence which is at least partly complementary to GAM RNA and which when bound by GAM RNA causes inhibition of translation of the GAM target mRNA into a corresponding GAM target protein.

The mechanism of the translational inhibition that is exerted by GAM RNA on one or more GAM TARGET GENEs may be similar or identical to the known mechanism of translational inhibition exerted by known miRNA oligonucleotides.

The nucleotide sequences of each of a plurality of GAM oligonucleotides that are described by FIG. 8 and their respective genomic sources and genomic locations are set forth in Tables 1-3, hereby incorporated herein.

The nucleotide sequences of GAM PRECURSOR RNAs, and a schematic representation of a predicted secondary folding of GAM FOLDED PRECURSOR RNAs, of each of a plurality of GAM oligonucleotides that are described by FIG. 8 are set forth in Table 4, hereby incorporated herein.

The nucleotide sequences of "diced" GAM RNAs of each of a plurality of GAM oligonucleotides that are described by FIG. 8 are set forth in Table 5, hereby incorporated herein.

The nucleotide sequences of target binding sites, such as BINDING SITE I, BINDING SITE II and BINDING SITE III that are found on GAM TARGET RNAs of each of a plurality of GAM oligonucleotides that are described by FIG. 8, and a schematic representation of the complementarity of each of these target binding sites to each of a plurality of GAM RNAs that are described by FIG. 8 are set forth in Tables 6-7, hereby incorporated herein.

It is appreciated that the specific functions and accordingly the utilities of each of a plurality of GAM oligonucleotides that are described by FIG. 8 are correlated with and may be deduced from the identity of the GAM TARGET GENES inhibited thereby, and whose functions are set forth in Table 8, hereby incorporated herein.

Studies documenting the well known correlations between each of a plurality of GAM TARGET GENEs that are described by FIG. 8 and the known gene functions and related diseases are listed in Table 9, hereby incorporated herein.

The present invention discloses a novel group of human oligonucleotides, belonging to the miRNA-like oligonucleotide group, here termed GAM oligonucleotides, for which a specific complementary binding has been determined bioinformatically.

Reference is now made to FIG. 9 which is a simplified block diagram illustrating a bioinformatic oligonucleotide detection system and method constructed and operative in accordance with a preferred embodiment of the present invention.

An important feature of the present invention is a bioinformatic oligonucleotide detection engine 100, which is capable of bioinformatically detecting oligonucleotides of the present invention.

The functionality of the bioinformatic oligonucleotide detection engine 100 includes receiving expressed RNA data 102, sequenced DNA data 104, and PROTEIN FUNCTION DATA 106; performing a complex process of analysis of this data as elaborated hereinbelow, and based on this analysis provides information, designated by reference numeral 108, identifying and describing features of novel oligonucleotides.

Expressed RNA data 102 comprises published expressed sequence tags (EST) data, published mRNA data, as well as other published RNA data. Sequenced DNA data 104 comprises alphanumeric data representing genomic sequences and preferably including annotations such as information indicating the location of known protein-coding regions relative to the genomic sequences.

PROTEIN FUNCTION DATA 106 comprises information from scientific publications e.g. physiological functions of known proteins and their connection, involvement and possible utility in treatment and diagnosis of various diseases.

Expressed RNA data 102 and sequenced DNA data 104 may preferably be obtained from data published by the National Center for Biotechnology Information (NCBI) at the National Institute of Health (NIH) (Jenuth, J. P. (2000). Methods Mol. Biol. 132:301-312 (2000), herein incorporated by reference) as well as from various other published data sources. PROTEIN FUNCTION DATA 106 may preferably be obtained from any one of numerous relevant published data sources, such as the Online Mendelian Inherited Disease In Man (OMIM™, Hamosh et al., Nucleic Acids Res. 30: 52-55 (2002)) database developed by John Hopkins University, and also published by NCBI (2000).

Prior to or during actual detection of BIOINFORMATICALLY-DETECTED GROUP OF NOVEL OLIGONUCLE- OTIDES 108 by the bioinformatic oligonucleotide detection engine 100, bioinformatic oligonucleotide detection engine training & validation functionality 110 is operative. This functionality uses one or more known miRNA oligonucleotides as a training set to train the bioinformatic oligonucleotide detection engine 100 to bioinformatically recognize miRNA-like oligonucleotides, and their respective potential target binding sites. BIOINFORMATIC OLIGONUCLEOTIDE DETECTION ENGINE TRAINING &VALIDATION FUNCTIONALITY 110 is further described hereinbelow with reference to FIG. 10.

The bioinformatic oligonucleotide detection engine 100 preferably comprises several modules which are preferably activated sequentially, and are described as follows:

A NON-CODING GENOMIC SEQUENCE DETECTOR 112 operative to bioinformatically detect non-protein-coding genomic sequences. The non-protein-coding genomic sequence detector 112 is further described herein below with reference to FIGS. 11A and 11B.

A hairpin detector 114 operative to bioinformatically detect genomic "hairpin-shaped" sequences, similar to GAM FOLDED PRECURSOR RNA (FIG. 8). The hairpin detector 114 is further described herein below with reference to FIGS. 12A and 12B.

A Dicer-cut location detector 116 operative to bioinformatically detect the location on a GAM FOLDED PRECURSOR RNA which is enzymatically cut by DICER COMPLEX (FIG. 8), yielding "diced" GAM RNA. The Dicer-cut location detector 116 is further described herein below with reference to FIGS. 13A-13C.

A target gene binding site detector 118 operative to bioinformatically detect target genes having binding sites, the nucleotide sequence of which is partially complementary to that of a given genomic sequence, such as a nucleotide sequence cut by DICER COMPLEX. The target gene binding site detector 118 is further described hereinbelow with reference to FIGS. 14A and 14B.

A function & utility analyzer, designated by reference numeral 120, is operative to analyze the function and utility of target genes in order to identify target genes which have a significant clinical function and utility. The function & utility analyzer 120 is further described hereinbelow with reference to FIG. 15

According to an embodiment of the present invention, the bioinformatic oligonucleotide detection engine 100 may employ a cluster of 40 personal computers (PCs; XEON®, 2.8 GHz, with 80 GB storage each) connected by Ethernet to eight servers (2-CPU, XEON™ 1.2-2.2 GHz, with ~200 GB storage each) and combined with an 8-processor server (8-CPU, Xeon 550 Mhz w/8 GB RAM) connected via 2 HBA fiber-channels to an EMC CLARIION™ 100-disks, 3.6 Terabyte storage device. A preferred embodiment of the present invention may also preferably comprise software that utilizes a commercial database software program, such as MICROSOFT™ SQL Server 2000.

According to a preferred embodiment of the present invention, the bioinformatic oligonucleotide detection engine 100 may employ a cluster of 80 Servers (XEON®, 2.8 GHz, with 80 GB storage each) connected by Ethernet to eight servers (2-CPU, XEON™ 1.2-2.2 GHz, with ~200 GB storage each) and combined with storage device (Promise Technology Inc., RM8000) connected to an 8-disks, 2 Terabytes total. A preferred embodiment of the present invention may also preferably comprise software that utilizes a commercial database software program, such as MICROSOFT™ SQL Server 2000. It is appreciated that the abovementioned hardware configuration is not meant to be limiting and is given as an illustration only. The present invention may be implemented in a wide variety of hardware and software configurations.

The present invention discloses 122764 novel oligonucleotides of the GAM group of oligonucleotides, which have been detected bioinformatically and 18602 novel polynucleotides of the GR group of polynucleotides, which have been detected bioinformatically. Laboratory confirmation of bioinformatically predicted oligonucleotides of the GAM group of oligonucleotides, and several bioinformatically predicted polynucleotides of the GR group of polynucleotides, is described hereinbelow with reference to FIGS. 21-24D. FIG. 27 and TABLE_13.txt.

Reference is now made to FIG. 10 which is a simplified flowchart illustrating operation of a preferred embodiment of the bioinformatic oligonucleotide detection engine training & validation functionality 110 described hereinabove with reference to FIG. 9.

bioinformatic oligonucleotide detection engine training & validation functionality 110 begins by training the bioinformatic oligonucleotide detection engine 100 (FIG. 9) to recognize one or more known miRNA oligonucleotides, as designated by reference numeral 122. This training step comprises hairpin detector training & validation functionality 124, further described hereinbelow with reference to FIG. 12A, Dicer-cut location detector training & validation functionality 126, further described hereinbelow with reference to FIGS. 13A and 13B, and target gene binding site detector training & validation functionality 128, further described hereinbelow with reference to FIG. 14A.

Next, the bioinformatic oligonucleotide detection engine training & validation functionality 110 is operative bioinformatically detect novel oligonucleotides, using bioinformatic oligonucleotide detection engine 100 (FIG. 9), as designated by reference numeral 130. Wet lab experiments are preferably conducted in order to validate expression and preferably function of some samples of the novel oligonucleotides detected by the bioinformatic oligonucleotide detection engine 100, as designated by reference numeral 132. FIGS. 22A-24D and Table 13 illustrate examples of wet lab validation of sample novel human oligonucleotides bioinformatically-detected in accordance with a preferred embodiment of the present invention.

Figure 11A:
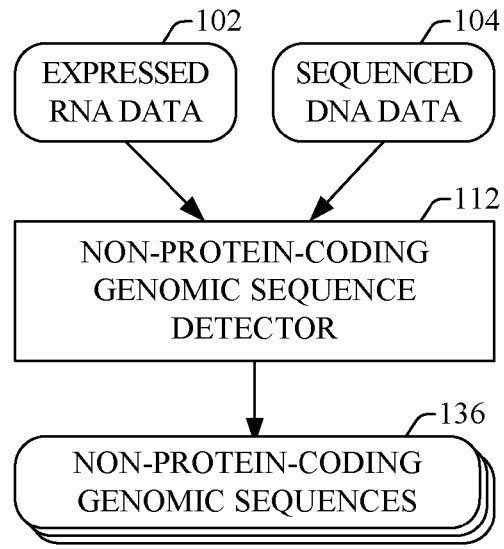
FIG. 11A is a simplified block diagram of a non-coding genomic sequence detector constructed and operative in accordance with a preferred embodiment of the present invention.

Reference is now made to FIG. 11A which is a simplified block diagram of a preferred implementation of the non-protein-coding genomic sequence detector 112 described hereinabove with reference to FIG. 9. The non-protein-coding genomic sequence detector 112 preferably receives at least two types of published genomic data: Expressed RNA data 102 and sequenced DNA data 104. The expressed RNA data 102 may include, inter alia, EST data, EST clusters data, EST genome alignment data and mRNA data. Sources for expressed RNA data 102 include NCBI dbEST, NCBI UniGene clusters and mapping data, and TIGR gene indices (Kirkness F. and Kerlavage, A. R., Methods Mol. Biol. 69:261-268 (1997)). Sequenced DNA data 104 may include sequence data (FASTA format files), and feature annotations (GenBank file format) mainly from NCBI databases. Based on the above mentioned input data, the non-protein-coding genomic sequence detector 112 produces a plurality of non-protein-coding genomic sequences 136. Preferred operation of the non-protein-coding genomic sequence detector 112 is described hereinbelow with reference to FIG. 11B.

Figure 11B:
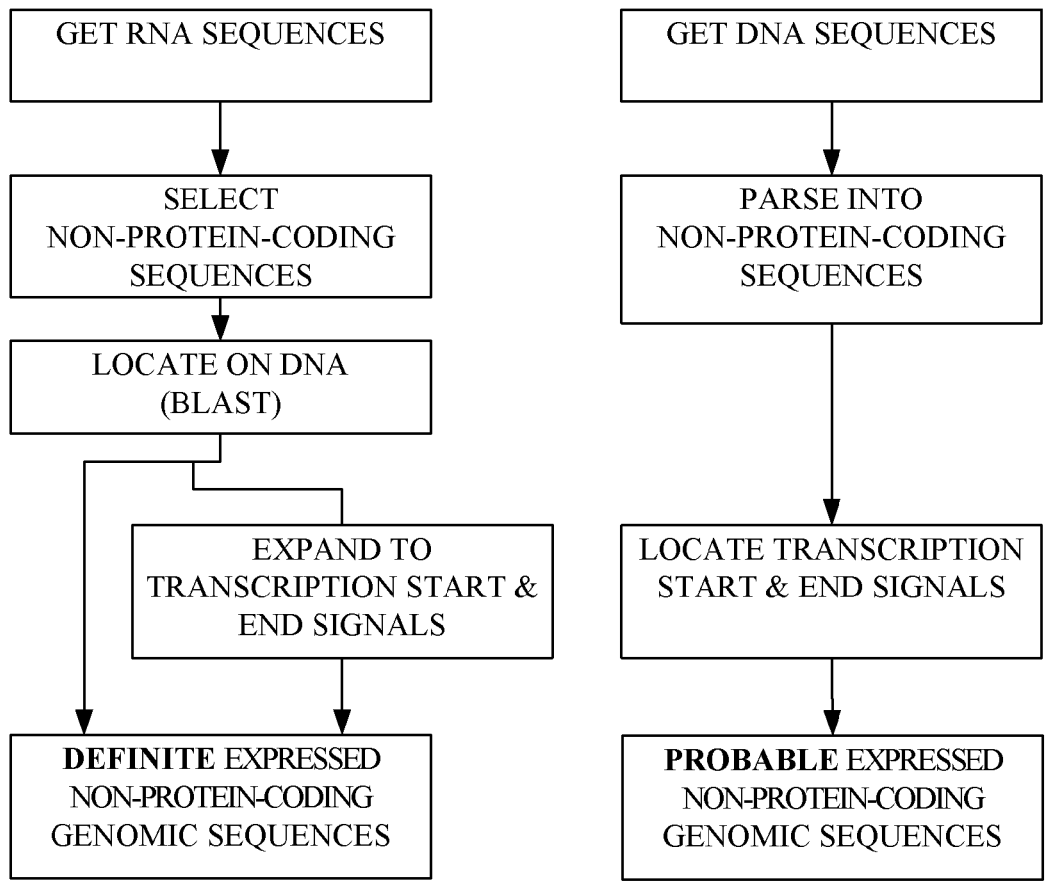
FIG. 11B is a simplified flowchart illustrating operation of a non-coding genomic sequence detector constructed and operative in accordance with a preferred embodiment of the present invention.

Reference is now made to FIG. 11B which is a simplified flowchart illustrating a preferred operation of the non-protein-coding genomic sequence detector 112 of FIG. 9. Detection of non-protein-coding genomic sequences 136, generally preferably progresses along one of the following two paths:

A first path for detecting non-protein-coding genomic sequences 136 (FIG. 11A) begins with receipt of a plurality of known RNA sequences, such as EST data. Each RNA sequence is first compared with known protein-coding DNA sequences, in order to select only those RNA sequences which are non-protein-coding, i.e. intergenic or intronic sequences. This can preferably be performed by using one of many alignment algorithms known in the art, such as BLAST (Altschul et al., J. Mol. Biol. 215:403-410 (1990)). This sequence comparison preferably also provides localization of the RNA sequence on the DNA sequences.

Alternatively, selection of non-protein-coding RNA sequences and their localization on the DNA sequences can be performed by using publicly available EST cluster data and genomic mapping databases, such as the UNIGENE database published by NCBI or the TIGR database. Such databases, map expressed RNA sequences to DNA sequences encoding them, find the correct orientation of EST sequences, and indicate mapping of ESTs to protein-coding DNA regions, as is well known in the art. Public databases, such as TIGR, may also be used to map an EST to a cluster of ESTs, known in the art as Tentative Human Consensus and assumed to be expressed as one segment. Publicly available genome annotation databases, such as NCBI's GenBank, may also be used to deduce expressed intronic sequences.

Optionally, an attempt may be made to "expand" the non-protein RNA sequences thus found, by searching for transcription start and end signals, respectively upstream and downstream of the location of the RNA on the DNA, as is well known in the art.

A second path for detecting non-protein-coding genomic sequences 136 (FIG. 11A) begins with receipt of DNA sequences. The DNA sequences are parsed into non-protein-coding sequences, using published DNA annotation data, by extracting those DNA sequences which are between known protein-coding sequences. Next, transcription start and end signals are sought. If such signals are found, and depending on their robustness, probable expressed non-protein-coding genomic sequences are obtained. Such approach is especially useful for identifying novel GAM oligonucleotides which are found in proximity to other known miRNA oligonucleotides, or other wet lab validated GAM oligonucleotides. Since, as described hereinbelow with reference to FIG. 16, GAM oligonucleotides are frequently found in clusters; sequences located near known miRNA oligonucleotides are more likely to contain novel GAM oligonucleotides. Optionally, sequence orthology, i.e. sequence conservation in an evolutionary related species, may be used to select genomic sequences having a relatively high probability of containing expressed novel GAM oligonucleotides.

Figure 12A:
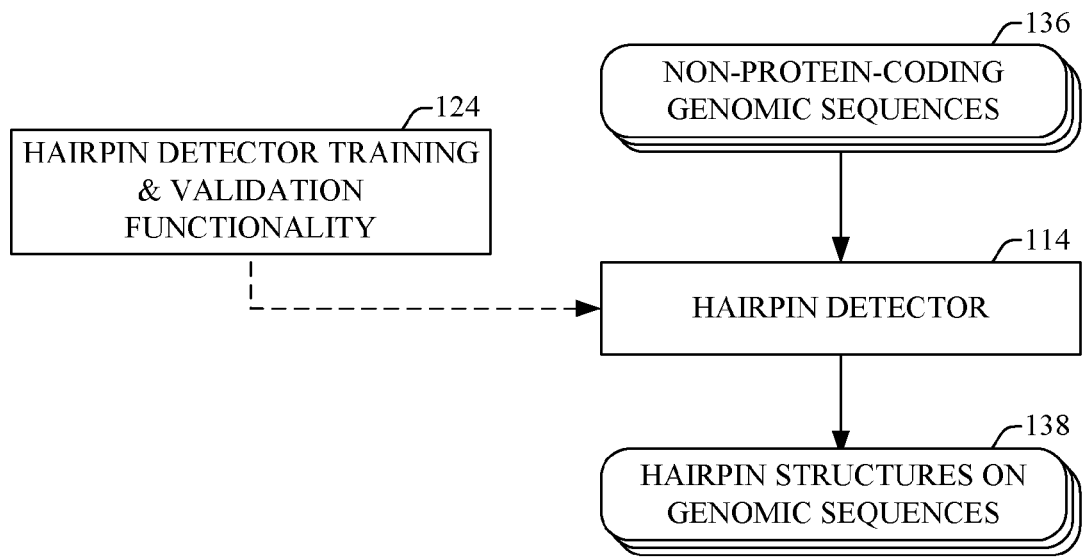
FIG. 12A is a simplified block diagram of a hairpin detector constructed and operative in accordance with a preferred embodiment of the present invention.

Reference is now made to FIG. 12A which is a simplified block diagram of a preferred implementation of the hairpin detector 114 described hereinabove with reference to FIG. 9.

The goal of the hairpin detector 114 is to detect hairpin-shaped genomic sequences, similar to those of known miRNA oligonucleotides. A hairpin-shaped genomic sequence is a genomic sequence, having a first half which is at least partially complementary to a second half thereof, which causes the halves to folds onto themselves, thereby forming a hairpin structure, as mentioned hereinabove with reference to FIG. 8.

The hairpin detector 114 (FIG. 9) receives a plurality of non-protein-coding genomic sequences 136 (FIG. 11A). Following operation of hairpin detector training & validation functionality 124 (FIG. 10), the hairpin detector 114 is operative to detect and output hairpin-shaped sequences, which are found in the non-protein-coding genomic sequences 136. The hairpin-shaped sequences detected by the hairpin detector 114 are designated hairpin structures on genomic sequences 138. A preferred mode of operation of the hairpin detector 114 is described hereinbelow with reference to FIG. 12B.

hairpin detector training & validation functionality 124 includes an iterative process of applying the hairpin detector 114 to known hairpin-shaped miRNA precursor sequences, calibrating the hairpin detector 114 such that it identifies a training set of known hairpin-shaped miRNA precursor sequences, as well as other similarly hairpin-shaped sequences. In a preferred embodiment of the present invention, the hairpin detector training & validation functionality 124 trains the hairpin detector 114 and validates each of the steps of operation thereof described hereinbelow with reference to FIG. 12B

The hairpin detector training & validation functionality 124 preferably uses two sets of data: the aforesaid training set of known hairpin-shaped miRNA precursor sequences, such as hairpin-shaped miRNA precursor sequences of 440 miRNA oligonucleotides of *H. sapiens, M. musculus, C. elegans, C. Brigssae* and *D. Melanogaster*, annotated in the RFAM database (Griffiths-Jones 2003), and a background set of about 1000 hairpin-shaped sequences found in expressed non-protein-coding human genomic sequences. The background set is expected to comprise some valid, previously undetected hairpin-shaped miRNA-like precursor sequences, and many hairpin-shaped sequences which are not hairpin-shaped miRNA-like precursors.

In a preferred embodiment of the present invention the efficacy of the hairpin detector 114 (FIG. 9) is confirmed. For example, when a similarity threshold is chosen such that 87% of the known hairpin-shaped miRNA precursors are successfully predicted, only 21.8% of the 1000 background set of hairpin-shaped sequences are predicted to be hairpin-shaped miRNA-like precursors.

Figure 12B:
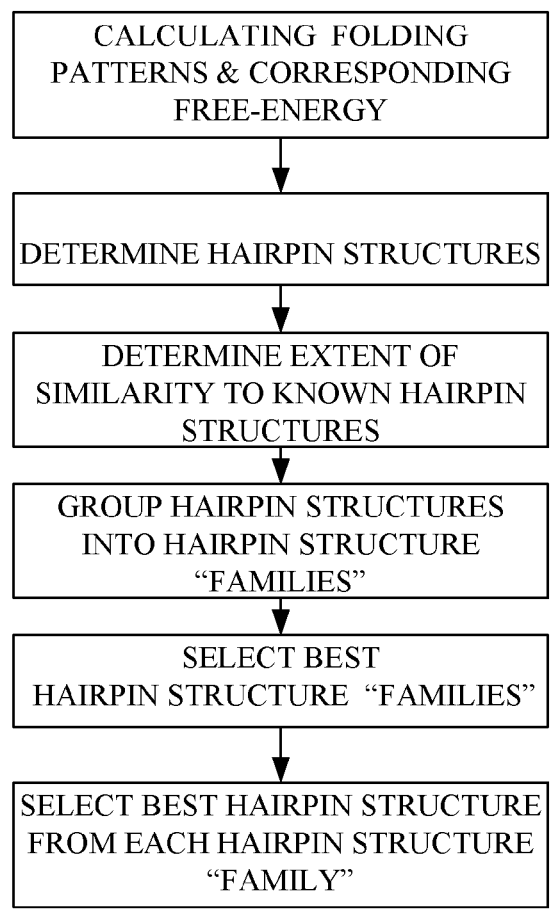
FIG. 12B is a simplified flowchart illustrating operation of a hairpin detector constructed and operative in accordance with a preferred embodiment of the present invention.

Reference is now made to FIG. 12B which is a simplified flowchart illustrating preferred operation of the hairpin detector 114 of FIG. 9. The hairpin detector 114 preferably initially uses a secondary structure folding algorithm based on free-energy minimization, such as the MFOLD algorithm, described in Mathews et al. J. Mol. Biol. 288:911-940 (1999) and Zuker, M. Nucleic Acids Res. 31: 3406-3415 (2003), the disclosure of which is hereby incorporated by reference. This algorithm is operative to calculate probable secondary structure folding patterns of the non-protein-coding genomic sequences 136 (FIG. 11A) as well as the free-energy of each of these probable secondary folding patterns. The secondary structure folding algorithm, such as the MFOLD algorithm (Mathews, 1997; Zuker 2003), typically provides a listing of the base-pairing of the folded shape, i.e. a listing of each pair of connected nucleotides in the sequence.

Next, the hairpin detector 114 analyzes the results of the secondary structure folding patterns, in order to determine the presence and location of hairpin folding structures. The goal of this second step is to assess the base-pairing listing provided by the secondary structure folding algorithm, in order to determine whether the base-pairing listing describes one or more hairpin type bonding pattern. Preferably, sequence segment corresponding to a hairpin structure is then separately analyzed by the secondary structure folding algorithm in order to determine its exact folding pattern and free-energy.

The hairpin detector 114 then assesses the hairpin structures found by the previous step, comparing them to hairpin structures of known miRNA precursors, using various characteristic hairpin structure features such as its free-energy and its thermodynamic stability, the amount and type of mismatched nucleotides and the existence of sequence repeat-elements, number of mismatched nucleotides in positions 18-22 counting from loop, and Percent of G nucleotide. Only hairpins that bear statistically significant resemblance to the training set of hairpin structures of known miRNA precursors, according to the abovementioned parameters, are accepted.

In a preferred embodiment of the present invention, similarity to the training set of hairpin structures of known miRNA precursors is determined using a "similarity score" which is calculated using a multiplicity of terms, where each term is a function of one of the above-mentioned hairpin structure features. The parameters of each function are found heuristically from the set of hairpin structures of known miRNA precursors, as described hereinabove with reference to hairpin detector training & validation functionality 124 (FIG. 10). The selection of the features and their function parameters is optimized so as to achieve maximized separation between the distribution of similarity scores validated miRNA precursor hairpin structures, and the distribution of similarity scores of hairpin structures detected in the background set mentioned hereinabove with reference to FIG. 12B.

In an alternative preferred embodiment of the present invention, the step described in the preceding paragraph may be split into two stages. A first stage implements a simplified scoring method, typically based on thresholding a subset of the hairpin structure features described hereinabove, and may employ a minimum threshold for hairpin structure length and a maximum threshold for free energy. A second stage is preferably more stringent, and preferably employs a full calculation of the weighted sum of terms described hereinabove. The second stage preferably is performed only on the subset of hairpin structures that survived the first stage.

The hairpin detector 114 also attempts to select hairpin structures whose thermodynamic stability is similar to that of hairpin structures of known miRNA precursors. This may be achieved in various ways. A preferred embodiment of the present invention utilizes the following methodology, preferably comprising three logical steps:

First, the hairpin detector 114 attempts to group hairpin structures into "families" of closely related hairpin structures. As is known in the art, a secondary structure folding algorithm typically provides multiple alternative folding patterns, for a given genomic sequence and indicates the free energy of each alternative folding pattern. It is a particular feature of the present invention that the hairpin detector 114 preferably assesses the various hairpin structures appearing in the various alternative folding patterns and groups' hairpin structures which appear at identical or similar sequence locations in various alternative folding patterns into common sequence location based "families" of hairpins. For example, all hairpin structures whose center is within 7 nucleotides of each other may be grouped into a "family". Hairpin structures may also be grouped into a "family" if their nucleotide sequences are identical or overlap to a predetermined degree.

It is also a particular feature of the present invention that the hairpin structure "families" are assessed in order to select only those families which represent hairpin structures that are as thermodynamically stable as those of hairpin structures of known miRNA precursors. Preferably only families which are represented in at least a selected majority of the alternative secondary structure folding patterns, typically 65%, 80% or 100% are considered to be sufficiently stable. Our tests suggest that only about 50% of the hairpin structures, predicted by the MFOLD algorithm with default parameters, are members of sufficiently stable families, comparing to about 90% of the hairpin structures that contain known miRNAs. This percent depends on the size of the fraction that was fold. In an alternative embodiment of the present invention we use fractions of size 1000 nts as preferable size. Different embodiment uses other sizes of genomics sequences, more or less strict demand for representation in the alternative secondary structure folding patterns.

It is an additional particular feature of the present invention that the most suitable hairpin structure is selected from each selected family. For example, a hairpin structure which has the greatest similarity to the hairpin structures appearing in alternative folding patterns of the family may be preferred. Alternatively or additionally, the hairpin structures having relatively low free energy may be preferred.

Alternatively or additionally considerations of homology to hairpin structures of other organisms and the existence of clusters of thermodynamically stable hairpin structures located adjacent to each other along a sequence may be important in selection of hairpin structures. The tightness of the clusters in terms of their location and the occurrence of both homology and clusters may be of significance.

Figure 13A:
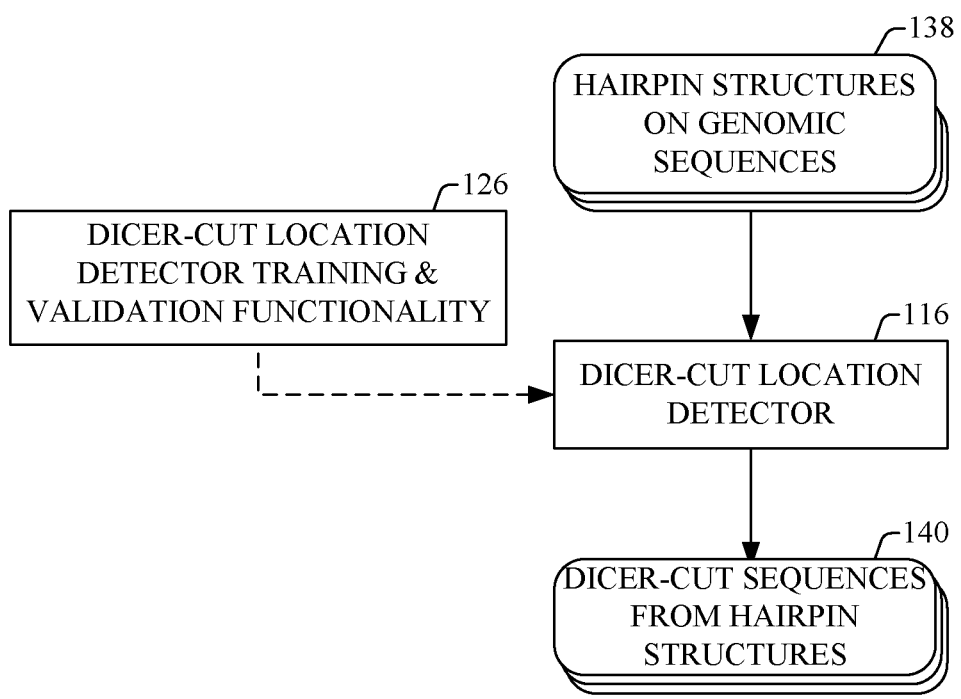
FIG. 13A is a simplified block diagram of a Dicer-cut location detector constructed and operative in accordance with a preferred embodiment of the present invention.
Figure 13B:
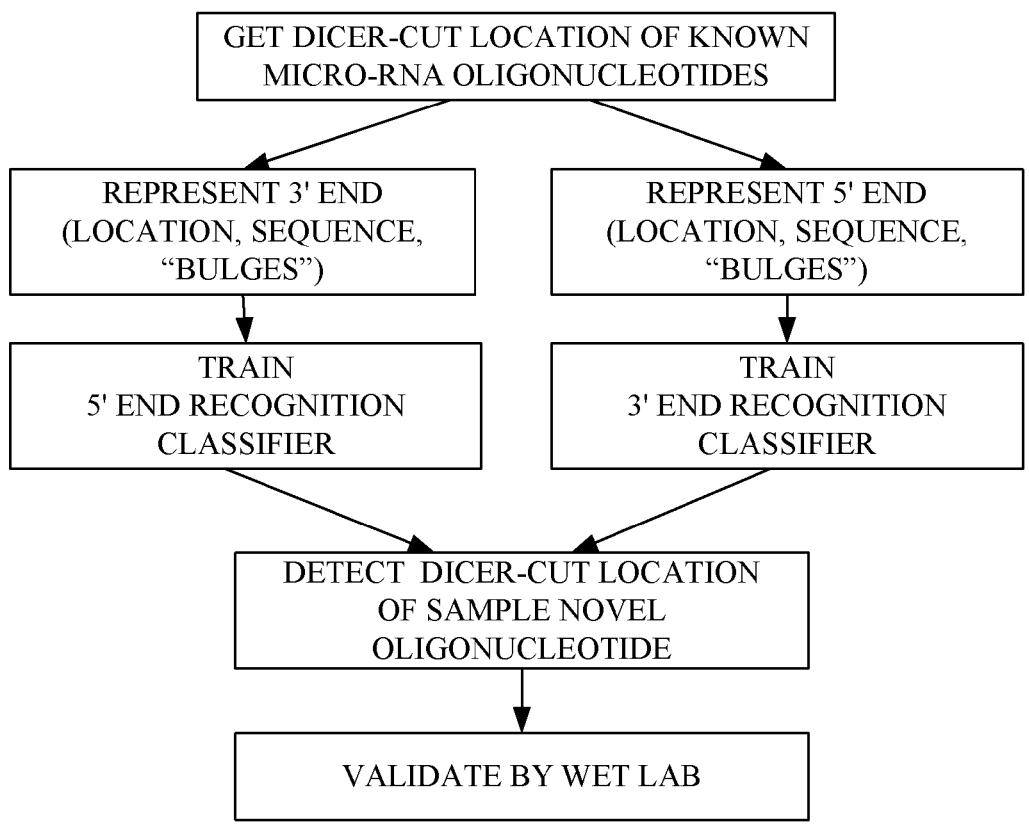
FIG. 13B is a simplified flowchart illustrating training of a Dicer-cut location detector constructed and operative in accordance with a preferred embodiment of the present invention.
Figure 13C:
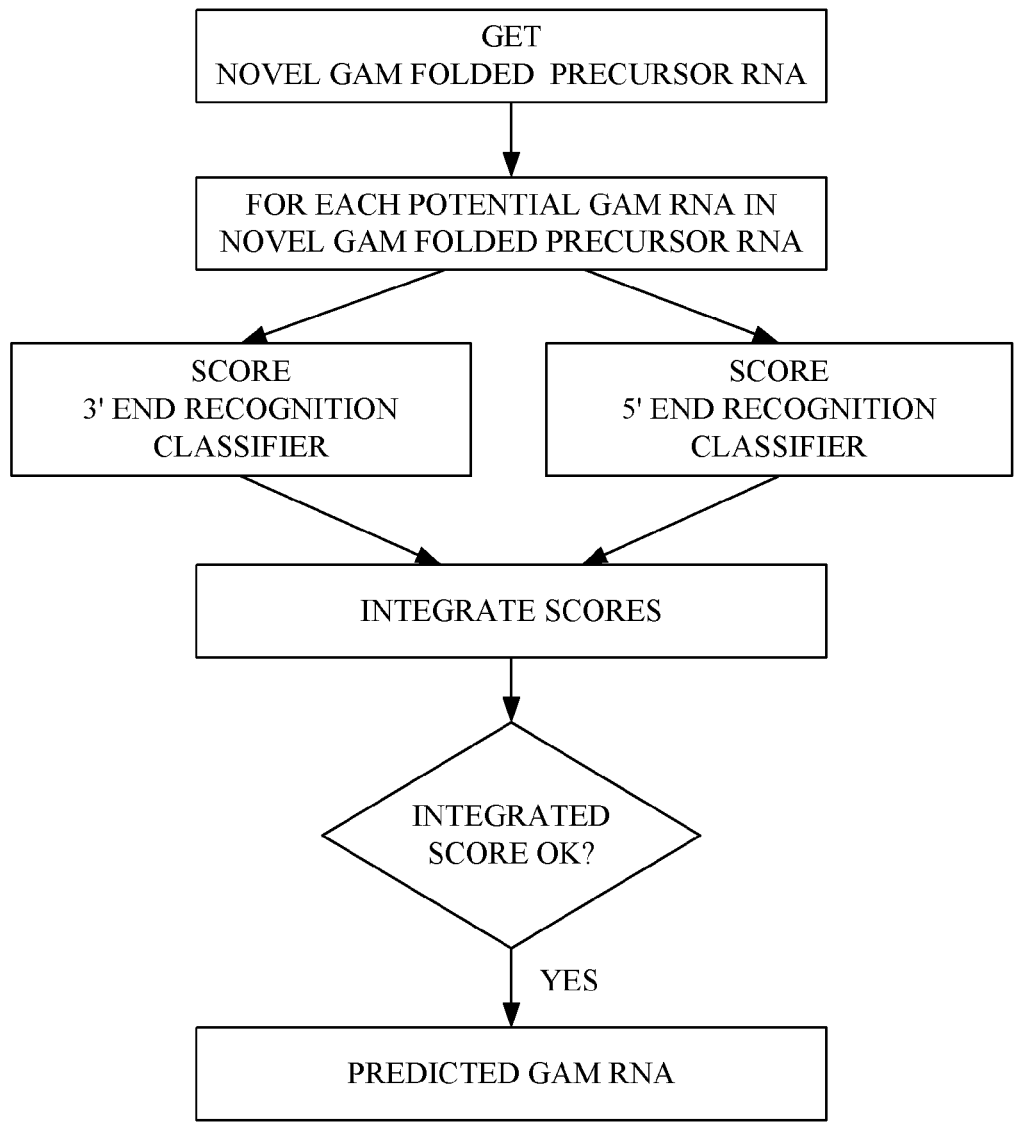
FIG. 13C is a simplified flowchart illustrating operation of a Dicer-cut location detector constructed and operative in accordance with a preferred embodiment of the present invention.

Reference is now made to FIGS. 13A-13C, which together describe the structure and operation of the Dicer-cut location detector 116, described hereinabove with reference to FIG. 9.

Reference is now made to FIG. 13A, which is a simplified block diagram of a preferred implementation of the Dicer-cut location detector 116. The goal of the Dicer-cut location detector 116 is to detect the location in which the DICER COMPLEX, described hereinabove with reference to FIG. 8, dices GAM FOLDED PRECURSOR RNA, yielding GAM RNA.

The Dicer-cut location detector 116 therefore receives a plurality of hairpin structures on genomic sequences, designated by reference numeral 138 (FIG. 12A), and following operation of Dicer-cut location detector training & validation functionality 126 (FIG. 10), is operative to detect a plurality of Dicer-cut sequences from hairpin structures, designated by reference numeral 140.

Reference is now made to FIG. 13B, which is a simplified flowchart illustrating a preferred implementation of Dicer-cut location detector training & validation functionality 126.

A general goal of the Dicer-cut location detector training & validation functionality 126 is to analyze the Dicer-cut locations of known diced miRNA on respective hairpin-shaped miRNA precursors in order to determine a common pattern in these locations, which can be used to predict Dicer-cut locations on GAM folded precursor RNAs.

The Dicer-cut locations of known miRNA precursors are obtained and studied. Locations of the 5' and/or 3' ends of the known diced miRNA oligonucleotides are preferably represented by their respective distances from the 5' end of the corresponding hairpin-shaped miRNA precursor. Additionally or alternatively, the 5' and/or 3' ends of the known diced miRNA oligonucleotides are preferably represented by the relationship between their locations and the locations of one or more nucleotides along the hairpin-shaped miRNA precursor. Additionally or alternatively, the 5' and/or 3' ends of the known diced miRNA oligonucleotides are preferably represented by the relationship between their locations and the locations of one or more bound nucleotide pairs along the hairpin-shaped miRNA precursor. Additionally or alternatively, the 5' and/or 3' ends of the known diced miRNA oligonucleotides are preferably represented by the relationship between their locations and the locations of one or more mismatched nucleotide pairs along the hairpin-shaped miRNA precursor. Additionally or alternatively, the 5' and/or 3' ends of the known diced miRNA oligonucleotides are preferably represented by the relationship between their locations and the locations of one or more unmatched nucleotides along the hairpin-shaped miRNA precursor. Additionally or alternatively, locations of the 5' and/or 3' ends of the known diced miRNA oligonucleotides are preferably represented by their respective distances from the loop located at the center of the corresponding hairpin-shaped miRNA precursor.

One or more of the foregoing location metrics may be employed in the Dicer-cut location detector training & validation functionality 126. Additionally, metrics related to the nucleotide content of the diced miRNA and/or of the hairpin-shaped miRNA precursor may be employed.

In a preferred embodiment of the present invention, Dicer-cut location detector training & validation functionality 126 preferably employs standard machine learning techniques known in the art of machine learning to analyze existing patterns in a given "training set" of examples. Standard machine learning techniques are capable, to a certain degree, of detecting patterns in examples to which they have not been previously exposed that are similar to those in the training set. Such machine learning techniques include, but are not limited to neural networks, Bayesian Modeling, Bayesian Networks, Support Vector Machines (SVM), Genetic Algorithms, Markovian Modeling, Maximum Likelihood Modeling, Nearest Neighbor Algorithms, Decision Trees and other techniques, as is well-known in the art.

In accordance with an embodiment of the present invention, two or more classifiers or predictors based on the abovementioned machine learning techniques are separately trained on the abovementioned training set, and are used jointly in order to predict the Dicer-cut location. As an example, FIG. 13B illustrates operation of two classifiers, a 3' end recognition classifier and a 5' end recognition classifier. Most preferably, the Dicer-cut location detector training & validation functionality 126 implements a "best-of-breed" approach employing a pair of classifiers based on the abovementioned Bayesian Modeling and Nearest Neighbor Algorithms, and accepting only "potential GAM RNAs" that score highly on one of these predictors. In this context, "high scores" means scores that have been demonstrated to have low false positive value when scoring known miRNA oligonucleotides. Alternatively, the Dicer-cut location detector training & validation functionality 126 may implement operation of more or less than two classifiers.

Predictors used in a preferred embodiment of the present invention are further described hereinbelow with reference to FIG. 13C. A computer program listing of a computer program implementation of the Dicer-cut location detector training & validation functionality 126 is enclosed on an electronic medium in computer-readable form, and is hereby incorporated by reference herein.

When evaluated on the abovementioned validation set of 440 published miRNA oligonucleotides using k-fold cross validation (Mitchell, 1997) with k=3, the performance of the resulting predictors is as follows: In 70% of known miRNA oligonucleotides, a 5' end location is correctly determined by a Support Vector Machine predictor within up to two nucleotides; a Nearest Neighbor (EDIT DISTANCE) predictor achieves 56% accuracy (247/440); and a Two-Phased Predictor that uses Bayesian modeling (TWO PHASED) achieves 80% accuracy (352/440) when only the first phase is used. When the second phase (strand choice) is implemented by a naive Bayesian model, the accuracy is 55% (244/440), and when the K-nearest-neighbor modeling is used for the second phase, 374/440 decisions are made and the accuracy is 65% (242/374). A K-nearest-neighbor predictor (FIRST-K) achieves 61% accuracy (268/440). The accuracies of all predictors are considerably higher on top-scoring subsets of published miRNA oligonucleotides.

Finally, in order to validate the efficacy and accuracy of the Dicer-cut location detector 116, a sample of novel oligonucleotides detected thereby is preferably selected, and validated by wet lab experiments. Laboratory results validating the efficacy of the Dicer-cut location detector 116 are described hereinbelow with reference to FIGS. 22-24D, FIG. 27 and also in the enclosed file "TABLE__13.txt".

Reference is now made to FIG. 13C, which is a simplified flowchart illustrating an operation of a Dicer-cut location detector 116 (FIG. 9), constructed and operative in accordance with a preferred embodiment of the present invention. The Dicer-cut location detector 116 preferably comprises a machine learning computer program module, which is trained to recognize Dicer-cut locations on known hairpin-shaped miRNA precursors, and based on this training, is operable to detect Dicer-cut locations of novel GAM RNA (FIG. 8) on GAM FOLDED PRECURSOR RNA (FIG. 8). In a preferred embodiment of the present invention, the Dicer-cut location module preferably utilizes machine learning algorithms, including but not limited to Support Vector Machine, Bayesian modeling, Nearest Neighbors, and K-nearest-neighbor algorithms that are known in the art.

When initially assessing a novel GAM FOLDED PRECURSOR RNA, each 19-24 nt-long segment thereof is considered to be a potential GAM RNA, because the Dicer-cut location is initially unknown.

For each such potential GAM RNA, the location of its 5' end or the locations of its 5' and 3' ends are scored by at least one recognition classifier or predictor, operating on features such as the following: Locations of the 5' and/or 3' ends of the known diced miRNA oligonucleotides, which are preferably represented by their respective distances from the 5' end of the corresponding hairpin-shaped miRNA precursor. Additionally or alternatively, the 5' and/or 3' ends of the known diced miRNA oligonucleotides, which are preferably represented by the relationship between their locations and the locations of one or more nucleotides along the hairpin-shaped miRNA precursor. Additionally or alternatively, the 5' and/or 3' ends of the known diced miRNA oligonucleotides, which are preferably represented by the relationship between their locations and the locations of one or more bound nucleotide pairs along the hairpin-shaped miRNA precursor. Additionally or alternatively, the 5' and/or 3' ends of the known diced miRNA oligonucleotides, which are preferably represented by the relationship between their locations and the locations of one or more mismatched nucleotide pairs along the hairpin-shaped miRNA precursor. Additionally or alternatively, the 5' and/or 3' ends of the known diced miRNA oligonucleotides, which are preferably represented by the relationship between their locations and the locations of one or more unmatched nucleotides along the hairpin-shaped miRNA precursor. Additionally or alternatively, locations of the 5' and/or 3' ends of the known diced miRNA oligonucleotides, which are preferably represented by their respective distances from the loop located at the center of the corresponding hairpin-shaped miRNA precursor. Additionally or alternatively, metrics related to the nucleotide content of the diced miRNA and/or of the hairpin-shaped miRNA precursor.

In a preferred embodiment of the present invention, the Dicer-cut location detector 116 (FIG. 9) may use a Support Vector Machine predictor.

In another preferred embodiment of the present invention, the Dicer-cut location detector 116 (FIG. 9) preferably employs an "EDIT DISTANCE" predictor, which seeks sequences that are similar to those of known miRNA oligonucleotides, utilizing a Nearest Neighbor algorithm, where a similarity metric between two sequences is a variant of the Edit Distance algorithm (Gusfield, 1997). The EDIT DISTANCE predictor is based on an observation that miRNA oligonucleotides tend to form clusters, the members of which show marked sequence similarity.

In yet another preferred embodiment of the present invention, the Dicer-cut location detector 116 (FIG. 9) preferably uses a "TWO PHASE" predictor, which predicts the Dicer-cut location in two distinct phases: (a) selecting a double-stranded segment of the GAM FOLDED PRECURSOR RNA (FIG. 8) comprising the GAM RNA by naive Bayesian modeling and (b) detecting which strand of the double-stranded segment contains GAM RNA (FIG. 8) by employing either naive or K-nearest-neighbor modeling. K-nearest-neighbor modeling is a variant of the "FIRST-K" predictor described hereinbelow, with parameters optimized for this specific task. The "TWO PHASE" predictor may be operated in two modes: either utilizing only the first phase and thereby producing two alternative Dicer-cut location predictions, or utilizing both phases and thereby producing only one final Dicer-cut location.

In still another preferred embodiment of the present invention, the Dicer-cut location detector 116 preferably uses a "FIRST-K" predictor, which utilizes a K-nearest-neighbor algorithm. The similarity metric between any two sequences is 1-E/L, where L is a parameter, preferably 8-10 and E is the edit distance between the two sequences, taking into account only the first L nucleotides of each sequence. If the K-nearest-neighbor scores of two or more locations on the GAM FOLDED PRECURSOR RNA (FIG. 8) are not significantly different, these locations are further ranked by a Bayesian model, similar to the one described hereinabove.

In accordance with an embodiment of the present invention, scores of two or more of the abovementioned classifiers or predictors are integrated, yielding an integrated score for each potential GAM RNA. As an example, FIG. 13C illustrates an integration of scores from two classifiers, a 3' end recognition classifier and a 5' end recognition classifier, the scores of which are integrated to yield an integrated score. Most preferably, the INTEGRATED SCORE of FIG. 13C preferably implements a "best-of-breed" approach employing a pair of classifiers and accepting only "potential GAM RNAs" that score highly on one of the abovementioned "EDIT DISTANCE", or "TWO PHASE" predictors. In this context, "high scores" means scores that have been demonstrated to have low false positive value when scoring known miRNA oligonucleotides. Alternatively, the INTEGRATED SCORE may be derived from operation of more or less than two classifiers.

The INTEGRATED SCORE is evaluated as follows: (a) the "potential GAM RNA" having the highest score is preferably taken to be the most probable GAM RNA, and (b) if the integrated score of this most probable GAM RNA is higher than a pre-defined threshold, then the most probable GAM RNA is accepted as a PREDICTED GAM RNA. Preferably, this evaluation technique is not limited to the highest scoring potential GAM RNA.

In a preferred embodiment of the present invention, PREDICTED GAM RNAs comprising a low complexity nucleotide sequence (e.g., ATATATA) may optionally be filtered out, because there is a high probability that they are part of a repeated element in the DNA, and are therefore not functional, as is known in the art. For each PREDICTED GAM RNA sequence, the number of occurrences of each two nt combination (AA, AT, AC) comprised in that sequence is counted. PREDICTED GAM RNA sequences where the sum of the two most probable combinations is higher than a threshold, preferably 8-10, are filtered out. As an example, when the threshold is set such that 2% of the known miRNA oligonucleotides are filtered out, 30% of the predicted GAM RNAs are filtered out.

Figure 14A:
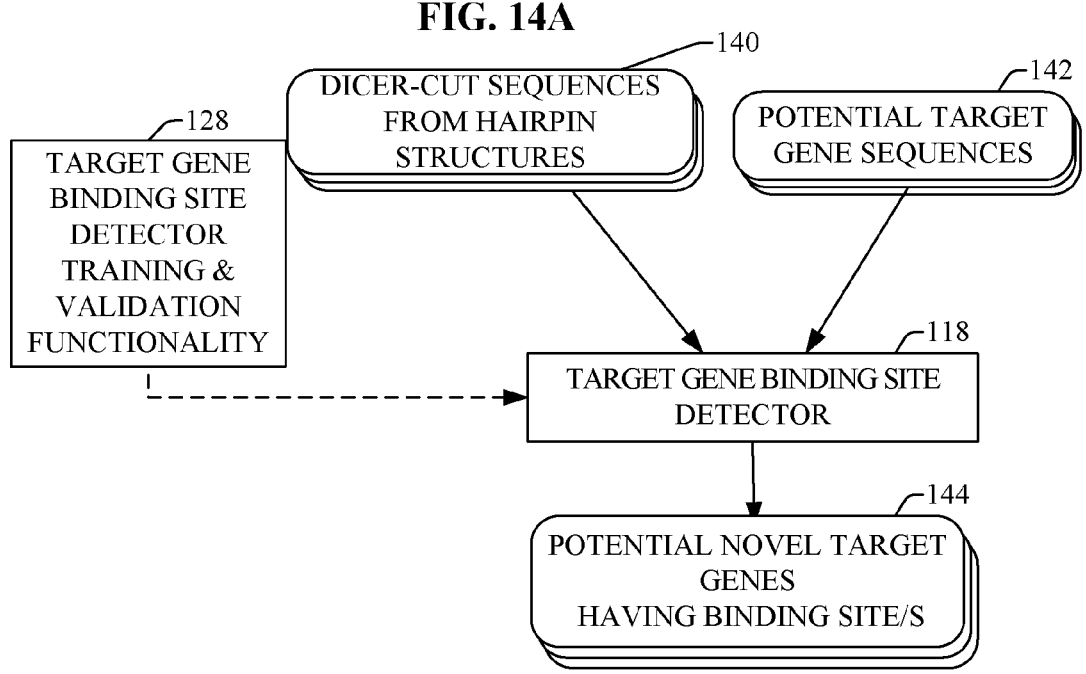
FIG. 14A is a simplified block diagram of a target gene binding site detector constructed and operative in accordance with a preferred embodiment of the present invention.

Reference is now made to FIG. 14A, which is a simplified block diagram of a preferred implementation of the target gene binding site detector 118 described hereinabove with reference to FIG. 9. The goal of the target gene binding site detector 118 is to detect one or more binding sites located in 3'UTRs of the mRNA of a known gene, such as BINDING SITE I, BINDING SITE II and BINDING SITE III (FIG. 8), the nucleotide sequence of which binding sites is partially or fully complementary to a GAM RNA, thereby determining that the abovementioned known gene is a target gene of the GAM RNA.

The target gene binding site detector 118 (FIG. 9) receives a plurality of Dicer-cut sequences from hairpin structures 140 (FIG. 13A) and a plurality of potential target gene sequences 142, which are derived from sequenced DNA data 104 (FIG. 9).

The target gene binding site detector training & validation functionality 128 (FIG. 10) is operative to train the target gene binding site detector 118 on known miRNA oligonucleotides and their respective target genes and to build a background model for an evaluation of the probability of achieving similar results randomly (P value) for the target gene binding site detector 118 results. The target gene binding site detector training & validation functionality 128 constructs the model by analyzing both heuristically and computationally the results of the target gene binding site detector 118.

Following operation of target gene binding site detector training & validation functionality 128 (FIG. 10), the target gene binding site detector 118 is operative to detect a plurality of potential novel target genes having binding site/s 144, the nucleotide sequence of which is partially or fully complementary to that of each of the plurality of Dicer-cut sequences from hairpin structures 140. Preferred operation of the target gene binding site detector 118 is further described hereinbelow with reference to FIG. 14B.

Figure 14B:
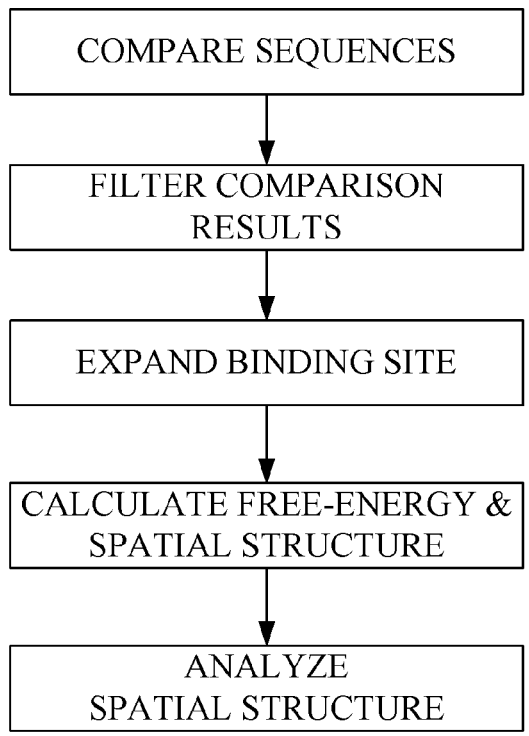
FIG. 14B is a simplified flowchart illustrating operation of a target gene binding site detector constructed and operative in accordance with a preferred embodiment of the present invention.

Reference is now made to FIG. 14B, which is a simplified flowchart illustrating a preferred operation of the target gene binding site detector 118 of FIG. 9.

In an embodiment of the present invention, the target gene binding site detector 118 first compares nucleotide sequences of each of the plurality of Dicer-cut sequences from hairpin structures 140 (FIG. 13A) to the potential target gene sequences 142 (FIG. 14A), such as 3' side UTRs of known mRNAs, in order to find crude potential matches. This step may be performed using a simple alignment algorithm such as BLAST.

Then, the target gene binding site detector 118 filters these crude potential matches, to find closer matches, which more closely resemble published miRNA oligonucleotide binding sites.

Next, the target gene binding site detector 118 expands the nucleotide sequences of the 3'UTR binding site found by the sequence comparison algorithm (e.g. BLAST or EDIT DISTANCE). A determination is made whether any subsequence of the expanded sequence may improve the match. The best match is considered the alignment.

Free-energy and spatial structure are computed for the resulting binding sites. Calculation of spatial structure may be performed by a secondary structure folding algorithm based on free-energy minimization, such as the MFOLD algorithm described in Mathews et al. (J. Mol. Biol. 288: 911-940 (1999)) and Zuker (Nucleic Acids Res. 31: 3406-3415

(2003)), the disclosure of which is hereby incorporated by reference. Free energy, spatial structure and the above preferences are reflected in scoring. The resulting scores are compared with scores characteristic of known binding sites of published miRNA oligonucleotides, and each binding site is given a score that reflects its resemblance to these known binding sites.

Finally, the target gene binding site detector 118 analyzes the spatial structure of the binding site. Each 3'UTR-GAM oligonucleotide pair is given a score. Multiple binding sites of the same GAM oligonucleotides to a 3'UTR are given higher scores than those that bind only once to a 3'UTR.

In a preferred embodiment of the present invention, performance of the target gene binding site detector 118 may be improved by integrating several of the abovementioned logical steps, using the methodology described hereinbelow.

For each of the dicer-cut sequence from hairpin structures 140, its starting segment, e.g. a segment comprising the first 8 nts from its 5' end, is obtained. For each starting segment, all of the 9 nt segments that are highly complementary to the starting segment are calculated. These calculated segments are referred to here as "potential binding site end segments". In a preferred embodiment of the present invention, for each 8 nt starting segment, the potential binding site end segments are all 9 nt segments whose complementary sequence contains a 7-9 nt sub-sequence that is not different from the starting segment by more than an insertion, deletion or replacement of one nt. Calculation of potential binding site end segments is preferably performed by a pre-processing tool that maps all possible 8 nt segments to their respective 9 nt segments.

Next, the mRNAs 3'UTRs is parsed into all the segments, with the same length as the potential binding site end segments, preferably 9 nt segments, comprised in the 3'UTR. Location of each such segment is noted, stored in a performance-efficient data structure and compared to the potential binding site end segments calculated in the previous step.

The target gene binding site detector 118 then expands the binding site sequence, preferably in the binding site 5' direction (i.e. immediately upstream), assessing the degree of its alignment to the dicer-cut sequence from hairpin structures 140. Preferably, an alignment algorithm is implemented which uses specific weighting parameters based on an analysis of known miRNA oligonucleotide binding sites. As an example, it is apparent that a good match of the 3' end of the binding site is critically important, a match of the 5' end is less important but can compensate for a small number of mismatches at the 3' end of the binding site, and a match of the middle portion of the binding site is much less important.

Next, the number of binding sites found in a specific 3'UTR, the degree of alignment of each of these binding sites, and their proximity to each other are assessed and compared to these properties found in known binding sites of published miRNA oligonucleotides. In a preferred embodiment, the fact that many of the known binding sites are clustered is used to evaluate the P value of obtaining a cluster of a few binding sites on the same target gene 3'UTR in the following way. It scans different score thresholds and calculates for each threshold the number and positions of possible binding sites with a score above the threshold. It then gets a P value for each threshold from a preprocessed calculated background matrix, described hereinbelow, and a number and positions of binding sites combination. The output score for each Dicer-cut sequences from hairpin structures 140 and potential target gene sequences 142 is the minimal P value, normalized with the number of threshold trails using a Bernoulli distribution. A preference of low P value pairs is made.

As mentioned hereinabove, for each target gene, a preprocessed calculated background matrix is built. The matrix includes rows for each number of miRNA oligonucleotide binding sites (in the preferred embodiment, the matrix includes 7 rows to accommodate 0 to 6 binding sites), and columns for each different score threshold (in the preferred embodiment, the matrix includes 5 columns for 5 different thresholds). Each matrix cell, corresponding to a specific number of binding sites and thresholds, is set to be the probability of getting equal or higher number binding sites and an equal or higher score using random 22 nt-long sequences with the same nucleotide distribution as known miRNA oligonucleotides (29.5% T, 24.5% A, 25% G and 21% C). Those probabilities are calculated by running the above procedure for 10000 random sequences that preserved the known miRNA nucleotide distribution (these sequence will be also referred to as miRNA oligonucleotide random sequences). The P value can be estimated as the number of random sequences that obeys the matrix cell requirement divided by the total number of random sequences (10000). In the preferred embodiment, 2 matrices are calculated. The P values of the second matrix are calculated under a constraint that at least two of the binding site positions are under a heuristically-determined constant value. The values of the second matrix are calculated without this constraint. The target gene binding site detector 118 uses the second matrix if the binding site positions agree with the constraint. Otherwise, it uses the first. In an alternative embodiment, only one matrix is calculated without any constraint on the binding sites positions.

A test performed using the target gene binding site detector 118 shows that all of the known miRNA oligonucleotide target genes are found using this algorithm with a P value of less than 0.5%. Running known miRNA oligonucleotides against 3400 potential 3'UTR of target gene sequences yields on average 32 target genes for each miRNA oligonucleotide with a P value less than 0.5%, while background sequences, as well as inverse or complement sequence of known miRNA oligonucleotide (which preserve their high order sequence statistics) found, as expected, 17 target genes on average. This result reflects that the algorithm has the ability to detect real target genes with 47% accuracy.

Finally, orthology data may optionally be used to further prefer binding sites based on their conservation. Preferably, this may be used in cases such as (a) where both the target mRNA and miRNA oligonucleotide have orthologues in another organism, e.g. Human-Mouse orthology, or (b) where a miRNA oligonucleotide (e.g. viral miRNA oligonucleotide) targets two mRNAs in orthologous organisms. In such cases, binding sites that are conserved are preferred.

In accordance with another preferred embodiment of the present invention, binding sites may be searched by a reverse process. Sequences of K (preferably 22) nucleotides in a UTR of a target gene are assessed as potential binding sites. A sequence comparison algorithm, such as BLAST or EDIT DISTANCE variant, is then used to search elsewhere in the genome for partially or fully complementary sequences that are found in known miRNA oligonucleotides or computationally-predicted GAM oligonucleotides. Only complementary sequences that meet predetermined spatial structure and free-energy criteria as described hereinabove, are accepted. Clustered binding sites are strongly preferred and potential binding sites and potential GAM oligonucleotides that occur in evolutionarily-conserved genomic sequences are also preferred. Scoring of candidate binding sites takes into account free-energy and spatial structure of the binding site complexes, as well as the aforesaid preferences.

Figure 15:
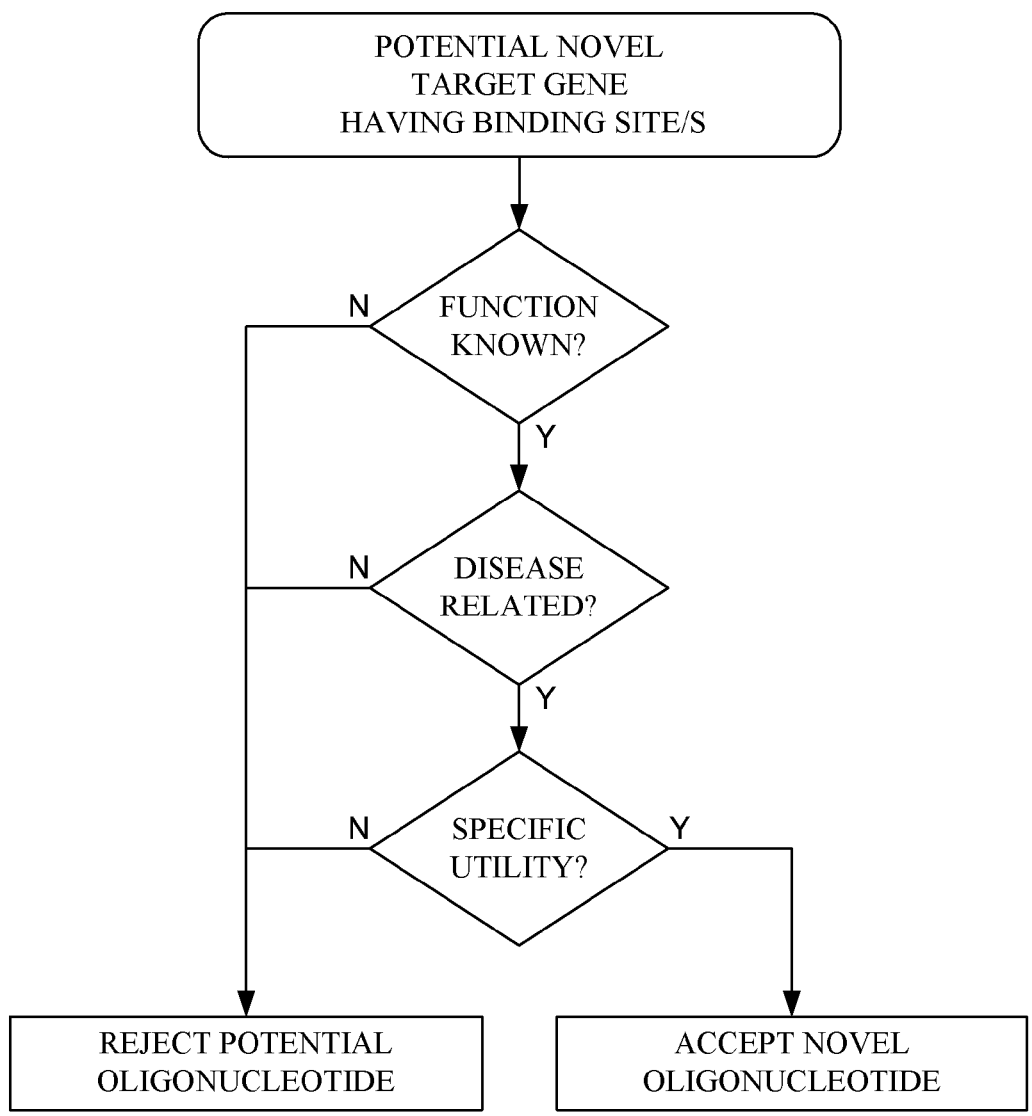
FIG. 15 is a simplified flowchart illustrating operation of a function and utility analyzer constructed and operative in accordance with a preferred embodiment of the present invention.

Reference is now made to FIG. 15 which is a simplified flowchart illustrating a preferred operation of the function & utility analyzer 120 described hereinabove with reference to FIG. 9. The goal of the function & utility analyzer 120 is to determine if a potential target gene is in fact a valid clinically useful target gene. Since a potential novel GAM oligonucleotide binding a binding site in the UTR of a target gene is understood to inhibit expression of that target gene, and if that target gene is shown to have a valid clinical utility, then in such a case it follows that the potential novel oligonucleotide itself also has a valid useful function which is the opposite of that of the target gene.

The function & utility analyzer 120 preferably receives as input a plurality of potential novel target genes having binding site/s 144 (FIG. 14A), generated by the target gene binding site detector 118 (FIG. 9). Each potential oligonucleotide is evaluated as follows: First, the system checks to see if the function of the potential target gene is scientifically well established. Preferably, this can be achieved bioinformatically by searching various published data sources presenting information on known function of proteins. Many such data sources exist and are published as is well known in the art. Next, for those target genes the function of which is scientifically known and is well documented, the system then checks if scientific research data exists which links them to known diseases. For example, a preferred embodiment of the present invention utilizes the OMIM™ (Hamosh et al, 2002) database published by NCBI, which summarizes research publications relating to genes which have been shown to be associated with diseases. Finally, the specific possible utility of the target gene is evaluated. While this process too may be facilitated by bioinformatic means, it might require manual evaluation of published scientific research regarding the target gene, in order to determine the utility of the target gene to the diagnosis and or treatment of specific disease. Only potential novel oligonucleotides, the target genes of which have passed all three examinations, are accepted as novel oligonucleotide.

Figure 16:
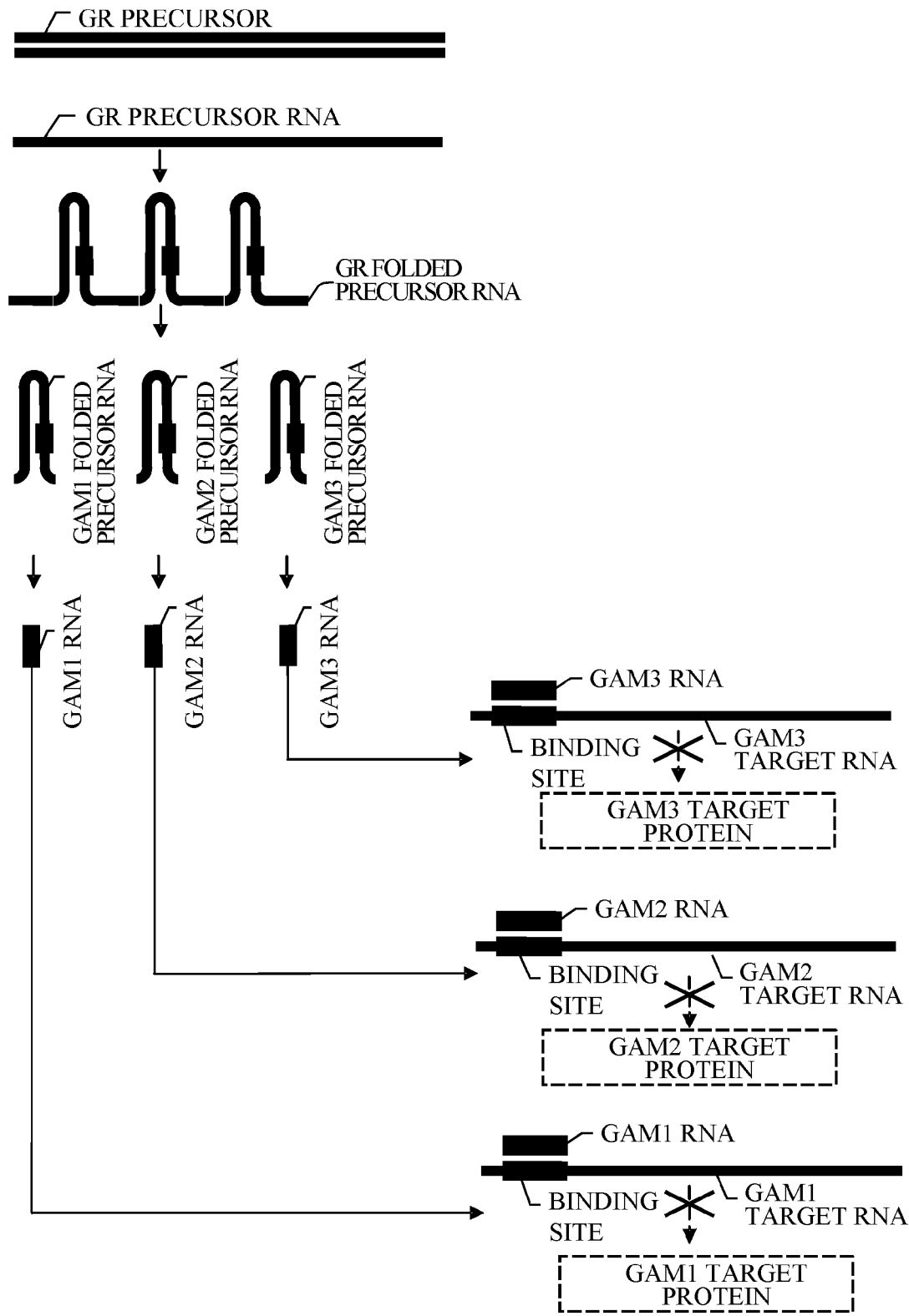
FIG. 16 is a simplified diagram describing a novel bioinformatically-detected group of regulatory polynucleotides, referred to here as Genomic Record (GR) polynucleotides, each of which encodes an "operon-like" cluster of novel miRNA-like oligonucleotides, which in turn modulate expression of one or more target genes.

Reference is now made to FIG. 16, which is a simplified diagram describing each of a plurality of novel bioinformatically-detected regulatory polynucleotide referred to in this Table as the Genomic Record (GR) polynucleotide. GR encodes an operon-like cluster of novel miRNA-like oligonucleotides, each of which in turn modulates the expression of at least one target gene. The function and utility of at least one target gene is known in the art.

The GR PRECURSOR is a novel, bioinformatically-detected, regulatory, non-protein-coding polynucleotide. The method by which the GR PRECURSOR is detected is described hereinabove with additional reference to FIGS. 9-18.

The GR PRECURSOR encodes GR PRECURSOR RNA that is typically several hundred to several thousand nts long. The GR PRECURSOR RNA folds spatially, forming the GR FOLDED PRECURSOR RNA. It is appreciated that the GR FOLDED PRECURSOR RNA comprises a plurality of what is known in the art as hairpin structures. Hairpin structures result from the presence of segments of the nucleotide sequence of GR PRECURSOR RNA in which the first half of each such segment has a nucleotide sequence which is at least a partial, and sometimes an accurate, reverse-complement sequence of the second half thereof, as is well known in the art.

The GR FOLDED PRECURSOR RNA is naturally processed by cellular enzymatic activity into a plurality of separate GAM precursor RNAs herein schematically represented by GAM1 FOLDED PRECURSOR RNA through GAM3 FOLDED PRECURSOR RNA. Each GAM folded precursor RNA is a hairpin-shaped RNA segment, corresponding to GAM FOLDED PRECURSOR RNA of FIG. 8.

The abovementioned GAM folded precursor RNAs are diced by DICER COMPLEX of FIG. 8, yielding short RNA segments of about 22 nts in length schematically represented by GAM1 RNA through GAM3 RNA. Each GAM RNA corresponds to GAM RNA of FIG. 8. GAM1 RNA, GAM2 RNA and GAM3 RNA each bind complementarily to binding sites located in the untranslated regions of their respective target genes, designated GAM1 TARGET RNA, GAM2 TARGET RNA and GAM3 TARGET RNA, respectively. These target binding sites correspond to BINDING SITE I, BINDING SITE II and BINDING SITE III of FIG. 8. The binding of each GAM RNA to its target RNA inhibits the translation of its respective target proteins, designated GAM1 TARGET PROTEIN, GAM2 TARGET PROTEIN and GAM3 TARGET PROTEIN, respectively.

It is appreciated that the specific functions, and accordingly the utilities, of the GR polynucleotide are correlated with and may be deduced from the identity of the target genes that are inhibited by GAM RNAs that are present in the operon-like cluster of the polynucleotide. Thus, for the GR polynucleotide, schematically represented by GAM1 TARGET PROTEIN through GAM3 TARGET PROTEIN that are inhibited by the GAM RNA. The function of these target genes is elaborated in Table 8, hereby incorporated herein.

Figure 17:
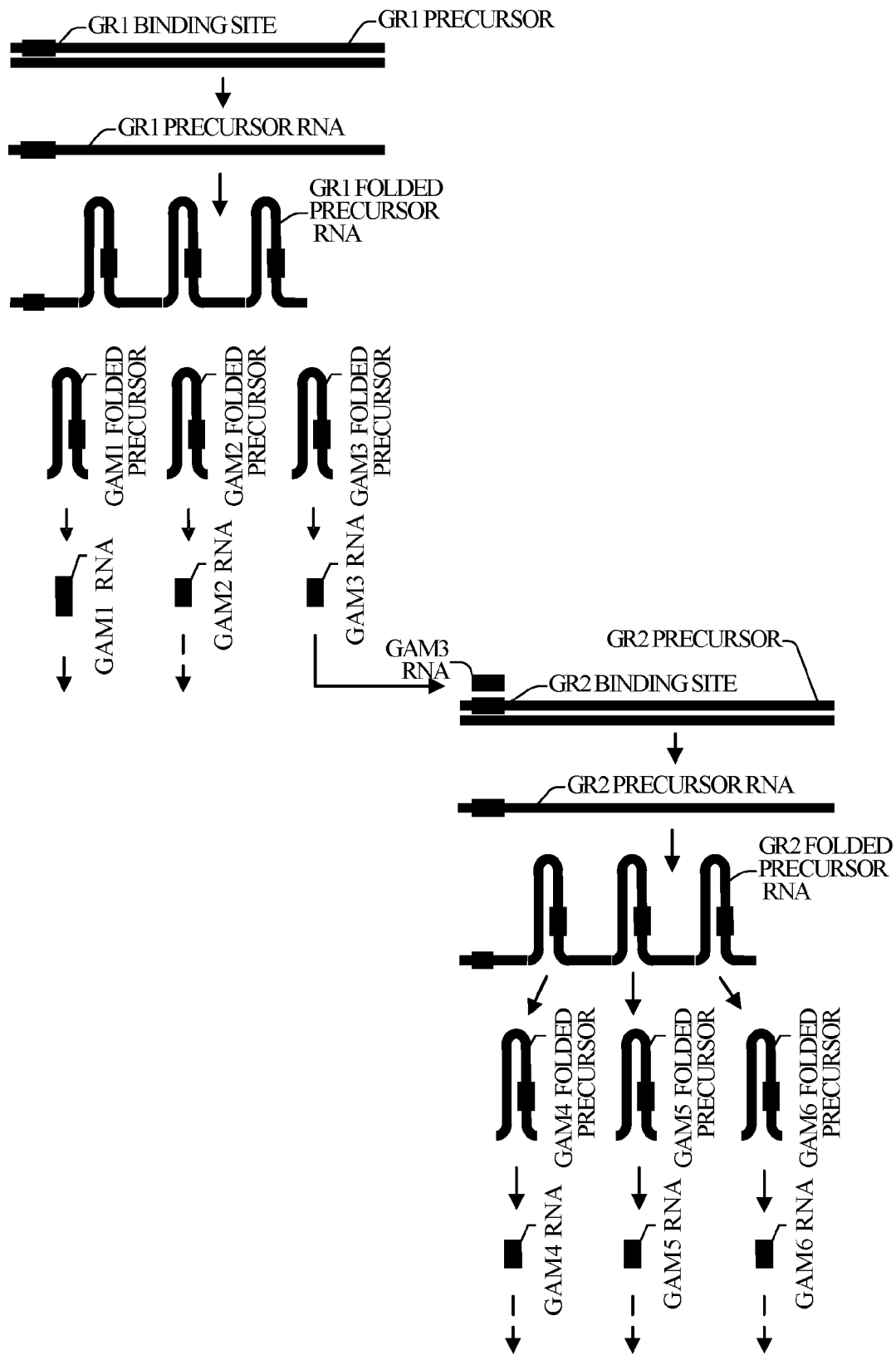
FIG. 17 is a simplified diagram illustrating a mode by which human oligonucleotides of a novel group of operon-like polynucleotides of the present invention, modulate expression of other such polynucleotides, in a cascading manner.

Reference is now made to FIG. 17 which is a simplified diagram illustrating a mode by which oligonucleotides of a novel group of operon-like polynucleotide described hereinabove with reference to FIG. 16 of the present invention, modulate expression of other such polynucleotide, in a cascading manner. GR1 PRECURSOR and GR2 PRECURSOR are two polynucleotides of the novel group of operon-like polynucleotides designated GR PRECURSOR (FIG. 16). As is typical of polynucleotides of the GR group of polynucleotides GR1 PRECURSOR and GR2 PRECURSOR, each encode a long RNA precursor, which in turn folds into a folded RNA precursor comprising multiple hairpin shapes, and is cut into respective separate hairpin-shaped RNA segments, each of which RNA segments being diced to yield an oligonucleotide of a group of oligonucleotides designated GAM RNA. In this manner GR1 yields GAM1 RNA, GAM2 RNA and GAM3 RNA, and GR2 yields GAM4 RNA, GAM5 RNA and GAM6 RNA. As FIG. 17 shows, GAM3 RNA, which derives from GR1, binds a binding site located adjacent to GR2 GPRECURSOR thus modulating expression of GR2, thereby invoking expression of GAM4 RNA, GAM5 RNA and GAM6 RNA which derive from GR2. It is appreciated that the mode of modulation of expression presented by FIG. 17 enables an unlimited "cascading effect" in which a GR polynucleotide comprises multiple GAM oligonucleotides each of which may modulate expression of other GR polynucleotides each such GR polynucleotides comprising additional GAM oligonucleotide etc., whereby eventually certain GAM oligonucleotides modulate expression of target proteins.

This mechanism is in accord with the conceptual model of the present invention addressing the differentiation enigma, described hereinabove with specific reference to FIGS. 6-7.

Figure 18:
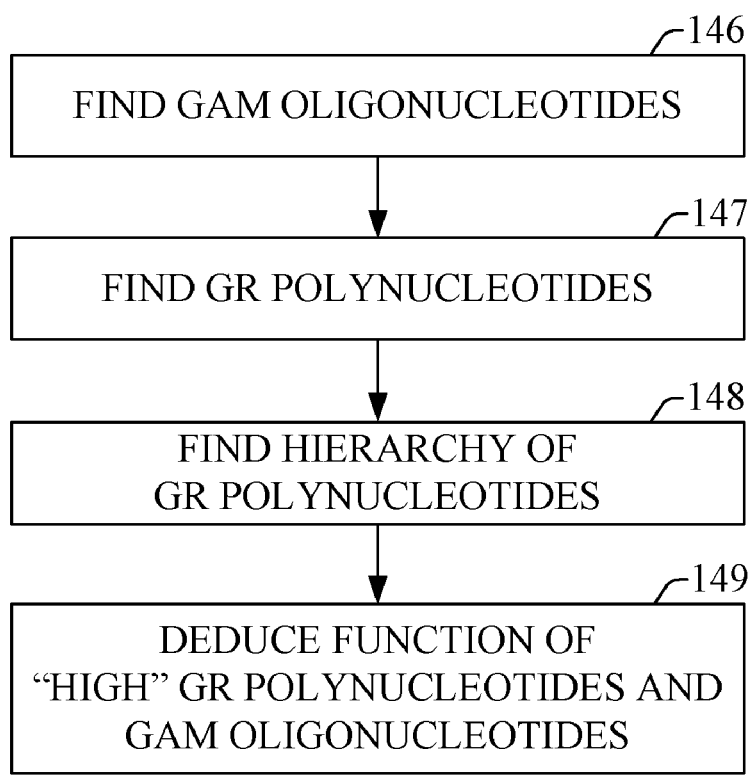
FIG. 18 is a block diagram illustrating an overview of a methodology for finding novel human oligonucleotides and novel operon-like human polynucleotides of the present invention, and their respective functions.

Reference is now made to FIG. 18 which is a block diagram illustrating an overview of a methodology for finding novel oligonucleotides and operon-like polynucleotides of the present invention, and their respective functions. According to a preferred embodiment of the present invention, the methodology to finding novel oligonucleotides of the present invention and their function comprises of the following major steps: First, FIND GAM OLIGONUCLEOTIDES 146 is used to detect, oligonucleotide of the novel group of oligonucleotide of the present invention, referred to here as GAM oligonucleotide. GAM oligonucleotides are located and their function elicited by detecting target proteins they bind and the function of those target proteins, as described hereinabove with reference to FIGS. 9-15. Next, FIND GR POLYNUCLEOTIDES 147 is used to detect polynucleotide of a novel group of operon-like polynucleotide of the present invention, referred to here as GR polynucleotide. GR polynucleotides are located, by locating clusters of proximally located GAM oligonucleotide, based on the previous step. Consequently, FIND HIERARCHY OF GR POLYNUCLEOTIDES 148 elicits the hierarchy of GR and GAM: binding sites for non-protein-binding GAM oligonucleotide comprised in each GR polynucleotide found are sought adjacent to other GR polynucleotides. When found, such a binding site indicates that the connection between the GAM and the GR the expression of which it modulates, and thus the hierarchy of the GR polynucleotides and the GAM oligonucleotides they comprise. Lastly, DEDUCE FUNCTION OF "HIGH" GR POLYNUCLEOTIDES AND GAM OLIGONUCLEOTIDES 149 is used to deduce the function of GR polynucleotides and GAM oligonucleotides which are "high" in the hierarchy, i.e. GAM oligonucleotides which modulate expression of other GR polynucleotides rather than directly modulating expression of target proteins. A preferred approach is as follows: The function of protein-modulating GAM oligonucleotides is deducible from the proteins which they modulate, provided that the function of these target proteins is known. The function of "higher" GAM oligonucleotides may be deduced by comparing the function of protein-modulating GAM oligonucleotides with the hierarchical relationships by which the "higher" GAM oligonucleotides are connected to the protein-modulating GAM oligonucleotides. For example, given a group of several protein-modulating GAM oligonucleotides which collectively cause a protein expression pattern typical of a certain cell-type, then a "higher" GAM oligonucleotide is sought which modulates expression of GR polynucleotides which perhaps modulate expression of other GR polynucleotides which eventually modulate expression of the given group of protein-modulating GAM oligonucleotide. The "higher" GAM oligonucleotide found in this manner is taken to be responsible for differentiation of that cell-type, as per the conceptual model of the invention described hereinabove with reference to FIG. 6.

Figure 19:
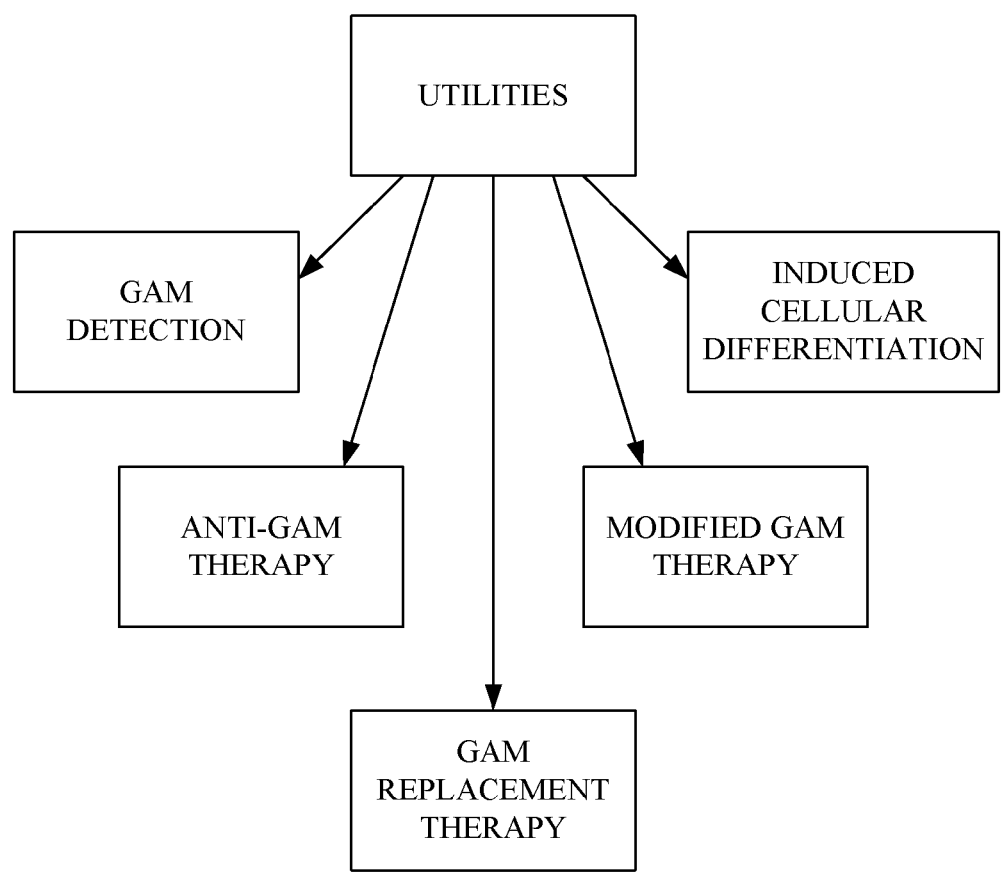
FIG. 19 is a block diagram illustrating different utilities of novel oligonucleotides and novel operon-like polynucleotides, both of the present invention.

Reference is now made to FIG. 19 which is a block diagram illustrating different utilities of oligonucleotide of the novel group of oligonucleotides of the present invention referred to here as GAM oligonucleotides and GR polynucleotides. The present invention discloses a first plurality of novel oligonucleotides referred to here as GAM oligonucleotides and a second plurality of operon-like polynucleotides referred to here as GR polynucleotides, each of the GR polynucleotide encoding a plurality of GAM oligonucleotides. The present invention further discloses a very large number of known target genes, which are bound by, and the expression of which is modulated by each of the novel oligonucleotides of the present invention. Published scientific data referenced by the present invention provides specific, substantial, and credible evidence that the above mentioned target genes modulated by novel oligonucleotides of the present invention, are associated with various diseases. Specific novel oligonucleotides of the present invention, target genes thereof and diseases associated therewith, are described hereinbelow with reference to Tables 1 through 13. It is therefore appreciated that a function of GAM oligonucleotides and GR polynucleotides of the present invention is modulation of expression of target genes related to known diseases, and that therefore utilities of novel oligonucleotides of the present invention include diagnosis and treatment of the above mentioned diseases.

FIG. 19 describes various types of diagnostic and therapeutic utilities of novel oligonucleotides of the present invention. A utility of novel oligonucleotide of the present invention is detection of GAM oligonucleotides and of GR polynucleotides. It is appreciated that since GAM oligonucleotides and GR polynucleotides modulate expression of disease related target genes, that detection of expression of GAM oligonucleotides in clinical scenarios associated with said diseases is a specific, substantial and credible utility. Diagnosis of novel oligonucleotides of the present invention may preferably be implemented by RNA expression detection techniques, including but not limited to biochips, as is well known in the art. Diagnosis of expression of oligonucleotides of the present invention may be useful for research purposes, in order to further understand the connection between the novel oligonucleotides of the present invention and the above mentioned related diseases, for disease diagnosis and prevention purposes, and for monitoring disease progress.

Another utility of novel oligonucleotides of the present invention is anti-GAM therapy, a mode of therapy which allows up regulation of a disease-related target gene of a novel GAM oligonucleotide of the present invention, by lowering levels of the novel GAM oligonucleotide which naturally inhibits expression of that target gene. This mode of therapy is particularly useful with respect to target genes which have been shown to be under-expressed in association with a specific disease. Anti-GAM therapy is further discussed hereinbelow with reference to FIGS. 20A and 20B and 28A-29.

A further utility of novel oligonucleotides of the present invention is GAM replacement therapy, a mode of therapy which achieves down regulation of a disease related target gene of a novel GAM oligonucleotide of the present invention, by raising levels of the GAM which naturally inhibits expression of that target gene. This mode of therapy is particularly useful with respect to target genes which have been shown to be over-expressed in association with a specific disease. GAM replacement therapy involves introduction of supplementary GAM products into a cell, or stimulation of a cell to produce excess GAM products. GAM replacement therapy may preferably be achieved by transfecting cells with an artificial DNA molecule encoding a GAM which causes the cells to produce the GAM product, as is well known in the art. Replacement therapy may also be performed by means of a suitable small molecule as further described hereinbelow with reference to FIG. 28D.

Yet a further utility of novel oligonucleotides of the present invention is modified GAM therapy. Disease conditions are likely to exist, in which a mutation in a binding site of a GAM RNA prevents natural GAM RNA to effectively bind inhibit a disease related target gene, causing up regulation of that target gene, and thereby contributing to the disease pathology. In such conditions, a modified GAM oligonucleotides is designed which effectively binds the mutated GAM binding site, i.e. is an effective anti-sense of the mutated GAM binding site, and is introduced in disease effected cells. Modified GAM therapy may be achieved by transfecting cells with an artificial DNA molecule encoding the modified GAM which causes the cells to produce the modified GAM product. It may also be achieved by introducing an appropriate small molecule into the cell, which acts similarly to the endogenous GAM oligonucleotide, as elaborated hereinbelow with reference to FIG. 28D.

The present invention may also be used to modulate differentiation, as conceptually described hereinabove with reference to FIGS. 1-7, using either oligonucleotides that specifically inhibit or enhance GAM oligonucleotide activity, or small molecules that do the same.

An additional utility of novel GAM of the present invention is induced cellular differentiation therapy. An aspect of the present invention is finding oligonucleotides which determine cellular differentiation, as described hereinabove with reference to FIG. 18. Induced cellular differentiation therapy comprises transfection of cell with such GAM oligonucleotides thereby determining their differentiation as desired. It is appreciated that this approach may be widely applicable, inter alia as a means for auto trans-plantation harvesting cells of one cell-type from a patient, modifying their differentiation as desired, and then trans-planting them back into the patient. It is further appreciated that this approach may also be utilized to modify cell differentiation in-vivo, by transfecting cells in a genetically diseased tissue with a cell-differentiation determining GAM thus stimulating these cells to differentiate appropriately.

Figure 20A:
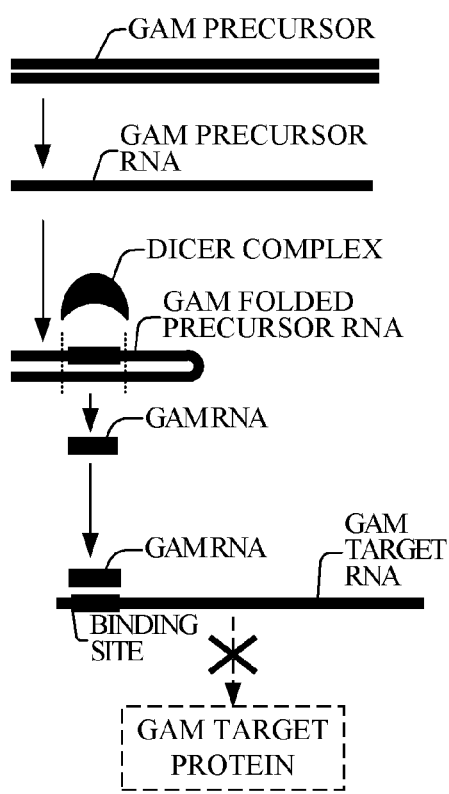
FIGS. 20A and 20B are simplified diagrams which, when taken together, illustrate a mode of oligonucleotide therapy applicable to novel oligonucleotides of the present invention.
Figure 20B:
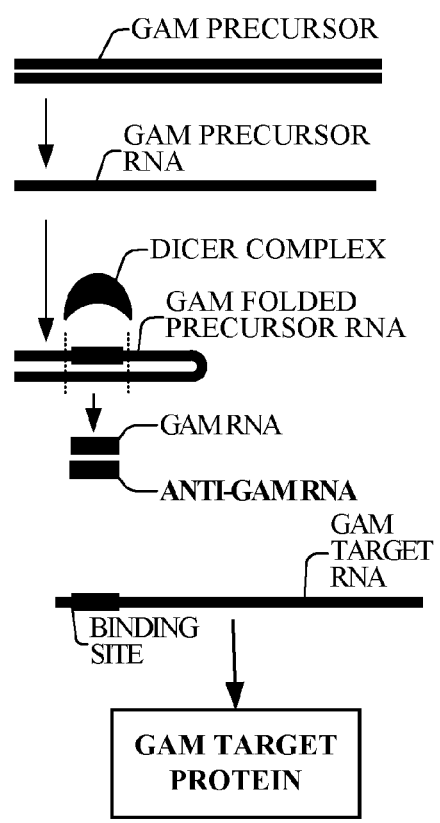

Reference is now made to FIGS. 20A and 20B, simplified diagrams which when taken together illustrate anti-GAM therapy mentioned hereinabove with reference to FIG. 19. A utility of novel GAMs of the present invention is anti-GAM therapy, a mode of therapy which allows up regulation of a disease-related target gene of a novel GAM of the present invention, by lowering levels of the novel GAM which naturally inhibits expression of that target gene. FIG. 20A shows a normal GAM inhibiting translation of a target gene by binding of GAM RNA to a BINDING SITE found in an untranslated region of GAM TARGET RNA, as described hereinabove with reference to FIG. 8.

FIG. 20B shows an example of anti-GAM therapy. ANTI-GAM RNA is short artificial RNA molecule the sequence of which is an anti-sense of GAM RNA. Anti-GAM treatment comprises transfecting diseased cells with ANTI-GAM RNA, or with a DNA encoding thereof. The ANTI-GAM RNA binds the natural GAM RNA, thereby preventing binding of natural GAM RNA to its BINDING SITE. This prevents natural translation inhibition of GAM TARGET RNA by GAM RNA, thereby up regulating expression of GAM TARGET PROTEIN.

It is appreciated that anti-GAM therapy is particularly useful with respect to target genes which have been shown to be under-expressed in association with a specific disease.

Furthermore, anti-GAM therapy is particularly useful, since it may be used in situations in which technologies known in the art as RNAi and siRNA can not be utilized. As in known in the art, RNAi and siRNA are technologies which offer means for artificially inhibiting expression of a target protein, by artificially designed short RNA segments which bind complementarily to mRNA of said target protein. However, RNAi and siRNA can not be used to directly up regulate translation of target proteins.

Figure 21A:
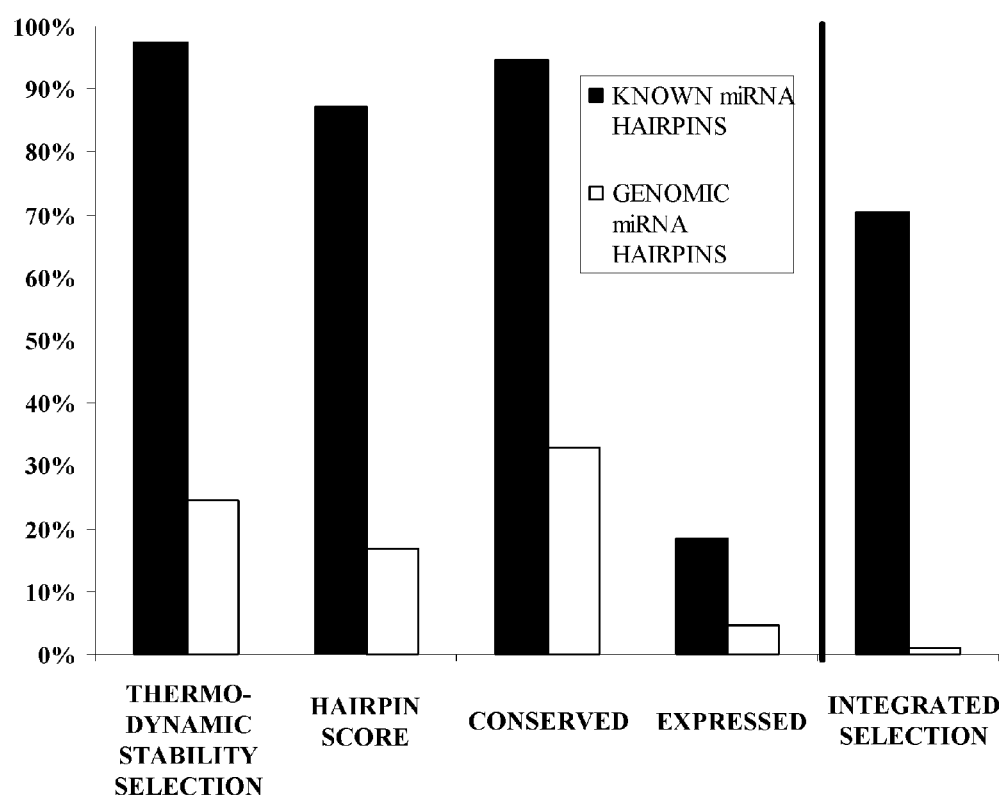
FIG. 21A is a bar graph illustrating performance results of a hairpin detector constructed and operative in accordance with a preferred embodiment of the present invention.

Reference is now made to FIG. 21A, which is a bar graph illustrating performance results of the hairpin detector 114 (FIG. 9) constructed and operative in accordance with a preferred embodiment of the present invention.

FIG. 21A illustrates efficacy of several features used by the hairpin detector 114 to detect GAM FOLDED PRECURSOR RNAs (FIG. 8). The values of each of these features is compared between a set of published miRNA precursor oligonucleotides, represented by shaded bars, and a set of random hairpins folded from the human genome denoted hereinbelow as a hairpin background set, represented by white bars. The published miRNA precursor oligonucleotides set is taken from RFAM database, Release 2.1 and includes 148 miRNA oligonucleotides from *H. Sapiens*. The background set comprises a set of 10,000 hairpins folded from the human genome.

It is appreciated that the hairpin background set is expected to comprise some valid, previously undetected hairpin-shaped miRNA precursor-like GAM FOLDED PRECURSOR RNAs of the present invention, and many hairpin-shaped sequences that are not hairpin-shaped miRNA-like precursors.

For each feature, the bars depict the percent of known miRNA hairpin precursors (shaded bars) and the percent of background hairpins (white bars) that pass the threshold for that feature. The percent of known miRNA oligonucleotides that pass the threshold indicates the sensitivity of the feature, while the corresponding background percent implies the specificity of the feature, although not precisely, because the background set comprises both true and false examples.

The first bar pair, labeled Thermodynamic Stability Selection, depicts hairpins that have passed the selection of "families" of closely related hairpin structures, as described hereinabove with reference to FIG. 12B.

The second bar pair, labeled Hairpin Score, depicts hairpins that have been selected by hairpin detector 114 (FIG. 12B), regardless of the families selection.

The third bar pair, labeled Conserved, depicts hairpins that are conserved in human, mouse and rat, (UCSC Goldenpath™ HG16 database).

The fourth bar pair, labeled Expressed, depicts hairpins that are found in EST blocks.

The fifth bar pair, labeled Integrated Selection, depicts hairpin structures predicted by a preferred embodiment of the present invention to be valid GAM PRECURSORs. In a preferred embodiment of the present invention, a hairpin may be considered to be a GAM PRECURSOR if its hairpin detector score is above 0, and it is in one of the following groups: a) in an intron and conserved or b) in an intergenic region and conserved or c) in an intergenic region and expressed, as described below. Further filtering of GAM precursor may be obtained by selecting hairpins with a high score of Dicer-cut location detector 116 as described hereinabove with reference to FIGS. 13A-13C, and with predicted miRNA oligonucleotides, which pass the low complexity filter as described hereinabove, and whose targets are selected by the target gene binding site detector 118 as described hereinabove with reference to FIGS. 14A-14B.

It is appreciated that these results validate the sensitivity and specificity of the hairpin detector 114 (FIG. 9) in identifying novel GAM FOLDED PRECURSOR RNAs, and in effectively distinguishing them from the abundant hairpins found in the genome.

Figure 21B:
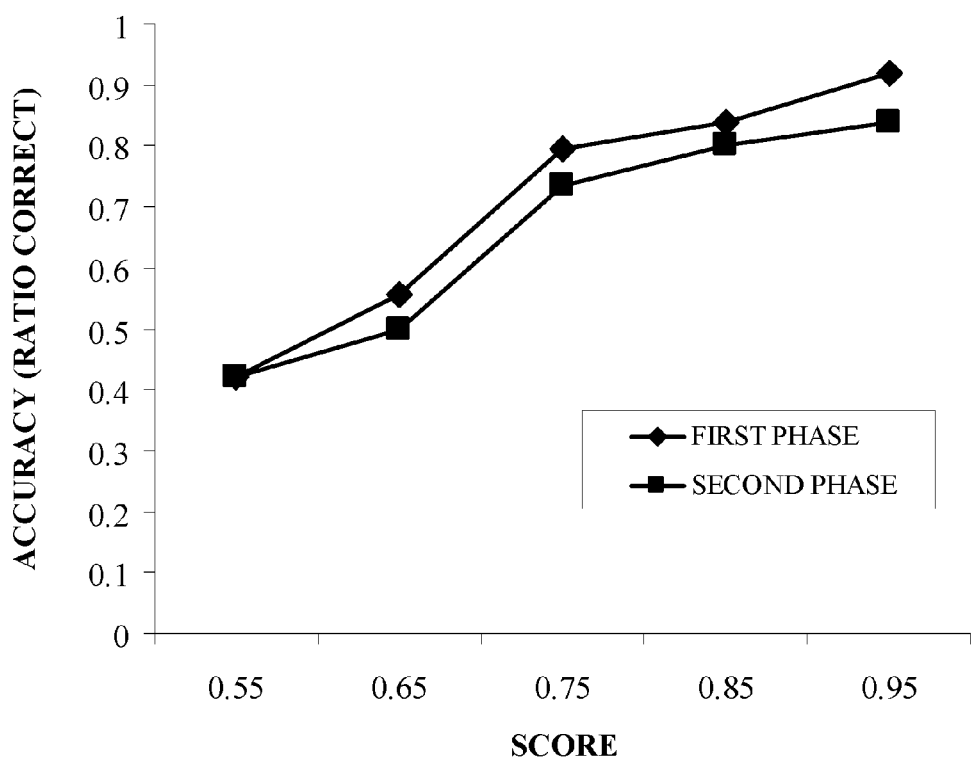
FIG. 21B is a line graph illustrating accuracy of a Dicer-cut location detector constructed and operative in accordance with a preferred embodiment of the present invention.

Reference is now made to FIG. 21B, which is a line graph illustrating accuracy of a Dicer-cut location detector 116 (FIG. 9) constructed and operative in accordance with a preferred embodiment of the present invention.

To determine the accuracy of the Dicer-cut location detector 116, a stringent training and test set was chosen from the abovementioned set of 440 known miRNA oligonucleotides, such that no two miRNA oligonucleotides in the set are homologous. This was performed to get a lower bound on the accuracy and avoid effects of similar known miRNA oligonucleotides appearing in both the training and test sets. On this stringent set of size 204, mfold cross validation with k=3 was performed to determine the percent of known miRNA oligonucleotides in which the dicer-cut location detector 116 described hereinabove predicted the correct miRNA oligonucleotide up to two nucleotides from the correct location.

The accuracy of the TWO PHASED predictor is depicted in the graph. The accuracy of the first phase of the TWO PHASED predictor is depicted by the upper line, and that of both phases of the TWO PHASED predictor is depicted by the lower line. Both are binned by the predictor score, where the score is the score of the first stage.

It is appreciated that these results validate the accuracy of the Dicer-cut location detector 116.

Figure 21C:
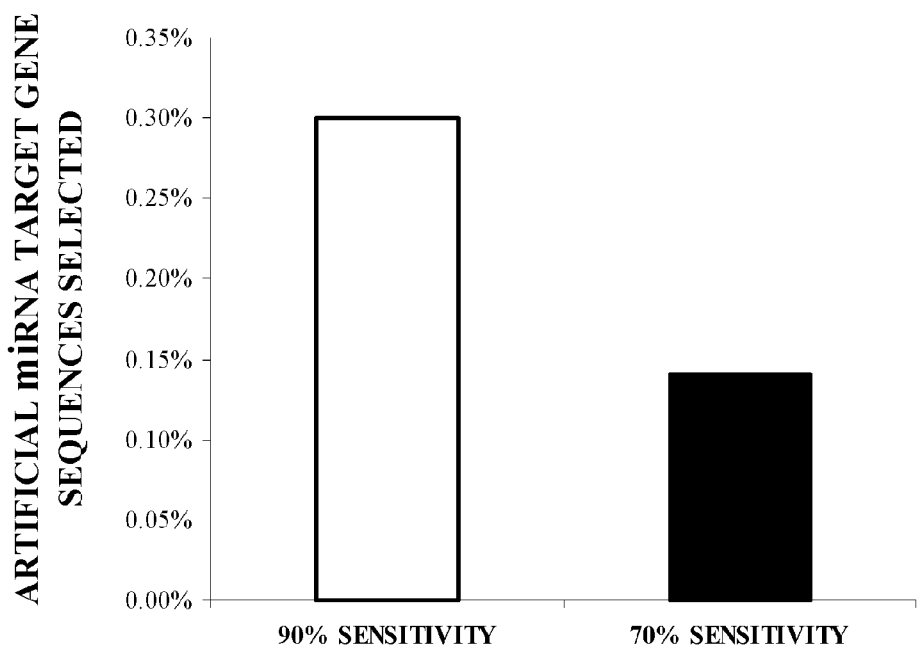
FIG. 21C is a bar graph illustrating performance results of the target gene binding site detector 118, constructed and operative in accordance with a preferred embodiment of the present invention.

Reference is now made to FIG. 21C, which is a bar graph illustrating the performance results of the target gene binding site detector 118 (FIG. 14A) constructed and operative in accordance with a preferred embodiment of the present invention.

FIG. 21C illustrates specificity and sensitivity of the target gene binding site detector 118. The values presented are the result of testing 10000 artificial miRNA oligonucleotide sequences (random 22 nt sequences with the same base composition as published miRNA oligonucleotide sequence). Adjusting the threshold parameters to fulfill 90% sensitivity of validated, published miRNA-3'UTR pairs, requires the P VAL of potential target gene sequences-Dicer-cut sequences to be less than 0.01 and also the P VAL of potential target ortholog gene sequences-Dicer-cut sequences to be less than 0.05. The target gene binding site detector 118 can filter out 99.7% of potential miRNA/gene pairs, leaving only the 0.3% that contain the most promising potential miRNA/gene pairs. Limiting the condition for the P VAL of potential target ortholog gene sequences-Dicer-cut sequences to be less than 0.01 reduces the sensitivity ratio to 70% but filters out more then 50% of the remaining 0.3%, to a final ratio of less than 0.15%.

It is appreciated that these results validate the sensitivity and specificity of the target gene binding site detector 118.

Reference is now made to FIG. 22, which is a summary table of laboratory results validating the expression of 29 novel human GAM RNA oligonucleotides in HeLa cells or, alternatively, in liver or thymus tissues detected by the bioinformatic oligonucleotide detection engine 100 (FIG. 9).

As a positive control, we used a reference set of eight known human miRNA oligonucleotides: hsa-MIR-21; hsa-MIR-27b; hsa-MIR-186; hsa-MIR-93; hsa-MIR-26a; hsa-MIR-191; hsa-MIR-31; and hsa-MIR-92. All positive controls were successfully validated by sequencing.

The table of FIG. 22 lists all GAM RNA predictions whose expression was validated. The field "Primer Sequence" contains the "specific" part of the primer; the field "Sequenced sequence" represents the nucleotide sequence detected by cloning (excluding the hemispecific primer sequence); the field "Predicted GAM RNA" contains the GAM RNA predicted sequence; the field "Distance indicate the distance from Primer; the number of mismatches between the "specific" region of the primer and the corresponding part of the GAM RNA sequence; the field "GAM Name" contains GAM RNA PRECURSOR ID followed by "A" or "B", which represents the GAM RNA position on the precursor as elaborated in the attached Tables.

A primer was designed such that its first half, the 5' region, is complementary to the adaptor sequence and its second half, the 3' region, anneals to the 5' terminus of GAM RNA sequence, yielding a hemispecific primer (as elaborated hereinbelow in the Methods section). A sample of 13 predicted GAM RNA sequences was examined by PCR using hemispecific primers and a primer specific to the 3' adaptor. PCR products were cloned into plasmid vectors and then sequenced. For all 13 predicted GAM RNA sequences, the GAM RNA sequence found in the hemispecific primer plus the sequence observed between the hemispecific primer and the 3' adaptor was completely included in the expected GAM RNA sequence (rows 1-7, and 29). The rest are GAM RNA predictions that were verified by cloning and sequencing, yet, by using a primer that was originally designed for a slightly different prediction.

It is appreciated that failure to detect a predicted oligonucleotide in the lab does not necessarily indicate a mistaken bioinformatic prediction. Rather, it may be due to technical sensitivity limitation of the lab test, or because the predicted oligonucleotides are not expressed in the tissue examined, or at the development phase tested. The observed GAM RNAs may be strongly expressed in HeLa cells while the original GAM RNAs are expressed at low levels in HeLa cells or not expressed at all. Under such circumstances, primer sequences containing up to three mismatches from a specific GAM RNA sequence may amplify it. Thus, we also considered cases in which differences of up to 3 mismatches in the hemispecific primer occur.

The 3' terminus of observed GAM RNA sequences is often truncated or extended by one or two nucleotides. Cloned sequences that were sequenced from both 5' and 3' termini have an asterick appended to the row number.

Interestingly, the primer sequence followed by the observed cloned sequence is contained within five GAM RNA sequences of different lengths, and belong to 24 precursors derived from distinct loci (Row 29). Out of these, one precursor appears four times in the genome and its corresponding GAM Names are 351973-A, 352169-A, 352445-A and 358164-A.

The sequence presented in Row 29 is a representative of the group of five GAM RNAs. The full list of GAM RNA sequences and their corresponding precursors is as follows (each GAM RNA sequence is followed by the GAM Name): TCACTGCAACCTCCACCTCCCA (352092, 352651, 355761), TCACTGCAACCTCCACCTCCCG (351868, 352440, 351973, 352169, 352445, 358164, 353737, 352382, 352235, 352232, 352268, 351919, 352473, 352444, 353638, 353004, 352925, 352943), TCACTGCAACCTCCACCTC-CTG (358311), TCACTGCAACCTCCACCTTCAG (353323), and TCACTGCAACCTCCACCTTCCG (353856).

Method Section

Cell Lines

Three common human cell lines, obtained from Dr. Yonat Shemer at Soroka Medical Center, Be'er Sheva, Israel, were used for RNA extraction; Human Embryonic Kidney HEK-293 cells, Human Cervix Adenocarcinoma HeLa cells and Human Prostate Carcinoma PC3 cells.

RNA Purification

Several sources of RNA were used to prepare libraries:

Total HeLa S100 RNA was prepared from HeLa S100 cellular fraction (4C Biotech, Belgium) through an SDS (1%)-Proteinase K (200 g/ml) 30 minute incubation at 37 C followed by an acid Phenol-Chloroform purification and isopropanol precipitation (Sambrook et al; Molecular Cloning—A Laboratory Manual).

Total HeLa, HEK-293 and PC3 cell RNA was prepared using the standard Tri-Reagent protocol (Sigma) according to the manufacturer's instructions, except that 1 volume of isopropanol was substituted with 3 volumes of ethanol.

Nuclear and Cytoplasmic RNA was prepared from HeLa or HEK-293 cells in the following manner:

Cell were washed and harvested in ice-cold PBS and precipitated in a swing-out rotor at 1200 rpm at 4 C for 5 minutes. Pellets were loosened by gentle vortexing. 4 ml of "NP40 lysis buffer" (10 mM TrisHCl, 5 mM MgCl2, 10 mM NaCl, 0.5% Nonidet P40, 1 mM Spermidine, 1 mM DTT, 140 U/ml rRnasine) was then added per 5*10^7 cells. Cells and lysis buffer were incubated for 5 minutes on ice and centrifuged in a swing-out rotor at 500×g at 4 C for 5 minutes. Supernatant, termed cytoplasm, is carefully removed to a tube containing SDS (1% final) and proteinase-K (200 g/ml final). Pellet, termed nuclear fraction, is re-washed and incubated with a similar amount of fresh lysis buffer. Lysis is monitored visually under a microscope at this stage, typically for 5 minutes. Nuclei are pelleted in a swing-out rotor at 500×g at 4 C for 5 minutes. Supernatant is pooled, incubated at 37 C for 30 minutes, Phenol/Chloroform-extracted, and RNA is alcohol-precipitated (Sambrook et al). Nuclei are loosened and then homogenized immediately in >10 volumes of Tri-Reagent (Sigma). Nuclear RNA is then prepared according to the manufacturer's instructions.

Total Tissue RNA

Total tissue RNA was obtained from Ambion USA, and included Human Liver, Thymus, Placenta, Testes and Brain.

RNA Size Fractionation

RNA used for libraries was always size-fractionated. Fractionation was done by loading up to 500 g RNA per YM100 Amicon Microcon column (Millipore) followed by a 500×g centrifugation for 40 minutes at 4 C. Flow-through "YM100" RNA is about one quarter of the total RNA and was used for library preparation or fractionated further by loading onto a YM30 Amicon Microcon column (Millipore) followed by a 13,500×g centrifugation for 25 minutes at 4 C. Flow-through "YM30" was used for library preparation "as is" and consists of less than 0.5% of total RNA. Additional size fractionation was achieved during library preparation.

Library Preparation

Two types of cDNA libraries, designated "One-tailed" and "Ligation", were prepared from the one of the abovementioned fractionated RNA samples. RNA was dephosphorylated and ligated to an RNA (designated with lowercase letters)-DNA (designated with UPPERCASE letters) hybrid 5'-phosphorylated, 3' idT blocked 3'-adapter (5'-P-uuuAAC-CGCATCCTTCTC-idT-3' Dharmacon #P-002045-01-05) (as elaborated in Elbashir et al., Genes Dev. 15:188-200 (2001)) resulting in ligation only of RNase III type cleavage products. 3'-Ligated RNA was excised and purified from a half 6%, half 13% polyacrylamide gel to remove excess adapter with a Nanosep 0.2M centrifugal device (Pall) according to instructions, and precipitated with glycogen and 3 volumes of ethanol. Pellet was resuspended in a minimal volume of water.

For the "Ligation" library, a DNA (UPPERCASE)-RNA (lowercase) hybrid 5'-adapter (5'-TACTAATACGACTCAC-Taaa-3' Dharmacon #P-002046-01-05) was ligated to the 3'-adapted RNA, reverse transcribed with "EcoRI-RT": (5'-GACTAGCTGGAATTCAAGGATGCGGTTAAA-3'), PCR amplified with two external primers essentially as in Elbashir et al. (2001), except that primers were "EcoRI-RT" and "PstI Fwd" (5'-CAGCCAACGCTGCAGATACGACTCAC-TAAA-3'). This PCR product was used as a template for a second round of PCR with one hemispecific and one external primer or with two hemispecific primers.

For the "One-tailed" library, the 3'-adapted RNA was annealed to 20 pmol primer "EcoRI RT" by heating to 70 C and cooling 0.1 C/sec to 30 C and then reverse-transcribed with Superscript II RT (according to manufacturer's instructions, Invitrogen) in a 20 l volume for 10 alternating 5 minute cycles of 37 C and 45 C. Subsequently, RNA was digested with 1 1 2M NaOH and 2 mM EDTA at 65 C for 10 minutes. cDNA was loaded on a polyacrylamide gel, excised and gel-purified from excess primer as above (invisible, judged by primer run alongside) and resuspended in 13 L of water. Purified cDNA was then oligo-dC tailed with 400 U of recombinant terminal transferase (Roche Molecular Biochemicals), 1 1 100M dCTP, 1 1 15 mM CoCl2, and 4 l reaction buffer, to a final volume of 20 l for 15 minutes at 37 C. Reaction was stopped with 2 l 0.2M EDTA and 15 l 3M NaOAc pH 5.2. Volume was adjusted to 150 l with water, Phenol:Bromochloropropane 10:1 extracted and subsequently precipitated with glycogen and 3 volumes of ethanol. C-tailed cDNA was used as a template for PCR with the external primers "T3-PstBsg (G/I)18" (5'-AATTAACCCTCACTAAAGGCTGCAG GTGCAGGIGGGIIGGGIIGGGIIGN-3' where I stands for Inosine and N for any of the 4 possible deoxynucleotides), and with "EcoRI Nested" (5'-GGAATTCAAGGATGCG-GTTA-3'). This PCR product was used as a template for a second round of PCR with one hemispecific and one external primer or with two hemispecific primers.

Primer Design and PCR

Hemispecific primers were constructed for each predicted GAM RNA oligonucleotide by an in-house program designed to choose about half of the 5' or 3' sequence of the GAM RNA corresponding to a TM of about 30-34 C constrained by an optimized 3' clamp, appended to the cloning adapter sequence (for "One-tailed" libraries, 5'-GGN-NGGGNNG on the 5' end or TTTAACCGCATC-3' on the 3' end of the GAM RNA; for "Ligation" libraries, the same 3' adapter and 5'-CGACTCACTAAA on the 5' end of the GAM RNA). Consequently, a fully complementary primer of a TM higher than 60 C was created covering only one half of the GAM RNA sequence permitting the unbiased elucidation by sequencing of the other half.

For each primer, the following criteria were used: Primers were graded according to the TM of the primer half and the nucleotide content of 3 nucleotides of the 3' clamp from worst to best, roughly: GGG-3'<CCC-3'<TTT-3'/AAA-3'<GG-3'<CC-3'<a TM lower than 30<a TM higher than 34<TT-3'/AA-3'<3G/C nucleotide combination <3 A/T nucleotide combination <any combination of two/three different nucleotides <any combination of three/three different nucleotides.

Validation PCR Product by Southern Blot

GAM RNA oligonucleotides were validated by hybridization of Polymerase Chain Reaction (PCR)-product Southern blots with a probe to the predicted GAM RNA.

PCR product sequences were confirmed by Southern blot (Southern E. M., Biotechnology 1992, 24:122-139 (1975)) and hybridization with DNA oligonucleotide probes synthesized as complementary (antisense) to predicted GAM RNA oligonucleotides. Gels were transferred onto a Bio-dyne PLUS 0.45 m (Pall) positively charged nylon membrane and UV cross-linked. Hybridization was performed overnight with DIG-labeled probes at 42?C in DIG Easy-Hyb buffer (Roche). Membranes were washed twice with 2×SSC and 0.1% SDS for 10 minutes at 42?C and then washed twice with 0.5×SSC and 0.1% SDS for 5 min at 42?C. The membrane was then developed by using a DIG luminescent detection kit (Roche) using anti-DIG and CSPD reaction, according to the manufacturer's protocol. All probes were prepared according to the manufacturer's (Roche Molecular Biochemicals) protocols: Digoxigenin (DIG) labeled antisense transcripts were prepared from purified PCR products using a DIG RNA labeling kit with T3 RNA polymerase. DIG-labeled PCR was prepared by using a DIG PCR labeling kit. 3'-DIG-tailed oligo ssDNA anti-sense probes, containing DIG-dUTP and dATP at an average tail length of 50 nts were prepared from 100 pmole oligonucleotides with the DIG Oligonucleotide Labeling Kit. Control reactions contained all of the components of the test reaction except library template.

Validation of PCR Product by Nested PCR on the Ligation

To further validate predicted GAM PCR product sequence derived from hemi-primers, a PCR-based diagnostic technique was devised to amplify only those products containing at least two additional nucleotides of the non hemi-primer defined part of the predicted GAM RNA oligonucleotide. In essence, a diagnostic primer was designed so that its 3' end, which is the specificity determining side, was identical to the desired GAM RNA oligonucleotide, 2-10 nts (typically 4-7, chosen for maximum specificity) further into its 3' end than the nucleotide stretch primed by the hemi-primer. The hemi-primer PCR product was first ligated into a T-cloning vector (pTZ57/T or pGEM-T) as described hereinabove. The ligation reaction mixture was used as template for the diagnostic PCR under strict annealing conditions with the new diagnostic primer in conjunction with a general plasmid-homologous primer, resulting in a distinct ~200 base-pair product. This PCR product can be directly sequenced, permitting the elucidation of the remaining nucleotides up to the 3' of the mature GAM RNA oligonucleotide adjacent to the 3' adapter. Alternatively, following analysis of the diagnostic PCR reaction on an agarose gel, positive ligation reactions (containing a band of the expected size) were transformed into E. coli. Using this same diagnostic technique and as an alternative to screening by Southern blot colony hybridization, transformed bacterial colonies were screened by colony-PCR (Gussow, D. and Clackson, T, Nucleic Acids Res. 17:4000 (1989)) with the nested primer and the vector primer, prior to plasmid purification and sequencing.

Validation of PCR Product by Cloning and Sequencing

CLONE SEQUENCING: PCR products were inserted into pGEM-T (Promega) or pTZ57/T (MBI Fermentas), heat-shock transformed into competent JM109 E. coli (Promega) and seeded on LB-Ampicilin plates with IPTG and Xgal. White and light blue colonies were transferred to duplicate gridded plates, one of which was blotted onto a membrane (Biodyne Plus, Pall) for hybridization with DIG tailed oligo probes (according to instructions, Roche) complementary to the expected GAM. Plasmid DNA from positive colonies was sequenced.

It is appreciated that the results summarize in FIG. 22 validate the efficacy of the bioinformatic oligonucleotide detection engine 100 of the present invention.

Reference is now made to FIG. 23A, which is a schematic representation of a novel human GR polynucleotide, located on chromosome 9, comprising 2 known human MIR oligonucleotides—MIR24 and MIR23, and 2 novel GAM oligonucleotides, herein designated GAM7617 and GAM252 (later discovered by other researchers as hsa-mir-27b), all marked by solid black boxes. FIG. 23A also schematically illustrates 6 non-GAM hairpin sequences, and one non-hairpin sequence, all marked by white boxes, and serving as negative controls. By "non-GAM hairpin sequences" is meant sequences of a similar length to known MIR PRECURSOR sequences, which form hairpin secondary folding pattern similar to MIR PRECURSOR hairpins, and yet which are assessed by the bioinformatic oligonucleotide detection engine 100 not to be valid GAM PRECURSOR hairpins. It is appreciated that FIG. 23A is a simplified schematic representation, reflecting only the order in which the segments of interest appear relative to one another, and not a proportional distance between the segments.

Reference is now made to FIG. 23B, which is a schematic representation of secondary folding of each of the MIRs and GAMs of the GR MIR24, MIR23, GAM7617 and GAM252, and of the negative control non-GAM hairpins, herein designated N2, N3, N252, N4, N6 and N7. N0 is a non-hairpin control, of a similar length to that of known MIR PRECURSOR hairpins. It is appreciated that the negative controls are situated adjacent to and in between real MIR oligonucleotides and GAM predicted oligonucleotides and demonstrates similar secondary folding patterns to that of known MIRs and GAMs.

Reference is now made to FIG. 23C, which is a picture of laboratory results of a PCR test upon a YM100 size-fractionated "ligation"-library, utilizing a set of specific primer pairs located directly inside the boundaries of the hairpins. Due to the nature of the library the only PCR amplifiable products can result from RNaseIII type enzyme cleaved RNA, as expected for legitimate hairpin precursors presumed to be produced by DROSHA (Lee et al, Nature 425 415-419, 2003). FIG. 23C demonstrates expression of hairpin precursors of known MIR oligonucleotides hsa-mir23 and hsa-mir24, and of novel bioinformatically-detected GAM7617 and GAM252 hairpins predicted bioinformatically by a system constructed and operative in accordance with a preferred embodiment of the present invention. FIG. 23C also shows that none of the 7 controls (6 hairpins designated N2, N3, N23, N4, N6 and N7 and 1 non-hairpin sequence designated N0) were expressed. N252 is a negative control sequence partially overlapping GAM252.

In the picture, test lanes including template are designated "+" and the control lane is designated "−". The control reaction contained all the components of the test reaction except library template. It is appreciated that for each of the tested hairpins, a clear PCR band appears in the test ("+") lane, but not in the control ("−") lane.

FIGS. 23A through 23C, when taken together validate the efficacy of the bioinformatic oligonucleotide detection engine in: (a) detecting known MIR oligonucleotides; (b) detecting novel GAM PRECURSOR hairpins which are found adjacent to these MIR oligonucleotides, and which despite exhaustive prior biological efforts and bioinformatic detection efforts, went undetected; (c) discerning between GAM (or MIR) PRECURSOR hairpins, and non-GAM hairpins.

It is appreciated that the ability to discern GAM-hairpins from non-GAM-hairpins is very significant in detecting GAM oligonucleotides since hairpins are highly abundant in the genome. Other MIR prediction programs have not been able to address this challenge successfully.

Reference is now made to FIG. 24A which is an annotated sequence of an EST comprising a novel GAM oligonucleotides detected by the oligonucleotide detection system of the present invention. FIG. 24A shows the nucleotide sequence of a known human non-protein-coding EST (Expressed Sequence Tag), identified as EST72223. The EST72223 clone obtained from TIGR database (Kirkness and Kerlavage, 1997) was sequenced to yield the above 705 bp transcript with a polyadenyl tail. It is appreciated that the sequence of this EST comprises sequences of one known miRNA oligonucleotide, identified as hsa-MIR98, and of one novel GAM oligonucleotide referred to here as GAM25, detected by the bioinformatic oligonucleotide detection engine 100 (FIG. 9) of the present invention.

The sequences of the precursors of the known MIR98 and of the predicted GAM25 precursors are marked in bold, the sequences of the established miRNA 98 and of the predicted miRNA-like oligonucleotide GAM25 are underlined.

Figure 24D:
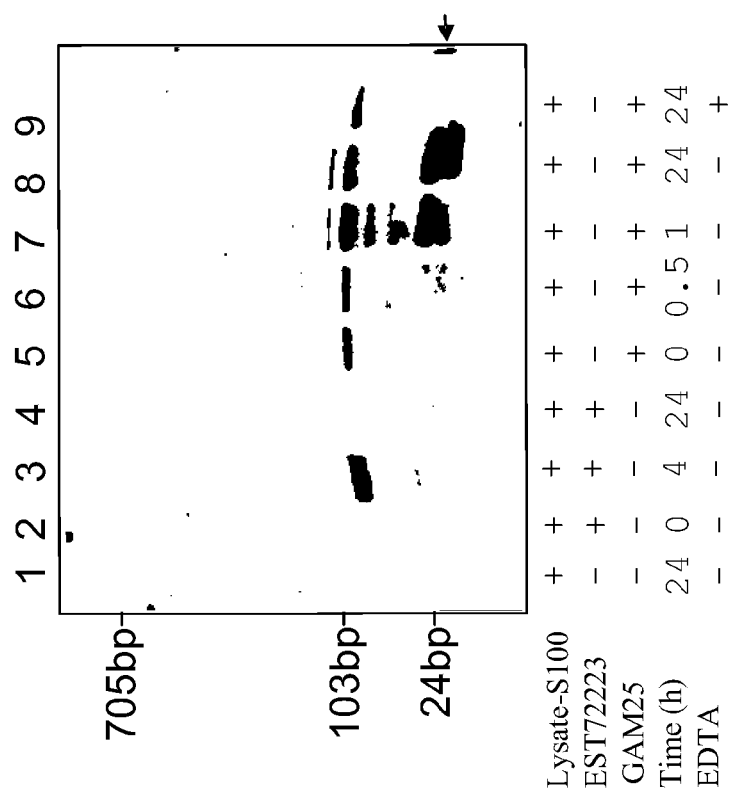
Figure 24C:
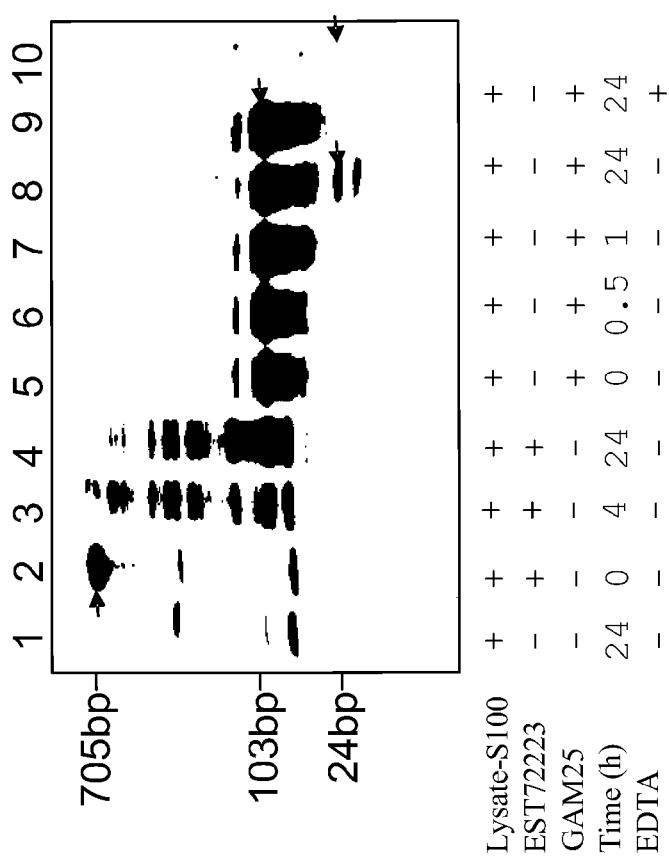

Reference is now made to FIGS. 24B, 24C and 24D that are pictures of laboratory results, which when taken together demonstrate laboratory confirmation of expression of the bioinformatically-detected novel oligonucleotide of FIG. 24A. In two parallel experiments, an enzymatically synthesized capped, EST72223 RNA transcript, was incubated with Hela S100 lysate for 0 minutes, 4 hours and 24 hours. RNA was subsequently harvested, run on a denaturing polyacrylamide gel, and reacted with either a 102 nt antisense MIR98 probe or a 145 nt antisenseGAM25 precursor transcript probe respectively. The Northern blot results of these experiments demonstrated processing of EST72223 RNA by Hela lysate (lanes 2-4, in FIGS. 24B and 24C), into ~80 bp and ~22 bp segments, which reacted with the MIR98 precursor probe (FIG. 24B), and into 100 bp and ~24 bp segments, which reacted with the GAM25 precursor probe (FIG. 24C). These results demonstrate the processing of EST72223 by Hela lysate into MIR98 precursor and GAM25 precursor. It is also appreciated from FIG. 24C (lane 1) that Hela lysate itself reacted with the GAM25 precursor probe, in a number of bands, including a ~100 bp band, indicating that GAM25-precursor is endogenously expressed in Hela cells. The presence of additional bands, higher than 100 bp in lanes 5-9 probably corresponds to the presence of nucleotide sequences in Hela lysate, which contain the GAM25 sequence.

In addition, in order to demonstrate the kinetics and specificity of the processing of MIR98 and GAM25 precursors into their respective mature, "diced" segments, transcripts of MIR98 and of the bioinformatically predicted GAM25 precursors were similarly incubated with Hela S100 lysate, for 0 minutes, 30 minutes, 1 hour and 24 hours, and for 24 hours with the addition of EDTA, added to inhibit Dicer activity, following which RNA was harvested, run on a polyacrylamide gel and reacted with MIR98 and GAM25 precursor probes. Capped transcripts were prepared for in-vitro RNA cleavage assays with T7 RNA polymerase, including a m7G (5')ppp(5')G-capping reaction using the T7-mMessage mMachine kit (Ambion). Purified PCR products were used as template for the reaction. These were amplified for each assay with specific primers containing a T7 promoter at the 5' end and a T3 RNA polymerase promoter at the 3' end. Capped RNA transcripts were incubated at 30 C in supplemented, dialysis concentrated, Hela S100 cytoplasmic extract (4 C Biotech, Seneffe, Belgium). The Hela S100 was supplemented by dialysis to a final concentration of 20 mM Hepes, 100 mM KCl, 2.5 mM MgCl2, 0.5 mM DTT, 20% glycerol and protease inhibitor cocktail tablets (Complete mini Roche Molecular Biochemicals). After addition of all components, final concentrations were 100 mM capped target RNA, 2 mM ATP, 0.2 mM GTP, 500 U/ml RNasin, 25 g/ml creatine kinase, 25 mM creatine phosphate, 2.5 mM DTT and 50% S100 extract. Proteinase K, used to enhance Dicer activity (Zhang et al., EMBO J. 21, 5875-5885 (2002)) was dissolved in 50 mM Tris-HCl pH 8, 5 mM CaCl2, and 50% glycerol, was added to a final concentration of 0.6 mg/ml. Cleavage reactions were stopped by the addition of 8 volumes of proteinase K buffer (200 Mm Tris-Hcl, pH 7.5, 25 mM EDTA, 300 mM NaCl, and 2% SDS) and incubated at 65 C for 15 min at different time points (0, 0.5, 1, 4, 24 h) and subjected to phenol/chloroform extraction. Pellets were dissolved in water and kept frozen. Samples were analyzed on a segmented half 6%, half 13% polyacrylamide 1×TBE-7M Urea gel.

The Northern blot results of these experiments demonstrated an accumulation of a ~22 bp segment which reacted with the MIR98 precursor probe, and of a ~24 bp segment which reacted with the GAM25 precursor probe, over time (lanes 5-8). Absence of these segments when incubated with EDTA (lane 9), which is known to inhibit Dicer enzyme (Zhang et al., 2002), supports the notion that the processing of MIR98 and GAM25 precursors into their "diced" segments is mediated by Dicer enzyme, found in Hela lysate. Other RNases do not utilize divalent cations and are thus not inhibited by EDTA. The molecular sizes of EST72223, MIR-98 and GAM25 and their corresponding precursors are indicated by arrows.

FIG. 24D present Northern blot results of same above experiments with GAM25 probe (24 nt). The results clearly demonstrated the accumulation of mature GAM25 oligonucleotide after 24 h.

To validate the identity of the band shown by the lower arrow in FIGS. 24C and 24D, a RNA band parallel to a marker of 24 base was excised from the gel and cloned as in Elbashir et al (2001) and sequenced. 90 clones corresponded to the sequence of mature GAM25 oligonucleotide, three corresponded to GAM25*(the opposite arm of the hairpin with a 1-3 nt 3' overhang) and two to the hairpin-loop.

GAM25 was also validated endogenously by sequencing from both sides from a HeLa YM100 total-RNA "ligation" libraries, utilizing hemispecific primers as described in FIG. 22.

Taken together, these results validate the presence and processing of a novel MIR-like oligonucleotide, GAM25, which was predicted bioinformatically. The processing of this novel GAM oligonucleotide product, by Hela lysate from EST72223, through its precursor, to its final form was similar to that observed for known miRNA oligonucleotide, MIR98.

Transcript products were 705 nt (EST72223), 102 nt (MIR98 precursor), 125 nt (GAM25 precursor) long. EST72223 was PCR amplified with T7-EST 72223 forward primer: 5'-TAATACGACTCACTATAGGCCCTTATTA-GAGGATTCTG CT-3' (SEQ ID NO: 10068178) and T3-EST72223 reverse primer:" AATTAACCCTCAC-TAAAGGTTTTTTTTTCCTGAGA CAGAGT-3' (SEQ ID NO: 10068179). MIR98 was PCR amplified using EST72223 as a template with T7MIR98 forward primer: 5'-TAATAC-GACTCACTATAGGGTGAGGTAGTAAG TTGTATTGTT-3' (SEQ ID NO: 10068180) and T3MIR98 reverse primer: 5'AATTAACCCTCACTAAAGGGAAAGTAGTAAGT TGTATAGTT-3' (SEQ ID NO: 10068181). GAM25 was PCR amplified using EST72223 as a template with GAM25 forward primer: 5' GAGGCAGGAGAATTGCTTGA-3' (SEQ ID NO: 10068182) and T3 EST72223 reverse primer: 5'-AATTAACCCTCACTAAAGGCCTGAGACA-GAGTCTTGCT C-3' (SEQ ID NO: 10068183).

It is appreciated that the data presented in FIGS. 24A, 24B, 24C and 24D when taken together validate the function of the bioinformatic oligonucleotide detection engine 100 of FIG. 9. FIG. 24A shows a novel GAM oligonucleotide bioinformatically-detected by the bioinformatic oligonucleotide detection engine 100, and FIGS. 24C and 24D show laboratory confirmation of the expression of this novel oligonucleotide. This is in accord with the engine training and validation methodology described hereinabove with reference to FIG. 9.

Figure 25A:
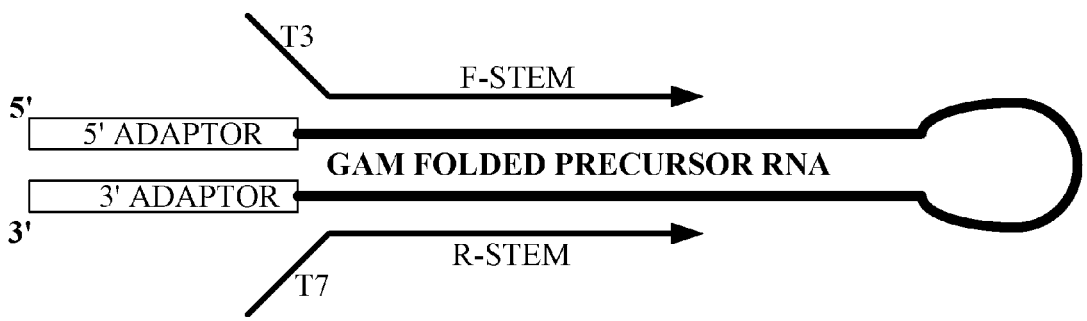
FIGS. 25A, 25B and 25C are schematic diagrams which, when taken together, represent methods of designing primers to identify specific hairpin oligonucleotides in accordance with a preferred embodiment of the present invention.
Figure 25B:
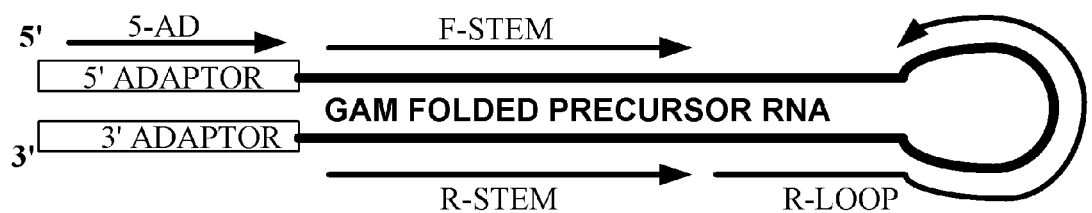
Figure 25C:
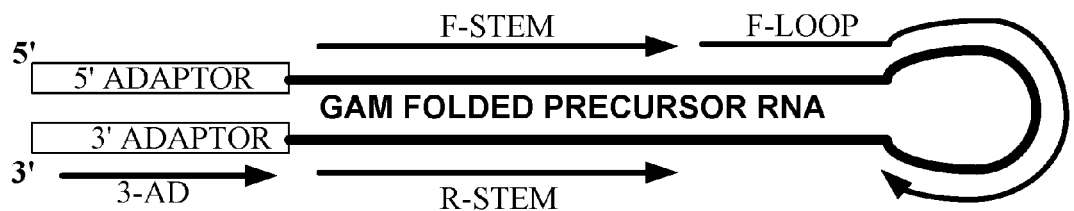

Reference is now made to FIGS. 25A-C, which schematically represent three methods that are employed to identify GAM FOLDED PRECURSOR RNA from libraries. Each method involves the design of specific primers for PCR amplification followed by sequencing. The libraries include hairpins as double-stranded DNA with two different adaptors ligated to their 5' and 3' ends.

Reference is now made to FIG. 25A, which depicts a first method that uses primers designed to the stems of the hairpins. Since the stem of the hairpins often has bulges, mismatches, as well as G-T pairing, which is less significant in DNA than is G-U pairing in the original RNA hairpin, the primer pairs were engineered to have the lowest possible match to the other strand of the stem. Thus, the F-Stem primer, derived from the 5' stem region of the hairpin, was chosen to have minimal match to the 3' stem region of the same hairpin. Similarly, the R-stem primer, derived from the 3' region of the hairpin (reverse complementary to its sequence), was chosen to have minimal match to the 5' stem region of the same hairpin. The F-Stem primer was extended in its 5' sequence with the T3 primer (5'-ATTAACCCTCAC-TAAAGGGA-3') and the R-Stem primer was extended in its 5' sequence with the T7 primer (5'-TAATACGACTCACTAT-AGGG). The extension is needed to obtain a large enough fragment for direct sequencing of the PCR product. Sequence data from the amplified hairpins is obtained in two ways. One way is the direct sequencing of the PCR products using the T3 primer that matches the extension of the F-Stem primer. Another way is the cloning of the PCR products into a plasmid, followed by PCR screening of individual bacterial colonies using a primer specific to the plasmid vector and either the R-Loop (FIG. 25B) or the F-Loop (FIG. 25C) primer. Positive PCR products are then sent for direct sequencing using the vector-specific primer.

Reference is now made to FIG. 25B, which depicts a second method in which R-Stem primer and R-Loop primers are used in a nested-PCR approach. First, PCR is performed with the R-Stem primer and the primer that matches the 5' adaptor sequence (5-ad primer). PCR products are then amplified in a second PCR using the R-Loop and 5-ad primers. As mentioned hereinabove, sequence data from the amplified hairpins is obtained in two ways. One way is the direct sequencing of the PCR products using the 5-ad primer. Another way is the cloning of the PCR products into a plasmid, followed by PCR screening of individual bacterial colonies using a primer specific to the plasmid vector and F-Stem primer. Positive PCR products are then sent for direct sequencing using the vector-specific primer. It should be noted that optionally an extended R-Loop primer is designed that includes a T7 sequence extension, as described hereinabove (FIG. 25A) for the R-Stem primer. This is important in the first sequencing option in cases where the PCR product is too short for sequencing.

Reference is now made to FIG. 25C, which depicts a third method, which is the exact reverse of the second method described hereinabove (FIG. 25B). F-Stem and F-Loop primers are used in a nested-PCR approach. First, PCR is performed with the F-Stem primer and the primer that matches the 3' adaptor sequence (3-ad primer). PCR products are then amplified in a second PCR using the F-Loop and 3-ad primers. As in the other two methods, sequence data from the amplified hairpins is obtained in two ways. One way is the direct sequencing of the PCR products using the F-Loop primer. Another way is the cloning of the PCR products into a plasmid, followed by PCR screening of individual bacterial colonies using a primer specific to the plasmid vector and R-Stem primer. Positive PCR products are then sent for direct sequencing using the vector-specific primer. It should be noted that optionally an extended F-Loop primer is designed that includes a T3 sequence extension, as described hereinabove (FIG. 25A) for the F-Stem primer. This is important in the first sequencing option in cases where the PCR product is too short for sequencing and also in order to enable the use of T3 primer.

In an embodiment of the present invention, the three methods mentioned hereinabove may be employed to validate the expression of GAM FOLDED PRECURSOR RNA.

Figure 26A:
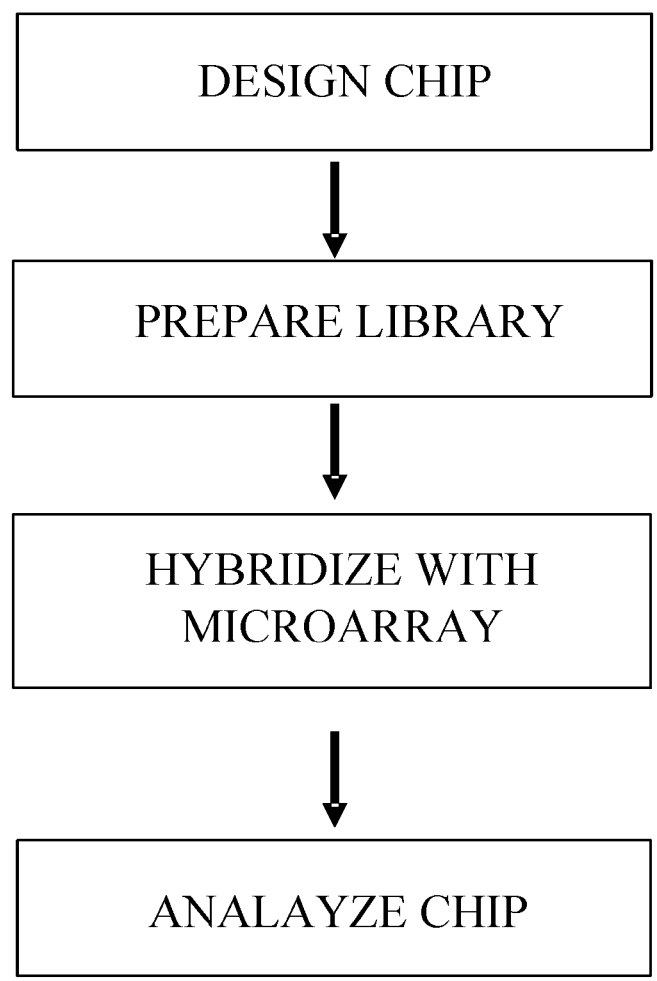
FIG. 26A is a simplified flowchart illustrating construction of a microarray constructed and operative to identify novel oligonucleotides of the present invention, in accordance with a preferred embodiment of the present invention.

Reference is now made to FIG. 26A, which is a flow chart with a general description of the design of the microarray to identify expression of published miRNA oligonucleotides, and of novel GAM oligonucleotides of the present invention.

Figure 26B:
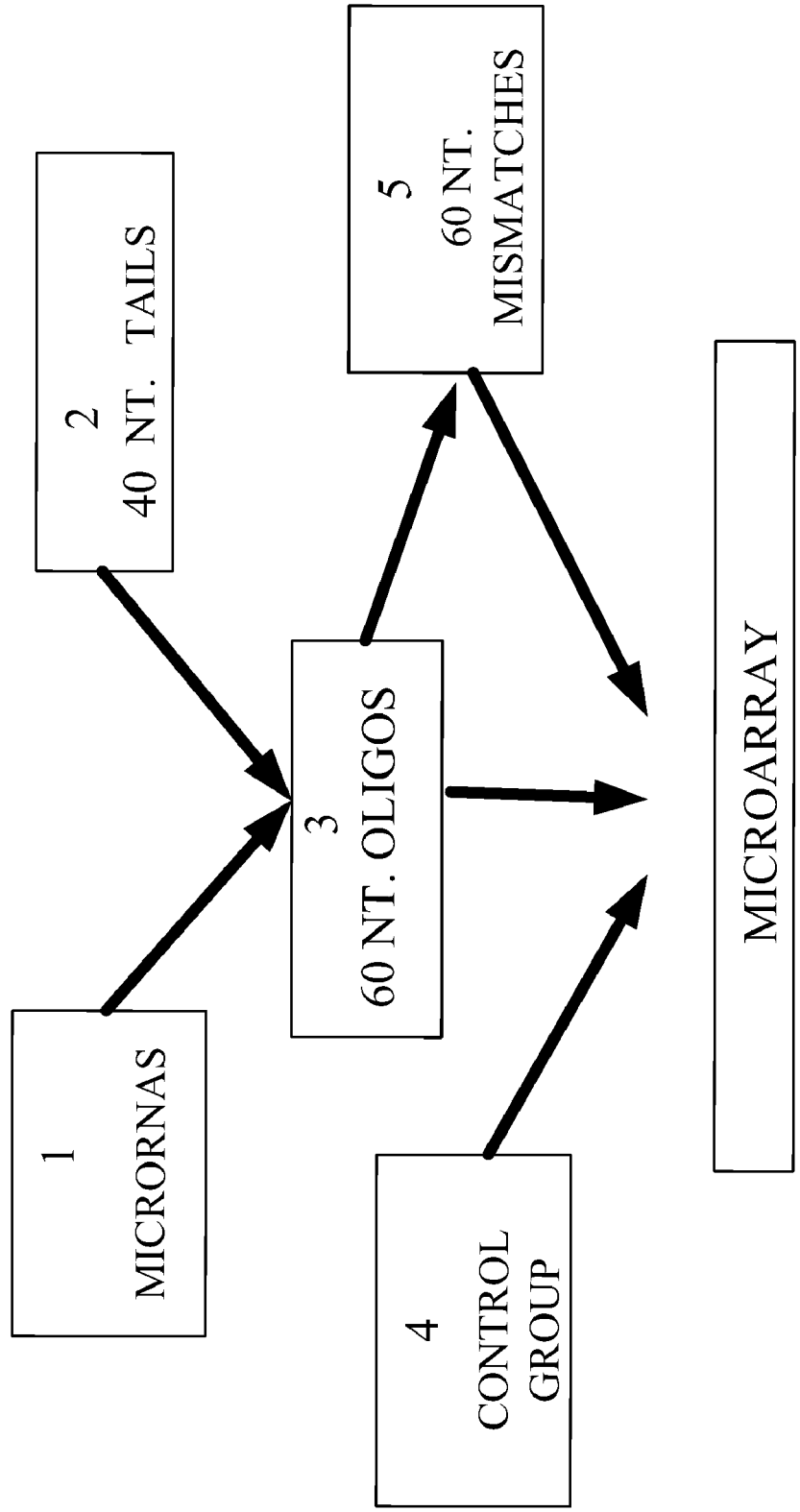
FIG. 26B is a simplified block diagram illustrating design of a microarray constructed and operative to identify novel oligonucleotides of the present invention, in accordance with a preferred embodiment of the present invention.
Figure 26C:
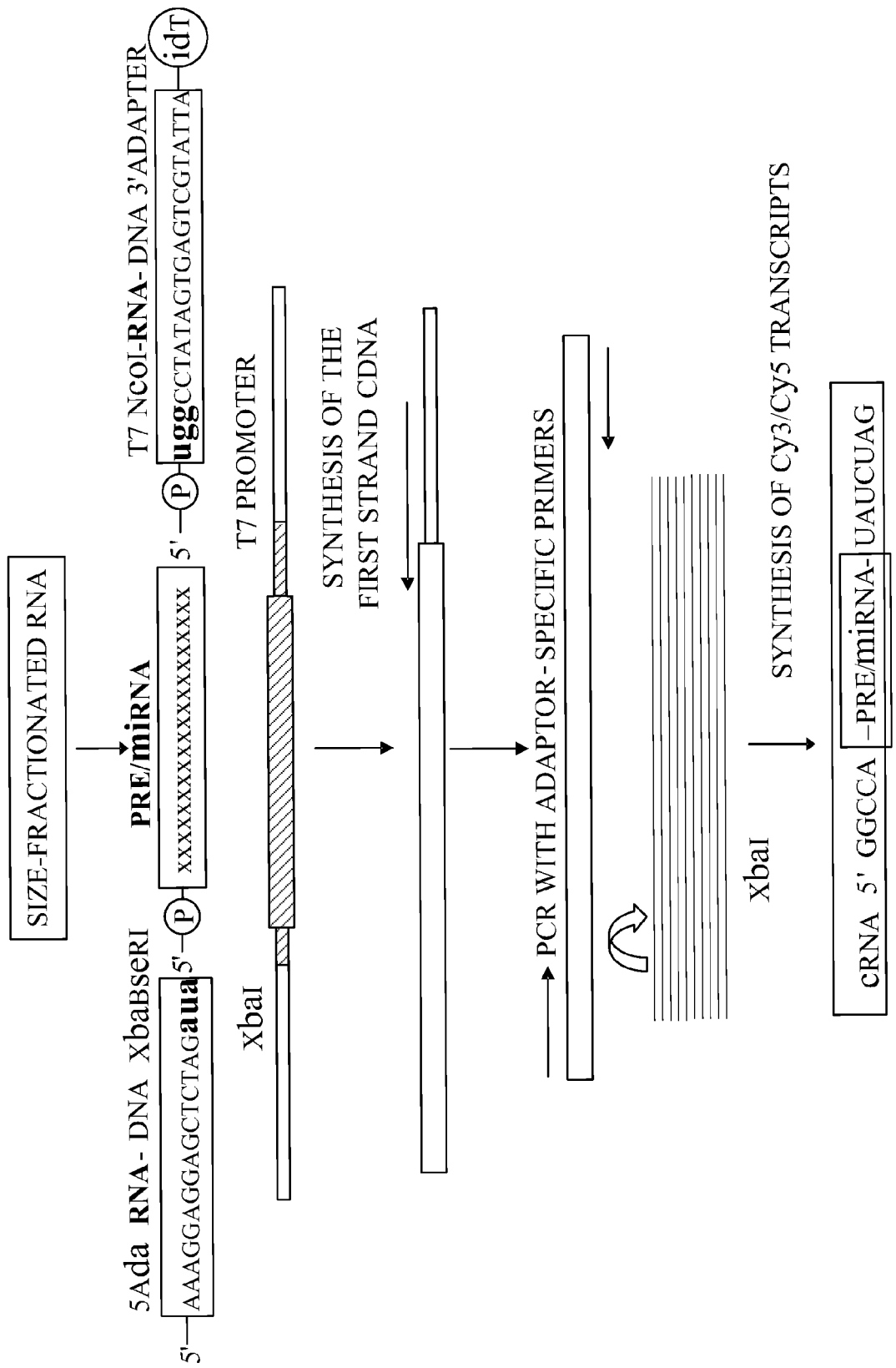
FIG. 26C is a flowchart illustrating a mode of preparation and amplification of a cDNA library in accordance with a preferred embodiment of the present invention.

A microarray that identifies miRNA oligonucleotides is designed (FIG. 26B). The DNA microarray is prepared by Agilent according to their SurePrint Procedure (reference describing their technology can be obtained from the Agilent website www.agilent.com). In this procedure, the oligonucleotide probes are synthesized on the glass surface. Other methods can also be used to prepare such microarray including the printing of pre-synthesized oligonucleotides on glass surface or using the photolithography method developed by Affymetrx (Lockhart D J et al., Nat Biotechnol. 14:1675-1680 (1996)). The 60-mer sequences from the design are synthesized on the DNA microarray. The oligonucleotides on the microarray, termed "probes" are of the exact sequence as the designed 60-mer sequences. Importantly, the 60-mer sequences and the probes are in the sense orientation with regards to the miRNA oligonucleotides. Next, a cDNA library is created from size-fractionated RNA, amplified, and converted back to RNA (FIG. 26C). The resulting RNA is termed "cRNA". The conversion to RNA is done using a T7 RNA polymerase promoter found on the 3' adaptor (FIG. 26C; T7 NcoI-RNA-DNA 3'Adaptor). Since the conversion to cRNA is done in the reverse direction compared to the orientation of the miRNA oligonucleotides, the cRNA is reverse complementary to the probes and is able to hybridize to it. This amplified RNA is hybridized with the microarray that identifies miRNA oligonucleotides, and the results are analyzed to indicate the relative level of miRNA oligonucleotides (and hairpins) that are present in the total RNA of the tissue (FIG. 27).

Reference is now made to FIG. 26B, which describes how the microarray to identify miRNA oligonucleotides is designed. miRNA oligonucleotide sequences or potential predicted miRNA oligonucleotides are generated by using known or predicted hairpins as input. Overlapping potential miRNA oligonucleotides are combined to form one larger sub-sequence within a hairpin.

To generate non-expressed sequences (tails), artificial sequences are generated that are 40 nts in length, which do not appear in the respective organism genome, do not have greater than 40% homology to sequences that appear in the genome, and with no 15-nucleotide window that has greater than 80% homology to sequences that appear in the genome.

To generate probe sequences, the most probable miRNA oligonucleotide sequences are placed at position 3 (from the 5' end) of the probe. Then, a tail sub-sequence to the miRNA oligonucleotide sequence was attached such that the combined sequence length will meet the required probe length (60 nts for Agilent microarrays).

The tails method provides better specificity compared to the triplet method. In the triplet method, it cannot be ascertained that the design sequence, and not an uncontrolled window from the triplet probe sequence, was responsible for hybridizing to the probe. Further the tails method allows the use of different lengths for the potential predicted miRNA oligonucleotide (of combined, overlapping miRNA oligonucleotides).

Hundreds of control probes were examined in order to ensure the specificity of the microarray. Negative controls contain probes which should have low intensity signal. For other control groups, the concentration of certain specific groups of interest in the library are monitored. Negative controls include tail sequences and non-hairpin sequences. Other controls include mRNA for coding genes, tRNA, and snoRNA.

For each probe that represents known or predicted miRNA oligonucleotides, additional mismatch probes were assigned in order to verify that the probe intensity is due to perfect match (or as close as possible to a perfect match) binding between the target miRNA oligonucleotide cRNA and its respective complementary sequence on the probe. Mismatches are generated by changing nucleotides in different positions on the probe with their respective complementary nucleotides (A< >T, G< >C, and vice versa). Mismatches in the tail region should not generate a significant change in the intensity of the probe signal, while mismatches in the miRNA oligonucleotide sequences should induce a drastic decrease in the probe intensity signal. Mismatches at various positions within the miRNA oligonucleotide sequence enable us to detect whether the binding of the probe is a result of perfect match or, alternatively, nearly perfect match binding.

Based on the above scheme, we designed a DNA microarray prepared by Agilent using their SurePrint technology. Table 11 is a detailed list of microarray chip probes Known miRNA Oligonucleotides:

The miRNA oligonucleotides and their respective precursor sequences are taken from Sanger Database to yield a total of 186 distinct miRNA oligonucleotide and precursor pairs. The following different probes are constructed:

1. Single miRNA Oligonucleotide Probes:

From each precursor, 26-mer containing the miRNA oligonucleotide were taken, then assigned 3 probes for each extended miRNA oligonucleotide sequence: 1. the 26-mer are at the 5' of the 60-mer probe, 2. the 26-mer are at the 3' of the 60-mer probe, 3. the 26-mer are in the middle of the 60-mer probe. Two different 34-mer subsequences from the design tails are attached to the 26-mer to accomplish 60-mer probe. For a subset of 32 of Single miRNA oligonucleotide probes, six additional mismatches mutations probes were designed: 4 block mismatches at 5' end of the miRNA oligonucleotide;

6 block mismatches at 3' end of the miRNA oligonucleotide;

1 mismatch at position 10 of the miRNA oligonucleotide;

2 mismatches at positions 8 and 17 of the miRNA oligonucleotide;

3 mismatches at positions 6, 12 and 18 of the miRNA oligonucleotide; and 6 mismatches at different positions out of the miRNA oligonucleotide.

2. Duplex miRNA Oligonucleotide Probes:

From each precursor, a 30-mer containing the miRNA oligonucleotide was taken, then duplicated to obtain 60-mer probe. For a subset of 32 of probes, three additional mismatch mutation probes were designed:

2 mismatches on the first miRNA oligonucleotide;

2 mismatches on the second miRNA oligonucleotide; and 2 mismatches on each of the miRNA oligonucleotides.

3. Triplet miRNA Oligonucleotide Probes:

Following Krichevsky's work (Krichevsky et al., RNA 9:1274-1281 (2003)), head to tail ~22-mer length miRNA oligonucleotide sequences were attached to obtain 60-mer probes containing up to three repeats of the same miRNA oligonucleotide sequence. For a subset of 32 probes, three additional mismatch mutation probes were designed:

2 mismatches on the first miRNA oligonucleotide;

2 mismatches on the second miRNA oligonucleotide; and 2 mismatches on each of the miRNA oligonucleotides.

4. Precursor with miRNA Oligonucleotide Probes:

For each precursor, 60-mer containing the miRNA oligonucleotide were taken.

5. Precursor without miRNA Oligonucleotide Probes:

For each precursor, a 60-mer containing no more then 16-mer of the miRNA oligonucleotide was taken. For a subset of 32 probes, additional mismatch probes containing four mismatches were designed.

Control Groups:

1. 100 60-mer sequences from representative ribosomal RNAs.

2. 85 60-mer sequences from representatives tRNAs.

3. 19 60-mer sequences from representative snoRNA.

4. 294 random 26-mer sequences from human genome not contained in published or predicted precursor sequences, placing them at the probe's 5' and attached 34-mer tail described above.

5. Negative Control: 182 different 60-mer probes contained different combinations of 10 nt-long sequences, in which each 10 nt-long sequence is very rare in the human genome, and the 60-mer combination is extremely rare.

Predicted GAM RNAs:

There are 8642 pairs of predicted GAM RNA and their respective precursors. From each precursor, a 26-mer containing the GAM RNA was placed at the 5' of the 60-mer probe and a 34-mer tail was attached to it. For each predicted probe, a mutation probes with 2 mismatches at positions 10 and 15 of the GAM RNA were added.

For a subset of 661 predicted precursors, up to 2 probes each containing one side of the precursor including any possible GAM RNA in it were added.

Microarray Analysis:

Based on known miRNA oligonucleotide probes, a preferred position of the miRNA oligonucleotide on the probe was evaluated, and hybridization conditions adjusted and the amount of cRNA to optimize microarray sensitivity and specificity ascertained. Negative controls are used to calculate background signal mean and standard deviation. Different probes of the same miRNA oligonucleotide are used to calculate signal standard deviation as a function of the signal.

For each probe, BG_Z_Score=(log(probe signal)−mean of log(negative control signal))/(log(negative control signal) standard deviation) were calculated.

For a probe with a reference probe with 2 mismatches on the miRNA oligonucleotide, MM_Z_Score MM_Z_Score= (log(perfect match signal)−log(reference mismatch signal))/ (standard deviation of log(signals) as the reference mismatch log(signal)) were calculated.

BG_Z_Score and MM_Z_Score are used to decide whether the probe is on and its reliability.

Reference is now made to FIG. 26C, which is a flowchart describing how the cDNA library was prepared from RNA and amplified. The general procedure was performed as described previously (Elbashir S M, Lendeckel W, Tuschl T. RNA interference is mediated by 21- and 22-nucleotide RNAs. Genes Dev. 2001 15:188-200) with several modifications which will be described hereinbelow.

First, the starting material is prepared. Instead of starting with standard total RNA, the total RNA was size-fractionated using an YM-100 Microcon column (Millipore Corporation, Billerica, Mass., USA) in the present protocol. Further, the present protocol uses human tissue or cell lines instead of a *Drosophila* in-vitro system as starting materials. Finally, 3 g of size-fractionated total RNA was used for the ligation of adaptor sequences.

Libraries used for microarray hybridization are listed hereinbelow: "A" library is composed of a mix of libraries from Total HeLa YM100 RNA and Nuclear HeLa YM100 RNA; "B" library is composed of a mix of libraries from Total HEK293 YM100 RNA and Nuclear HEK293 YM100 RNA; "C" library is composed of a mix of YM100 RNA libraries from Total PC3, Nuclear PC3 and from PC3 cells in which Dicer expression was transiently silenced by Dicer specific siRNA; "D" library is prepared from YM100 RNA from Total Human Brain (Ambion Cat#7962); "E" library is prepared from YM100 RNA from Total Human Liver (Ambion Cat#7960); "F" library is prepared from YM100 RNA from Total Human Thymus (Ambion Cat#7964); "G" library is prepared from YM100 RNA from Total Human Testis (Ambion Cat#7972); and "H" library is prepared from YM100 RNA from Total Human Placenta (Ambion Cat#7950).

Library letters appended by a numeral "1" or "2" are digested by XbaI (NEB); Library letters affixed by a numeral "3" are digested by Xba1 and SpeI (NEB); Library letters appended by a numeral "4" are digested by Xba1 and the transcribed cRNA is then size-fractionated by YM30, retaining the upper fraction consisting of 60 nts and longer; Library letters affixed by a numeral "5" are digested by Xba1 and the transcribed cRNA is then size-fractionated by YM30 retaining the flow-through fraction consequently concentrated with YM10 consisting of 30 nts-60 nts; Library letters affixed by a numeral "6" are digested by Xba1 and the DNA is fractionated on a 13% native acrylamide gel from 40-60 nt, electroeluted on a GeBaFlex Maxi column (GeBa Israel), and lyophilized; Library letters affixed by a numeral "7" are digested by Xba1 and the DNA is fractionated on a 13% native acrylamide gel from 80-160 nt, electroeluted and lyophilized.

Next, unique RNA-DNA hybrid adaptor sequences with a T7 promoter were designed. This step is also different than other protocols that create libraries for microarrays. Most protocols use complements to the polyA tails of mRNA with a T7 promoter to amplify only mRNA. However, in the present invention, adaptors are used to amplify all of the RNA within the size-fractionated starting material. The adaptor sequences are ligated to the size-fractionated RNA as described in FIG. 22, with subsequent gel-fractionation steps. The RNA is then converted to first strand cDNA using reverse transcription.

Next, the cDNA is amplified using PCR with adaptor-specific primers. At this point, there is the optional step of removing the tRNA, which is likely to be present because of its low molecular weight, but may add background noise in the present experiments. All tRNA contain the sequence ACC at their 3' end, and the adaptor contains GGT at its 5' end. This sequence together (GGTACC) is the target site for NcoI restriction digestion. Thus, adding the restriction enzyme NcoI either before or during PCR amplification will effectively prevent the exponential amplification of the cDNA sequences that are complements of the tRNAs.

The amplified DNA is restriction enzyme-digested with Xba1 (and, optionally, with Pst or SpeI) to remove the majority of the adaptor sequences that were initially added to the RNA. Using the first set of RNA-DNA hybrid adaptors listed below, the first two sets of primers listed below, and Xba1 restriction digest yields the following cRNA products: 5'GGCCA-pallindrome/microRNA-UAUCUAG. Using the second set of RNA-DNA hybrid adaptors listed below, the second set of primers listed below, and Xba1 and Pst restriction digest yields the following, smaller cRNA products: 5'GG-pallindrome/microRNA-C*.

Then, cDNA is transcribed to cRNA utilizing an RNA polymerase e.g. T7 dictated by the promoter incorporated in the adaptor. cRNA may be labeled in the course of transcription with aminoallyl or fluorescent nucleotides such as Cy3- or Cy5-UTP and CTP among other labels, and cRNA sequences thus transcribed and labeled are hybridized with the microarray.

The following RNA-DNA hybrid adaptors are included in the present invention:

Name: T7 NcoI-RNA-DNA 3'Adapter

Sequence: 5'(5phos)rUrGrGCCTATAGTGAGTCG-TATTA(3I nvdT)3' (SEQ ID NO: 10068186)

2. Name: 5Ada RNA-DNA XbaBseRI

Sequence: 5'AAAGGAGGAGCTCTAGrArUrA 3' (SEQ ID NO: 10068187) or optionally:

3. Name: 5Ada MC RNA-DNA PstAtaBser

Sequence: 5'CCTAGGAGGAGGACGTCTGrCrArG 3' (SEQ ID NO: 10068188)

4. Name: 3'Ada nT7 MC RNA-DNA

Sequence: 5'(5phos)rCrCrUATAGTGAGTCGTATTATCT (3InvdT)3' (SEQ ID NO: 10068189)

The following DNA primers are included in the present invention:

1. Name: T7 NcoI-RT-PCR primer

Sequence: 5'TAATACGACTCACTATAGGCCA 3' (SEQ ID NO: 10068308)

2. Name: T7NheI SpeI-RT-PCR primer

Sequence: 5'GCTAGCACTAGTTAATACGACTCACTAT-AGGC CA 3' (SEQ ID NO: 10068309)

3. Name: 5Ada XbaBseRI Fwd

Sequence: 5'AAAGGAGGAGCTCTAGATA 3' (SEQ ID NO: 10068192)

4. Name: Pst-5Ada XbaBseRI Fwd

Sequence: 5'TGACCTGCAGAAAGGAGGAGCTCTA-GATA 3' (SEQ ID NO: 10068193) or optionally:

5. Name: 5Ada MC PstAtaBser fwd

Sequence: 5'ATCCTAGGAGGAGGACGTCTGCAG 3' (SEQ ID NO: 10068306)

6. Name: RT nT7 MC XbaI

Sequence: 5'GCTCTAGGATAATACGACTCACTATAGG 3' (SEQ ID NO: 10068307)

Figure 27A:
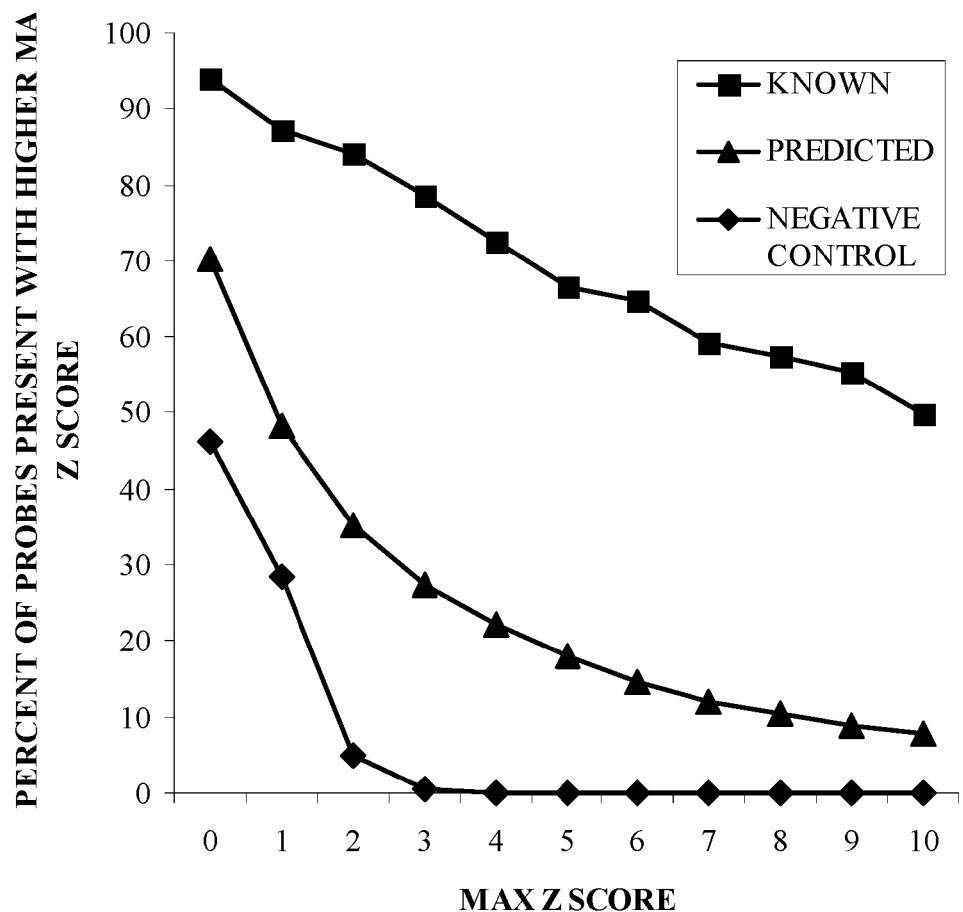
FIG. 27A is a line graph showing results of detection of known microRNA oligonucleotides and of novel GAM oligonucleotides, using a microarray constructed and operative in accordance with a preferred embodiment of the present invention.

Reference is now made to FIG. 27A, which demonstrates the detection of known miRNA oligonucleotides and of novel GAM oligonucleotides, using a microarray constructed and operative in accordance with a preferred embodiment of the present invention. Based on negative control probe intensity signals, we evaluated the background, non-specific, logarithmic intensity distribution, and extracted its mean, designated BG_mean, and standard deviation, designated BG_std. In order to normalize intensity signals between different microarray experiments, a Z score, which is a statistical measure that quantifies the distance (measured in standard deviations) that a data point is from the mean of a data set, was calculated for each probe with respect to the negative control using the following Z score formula: Z=(logarithm of probe signal BG_mean)/BG_std. We performed microarray experiments using RNA extracted from several different tissues and we calculated each probes maximum Z score. FIG. 27A shows the percentages of known, predicted and negative control groups that have a higher max Z score than a specified threshold as a function of max Z score threshold. The negative control group plot, included as a reference, considers probe with a max Z score greater then 4 as a reliable probe with meaningful signals. The sensitivity of our method was demonstrated by the detection of almost 80% of the known published miRNA oligonucleotides in at least one of the examined tissues. At a threshold of 4 for the max Z score, 28% of the predicted GAMs are present in at least one of the examined tissues.

Figure 27B:
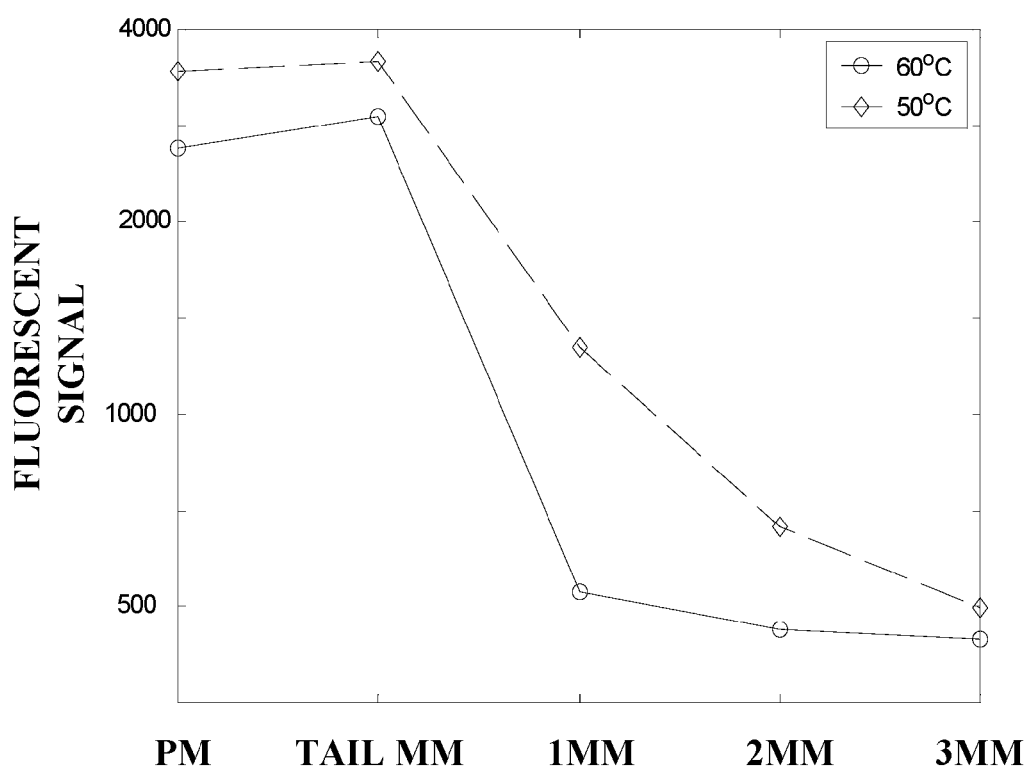
FIG. 27B is a line graph showing specificity of hybridization of a microarray constructed and operative in accordance with a preferred embodiment of the present invention.

Reference is now made to FIG. 27B, which is a line graph showing specificity of hybridization of a microarray constructed and operative in accordance with a preferred embodiment of the present invention and described hereinabove with reference to FIGS. 26A-26C. The average signal of known miRNA oligonucleotides in Library A2 is presented on a logarithmic scale as a function of the following probe types under two different hybridization conditions: 50 C and 60 C: perfect match (PM), six mismatches on the tail (TAIL MM), one mismatch on the miRNA oligonucleotide (1 mM), two separate mismatches on the miRNA oligonucleotide (2 mM), three separate mismatches on the miRNA oligonucleotide (3 mM). The relative equality of perfect match probes and probes with the same miRNA oligonucleotide but many mismatches over the tail attest to the independence between the tail and the probe signal. At a hybridization temperature of 60?C, one mismatch in the middle of the miRNA oligonucleotide is enough to dramatically reduce the probe signal. Conducting chip hybridization at 60 C ensures that a probe has a very high specificity.

It is appreciated that these results demonstrate the specificity of the microarray of the present invention in detecting expression of microRNA oligonucleotides.

Reference is now made to FIG. 27C, which is a summary table demonstrating detection of known microRNA oligonucleotides using a microarray constructed and operative in accordance with a preferred embodiment of the present invention and described hereinabove with reference to FIGS. 26A-26C.

Labeled cRNA from HeLa cells and Human Liver, Brain, Thymus, Placenta, and Testes was used for 6 different hybridizations. The table contains the quantitative values obtained for each miRNA oligonucleotide probe. For each miRNA oligonucleotide, the highest value (or values) is given in bolded font while lower values are given in regular font size. Results for MIR-124A, MIR-9 and MIR-122A are exactly as expected from previous studies. The References column contains the relevant references in the published literature for each case. In addition to these miRNA oligonucleotides, the table shows other known miRNA oligonucleotides that are expressed in a tissue-specific manner. We show that MIR-128A, MIR-129 and MIR-128B are highly enriched in Brain; MIR-194, MIR-148 and MIR-192 are highly enriched in Liver; mIR-96, MIR-150, MIR-205, MIR-182 and MIR-183 are highly enriched in Thy-mus; MIR-204, MIR-10B, MIR-154 and MIR134 are highly enriched in Testes; and MIR-122, MIR-210, MIR-221, MIR-141, MIR-23A, MIR-200 C and MIR-136 are highly enriched in Placenta. In most cases, low but significant levels are observed in the other tissues. However, in some cases, miRNA oligonucleotides are also expressed at relative high levels in an additional tissue.

It is appreciated that these results reproduce previously published studies of expression of known microRNA oligonucleotides. These results demonstrate the reliability of the microarray of the present invention in detecting expression of published microRNA oligonucleotides, and of novel GAM oligonucleotides of the present invention.

Reference is now made to

Figure 28A:
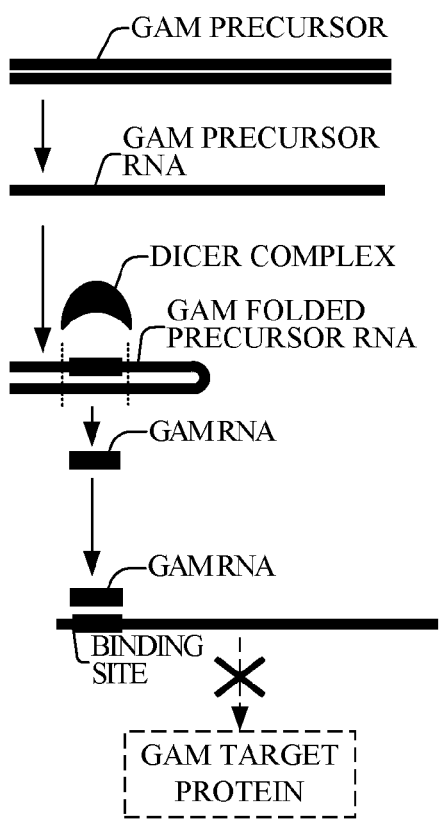

Reference is now made to FIGS. 28A-28D, simplified diagrams which when taken together illustrate different modes by which small molecules may be uses as therapeutic agents related to microRNA oligonucleotides. The present invention describes a novel approach whereby small molecules may be used to modulate activity of GAM oligonucleotides. This mode of therapy allows inter alia up regulation of a disease-related target gene of a novel GAM of the present invention, by lowering levels of the novel GAM which naturally inhibits expression of that target gene. Reference is now made to FIG. 28A. FIG. 28A which shows a normal GAM inhibiting translation of a target gene by binding of GAM RNA to a BINDING SITE found in an untranslated region of GAM TARGET RNA, as described hereinabove with reference to FIG. 8.

Figure 28B:
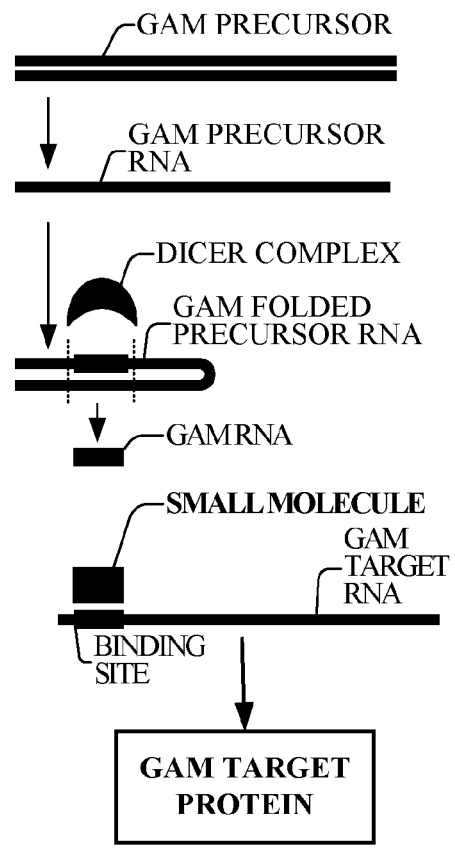

Reference is now made to FIG. 28B which shows an example of anti-GAM therapy, using a small molecule. SMALL MOLECULE is a small molecule that is capable of binding a binding site of GAM-RNA, such that this binding poses a competitive inhibition for the GAM RNA, which is therefore unable to bind the BINDING SITE, and therefore unable to repress translation of the TARGET PROTEIN. This causes de-facto an up-regulation of the target protein, since it counters the normal endogenous baseline inhibition of translation of GAM RNA on the target protein.

Reference is now made to FIG. 28C which shows an example of anti-GAM therapy, using a small molecule that binds the GAM RNA. In this case a small molecule is shown, which is capable of binding GAM-RNA itself, thereby inhibiting the translation inhibition activity of the GAM RNA. This too causes de-facto an up-regulation of the target protein, since it counters the normal endogenous baseline inhibition of translation of GAM RNA on the target protein.

It is appreciated that small molecule based anti-GAM therapy as illustrated hereinabove with reference to FIGS. 28A-28C is particularly useful with respect to disease states in which proteins associated with the disease are known to be under-expressed in association with a specific and are target genes of GAM oligonucleotides.

Reference is now made to FIG. 28D which shows an example of a GAM agonist therapy, using a small molecule. In this case a small molecule is shown which is capable of binding the binding site, but in which this binding causes an effect similar to the binding of the GAM RNA: it inhibits translation of the target protein.

Figure 29:
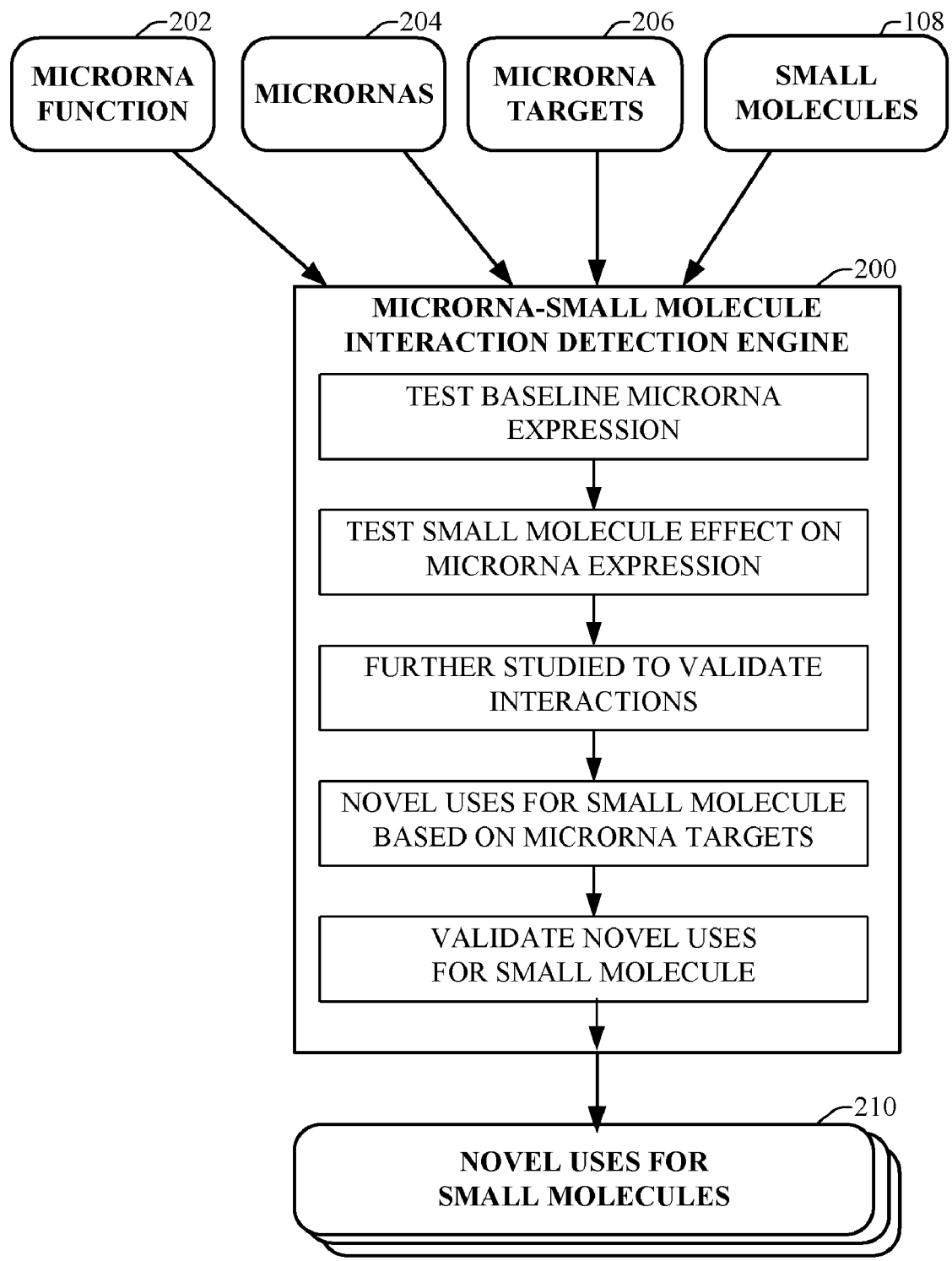
FIG. 29 is a block diagram of a microRNA-small molecule interaction detection engine constructed and operative in accordance with a preferred embodiment of the present invention.

Reference is now made to FIG. 29 which is a block diagram of a microRNA-small molecule interaction detection engine, constructed and operative in accordance with a preferred embodiment of the present invention.

A central element in the present invention is a microRNA small molecule interaction detection engine 200. The microRNA small molecule interaction detection engine 200 receives as input several types of data: one or more microRNAs 204, microRNA function 202 of the microRNAs 204, microRNA targets 206 of the microRNA 204, and one or more small molecules 108.

It is appreciated that the bioinformatic oligonucleotide detection engine 100 (FIG. 9) of the present invention is operative to detect novel microRNAs 204, and microRNA function 202 and microRNA targets 206 thereof, as described hereinabove with reference to FIGS. 1-27C. It is further appreciated that the present invention describes 122,764 novel microRNA like GAM oligonucleotides, described in Tables 1-14. These GAM oligonucleotides may serve as input for the microRNA small molecule interaction detection engine 200.

Table 15 lists 1,234 such known small molecules 108 that are used as pharmaceutical agents, and are FDA licensed, and therefore may be used as input for the microRNA small molecule interaction detection engine 200.

In a preferred embodiment of the present invention, the microRNA small molecule interaction detection engine 200 first tests baseline expression of one or more microRNAs in one or more tissues, in one or more clinical settings.

Next, the microRNA small molecule interaction detection engine 200 tests expression of microRNAs after introduction of a small molecule into the tissue tested, and therefrom assesses the effect of the small molecule on each of the microRNAs being tested.

Further biological and chemical studies are carried out in order to validate the suspected interaction between the small molecule and the microRNA.

The knowledge of the microRNA targets 206 of the microRNA and its microRNA function may then be used to evaluate potential novel uses for the small molecule, and estimate potential side-effects. The knowledge of the microRNA, and of its various targets allows an elaborate understanding of the web of activities and physiological actions that it may have, rather than blindly trying the small molecule in different clinical settings in order to see which will succeed, and which will produce side effects.

Finally, further biological studies are preferably performed to validate the novel uses of the small molecule.

The output of the microRNA small molecule interaction detection engine 200 is one or more novel uses for small molecules 210.

DETAILED DESCRIPTION OF TABLES

Table 1 comprises data relating the SEQ ID NO of oligonucleotides of the present invention to their corresponding GAM NAME, and contains the following fields: GAM SEQ-ID: GAM SEQ ID NO, as in the Sequence Listing; GAM NAME: Rosetta Genomics Ltd. nomenclature (see below); GAM RNA SEQUENCE: Sequence (5' to 3') of the mature, "diced" GAM RNA; GAM ORGANISM: identity of the organism encoding the GAM oligonucleotide; GAM POS: Dicer cut location (see below); and Table 2 comprises detailed textual description according to the description of FIG. 8 of each of a plurality of novel GAM oligonucleotides of the present invention, and contains the following fields: GAM NAME: Rosetta Genomics Ltd. nomenclature (see below); GAM ORGANISM: identity of the organism encoding the GAM oligonucleotide; PRE-CUR SEQ-ID:GAM precursor Seq-ID, as in the Sequence Listing; PRECURSOR SEQUENCE: Sequence (5' to 3') of the GAM precursor; GAM DESCRIPTION: Detailed description of GAM oligonucleotide with reference to FIG. 8; and Table 3 comprises data relating to the source and location of novel GAM oligonucleotides of the present invention, and contains the following fields: GAM NAME: Rosetta Genomics Ltd. nomenclature (see below); PRECUR SEQ-ID: GAM precursor SEQ ID NO, as in the Sequence Listing; GAM ORGANISM: identity of the organism encodes the GAM oligonucleotide; SOURCE: Chromosome encoding a human GAM oligonucleotide; STRAND: Orientation of the strand, "+" for the plus strand, "−" for the minus strand; SRC-START OFFSET: Start offset of GAM precursor sequence relative to the SOURCE; SRC-END OFFSET: End offset of GAM precursor sequence relative to the SOURCE; and Table 4 comprises data relating to GAM precursors of novel GAM oligonucleotides of the present invention, and contains the following fields: GAM NAME: Rosetta Genomics Ltd. nomenclature (see below); PRECUR SEQ-ID: GAM precursor Seq-ID, as in the Sequence Listing; GAM ORGANISM: identity of the organism encoding the GAM oligonucleotide; PRECURSOR-SEQUENCE: GAM precursor nucleotide sequence (5' to 3'); GAM FOLDED PRECURSOR RNA: Schematic representation of the GAM folded precursor, beginning 5' end (beginning of upper row) to 3' end (beginning of lower row), where the hairpin loop is positioned at the right part of the draw; and Table 5 comprises data relating to GAM oligonucleotides of the present invention, and contains the following fields: GAM NAME: Rosetta Genomics Ltd. nomenclature (see below); GAM ORGANISM: identity of the organism encoding the GAM oligonucleotide; GAM RNA SEQUENCE: Sequence (5' to 3') of the mature, "diced" GAM RNA; PRECUR SEQ-ID: GAM precursor Seq-ID, as in the Sequence Listing; GAM POS: Dicer cut location (see below); and Table 6 comprises data relating SEQ ID NO of the GAM target gene binding site sequence to TARGET gene name and target binding site sequence, and contains the following fields: TARGET BINDING SITE SEQ-ID: Target binding site SEQ ID NO, as in the Sequence Listing; TARGET ORGANISM: identity of organism encode the TARGET gene; TARGET: GAM target gene name; TARGET BINDING SITE SEQUENCE: Nucleotide sequence (5' to 3') of the target binding site; and Table 7 comprises data relating to target-genes and binding sites of GAM oligonucleotides of the present invention, and contains the following fields: GAM NAME: Rosetta Genomics Ltd. nomenclature (see below); GAM ORGANISM: identity of the organism encoding the GAM oligonucleotide; GAM RNA SEQUENCE: Sequence (5' to 3') of the mature, "diced" GAM RNA; TARGET: GAM target gene name; TARGET REF-ID: Target accession number (GenBank); TARGET ORGANISM: identity of organism encode the TARGET gene; UTR: Untranslated region of binding site/s (3' or 5'); TARGET BS-SEQ: Nucleotide sequence (5' to 3') of the target binding site; BINDING SITE-DRAW: Schematic representation of the binding site, upper row represent 5' to 3' sequence of the GAM, Lower row represent 3' to 5' Sequence of the target; GAM POS: Dicer cut location (see below); and Table 8 comprises data relating to functions and utilities of novel GAM oligonucleotides of the present invention, and contains the following fields: GAM NAME: Rosetta Genomics Ltd. nomenclature (see below); GAM RNA SEQUENCE: Sequence (5' to 3') of the mature, "diced" GAM RNA; GAM ORGANISM: identity of the organism encoding the GAM oligonucleotide; TARGET:GAM target gene name; TARGET ORGANISM: identity of organism encode the TARGET gene; GAM FUNCTION: Description of the GAM functions and utilities; GAM POS: Dicer cut location (see below); and Table 9 comprises references of GAMs target genes and contains the following fields: TARGET: Target gene name; TARGET ORGANISM: identity of organism encode the TARGET gene; REFERENCES: reference relating to the target gene; and Table 10 comprises data relating to novel GR (Genomic Record) polynucleotides of the present invention, and contains the following fields: GR NAME: Rosetta Genomics Ltd.nomenclature (see below); GR ORGANISM: identity of the organism encoding the GR polynucleotide; GR DESCRIPTION: Detailed description of a GR polynucleotide, with reference to FIG. 16; and Table 11 comprises data of all sequences printed on the chip experiment as described herein above with reference to FIG. 26 and include the following fields: PROBE SEQUENCE: the sequence that was printed on the chip PROBE TYPE: as described in details in FIG. 26 in chip design section and summarized as following: a. Known—published miR, Known_mis1—published miR with 1 mismatch mutation on miR sequence. Known_mis2—published miR with 2 mismatches mutation on miR sequenced. Known_mis3—published miR with 3 mismatches mutation on miR sequence, Known_mis4—published miR with 6 mismatches mutation not on miR sequence, Predicted—GAM-Rosetta Genomics Ltd. Mismatch—GAM-Rosetta Genomics Ltd. with 2 mismatches, Edges1—left half of GAM-Rosetta Genomics Ltd, Edges2—right half of GAM-Rosetta Genomics Ltd extended with its palindrom, Control1—negative control, Control2—random sequences, I. Control3—tRNA, m. Control4—snoRNA, Control5—mRNA, Control6—other; GAM RNA SEQ ID/MIR NAME: for GAM-Rosetta Genomics Ltd. Nomenclature (see below); GAM RNA SEQUENCE: Sequence (5' to 3') of the mature, "diced" GAM RNA; LIBRARY: the library name as defined in FIG. 26C; SIGNAL: Raw signal data for library; BACKGROUND Z-SCORE: Z score of probe signal with respect to background, negative control signals; MISMATCH Z-SCORE: Z-score of probe signal with respect to its mismatch probe signal;

Table 12 comprises data relating to diseases that GAM oligonucleotides are predicted to regulate the disease-associated genes. Each row is referred to a specific disease, and lists the GAM target genes related to the disease. The first row is a summary of ALL diseases containing in the present invention, thus listing ALL GAM target genes relating to theses diseases. The table contains the following fields: ROW#: index of the row number; DISEASE NAME: name of the disease; TARGET-GENES ASSOCIATED WITH DISEASE: list of GAM target genes that are associated with the specified disease; and Table 13 comprises data related to the GAM RNA SEQUENCEs included in the present invention that were validated by laboratory means. If the validated sequence appeared in more than one GAM precursor, the GAM RNA SEQ-ID indicated may be arbitrarily chosen. The VALIDATION METHOD indicates the type of validation performed on the sequence: "Mir Sequencing" refers to miRNA oligonucleotide sequences that were sequenced, as described hereinabove with reference to FIG. 22. Other validations are from microarray experiments as described hereinabove with reference to FIGS. 26A-C and 27A-C. The SIGNAL indicates a raw signal data; BACKGROUND Z-SCORE indicates a Z score of probe signal with respect to background, negative control signals; MISMATCH Z-SCORE: indicates a Z-score of probe signal with respect to its mismatch probe signal. The microarray validations are divided into two groups: a) "Chip strong" refers to miRNA oligonucleotide sequences whose intensity (SIGNAL) on the microarray "chip" was more than 6 standard deviations above the background intensity, and the differential to the corresponding mismatch intensity was more than 2 standard deviations, where in this case the standard deviation is of the intensity of identical probes and b) "Chip" refers to miRNA oligonucleotide sequences, whose intensity was more than 4 standard deviations above the background intensity.

Table 14 comprises sequence data of GAMs associated with different diseases. Each row refers to a specific disease, and lists the SEQ ID NOs of GAMs that target genes associated with that disease. The table contains the following fields: ROW#: index of the row number; DISEASE NAME: name of the disease; SEQ ID NOs OF GAMS ASSOCIATED WITH DISEASE: list of sequence listing IDs of GAMs targeting genes that are associated with the specified disease.

Table 15 comprises a list of pharmaceutical chemicals that have been licensed by the FDA for various indications, and their respective chemical formulas. The table contains the following fields: CHEMICAL NAME, and CHEMICAL FORMULA.

The following conventions and abbreviations are used in the tables: The nucleotide "U" is represented as "T" in the tables, and;

GAM NAME or GR NAME are names for nucleotide sequences of the present invention given by RosettaGenomics Ltd. nomenclature method. All GAMs/GRs are designated by GAMx/GRx where x is a unique ID.

GAM POS is a position of the GAM RNA on the GAM PRECURSOR RNA sequence. This position is the Dicer cut location: A indicates a probable Dicer cut location; B indicates an alternative Dicer cut location.

All human nucleotide sequences of the present invention as well as their chromosomal location and strand orientation are derived from sequence records of UCSC-hg16 version, which is based on NCBI, Build34 database (April, 2003).

SEQUENCE LISTING (10068309 sequences)

SEQ ID NO: 1 - DNA, 17 bp, Homo sapiens
gcgcctgtgcctcctaa

SEQ ID NO: 2 - DNA, 22 bp, Homo sapiens
gctcccactgctgtcctgccat

SEQ ID NO: 3 - DNA, 22 bp, Homo sapiens
gctgcacttcagcctgggtgtc

SEQ ID NO: 4 - DNA, 22 bp, Homo sapiens
gctggctccacctgctgccagg

SEQ ID NO: 5 - DNA, 21 bp, Homo sapiens
ggaatggtggttgtatggttg

SEQ ID NO: 6 - DNA, 23 bp, Homo sapiens
ggccaagtggatgctggtttagc

SEQ ID NO: 7 - DNA, 22 bp, Homo sapiens
ggccgggtgctctggaggtgct

SEQ ID NO: 8 - DNA, 22 bp, Homo sapiens
ggccgtggtcgctgactctcgt

SEQ ID NO: 9 - DNA, 22 bp, Homo sapiens
ggctggttagatttgtggtctt

SEQ ID NO: 10 - DNA, 22 bp, Homo sapiens
gggaaataattaatgtgaagtc

SEQ ID NO: 11 - DNA, 22 bp, Homo sapiens
ggggaacgcgctggcccgcgcc

SEQ ID NO: 12 - DNA, 19 bp, Homo sapiens
gggtctctgttggcttctt

SEQ ID NO: 13 - DNA, 22 bp, Homo sapiens
gggttactctgtgttggtcagg

SEQ ID NO: 14 - DNA, 22 bp, Homo sapiens
ggtggcccctgggagatgctgg

SEQ ID NO: 15 - DNA, 22 bp, Homo sapiens
gtcagtcattgaatgctggcct

SEQ ID NO: 16 - DNA, 22 bp, Homo sapiens
gtgcggcctggccttcaagtgg

SEQ ID NO: 17 - DNA, 22 bp, Homo sapiens
gtgcttaaagaatggctgtccg

SEQ ID NO: 18 - DNA, 19 bp, Homo sapiens
gtttctctgggcttggcat

SEQ ID NO: 19 - DNA, 20 bp, Homo sapiens
tagcatggctctatggaaca

SEQ ID NO: 20 - DNA, 22 bp, Homo sapiens
taggtatggcttgtggcacagc

SEQ ID NO: 21 - DNA, 22 bp, Homo sapiens
tattcattgcccatgtttgtga

SEQ ID NO: 22 - DNA, 22 bp, Homo sapiens
tcactgcaacctccaccttcag

SEQ ID NO: 23 - DNA, 22 bp, Homo sapiens
tccagctgtccacgtcttcctg

SEQ ID NO: 24 - DNA, 23 bp, Homo sapiens
tccaggccctcaatccatttcca

SEQ ID NO: 25 - DNA, 22 bp, Homo sapiens
tcccagctcctgggccccacag

SEQ ID NO: 26 - DNA, 22 bp, Homo sapiens
tccttcctctgtcaggcaggcc

SEQ ID NO: 27 - DNA, 22 bp, Homo sapiens
tcgctcaggcaggagtgcagtg

SEQ ID NO: 28 - DNA, 22 bp, Homo sapiens
tctcttcgctggccctcgggga

SEQ ID NO: 29 - DNA, 22 bp, Homo sapiens
tgacctcctttctcgactaatt

SEQ ID NO: 30 - DNA, 22 bp, Homo sapiens
tgatctcgtgatctacccgcct

SEQ ID NO: 31 - DNA, 22 bp, Homo sapiens
tgcctaggtctggcctccttgg

SEQ ID NO: 32 - DNA, 22 bp, Homo sapiens
tgcctggcctcctgattccctc

SEQ ID NO: 33 - DNA, 22 bp, Homo sapiens
tgcctggcctcttcagcacttc

SEQ ID NO: 34 - DNA, 22 bp, Homo sapiens
tgcttgctgtggttggctggta

SEQ ID NO: 35 - DNA, 19 bp, Homo sapiens
tggagctgggtctggggca

SEQ ID NO: 36 - DNA, 18 bp, Homo sapiens
tggtaggttgggcagttc

SEQ ID NO: 37 - DNA, 22 bp, Homo sapiens
tggtttcccttttggcctctcc

SEQ ID NO: 38 - DNA, 22 bp, Homo sapiens
ttcaagtgtttaagttctgctt

SEQ ID NO: 39 - DNA, 22 bp, Homo sapiens
ttctgatggttaagttctgtca

SEQ ID NO: 40 - DNA, 22 bp, Homo sapiens
ttgacatgcctcctacatgatc

SEQ ID NO: 41 - DNA, 22 bp, Homo sapiens
ttgggggaggcctgctgcccat

SEQ ID NO: 42 - DNA, 18 bp, Homo sapiens
aaactgcttccttggcct

SEQ ID NO: 43 - DNA, 22 bp, Homo sapiens
aaccttgtgatccacccacctt

SEQ ID NO: 44 - DNA, 22 bp, Homo sapiens
aatggtctctttgttccctgct

SEQ ID NO: 45 - DNA, 22 bp, Homo sapiens
acaaagtgcctccctttagagt

SEQ ID NO: 46 - DNA, 22 bp, Homo sapiens
acattctctgattggtgcctcc

SEQ ID NO: 47 - DNA, 22 bp, Homo sapiens
accatctcctgtgcctccagct

SEQ ID NO: 48 - DNA, 22 bp, Homo sapiens
accccgctccttgcagcctctg

SEQ ID NO: 49 - DNA, 22 bp, Homo sapiens
accttgtgatccacctgctttg

SEQ ID NO: 50 - DNA, 22 bp, Homo sapiens
actcactgcaacctccacctcc

SEQ ID NO: 51 - DNA, 22 bp, Homo sapiens
actgcactccatccagcctggc

SEQ ID NO: 52 - DNA, 22 bp, Homo sapiens
agcaagaccagggttttgtgtt

SEQ ID NO: 53 - DNA, 22 bp, Homo sapiens
agcctctggtccttttttccct

SEQ ID NO: 54 - DNA, 21 bp, Homo sapiens
aggcagagaggaccagagact

SEQ ID NO: 55 - DNA, 22 bp, Homo sapiens
aggtggccacaaggtggctggc

SEQ ID NO: 56 - DNA, 22 bp, Homo sapiens
agtcgctggaccatcagagcct

SEQ ID NO: 57 - DNA, 22 bp, Homo sapiens
agtggcgtgatctcggctcggt

SEQ ID NO: 58 - DNA, 22 bp, Homo sapiens
atagcagcgctggccctctgcc

SEQ ID NO: 59 - DNA, 22 bp, Homo sapiens
atcttttatcactcccactgct

SEQ ID NO: 60 - DNA, 22 bp, Homo sapiens
atgccactgcgctccagcctga

SEQ ID NO: 61 - DNA, 22 bp, Homo sapiens
atggccctcttatcacagctcc

SEQ ID NO: 62 - DNA, 21 bp, Homo sapiens
cactgcactccagctctgggt

SEQ ID NO: 63 - DNA, 22 bp, Homo sapiens
cactgccttggccacctatcct

SEQ ID NO: 64 - DNA, 22 bp, Homo sapiens
cacttcccttctctgctcatgg

SEQ ID NO: 65 - DNA, 22 bp, Homo sapiens
cagcctctatgcccccgtcacc

SEQ ID NO: 66 - DNA, 22 bp, Homo sapiens
cagctggtgcttgcctggctaa

SEQ ID NO: 67 - DNA, 22 bp, Homo sapiens
caggctcttccctctggccaag

SEQ ID NO: 68 - DNA, 22 bp, Homo sapiens
caggctggctccctgaaggttc

SEQ ID NO: 69 - DNA, 22 bp, Homo sapiens
ccaggctggagtgcaagcagca

SEQ ID NO: 70 - DNA, 22 bp, Homo sapiens
ccagtacgttgctcagctcctc

SEQ ID NO: 71 - DNA, 22 bp, Homo sapiens
ccccactgtccccggagctggc

SEQ ID NO: 72 - DNA, 21 bp, Homo sapiens
cccggcacctccgctgcacac

SEQ ID NO: 73 - DNA, 22 bp, Homo sapiens
cccgggtggagcctgggctgtg

SEQ ID NO: 74 - DNA, 22 bp, Homo sapiens
ccctctggcccctgtggtggat

SEQ ID NO: 75 - DNA, 22 bp, Homo sapiens
cctccggtcattgtgcgggcct

SEQ ID NO: 76 - DNA, 22 bp, Homo sapiens
cctcgctctccattcggccctc

SEQ ID NO: 77 - DNA, 22 bp, Homo sapiens
cgaccttgtgatcctcccgcct

SEQ ID NO: 78 - DNA, 22 bp, Homo sapiens
cggcactgtagtctggctggga

SEQ ID NO: 79 - DNA, 22 bp, Homo sapiens
cggcgagcgggacctgcgcctg

SEQ ID NO: 80 - DNA, 22 bp, Homo sapiens
ctcagctcatccactaaatccc

SEQ ID NO: 81 - DNA, 22 bp, Homo sapiens
ctgcagcctccactttctgggc

SEQ ID NO: 82 - DNA, 22 bp, Homo sapiens
ctgcctgcctggcccaggaacc

SEQ ID NO: 83 - DNA, 22 bp, Homo sapiens
ctgctgcgctggccgtcacggt

SEQ ID NO: 84 - DNA, 17 bp, Homo sapiens
ctggaggagctgccatg

SEQ ID NO: 85 - DNA, 22 bp, Homo sapiens
ctggctaagatccaagaaaggc

SEQ ID NO: 86 - DNA, 22 bp, Homo sapiens
ctggctagatgtgtggccatga

SEQ ID NO: 87 - DNA, 22 bp, Homo sapiens
gacccctaaacccgctgggctg

SEQ ID NO: 88 - DNA, 22 bp, Homo sapiens
gaccttgtgatccgcccacttt

SEQ ID NO: 89 - DNA, 22 bp, Homo sapiens
gagccgccctccacgatgtccc

SEQ ID NO: 90 - DNA, 22 bp, Homo sapiens
gatgtcgtgatccacccgcctt

SEQ ID NO: 91 - DNA, 23 bp, Homo sapiens
gattactggtatttgctggctcc

SEQ ID NO: 92 - DNA, 22 bp, Homo sapiens
gcagcatcccggcctccactgt

SEQ ID NO: 93 - DNA, 22 bp, Homo sapiens
gcagggaactggctgggctttc

SEQ ID NO: 94 - DNA, 21 bp, Homo sapiens
gccagcctccatcctcccttg

SEQ ID NO: 95 - DNA, 22 bp, Homo sapiens
gcccttcggaaagcgtcgcctg

SEQ ID NO: 96 - DNA, 22 bp, Homo sapiens
gccctttgtgtctggctggggt

SEQ ID NO: 97 - DNA, 22 bp, Homo sapiens
gcctggccaacatagtgggacc

SEQ ID NO: 98 - DNA, 22 bp, Homo sapiens
gctcacagcctcccccggcctg

SEQ ID NO: 99 - DNA, 22 bp, Homo sapiens
gctcctggccgggctgctcctg

SEQ ID NO: 100 - DNA, 22 bp, Homo sapiens
gctgcaccccagcctgggtaac

SEQ ID NO: 101 - DNA, 22 bp, Homo sapiens
gctgtaagtcacctggcccgat

SEQ ID NO: 102 - DNA, 22 bp, Homo sapiens
gcttcagagaggggtgaagctg

SEQ ID NO: 103 - DNA, 21 bp, Homo sapiens
ggaggtactgtagctggcgtt

SEQ ID NO: 104 - DNA, 22 bp, Homo sapiens
ggccgtccctagagatggggtt

SEQ ID NO: 105 - DNA, 22 bp, Homo sapiens
ggcgctggcctgtgggatcccg

SEQ ID NO: 106 - DNA, 22 bp, Homo sapiens
ggctctggctttggaggagcag

SEQ ID NO: 107 - DNA, 22 bp, Homo sapiens
gggaagctggtcacccacaggc

SEQ ID NO: 108 - DNA, 22 bp, Homo sapiens
ggggctggtctttccacttact

SEQ ID NO: 109 - DNA, 22 bp, Homo sapiens
ggggcttctagggtgccagatc

SEQ ID NO: 110 - DNA, 20 bp, Homo sapiens
ggtagtctttgtcccctggc

SEQ ID NO: 111 - DNA, 22 bp, Homo sapiens
ggtgccctctggctctactccc

SEQ ID NO: 112 - DNA, 22 bp, Homo sapiens
ggtggtggagcgggcccaggcc

SEQ ID NO: 113 - DNA, 22 bp, Homo sapiens
gtagctgtgttcattctggatg

SEQ ID NO: 114 - DNA, 22 bp, Homo sapiens
gtctcggactcctgatctcagg

SEQ ID NO: 115 - DNA, 22 bp, Homo sapiens
gtgctttgctggaatcgaggaa

SEQ ID NO: 116 - DNA, 22 bp, Homo sapiens
tagctcctcccagatctcatct

SEQ ID NO: 117 - DNA, 22 bp, Homo sapiens
tcacgcgccctcctgggccctg

SEQ ID NO: 118 - DNA, 22 bp, Homo sapiens
tcactgcaacctccaccacgtg

SEQ ID NO: 119 - DNA, 22 bp, Homo sapiens
tcactgcaacctccaccagcct

SEQ ID NO: 120 - DNA, 22 bp, Homo sapiens
tcactgcaacctccacctccca

SEQ ID NO: 121 - DNA, 22 bp, Homo sapiens
tcactgcaacctccaccttccg

SEQ ID NO: 122 - DNA, 22 bp, Homo sapiens
tcactgcaagctccaccctccg

SEQ ID NO: 123 - DNA, 22 bp, Homo sapiens
tcaggggttggcttgttgtgtt

SEQ ID NO: 124 - DNA, 22 bp, Homo sapiens
tcattgcaacctcctcctgggt

SEQ ID NO: 125 - DNA, 22 bp, Homo sapiens
tcctgggctttggcttgttggg

SEQ ID NO: 126 - DNA, 22 bp, Homo sapiens
tcctggggcttgtcgctggcca

SEQ ID NO: 127 - DNA, 20 bp, Homo sapiens
tctctatgccatgctggcct

SEQ ID NO: 128 - DNA, 22 bp, Homo sapiens
tgcctgccgttaaatgttactt

SEQ ID NO: 129 - DNA, 22 bp, Homo sapiens
tgctagctgcccgaaggtctca

SEQ ID NO: 130 - DNA, 22 bp, Homo sapiens
tgctggctatcctgcgcctttc

SEQ ID NO: 131 - DNA, 22 bp, Homo sapiens
tggctttagtaataagtttctc

SEQ ID NO: 132 - DNA, 22 bp, Homo sapiens
tggtcgggctgcatcttccggc

SEQ ID NO: 133 - DNA, 22 bp, Homo sapiens
tggtggaggcgctgctggccag

SEQ ID NO: 134 - DNA, 22 bp, Homo sapiens
tggttcttcgctgggcggctgc

SEQ ID NO: 135 - DNA, 22 bp, Homo sapiens
tgtctccccactggtcttccag

SEQ ID NO: 136 - DNA, 22 bp, Homo sapiens
tgtgctggcctttggtgacttc

SEQ ID NO: 137 - DNA, 22 bp, Homo sapiens
ttccctgggactggcctgcacc

SEQ ID NO: 138 - DNA, 22 bp, Homo sapiens
ttctctgtgctgggtcctgagg

SEQ ID NO: 139 - DNA, 22 bp, Homo sapiens
ttcttctgccccttgcctgaca

SEQ ID NO: 140 - DNA, 22 bp, Homo sapiens
ttggtccccttcaaccagctac

SEQ ID NO: 141 - DNA, 22 bp, Homo sapiens
tttggtccccttcaaccagcta

SEQ ID NO: 142 - DNA, 22 bp, Homo sapiens
aagacaccagagactggcctca

SEQ ID NO: 143 - DNA, 22 bp, Homo sapiens
acactttgcccctggccgcctt

SEQ ID NO: 144 - DNA, 22 bp, Homo sapiens
acaggcgatccacccgcctcag

SEQ ID NO: 145 - DNA, 22 bp, Homo sapiens
agagtctccctgtgttgccctg

SEQ ID NO: 146 - DNA, 20 bp, Homo sapiens
agcagagcagtctccgctca

SEQ ID NO: 147 - DNA, 22 bp, Homo sapiens
agctggcttacttgagatgcat

SEQ ID NO: 148 - DNA, 22 bp, Homo sapiens
aggatcttgctatgttggccag

SEQ ID NO: 149 - DNA, 22 bp, Homo sapiens
agggaaggactgctgggttggc

SEQ ID NO: 150 - DNA, 22 bp, Homo sapiens
aggtgctggggcttggcctgct

SEQ ID NO: 151 - DNA, 22 bp, Homo sapiens
agtgttggctcggctggctgcc

SEQ ID NO: 152 - DNA, 18 bp, Homo sapiens
agtttgtgtaagaaaagc

SEQ ID NO: 153 - DNA, 22 bp, Homo sapiens
attctgtgctaactgcaggcca

SEQ ID NO: 154 - DNA, 22 bp, Homo sapiens
atttacatacccagcagcctcc

SEQ ID NO: 155 - DNA, 22 bp, Homo sapiens
cagcagcacactgtggtttgta

SEQ ID NO: 156 - DNA, 22 bp, Homo sapiens
aagtgctagtgagtctattgta

SEQ ID NO: 157 - DNA, 22 bp, Homo sapiens
aatcgcttgaacccaggaagtg

SEQ ID NO: 158 - DNA, 22 bp, Homo sapiens
aattgcacggtatccatctgta

SEQ ID NO: 159 - DNA, 22 bp, Homo sapiens
acaaagcgcttctctttagagt

SEQ ID NO: 160 - DNA, 20 bp, Homo sapiens
accctggccgactgcccctt

SEQ ID NO: 161 - DNA, 22 bp, Homo sapiens
acgcgctggggcgctggccaat

SEQ ID NO: 162 - DNA, 22 bp, Homo sapiens
actgcactgcagcctggccaac

SEQ ID NO: 163 - DNA, 22 bp, Homo sapiens
agcacggtgggtttggctggca

SEQ ID NO: 164 - DNA, 22 bp, Homo sapiens
agcgtgttgggaggagctgcag

SEQ ID NO: 165 - DNA, 22 bp, Homo sapiens
aggacctgtcccctggcccact

SEQ ID NO: 166 - DNA, 21 bp, Homo sapiens
aggccaagaaggaagcagagg

SEQ ID NO: 167 - DNA, 19 bp, Homo sapiens
agtcattatctcctggacc

SEQ ID NO: 168 - DNA, 22 bp, Homo sapiens
atcactttgagtccaggagttt

SEQ ID NO: 169 - DNA, 22 bp, Homo sapiens
atctcagctctgcctcctgggt

SEQ ID NO: 170 - DNA, 22 bp, Homo sapiens
atgggcctcctattatccccat

SEQ ID NO: 171 - DNA, 22 bp, Homo sapiens
attaggagagtgggtgctaagt

SEQ ID NO: 172 - DNA, 22 bp, Homo sapiens
attgttgcccatgtttttattt

SEQ ID NO: 173 - DNA, 22 bp, Homo sapiens
cactgcaacctccacctcctgg

SEQ ID NO: 174 - DNA, 22 bp, Homo sapiens
cactgcagcctccatctctggg

SEQ ID NO: 175 - DNA, 22 bp, Homo sapiens
cactgtcttcctttggctcctc

SEQ ID NO: 176 - DNA, 22 bp, Homo sapiens
catgctggcccacacccgctgc

SEQ ID NO: 177 - DNA, 20 bp, Homo sapiens
ccagaccattttgccttacc

SEQ ID NO: 178 - DNA, 22 bp, Homo sapiens
cccctcagtttgctagtatttt

SEQ ID NO: 179 - DNA, 22 bp, Homo sapiens
cccctgctgtgcttgcatggct

SEQ ID NO: 180 - DNA, 22 bp, Homo sapiens
ccgtccccggtgctgcctgcgc

SEQ ID NO: 181 - DNA, 22 bp, Homo sapiens
cctcactcaggtttggaccctg

SEQ ID NO: 182 - DNA, 22 bp, Homo sapiens
cctctgcaccaacctgtcaaga

SEQ ID NO: 183 - DNA, 22 bp, Homo sapiens
cctctttcaccgtgcctgtccc

SEQ ID NO: 184 - DNA, 22 bp, Homo sapiens
cctgtggtccctgtctgtgcct

SEQ ID NO: 185 - DNA, 22 bp, Homo sapiens
ccttttatcccctaattggcct

SEQ ID NO: 186 - DNA, 22 bp, Homo sapiens
cgccatgtccagcgtcttcggg

SEQ ID NO: 187 - DNA, 22 bp, Homo sapiens
cggtgcctcctccagtgttgct

SEQ ID NO: 188 - DNA, 22 bp, Homo sapiens
cgtaagtcacagcgcctggccc

SEQ ID NO: 189 - DNA, 22 bp, Homo sapiens
ctcagtgcaacctccgcctact

SEQ ID NO: 190 - DNA, 22 bp, Homo sapiens
ctccttgctggtctggtgtaat

SEQ ID NO: 191 - DNA, 23 bp, Homo sapiens
ctcgacttccctggcttgcgtga

SEQ ID NO: 192 - DNA, 22 bp, Homo sapiens
ctctgagtcctgcactcacccg

SEQ ID NO: 193 - DNA, 22 bp, Homo sapiens
ctctgtgatatggtttgtaata

SEQ ID NO: 194 - DNA, 22 bp, Homo sapiens
ctctttggttggttcctgatgc

SEQ ID NO: 195 - DNA, 20 bp, Homo sapiens
ctgctctggtttcctctgtc

SEQ ID NO: 196 - DNA, 22 bp, Homo sapiens
ctggcccctttcattctggaag

SEQ ID NO: 197 - DNA, 22 bp, Homo sapiens
cttcctgcctctcgccgcccgc

SEQ ID NO: 198 - DNA, 22 bp, Homo sapiens
cttgcctgccctgtgtcataaa

SEQ ID NO: 199 - DNA, 22 bp, Homo sapiens
gacctcgtgatccgcctgcttt

SEQ ID NO: 200 - DNA, 22 bp, Homo sapiens
gaccttgtgatccacctgtttt

SEQ ID NO: 201 - DNA, 23 bp, Homo sapiens
gcagctcctggaggtgagaggcg

SEQ ID NO: 202 - DNA, 22 bp, Homo sapiens
gcaggctctggcttattctggg

SEQ ID NO: 203 - DNA, 21 bp, Homo sapiens
gcagggaactggctgggcttt

SEQ ID NO: 204 - DNA, 22 bp, Homo sapiens
gcctccaggtcggtctttctct

SEQ ID NO: 205 - DNA, 22 bp, Homo sapiens
gcctgtcctcttccgcctgtct

SEQ ID NO: 206 - DNA, 22 bp, Homo sapiens
gcgccgccatccgcatcctcgt

SEQ ID NO: 207 - DNA, 22 bp, Homo sapiens
gcggcggcggtagcaaaaatga

SEQ ID NO: 208 - DNA, 22 bp, Homo sapiens
gctcgctggggtctgcaggcgg

SEQ ID NO: 209 - DNA, 22 bp, Homo sapiens
gctgaacgagctggccaagttc

SEQ ID NO: 210 - DNA, 20 bp, Homo sapiens
gctgctgggccatttgttgg

SEQ ID NO: 211 - DNA, 22 bp, Homo sapiens
ggcccagtgcaagctctttctg

SEQ ID NO: 212 - DNA, 23 bp, Homo sapiens
ggctggccccatccaggctggca

SEQ ID NO: 213 - DNA, 22 bp, Homo sapiens
ggctggtggctggttctggacc

SEQ ID NO: 214 - DNA, 22 bp, Homo sapiens
gggcgtggagctggaatgatgt

SEQ ID NO: 215 - DNA, 20 bp, Homo sapiens
gggcttttggaatggtctgt

SEQ ID NO: 216 - DNA, 22 bp, Homo sapiens
ggtgccccatcgcgggtggctg

SEQ ID NO: 217 - DNA, 21 bp, Homo sapiens
ggtggctatggctgtgctcgc

SEQ ID NO: 218 - DNA, 22 bp, Homo sapiens
gtgacagtgaatctagacagac

SEQ ID NO: 219 - DNA, 22 bp, Homo sapiens
gtgacctggccgcctaaaccca

SEQ ID NO: 220 - DNA, 22 bp, Homo sapiens
gtgactgtgggtttctggttcc

SEQ ID NO: 221 - DNA, 22 bp, Homo sapiens
gtgctggtgctcgctcctctgg

SEQ ID NO: 222 - DNA, 22 bp, Homo sapiens
gtggtagctccaggctgtctga

SEQ ID NO: 223 - DNA, 23 bp, Homo sapiens
gtgttgtcgctgggttttgaggg

SEQ ID NO: 224 - DNA, 22 bp, Homo sapiens
gttggtcttcattaaatgcttt

SEQ ID NO: 225 - DNA, 22 bp, Homo sapiens
gttggttttagcttggcccatt

SEQ ID NO: 226 - DNA, 22 bp, Homo sapiens
tactgcactccagccttgccaa

SEQ ID NO: 227 - DNA, 21 bp, Homo sapiens
tagaactatggctatgtgcca

SEQ ID NO: 228 - DNA, 22 bp, Homo sapiens
tcagcctcctccaccccagagt

SEQ ID NO: 229 - DNA, 22 bp, Homo sapiens
tcccctcttggcttggtccaga

SEQ ID NO: 230 - DNA, 22 bp, Homo sapiens
tctaagagaaaggaagttcaga

SEQ ID NO: 231 - DNA, 22 bp, Homo sapiens
tctccacagctggcccccaaga

SEQ ID NO: 232 - DNA, 22 bp, Homo sapiens
tctcccagatcctttagcctcc

SEQ ID NO: 233 - DNA, 19 bp, Homo sapiens
tctctagtcctgcctcccc

SEQ ID NO: 234 - DNA, 22 bp, Homo sapiens
tctgcagcagagcagctccctg

SEQ ID NO: 235 - DNA, 22 bp, Homo sapiens
tgatagatccatattttggtaa

SEQ ID NO: 236 - DNA, 22 bp, Homo sapiens
tgcaccactgcaccccagtctg

SEQ ID NO: 237 - DNA, 22 bp, Homo sapiens
tgcagcctcttgtttcagcccc

SEQ ID NO: 238 - DNA, 22 bp, Homo sapiens
tgcaggttgctggtctgatctc

SEQ ID NO: 239 - DNA, 22 bp, Homo sapiens
tgccagtatccttctgagaccc

SEQ ID NO: 240 - DNA, 21 bp, Homo sapiens
tgcccggatacccctggcctc

SEQ ID NO: 241 - DNA, 22 bp, Homo sapiens
tgcctgccccagctgagatatc

SEQ ID NO: 242 - DNA, 22 bp, Homo sapiens
tgcgttccagttgctgccaggc

SEQ ID NO: 243 - DNA, 21 bp, Homo sapiens
tgctctgatttttgccccagc

SEQ ID NO: 244 - DNA, 22 bp, Homo sapiens
tgctctgatttttgccccagct

SEQ ID NO: 245 - DNA, 22 bp, Homo sapiens
tgctgcaccctctgcctccggg

SEQ ID NO: 246 - DNA, 20 bp, Homo sapiens
tgctgccctaagaccacctt

SEQ ID NO: 247 - DNA, 22 bp, Homo sapiens
tgcttctagggaggccgcagga

SEQ ID NO: 248 - DNA, 23 bp, Homo sapiens
tggaggagagtttgtcagtatag

SEQ ID NO: 249 - DNA, 22 bp, Homo sapiens
tggagttggctgcagatgagtc

SEQ ID NO: 250 - DNA, 22 bp, Homo sapiens
tggcggatctttcctgcctccc

SEQ ID NO: 251 - DNA, 22 bp, Homo sapiens
tggtgcagcgtgtggtggctct

SEQ ID NO: 252 - DNA, 22 bp, Homo sapiens
tgtggtagtcacggcccgccac

SEQ ID NO: 253 - DNA, 22 bp, Homo sapiens
ttgatgccccgtcctgtacact

SEQ ID NO: 254 - DNA, 22 bp, Homo sapiens
ttgctagtgtttggttgatggt

SEQ ID NO: 255 - DNA, 22 bp, Homo sapiens
ttgtcactgcactccagtctgg

SEQ ID NO: 256 - DNA, 22 bp, Homo sapiens
aaggccgccccttcatgctcct

SEQ ID NO: 257 - DNA, 22 bp, Homo sapiens
aagtgatacgcctgcctcggcc

SEQ ID NO: 258 - DNA, 22 bp, Homo sapiens
aagtgctcatagtgcaggtagt

SEQ ID NO: 259 - DNA, 22 bp, Homo sapiens
aatcacttgaacccaagaagtg

SEQ ID NO: 260 - DNA, 24 bp, Homo sapiens
aattgcttgaacccaggaagtgga

SEQ ID NO: 261 - DNA, 22 bp, Homo sapiens
acaaagtgcctccttttagagt

SEQ ID NO: 262 - DNA, 22 bp, Homo sapiens
actgcactccagcctgggctac

SEQ ID NO: 263 - DNA, 22 bp, Homo sapiens
acttggaactggcccctttcat

SEQ ID NO: 264 - DNA, 19 bp, Homo sapiens
agaagggctggcaggagtt

SEQ ID NO: 265 - DNA, 22 bp, Homo sapiens
agatttcccttcctgcttgcct

SEQ ID NO: 266 - DNA, 22 bp, Homo sapiens
agctcctggcttcaagcaatcc

SEQ ID NO: 267 - DNA, 22 bp, Homo sapiens
agctggtttaatatgctgtctg

SEQ ID NO: 268 - DNA, 22 bp, Homo sapiens
aggaaaaaaattaatgtgagtc

SEQ ID NO: 269 - DNA, 22 bp, Homo sapiens
aggacctgtaatcccagcactt

SEQ ID NO: 270 - DNA, 22 bp, Homo sapiens
aggctggttagatttgtggtct

SEQ ID NO: 271 - DNA, 22 bp, Homo sapiens
agggcaggaggtccgtcccttc

SEQ ID NO: 272 - DNA, 22 bp, Homo sapiens
agggttgtgtgctggccgctgg

SEQ ID NO: 273 - DNA, 22 bp, Homo sapiens
aggtgctctgtgtatgcataga

SEQ ID NO: 274 - DNA, 22 bp, Homo sapiens
agttctcttgcttcagcctccc

SEQ ID NO: 275 - DNA, 22 bp, Homo sapiens
atggtactccagcctgggtgac

SEQ ID NO: 276 - DNA, 22 bp, Homo sapiens
atggtagctgtccacatcagga

SEQ ID NO: 277 - DNA, 22 bp, Homo sapiens
atggtgctggtgggagtgtatt

SEQ ID NO: 278 - DNA, 22 bp, Homo sapiens
attgcactccagcctgagcaaa

SEQ ID NO: 279 - DNA, 22 bp, Homo sapiens
caactcactgcggcctcaacct

SEQ ID NO: 280 - DNA, 22 bp, Homo sapiens
cacccgctggtccctgcagttc

SEQ ID NO: 281 - DNA, 22 bp, Homo sapiens
cacctggctggcaatttataat

SEQ ID NO: 282 - DNA, 22 bp, Homo sapiens
caccttgtgatccacccgcctt

SEQ ID NO: 283 - DNA, 22 bp, Homo sapiens
cactgcactccagcccgagcaa

SEQ ID NO: 284 - DNA, 22 bp, Homo sapiens
caggaaaaggcggctcggggct

SEQ ID NO: 285 - DNA, 22 bp, Homo sapiens
cattattctcagttctgtgcag

SEQ ID NO: 286 - DNA, 22 bp, Homo sapiens
cattctgtgagctgctggcttt

SEQ ID NO: 287 - DNA, 22 bp, Homo sapiens
cattgcactccagcctcccata

SEQ ID NO: 288 - DNA, 22 bp, Homo sapiens
ccactgaggtagctggtgactg

SEQ ID NO: 289 - DNA, 22 bp, Homo sapiens
cccgcgatctccttgtggccgt

SEQ ID NO: 290 - DNA, 22 bp, Homo sapiens
ccctgcctgtcctggtcccgtt

SEQ ID NO: 291 - DNA, 22 bp, Homo sapiens
cctgctctctgttcttaagctt

SEQ ID NO: 292 - DNA, 19 bp, Homo sapiens
cctggccgctgtgccccct

SEQ ID NO: 293 - DNA, 22 bp, Homo sapiens
cgcccaggctggagtgccagtg

SEQ ID NO: 294 - DNA, 22 bp, Homo sapiens
cgcccgctggccctgcgatctc

SEQ ID NO: 295 - DNA, 22 bp, Homo sapiens
cgttcactcccttgcccctcgg

SEQ ID NO: 296 - DNA, 22 bp, Homo sapiens
ctagactgaagctccttgagga

SEQ ID NO: 297 - DNA, 22 bp, Homo sapiens
ctcaggtgatccacccctcttg

SEQ ID NO: 298 - DNA, 22 bp, Homo sapiens
ctcgcccctctcagccctgcaa

SEQ ID NO: 299 - DNA, 22 bp, Homo sapiens
ctctccttggccacctccatga

SEQ ID NO: 300 - DNA, 22 bp, Homo sapiens
ctctgatgtctgcccctcacct

SEQ ID NO: 301 - DNA, 21 bp, Homo sapiens
ctggcctatcataagcatttt

SEQ ID NO: 302 - DNA, 22 bp, Homo sapiens
cttgattttgtctctggccctg

SEQ ID NO: 303 - DNA, 22 bp, Homo sapiens
cttggagtaggtcattgggtgg

SEQ ID NO: 304 - DNA, 22 bp, Homo sapiens
gaacttgtgatccgcccacctt

SEQ ID NO: 305 - DNA, 22 bp, Homo sapiens
gaagggggaagagagctggccg

SEQ ID NO: 306 - DNA, 22 bp, Homo sapiens
gaagtttgaagcctgttgttca

SEQ ID NO: 307 - DNA, 22 bp, Homo sapiens
gacccatcctccacttggcagc

SEQ ID NO: 308 - DNA, 17 bp, Homo sapiens
gcactgctgcctcctgg

SEQ ID NO: 309 - DNA, 22 bp, Homo sapiens
gccccagctcaccggctcactg

SEQ ID NO: 310 - DNA, 20 bp, Homo sapiens
gccttggtggttttggtagt

SEQ ID NO: 311 - DNA, 22 bp, Homo sapiens
cagcagctcagcctccttccca

SEQ ID NO: 312 - DNA, 22 bp, Homo sapiens
cagtttgtccccatggccatgt

SEQ ID NO: 313 - DNA, 22 bp, Homo sapiens
catcacccccagacctcagtgc

SEQ ID NO: 314 - DNA, 22 bp, Homo sapiens
ccccactgttttcttcatccta

SEQ ID NO: 315 - DNA, 22 bp, Homo sapiens
ccctcttggcttctatcccacc

SEQ ID NO: 316 - DNA, 22 bp, Homo sapiens
ccctggctcactttctgttgtg

SEQ ID NO: 317 - DNA, 22 bp, Homo sapiens
ccgcctggcccattgcagggca

SEQ ID NO: 318 - DNA, 22 bp, Homo sapiens
cctggctctggcttcctgttgt

SEQ ID NO: 319 - DNA, 22 bp, Homo sapiens
cctggtcggcgtggtgacggcg

SEQ ID NO: 320 - DNA, 22 bp, Homo sapiens
cgccgccctccgaggactcctt

SEQ ID NO: 321 - DNA, 22 bp, Homo sapiens
cgcctcctctctgtcctgattt

SEQ ID NO: 322 - DNA, 22 bp, Homo sapiens
cgcctggcccccagtactttgt

SEQ ID NO: 323 - DNA, 22 bp, Homo sapiens
cggtgggtgcttcaggcggtgg

SEQ ID NO: 324 - DNA, 22 bp, Homo sapiens
ctcagtgctgctggctcctgtc

SEQ ID NO: 325 - DNA, 23 bp, Homo sapiens
ctcattgtagcctccagttcttg

SEQ ID NO: 326 - DNA, 22 bp, Homo sapiens
ctggactgagctccttgaggcc

SEQ ID NO: 327 - DNA, 22 bp, Homo sapiens
ctggtgttgggtcttgctttta

SEQ ID NO: 328 - DNA, 22 bp, Homo sapiens
ctgtgctctttccacggcccca

SEQ ID NO: 329 - DNA, 22 bp, Homo sapiens
gatgagtttgcctggcctgcag

SEQ ID NO: 330 - DNA, 21 bp, Homo sapiens
gatgggtttgttggagaggtc

SEQ ID NO: 331 - DNA, 22 bp, Homo sapiens
gcccttgaagctctgacccgct

SEQ ID NO: 332 - DNA, 21 bp, Homo sapiens
gcctagtggatttgaagggcc

SEQ ID NO: 333 - DNA, 22 bp, Homo sapiens
gcctggcctaaattagtaattt

SEQ ID NO: 334 - DNA, 22 bp, Homo sapiens
gcctggcctaattccagcattt

SEQ ID NO: 335 - DNA, 22 bp, Homo sapiens
gcctggcctcctacagtacttt

SEQ ID NO: 336 - DNA, 22 bp, Homo sapiens
gcgggcggcttcatcttgccct

SEQ ID NO: 337 - DNA, 22 bp, Homo sapiens
gctaggctgctggccactgagg

SEQ ID NO: 338 - DNA, 22 bp, Homo sapiens
gctgttttcccatagctggtca

SEQ ID NO: 339 - DNA, 22 bp, Homo sapiens
ggaggctggccttcagacgggt

SEQ ID NO: 340 - DNA, 22 bp, Homo sapiens
ggcccaggttggagtgcagtga

SEQ ID NO: 341 - DNA, 22 bp, Homo sapiens
ggcggcccaggcgcttggagat

SEQ ID NO: 342 - DNA, 22 bp, Homo sapiens
ggcgtgccctggccccgaggct

SEQ ID NO: 343 - DNA, 23 bp, Homo sapiens
ggctgctggtctttcatagtggg

SEQ ID NO: 344 - DNA, 22 bp, Homo sapiens
ggctgctggtttcttgttttag

SEQ ID NO: 345 - DNA, 22 bp, Homo sapiens
ggcttcctgcctcgggctggcc

SEQ ID NO: 346 - DNA, 22 bp, Homo sapiens
gggagttgtggttggcttctgg

SEQ ID NO: 347 - DNA, 22 bp, Homo sapiens
ggttctcagcctgagccgcccc

SEQ ID NO: 348 - DNA, 22 bp, Homo sapiens
gtcctcactggccgcacgctga

SEQ ID NO: 349 - DNA, 22 bp, Homo sapiens
gtgttcctgtgctggatggtca

SEQ ID NO: 350 - DNA, 22 bp, Homo sapiens
tagctgagccgcctggctgggg

SEQ ID NO: 351 - DNA, 22 bp, Homo sapiens
taggaggattgcttgtggccag

SEQ ID NO: 352 - DNA, 22 bp, Homo sapiens
tcactgcaacctccacctcccg

SEQ ID NO: 353 - DNA, 22 bp, Homo sapiens
tcactgcaacctccacctcctg

SEQ ID NO: 354 - DNA, 22 bp, Homo sapiens
tcagctcctaccccggccccag

SEQ ID NO: 355 - DNA, 22 bp, Homo sapiens
tcagggctgcactggctggtct

SEQ ID NO: 356 - DNA, 21 bp, Homo sapiens
tccactgtccctggcactttt

SEQ ID NO: 357 - DNA, 22 bp, Homo sapiens
tccattggccttttatcctaga

SEQ ID NO: 358 - DNA, 22 bp, Homo sapiens
tcctacggtggccacagtctgg

SEQ ID NO: 359 - DNA, 22 bp, Homo sapiens
tcctcagcttggccacggagtt

SEQ ID NO: 360 - DNA, 22 bp, Homo sapiens
tcctccagagcttcatcctgcc

SEQ ID NO: 361 - DNA, 22 bp, Homo sapiens
tcctccctcacctcagtctggg

SEQ ID NO: 362 - DNA, 22 bp, Homo sapiens
tcctggccatccagcctgggga

SEQ ID NO: 363 - DNA, 20 bp, Homo sapiens
tctgcctccaggagctggca

SEQ ID NO: 364 - DNA, 22 bp, Homo sapiens
tgcccactgctggccaccaccc

SEQ ID NO: 365 - DNA, 22 bp, Homo sapiens
tgccgcccggccatctcggctc

SEQ ID NO: 366 - DNA, 22 bp, Homo sapiens
tgcctagccaagtccagtattt

SEQ ID NO: 367 - DNA, 22 bp, Homo sapiens
tgctctgttggcttcttttgtc

SEQ ID NO: 368 - DNA, 22 bp, Homo sapiens
tgggtcctggctgaagatctct

SEQ ID NO: 369 - DNA, 22 bp, Homo sapiens
tgggtctctggccaccccagcc

SEQ ID NO: 370 - DNA, 22 bp, Homo sapiens
tgggttttgtttgtacagtgta

SEQ ID NO: 371 - DNA, 19 bp, Homo sapiens
tggtctggcccacatggtc

SEQ ID NO: 372 - DNA, 22 bp, Homo sapiens
tggtgctagttaaatcttcagg

SEQ ID NO: 373 - DNA, 22 bp, Homo sapiens
tgtctggctttcttcagttagc

SEQ ID NO: 374 - DNA, 22 bp, Homo sapiens
ttataatgtatagctgtgcctg

SEQ ID NO: 375 - DNA, 22 bp, Homo sapiens
ttattgcactccagcctgggta

SEQ ID NO: 376 - DNA, 22 bp, Homo sapiens
ttcactgctctagccctaattt

SEQ ID NO: 377 - DNA, 22 bp, Homo sapiens
ttctggcttctcccaggcggcc

SEQ ID NO: 378 - DNA, 22 bp, Homo sapiens
ttgctcaggctggcgtgcaatg

SEQ ID NO: 379 - DNA, 22 bp, Homo sapiens
tttaaatcacaactctgcccct

SEQ ID NO: 380 - DNA, 21 bp, Homo sapiens
tttcttgggccgtgtgctggt

SEQ ID NO: 381 - DNA, 22 bp, Homo sapiens
ttccatatctgttgcatatcat

SEQ ID NO: 382 - DNA, 22 bp, Homo sapiens
ccactgcacttcagcctgggtg

SEQ ID NO: 383 - DNA, 22 bp, Homo sapiens
gccaaataagtgtccggccctc

SEQ ID NO: 384 - DNA, 22 bp, Homo sapiens
atccttgagccaatgactgatt

SEQ ID NO: 385 - DNA, 18 bp, Homo sapiens
tgagagcattcgaggcaa

SEQ ID NO: 386 - DNA, 22 bp, Homo sapiens
gggactggagtagaggccggtg

SEQ ID NO: 387 - DNA, 22 bp, Homo sapiens
gtagtgggtggaaatgactaca

SEQ ID NO: 388 - DNA, 22 bp, Homo sapiens
ttcctaagtcctgccagcagtc

SEQ ID NO: 389 - DNA, 22 bp, Homo sapiens
gcccgcgccagcctctccatct

SEQ ID NO: 390 - DNA, 22 bp, Homo sapiens
gccttgtttctctcccagataa

SEQ ID NO: 391 - DNA, 22 bp, Homo sapiens
ttgtgggggctgccctgtacgg

SEQ ID NO: 392 - DNA, 22 bp, Homo sapiens
tagcagcaaagcaggatctgct

SEQ ID NO: 393 - DNA, 15 bp, Homo sapiens
gcctctgagagccac

SEQ ID NO: 394 - DNA, 22 bp, Homo sapiens
ttgcccagagtcacccagctca

SEQ ID NO: 395 - DNA, 19 bp, Homo sapiens
cgtggcctgcactcgcagc

SEQ ID NO: 396 - DNA, 22 bp, Homo sapiens
cattgcactccagccttggcaa

SEQ ID NO: 397 - DNA, 19 bp, Homo sapiens
accttctgggaaacattcc

SEQ ID NO: 398 - DNA, 22 bp, Homo sapiens
gagagtgagatcctcctgggga

SEQ ID NO: 399 - DNA, 22 bp, Homo sapiens
tgctcgccccacatgccctcat

SEQ ID NO: 400 - DNA, 22 bp, Homo sapiens
ggagttcacgatgttggccagg

SEQ ID NO: 401 - DNA, 22 bp, Homo sapiens
tttatagcagcatgatttataa

SEQ ID NO: 402 - DNA, 22 bp, Homo sapiens
tactttgtccatttgcaggcag

SEQ ID NO: 403 - DNA, 22 bp, Homo sapiens
cagggtgccaaagaacaaatat

SEQ ID NO: 404 - DNA, 22 bp, Homo sapiens
tattattgacatttacttggtg

SEQ ID NO: 405 - DNA, 22 bp, Homo sapiens
atgcattgtcaggcaatttcat

SEQ ID NO: 406 - DNA, 16 bp, Homo sapiens
atgctgctattagagg

SEQ ID NO: 407 - DNA, 19 bp, Homo sapiens
gatttaaacgtggctctat

SEQ ID NO: 408 - DNA, 22 bp, Homo sapiens
tcactgcaacctctgcctcttg

SEQ ID NO: 409 - DNA, 22 bp, Homo sapiens
tcagtgtgaattcaggagccta

SEQ ID NO: 410 - DNA, 22 bp, Homo sapiens
gaaaagagacagggtgggtgat

SEQ ID NO: 411 - DNA, 22 bp, Homo sapiens
tttgcattgcattaagtattct

SEQ ID NO: 412 - DNA, 22 bp, Homo sapiens
aggagctgtcagagtgccagag

SEQ ID NO: 413 - DNA, 22 bp, Homo sapiens
tacgcgaagaaggacctgatgg

SEQ ID NO: 414 - DNA, 22 bp, Homo sapiens
agctgccccgaggcggcgggaa

SEQ ID NO: 415 - DNA, 22 bp, Homo sapiens
atcccaggcggcacaggttgca

SEQ ID NO: 416 - DNA, 22 bp, Homo sapiens
tggttacccagtcgctggagtt

SEQ ID NO: 417 - DNA, 22 bp, Homo sapiens
aatgtgagccaatgcccgtggg

SEQ ID NO: 418 - DNA, 22 bp, Homo sapiens
aagtttgtgtagtttagcatcc

SEQ ID NO: 419 - DNA, 22 bp, Homo sapiens
gcttctcaattctcaccctcca

SEQ ID NO: 420 - DNA, 20 bp, Homo sapiens
gtgcaatggcaccatctcag

SEQ ID NO: 421 - DNA, 22 bp, Homo sapiens
cactgggcgtgtcctgggtgag

SEQ ID NO: 422 - DNA, 21 bp, Homo sapiens
tcctgtaagcttgggtggctc

SEQ ID NO: 423 - DNA, 22 bp, Homo sapiens
tcaaatctcatcttgaattgta

SEQ ID NO: 424 - DNA, 22 bp, Homo sapiens
cccaggctggagtgcagtggcg

SEQ ID NO: 425 - DNA, 22 bp, Homo sapiens
aagctctttccactaaaccact

SEQ ID NO: 426 - DNA, 22 bp, Homo sapiens
cagccccatggtgtgctccagc

SEQ ID NO: 427 - DNA, 22 bp, Homo sapiens
ttgactgtgatgggctcagctg

SEQ ID NO: 428 - DNA, 22 bp, Homo sapiens
tcagtgcacccaattctctcca

SEQ ID NO: 429 - DNA, 22 bp, Homo sapiens
ttcaatatgatattagctgtgg

SEQ ID NO: 430 - DNA, 20 bp, Homo sapiens
tgctggaaattgttctagga

SEQ ID NO: 431 - DNA, 22 bp, Homo sapiens
atgaacttccagagcttggtga

SEQ ID NO: 432 - DNA, 22 bp, Homo sapiens
gcagctctatgtgatggtaaat

SEQ ID NO: 433 - DNA, 22 bp, Homo sapiens
acatccgcaggttataaagccc

SEQ ID NO: 434 - DNA, 22 bp, Homo sapiens
tctgacattagattaattggaa

SEQ ID NO: 435 - DNA, 22 bp, Homo sapiens
taatggattaacgtccctgtcg

SEQ ID NO: 436 - DNA, 19 bp, Homo sapiens
gttctttcatagtaagagc

SEQ ID NO: 437 - DNA, 22 bp, Homo sapiens
ttcagaagagacactgtgacag

SEQ ID NO: 438 - DNA, 22 bp, Homo sapiens
aagagagtcagtctgagcacca

SEQ ID NO: 439 - DNA, 22 bp, Homo sapiens
ctatcacagagggttgttttga

SEQ ID NO: 440 - DNA, 22 bp, Homo sapiens
tgcttgattctgtccctttatt

SEQ ID NO: 441 - DNA, 22 bp, Homo sapiens
gtgcggatcggtgtcctccaaa

SEQ ID NO: 442 - DNA, 22 bp, Homo sapiens
agttgcatgtccaagggggtag

SEQ ID NO: 443 - DNA, 22 bp, Homo sapiens
tccccattcctctcggtggtgg

SEQ ID NO: 444 - DNA, 22 bp, Homo sapiens
cacccaggctggagagcagtgg

SEQ ID NO: 445 - DNA, 22 bp, Homo sapiens
ctctctgggcccagttggcacc

SEQ ID NO: 446 - DNA, 22 bp, Homo sapiens
tctgcaccatcgtatgcttaat

SEQ ID NO: 447 - DNA, 22 bp, Homo sapiens
ctctgagctgccttttgagctt

SEQ ID NO: 448 - DNA, 22 bp, Homo sapiens
aatggaatcagtttctctaagt

SEQ ID NO: 449 - DNA, 22 bp, Homo sapiens
tctctggttatgtcattaagca

SEQ ID NO: 450 - DNA, 22 bp, Homo sapiens
tcccgcccttgtacttgccgag

SEQ ID NO: 451 - DNA, 19 bp, Homo sapiens
ctgacatgtgggggatgtc

SEQ ID NO: 452 - DNA, 22 bp, Homo sapiens
atgtttttaaatagacttacag

SEQ ID NO: 453 - DNA, 22 bp, Homo sapiens
cccctcttggcattgagtgcca

SEQ ID NO: 454 - DNA, 22 bp, Homo sapiens
tgcaccctcatcagtcaaatgg

SEQ ID NO: 455 - DNA, 22 bp, Homo sapiens
agtgcagtggttaggagccagg

SEQ ID NO: 456 - DNA, 22 bp, Homo sapiens
ggcatagcggctcagcgtccag

SEQ ID NO: 457 - DNA, 22 bp, Homo sapiens
ctgaagaggctccgcccacaag

SEQ ID NO: 458 - DNA, 22 bp, Homo sapiens
caaatactacgattcttgcagt

SEQ ID NO: 459 - DNA, 22 bp, Homo sapiens
aagaagcattctttcattggtt

SEQ ID NO: 460 - DNA, 23 bp, Homo sapiens
agagtgcagagatatgcttgtgt

SEQ ID NO: 461 - DNA, 22 bp, Homo sapiens
aatttcggttcaaggcccagtt

SEQ ID NO: 462 - DNA, 22 bp, Homo sapiens
gtttctggagtgactataactg

SEQ ID NO: 463 - DNA, 17 bp, Homo sapiens
tggttgtgggaactgaa

SEQ ID NO: 464 - DNA, 22 bp, Homo sapiens
gcctgtgtggatgcgccggtgc

SEQ ID NO: 465 - DNA, 22 bp, Homo sapiens
cttgctgccagccaccatactg

SEQ ID NO: 466 - DNA, 22 bp, Homo sapiens
cggagcgctgggggactctgca

SEQ ID NO: 467 - DNA, 22 bp, Homo sapiens
gtgccgcgacgcagtcggtgcc

SEQ ID NO: 468 - DNA, 17 bp, Homo sapiens
gagcccctttccaagtt

SEQ ID NO: 469 - DNA, 22 bp, Homo sapiens
aggagggtgggaagcagtttta

SEQ ID NO: 470 - DNA, 22 bp, Homo sapiens
cccattgtggttgttgaggata

SEQ ID NO: 471 - DNA, 22 bp, Homo sapiens
ggaatgaatttccagctgggtc

SEQ ID NO: 472 - DNA, 22 bp, Homo sapiens
tgatttcaagccagggggcgtt

SEQ ID NO: 473 - DNA, 22 bp, Homo sapiens
tgggggagctcagtccagccca

SEQ ID NO: 474 - DNA, 22 bp, Homo sapiens
gtgatggaagtcttgttccggg

SEQ ID NO: 475 - DNA, 22 bp, Homo sapiens
aggccagcctgcccaaagctgc

SEQ ID NO: 476 - DNA, 21 bp, Homo sapiens
gttcaaatcctgacactacac

SEQ ID NO: 477 - DNA, 22 bp, Homo sapiens
gatgtgtttccaggatttgttt

SEQ ID NO: 478 - DNA, 22 bp, Homo sapiens
ttgtccgtggtgagttcgcatt

SEQ ID NO: 479 - DNA, 19 bp, Homo sapiens
ttaccgtgaaatggttcag

SEQ ID NO: 480 - DNA, 22 bp, Homo sapiens
ctgtctgcaggatagtaccctc

SEQ ID NO: 481 - DNA, 22 bp, Homo sapiens
atggccgcctgtccttcccgcc

SEQ ID NO: 482 - DNA, 22 bp, Homo sapiens
taaggcaggaactggctgtttt

SEQ ID NO: 483 - DNA, 22 bp, Homo sapiens
gatggtgcaggtgaagtgctgg

SEQ ID NO: 484 - DNA, 22 bp, Homo sapiens
atggtgtttataggcaaagatc

SEQ ID NO: 485 - DNA, 22 bp, Homo sapiens
gaggactgaaacttacaggaaa

SEQ ID NO: 486 - DNA, 22 bp, Homo sapiens
gatgccctggcctgtccccgca

SEQ ID NO: 487 - DNA, 22 bp, Homo sapiens
ggaggagacagtaaaaagcacg

SEQ ID NO: 488 - DNA, 22 bp, Homo sapiens
aacacacctggttaacctcttt

SEQ ID NO: 489 - DNA, 22 bp, Homo sapiens
actcagtacatctggagttggc

SEQ ID NO: 490 - DNA, 22 bp, Homo sapiens
cattctaggcctggcttgggcc

SEQ ID NO: 491 - DNA, 22 bp, Homo sapiens
tttgtttgccacacaaaacagt

SEQ ID NO: 492 - DNA, 22 bp, Homo sapiens
cagtgcccgccgccgttcctgg

SEQ ID NO: 493 - DNA, 20 bp, Homo sapiens
ggcagagggcctgggagaag

SEQ ID NO: 494 - DNA, 22 bp, Homo sapiens
ggaggggatttagtagatgcta

SEQ ID NO: 495 - DNA, 22 bp, Homo sapiens
tggggagaaatgtctttgttcc

SEQ ID NO: 496 - DNA, 22 bp, Homo sapiens
tgcttgtgacagaactgtgtcc

SEQ ID NO: 497 - DNA, 22 bp, Homo sapiens
aaggcaaaagaggtgtcatcac

SEQ ID NO: 498 - DNA, 22 bp, Homo sapiens
aagtccaggtcctcattccatc

SEQ ID NO: 499 - DNA, 22 bp, Homo sapiens
tgtgacgttgttctggattccc

SEQ ID NO: 500 - DNA, 22 bp, Homo sapiens
ttccttacattcatatggcttc

SEQ ID NO: 501 - DNA, 22 bp, Homo sapiens
tatggcattgttggtgatgata

SEQ ID NO: 502 - DNA, 22 bp, Homo sapiens
agggtctatataggtcaggacc

SEQ ID NO: 503 - DNA, 22 bp, Homo sapiens
tggcccagtatgtataatctta

SEQ ID NO: 504 - DNA, 22 bp, Homo sapiens
agcctgggcaacagagcaaaac

SEQ ID NO: 505 - DNA, 22 bp, Homo sapiens
aaatgcacaaagattttgcact

SEQ ID NO: 506 - DNA, 23 bp, Homo sapiens
agcaatctgtgtttcagcaagcc

SEQ ID NO: 507 - DNA, 22 bp, Homo sapiens
agtattacatggccaatctcct

SEQ ID NO: 508 - DNA, 22 bp, Homo sapiens
accctactaaatgtggtatgtc

SEQ ID NO: 509 - DNA, 22 bp, Homo sapiens
acctgcaggcacaggtgtgcgc

SEQ ID NO: 510 - DNA, 22 bp, Homo sapiens
tgaggtgcagcaatcctcatgt

SEQ ID NO: 511 - DNA, 22 bp, Homo sapiens
ttttggccacatccttttgagt

SEQ ID NO: 512 - DNA, 22 bp, Homo sapiens
aatggagattccaagttccttt

SEQ ID NO: 513 - DNA, 22 bp, Homo sapiens
tgaggcaggacttgcataaagt

SEQ ID NO: 514 - DNA, 22 bp, Homo sapiens
ggggtactggctggagccccac

SEQ ID NO: 515 - DNA, 22 bp, Homo sapiens
tttggaggggaagaccttggag

SEQ ID NO: 516 - DNA, 22 bp, Homo sapiens
ggcaaggtgctacagacagtga

SEQ ID NO: 517 - DNA, 22 bp, Homo sapiens
gcagacgtcaccgagtcgatgg

SEQ ID NO: 518 - DNA, 22 bp, Homo sapiens
tagcatgtcagtcgccacacgt

SEQ ID NO: 519 - DNA, 22 bp, Homo sapiens
cggcatccccacttcctcctgc

SEQ ID NO: 520 - DNA, 22 bp, Homo sapiens
ctggctctcaggctggtcccca

SEQ ID NO: 521 - DNA, 22 bp, Homo sapiens
tggttaagtccagaaaggaagc

SEQ ID NO: 522 - DNA, 20 bp, Homo sapiens
ttgagcagcagtgctgtgtc

SEQ ID NO: 523 - DNA, 22 bp, Homo sapiens
actggggctgatgcgttcgtgt

SEQ ID NO: 524 - DNA, 22 bp, Homo sapiens
aatggctctgatgttgttgtga

SEQ ID NO: 525 - DNA, 19 bp, Homo sapiens
agcagtgtagaagtgttcc

SEQ ID NO: 526 - DNA, 22 bp, Homo sapiens
tttgcttgttcaagatttctgt

SEQ ID NO: 527 - DNA, 22 bp, Homo sapiens
aacactatctgccttacaggga

SEQ ID NO: 528 - DNA, 22 bp, Homo sapiens
gagggggctagcgcagtgccca

SEQ ID NO: 529 - DNA, 22 bp, Homo sapiens
gcctgatgagcttccagctgag

SEQ ID NO: 530 - DNA, 22 bp, Homo sapiens
aggacagagggaccagagccca

SEQ ID NO: 531 - DNA, 22 bp, Homo sapiens
ggccactggccaggatctaaga

SEQ ID NO: 532 - DNA, 22 bp, Homo sapiens
tccttgaaaggggctgcagggc

SEQ ID NO: 533 - DNA, 22 bp, Homo sapiens
ccacaccatcgtttttacctta

SEQ ID NO: 534 - DNA, 22 bp, Homo sapiens
gtagcccacctggggagggcga

SEQ ID NO: 535 - DNA, 22 bp, Homo sapiens
tctaattttggcattttaacct

SEQ ID NO: 536 - DNA, 22 bp, Homo sapiens
tattatccaaagagctgggagc

SEQ ID NO: 537 - DNA, 22 bp, Homo sapiens
aagaactgagtacgttaataaa

SEQ ID NO: 538 - DNA, 18 bp, Homo sapiens
gcaagtgtctgtcccctt

SEQ ID NO: 539 - DNA, 22 bp, Homo sapiens
cctaggagttcgaagctgcagt

SEQ ID NO: 540 - DNA, 22 bp, Homo sapiens
cagcagtgtacaaggtgtcaga

SEQ ID NO: 541 - DNA, 22 bp, Homo sapiens
ttatacagggagtttccctgca

SEQ ID NO: 542 - DNA, 21 bp, Homo sapiens
tggtacaccttgcctgtcaga

SEQ ID NO: 543 - DNA, 22 bp, Homo sapiens
tgacatttcctagtgctttgtg

SEQ ID NO: 544 - DNA, 22 bp, Homo sapiens
cttaattggcttatttcctcaa

SEQ ID NO: 545 - DNA, 22 bp, Homo sapiens
atgcccaatgtcacaatttttg

SEQ ID NO: 546 - DNA, 22 bp, Homo sapiens
tcactgcactccagcctgggca

SEQ ID NO: 547 - DNA, 22 bp, Homo sapiens
tggctccacaggccagggtgtg

SEQ ID NO: 548 - DNA, 22 bp, Homo sapiens
ttgcagcccgggttggtttgtg

SEQ ID NO: 549 - DNA, 22 bp, Homo sapiens
cttctagagaggtgagctggag

SEQ ID NO: 550 - DNA, 22 bp, Homo sapiens
aagaccagcctatgttttccat

SEQ ID NO: 551 - DNA, 22 bp, Homo sapiens
cttagagatgggttttacttag

SEQ ID NO: 552 - DNA, 22 bp, Homo sapiens
tgtccgcggtttgcgttgtggg

SEQ ID NO: 553 - DNA, 22 bp, Homo sapiens
gcggggcctgactctgacccgc

SEQ ID NO: 554 - DNA, 22 bp, Homo sapiens
ggatgcacgaaggcgcctcgga

SEQ ID NO: 555 - DNA, 22 bp, Homo sapiens
aaagtgctgggattacaggcat

SEQ ID NO: 556 - DNA, 22 bp, Homo sapiens
ccattgtaaattctgtggaagt

SEQ ID NO: 557 - DNA, 22 bp, Homo sapiens
ttctcctttcattccctgtaga

SEQ ID NO: 558 - DNA, 22 bp, Homo sapiens
gatttctctgcacccactcagg

SEQ ID NO: 559 - DNA, 22 bp, Homo sapiens
tttcccaggctggaatgcagtg

SEQ ID NO: 560 - DNA, 22 bp, Homo sapiens
acctggaacttggtcatttttc

SEQ ID NO: 561 - DNA, 22 bp, Homo sapiens
ttcttctccgaggagggctggt

SEQ ID NO: 562 - DNA, 22 bp, Homo sapiens
cagccttagcaggatcatctga

SEQ ID NO: 563 - DNA, 22 bp, Homo sapiens
agatcggctttgcagacctcat

SEQ ID NO: 564 - DNA, 22 bp, Homo sapiens
ctgcactgagcatctaacctta

SEQ ID NO: 565 - DNA, 22 bp, Homo sapiens
gcaggagaacaaagcaagctgc

SEQ ID NO: 566 - DNA, 22 bp, Homo sapiens
gtggccgccaggtcctcgtcca

SEQ ID NO: 567 - DNA, 22 bp, Homo sapiens
agacatccttcaagtgatatgt

SEQ ID NO: 568 - DNA, 22 bp, Homo sapiens
tgtgtctcaagtcagagcatca

SEQ ID NO: 569 - DNA, 22 bp, Homo sapiens
cactctcagcataatgaatgtg

SEQ ID NO: 570 - DNA, 19 bp, Homo sapiens
gcctcatttccacctcccc

SEQ ID NO: 571 - DNA, 22 bp, Homo sapiens
aggagagctggtgtctggaatc

SEQ ID NO: 572 - DNA, 18 bp, Homo sapiens
ggctgtggacaagattag

SEQ ID NO: 573 - DNA, 22 bp, Homo sapiens
ggttttatcctacccacacagc

SEQ ID NO: 574 - DNA, 22 bp, Homo sapiens
tgcgcctggggccctggctgtc

SEQ ID NO: 575 - DNA, 22 bp, Homo sapiens
ggacccaggggtctctctgtcc

SEQ ID NO: 576 - DNA, 22 bp, Homo sapiens
cactgcactccatcctgggaaa

SEQ ID NO: 577 - DNA, 22 bp, Homo sapiens
cagttccctccgccagcacttc

SEQ ID NO: 578 - DNA, 22 bp, Homo sapiens
aaagttctctatggtgtaaaaa

SEQ ID NO: 579 - DNA, 22 bp, Homo sapiens
acactggttggttgaatttact

SEQ ID NO: 580 - DNA, 22 bp, Homo sapiens
gtcctaccatgaattcactcca

SEQ ID NO: 581 - DNA, 22 bp, Homo sapiens
aaccccaaaacctctgaagtgg

SEQ ID NO: 582 - DNA, 22 bp, Homo sapiens
tggcaggcgggagccatagagg

SEQ ID NO: 583 - DNA, 22 bp, Homo sapiens
ttgcacagaatgacaatatgta

SEQ ID NO: 584 - DNA, 22 bp, Homo sapiens
tttccagagggtgctcagggcg

SEQ ID NO: 585 - DNA, 22 bp, Homo sapiens
accttgaccttgagcacctgtt

SEQ ID NO: 586 - DNA, 22 bp, Homo sapiens
gtagcagagggcccaggtaact

SEQ ID NO: 587 - DNA, 22 bp, Homo sapiens
gtacaaatgcaggtttgttaca

SEQ ID NO: 588 - DNA, 22 bp, Homo sapiens
tgtgcctactgatagagccaag

SEQ ID NO: 589 - DNA, 22 bp, Homo sapiens
cccgagcctcggtttcttttct

SEQ ID NO: 590 - DNA, 22 bp, Homo sapiens
tacaacctctgcctcccaagtt

SEQ ID NO: 591 - DNA, 22 bp, Homo sapiens
tctcaatttgattacattcata

SEQ ID NO: 592 - DNA, 22 bp, Homo sapiens
tggcaccagggaacaagcattt

SEQ ID NO: 593 - DNA, 22 bp, Homo sapiens
aagctgttgttcatcctgaatt

SEQ ID NO: 594 - DNA, 22 bp, Homo sapiens
atatttgcattttaaacaggca

SEQ ID NO: 595 - DNA, 22 bp, Homo sapiens
tagatacctgctggacctcatt

SEQ ID NO: 596 - DNA, 22 bp, Homo sapiens
gctgtctcatacaaggccctgc

SEQ ID NO: 597 - DNA, 22 bp, Homo sapiens
agtgcaatggctgcctgcatgg

SEQ ID NO: 598 - DNA, 22 bp, Homo sapiens
gatattcctgaaggacagggtt

SEQ ID NO: 599 - DNA, 22 bp, Homo sapiens
ctctcagtcctgcgcgcctctg

SEQ ID NO: 600 - DNA, 22 bp, Homo sapiens
ttttcaggctgatttgtgttag

SEQ ID NO: 601 - DNA, 22 bp, Homo sapiens
cgtcatcacggcaagcatctcc

SEQ ID NO: 602 - DNA, 22 bp, Homo sapiens
ctgtggcgccgctgagagcaga

SEQ ID NO: 603 - DNA, 22 bp, Homo sapiens
ggtgaagtaatgaaacagggag

SEQ ID NO: 604 - DNA, 22 bp, Homo sapiens
tgagatggagtctcgctctgtt

SEQ ID NO: 605 - DNA, 22 bp, Homo sapiens
ttgctgctctgccggtacagct

SEQ ID NO: 606 - DNA, 22 bp, Homo sapiens
taagaaatttagttatagaatg

SEQ ID NO: 607 - DNA, 22 bp, Homo sapiens
gagggagggactagcattctct

SEQ ID NO: 608 - DNA, 21 bp, Homo sapiens
aggagcattgttgtggtggag

SEQ ID NO: 609 - DNA, 22 bp, Homo sapiens
tcccagaaacgcatatgttcat

SEQ ID NO: 610 - DNA, 22 bp, Homo sapiens
gcctgtcccgcaccggagcccg

SEQ ID NO: 611 - DNA, 22 bp, Homo sapiens
gtcaccttgaacaggctactca

SEQ ID NO: 612 - DNA, 22 bp, Homo sapiens
gtctccccagggccctcttcat

SEQ ID NO: 613 - DNA, 22 bp, Homo sapiens
tggatggctgtggtctttgccc

SEQ ID NO: 614 - DNA, 22 bp, Homo sapiens
atgtttttggaaatgggaacat

SEQ ID NO: 615 - DNA, 22 bp, Homo sapiens
tatcataggttctgaatgtttc

SEQ ID NO: 616 - DNA, 22 bp, Homo sapiens
cccatgattcaattgtctccat

SEQ ID NO: 617 - DNA, 22 bp, Homo sapiens
tgagccgtggtctctgagggtg

SEQ ID NO: 618 - DNA, 22 bp, Homo sapiens
cttccttctcactagcagcgcc

SEQ ID NO: 619 - DNA, 22 bp, Homo sapiens
aaagtgctgggattacaagtgt

SEQ ID NO: 620 - DNA, 22 bp, Homo sapiens
tcctttgcttctgtcattctcc

SEQ ID NO: 621 - DNA, 22 bp, Homo sapiens
gggttgtagagctggaagggga

SEQ ID NO: 622 - DNA, 22 bp, Homo sapiens
tttatagtagcatgatttatag

SEQ ID NO: 623 - DNA, 22 bp, Homo sapiens
ggaggctgagaggtcgcagtgg

SEQ ID NO: 624 - DNA, 22 bp, Homo sapiens
gaggctgaggttgcagtgagct

SEQ ID NO: 625 - DNA, 22 bp, Homo sapiens
tggtggcgggcagggccgtcac

SEQ ID NO: 626 - DNA, 19 bp, Homo sapiens
gtaatatgtgctgagtcct

SEQ ID NO: 627 - DNA, 22 bp, Homo sapiens
aaagtgctgggattataggcat

SEQ ID NO: 628 - DNA, 22 bp, Homo sapiens
aggccgtctgcaggcctgcagg

SEQ ID NO: 629 - DNA, 22 bp, Homo sapiens
caccgagtgacagtagccatca

SEQ ID NO: 630 - DNA, 22 bp, Homo sapiens
cagggtgacaagtggcaaggag

SEQ ID NO: 631 - DNA, 22 bp, Homo sapiens
agtcaataaaagctttagattc

SEQ ID NO: 632 - DNA, 23 bp, Homo sapiens
ttgcatagacatcctcatagatt

SEQ ID NO: 633 - DNA, 22 bp, Homo sapiens
cagatgtcatttcccatgcagc

SEQ ID NO: 634 - DNA, 22 bp, Homo sapiens
ctggttatctcggccacagaga

SEQ ID NO: 635 - DNA, 22 bp, Homo sapiens
aggtagaaggaccagaatttat

SEQ ID NO: 636 - DNA, 22 bp, Homo sapiens
gcacagagagggaaggtaactt

SEQ ID NO: 637 - DNA, 22 bp, Homo sapiens
tctaaacttgtaaacaagcata

SEQ ID NO: 638 - DNA, 22 bp, Homo sapiens
ggccactgctctccagcctggg

SEQ ID NO: 639 - DNA, 22 bp, Homo sapiens
tgggaagggtcaacagctggaa

SEQ ID NO: 640 - DNA, 22 bp, Homo sapiens
cagaggaacgtttggattgatt

SEQ ID NO: 641 - DNA, 22 bp, Homo sapiens
aacatatcatttaaccctcacc

SEQ ID NO: 642 - DNA, 22 bp, Homo sapiens
agccaatctggggagacgggag

SEQ ID NO: 643 - DNA, 22 bp, Homo sapiens
aagacacaatgtagcccagcac

SEQ ID NO: 644 - DNA, 22 bp, Homo sapiens
tgggccgtggagcactctgaga

SEQ ID NO: 645 - DNA, 22 bp, Homo sapiens
tcactacctgacaatacagtat

SEQ ID NO: 646 - DNA, 22 bp, Homo sapiens
cagcctgtcggctccttcattc

SEQ ID NO: 647 - DNA, 22 bp, Homo sapiens
tccaccatgtaacaagctctgt

SEQ ID NO: 648 - DNA, 23 bp, Homo sapiens
ttgggcaaatcactaacgtctcc

SEQ ID NO: 649 - DNA, 22 bp, Homo sapiens
gcctgggtccaccgctcgcgct

SEQ ID NO: 650 - DNA, 22 bp, Homo sapiens
gcctgacttgtgtattttacat

SEQ ID NO: 651 - DNA, 22 bp, Homo sapiens
gaggccactgtccctgccttcc

SEQ ID NO: 652 - DNA, 22 bp, Homo sapiens
tctttgttattgtgaatagggt

SEQ ID NO: 653 - DNA, 22 bp, Homo sapiens
atctggttcttcttaggcatca

SEQ ID NO: 654 - DNA, 20 bp, Homo sapiens
ttgttagaggaatgccatag

SEQ ID NO: 655 - DNA, 18 bp, Homo sapiens
gcagctagccaggggggc

SEQ ID NO: 656 - DNA, 22 bp, Homo sapiens
gcagggaggtttgctgacctgg

SEQ ID NO: 657 - DNA, 22 bp, Homo sapiens
actgggcctgattgggtcggag

SEQ ID NO: 658 - DNA, 22 bp, Homo sapiens
ctcaggacccggtccaggtggg

SEQ ID NO: 659 - DNA, 22 bp, Homo sapiens
acccgccgcacgtccaggctga

SEQ ID NO: 660 - DNA, 22 bp, Homo sapiens
tggcttccccggagtgacatgt

SEQ ID NO: 661 - DNA, 22 bp, Homo sapiens
aggatcctgcgctttgggggag

SEQ ID NO: 662 - DNA, 22 bp, Homo sapiens
aagtgatgctacgactttgaca

SEQ ID NO: 663 - DNA, 22 bp, Homo sapiens
aagtataatcaaagcagggcta

SEQ ID NO: 664 - DNA, 22 bp, Homo sapiens
atcctcagacttcacgttccat

SEQ ID NO: 665 - DNA, 22 bp, Homo sapiens
agtgagtttagggtgcaggtgt

SEQ ID NO: 666 - DNA, 22 bp, Homo sapiens
gaggaggcttccgggaggcacg

SEQ ID NO: 667 - DNA, 22 bp, Homo sapiens
ggaggagcatgagagggtagtg

SEQ ID NO: 668 - DNA, 22 bp, Homo sapiens
gctgtccagcccttgttcacct

SEQ ID NO: 669 - DNA, 22 bp, Homo sapiens
taacatttaaatttttcacata

SEQ ID NO: 670 - DNA, 22 bp, Homo sapiens
agggaaatctcagctctaaaat

SEQ ID NO: 671 - DNA, 22 bp, Homo sapiens
ggttgcaaactcctgggatcaa

SEQ ID NO: 672 - DNA, 22 bp, Homo sapiens
acactctagagggaagcgcttt

SEQ ID NO: 673 - DNA, 22 bp, Homo sapiens
ttggcttttatgcagcttaggt

SEQ ID NO: 674 - DNA, 22 bp, Homo sapiens
ccttcattcattaatttagccc

SEQ ID NO: 675 - DNA, 22 bp, Homo sapiens
catctgtaaagtaggaatattg

SEQ ID NO: 676 - DNA, 22 bp, Homo sapiens
ggaagggcaaaagagatgaact

SEQ ID NO: 677 - DNA, 22 bp, Homo sapiens
ctgctcagtaatagtcctatct

SEQ ID NO: 678 - DNA, 22 bp, Homo sapiens
ttcatatgtgaactcagtgatg

SEQ ID NO: 679 - DNA, 22 bp, Homo sapiens
tttgccagtattttattgatga

SEQ ID NO: 680 - DNA, 22 bp, Homo sapiens
ccggtctgtgtacttgctggcc

SEQ ID NO: 681 - DNA, 22 bp, Homo sapiens
attgtactacaccatagtactg

SEQ ID NO: 682 - DNA, 17 bp, Homo sapiens
cagtcgaggaggacctg

SEQ ID NO: 683 - DNA, 22 bp, Homo sapiens
tgttgagtatatacctacaagt

SEQ ID NO: 684 - DNA, 22 bp, Homo sapiens
aagcagatctgatagggccctg

SEQ ID NO: 685 - DNA, 22 bp, Homo sapiens
cactgcactccagcctgggaga

SEQ ID NO: 686 - DNA, 22 bp, Homo sapiens
ttctggaaggatgtttctatct

SEQ ID NO: 687 - DNA, 22 bp, Homo sapiens
tactgtgtgcccagccgagctg

SEQ ID NO: 688 - DNA, 22 bp, Homo sapiens
atacataattacttccgatgtt

SEQ ID NO: 689 - DNA, 22 bp, Homo sapiens
gcgcactgggcgcacgcgtagg

SEQ ID NO: 690 - DNA, 22 bp, Homo sapiens
tgacatgtatatcttacgctat

SEQ ID NO: 691 - DNA, 22 bp, Homo sapiens
tggccttgagagatcaaaaggt

SEQ ID NO: 692 - DNA, 22 bp, Homo sapiens
gcccagatctcctgaccctcag

SEQ ID NO: 693 - DNA, 22 bp, Homo sapiens
tggggtacttgtatcaaagcac

SEQ ID NO: 694 - DNA, 22 bp, Homo sapiens
tcacttcccagacggggtggca

SEQ ID NO: 695 - DNA, 22 bp, Homo sapiens
tgcctactagtactattttgtg

SEQ ID NO: 696 - DNA, 22 bp, Homo sapiens
tgttccgaccgtggggtttgat

SEQ ID NO: 697 - DNA, 21 bp, Homo sapiens
gctgctcgagatccagtgctt

SEQ ID NO: 698 - DNA, 22 bp, Homo sapiens
ttagcacaattatttcagttgt

SEQ ID NO: 699 - DNA, 23 bp, Homo sapiens
gtctctagagtgtggagcaaaga

SEQ ID NO: 700 - DNA, 22 bp, Homo sapiens
ggtgctggacacgtggcactcc

SEQ ID NO: 701 - DNA, 22 bp, Homo sapiens
acactgatgttggccctggtca

SEQ ID NO: 702 - DNA, 22 bp, Homo sapiens
aggctgtgtggataatattggg

SEQ ID NO: 703 - DNA, 22 bp, Homo sapiens
gccagggttcaagctattctcc

SEQ ID NO: 704 - DNA, 22 bp, Homo sapiens
atggctgcctgggcgctggccg

SEQ ID NO: 705 - DNA, 22 bp, Homo sapiens
attgtaaatagtgccacaataa

SEQ ID NO: 706 - DNA, 22 bp, Homo sapiens
tttctcctcatgactggttgtg

SEQ ID NO: 707 - DNA, 22 bp, Homo sapiens
acccagtctggagtgcagtgac

SEQ ID NO: 708 - DNA, 22 bp, Homo sapiens
aaagcgcttccctttggagcgt

SEQ ID NO: 709 - DNA, 22 bp, Homo sapiens
aacgcccagccttgatcaaatg

SEQ ID NO: 710 - DNA, 22 bp, Homo sapiens
gcagaccctgaactgggcatgg

SEQ ID NO: 711 - DNA, 22 bp, Homo sapiens
tgagcacatgccagcccttctc

SEQ ID NO: 712 - DNA, 22 bp, Homo sapiens
cagtgatcgcactcaacagttt

SEQ ID NO: 713 - DNA, 22 bp, Homo sapiens
gacctcgtgatctgccggcctt

SEQ ID NO: 714 - DNA, 22 bp, Homo sapiens
tttctgattgtcatgctgggtg

SEQ ID NO: 715 - DNA, 22 bp, Homo sapiens
ctggatgtccaggtagaagttt

SEQ ID NO: 716 - DNA, 14 bp, Homo sapiens
gcaggcggatcact

SEQ ID NO: 717 - DNA, 22 bp, Homo sapiens
tgtgcgtcctgtgcgcacactg

SEQ ID NO: 718 - DNA, 22 bp, Homo sapiens
cccttggggtggaggttgcagt

SEQ ID NO: 719 - DNA, 22 bp, Homo sapiens
tggctaacaaggtgaaaccccg

SEQ ID NO: 720 - DNA, 22 bp, Homo sapiens
tattaagtggtgagtactgcca

SEQ ID NO: 721 - DNA, 22 bp, Homo sapiens
gaccactggggtgagggccatc

SEQ ID NO: 722 - DNA, 22 bp, Homo sapiens
gtcctggggattatagagtgtt

SEQ ID NO: 723 - DNA, 22 bp, Homo sapiens
tatacactgttgttgggagtct

SEQ ID NO: 724 - DNA, 22 bp, Homo sapiens
tgtgctctgactttctcctggt

SEQ ID NO: 725 - DNA, 22 bp, Homo sapiens
ttaggtcacatcggtgaccaaa

SEQ ID NO: 726 - DNA, 22 bp, Homo sapiens
actgtactccagccttggggac

SEQ ID NO: 727 - DNA, 22 bp, Homo sapiens
gacccaggggcagggagaaagt

SEQ ID NO: 728 - DNA, 22 bp, Homo sapiens
catagagtgatgtaaggtatgt

SEQ ID NO: 729 - DNA, 22 bp, Homo sapiens
aggtgactggtttatctggcag

SEQ ID NO: 730 - DNA, 22 bp, Homo sapiens
ggggtgggcgtgcagggacacc

SEQ ID NO: 731 - DNA, 22 bp, Homo sapiens
tgatctcctgaccttgtaatcc

SEQ ID NO: 732 - DNA, 22 bp, Homo sapiens
ttgcactataggaaaatgtgtc

SEQ ID NO: 733 - DNA, 22 bp, Homo sapiens
tctaggtaggctgtgtgtggaa

SEQ ID NO: 734 - DNA, 22 bp, Homo sapiens
gtggggcctgtggcttccgtgg

SEQ ID NO: 735 - DNA, 22 bp, Homo sapiens
agcctggcctgggcaggcacat

SEQ ID NO: 736 - DNA, 22 bp, Homo sapiens
gaagtgtagtcttgagccccca

SEQ ID NO: 737 - DNA, 22 bp, Homo sapiens
caggggcggtggctcacgcctg

SEQ ID NO: 738 - DNA, 22 bp, Homo sapiens
gcaagtgaatgaggttgagatt

SEQ ID NO: 739 - DNA, 22 bp, Homo sapiens
tgctcattggcgatctgaggga

SEQ ID NO: 740 - DNA, 17 bp, Homo sapiens
gaaatcggacgatttta

SEQ ID NO: 741 - DNA, 23 bp, Homo sapiens
cctgcctccccatcagttataca

SEQ ID NO: 742 - DNA, 22 bp, Homo sapiens
aggtacatggggtgtgtgcacg

SEQ ID NO: 743 - DNA, 22 bp, Homo sapiens
accagtgttctggaatcctatg

SEQ ID NO: 744 - DNA, 22 bp, Homo sapiens
caggaaggcgcggctgtgcctg

SEQ ID NO: 745 - DNA, 22 bp, Homo sapiens
accactgcactccagtctgggc

SEQ ID NO: 746 - DNA, 19 bp, Homo sapiens
ccagagagctaggtacaga

SEQ ID NO: 747 - DNA, 22 bp, Homo sapiens
agggttcagtgaggtgtactcc

SEQ ID NO: 748 - DNA, 22 bp, Homo sapiens
gtagttctgcagtgtcacctga

SEQ ID NO: 749 - DNA, 22 bp, Homo sapiens
ggtgggagagcttgctttgatg

SEQ ID NO: 750 - DNA, 22 bp, Homo sapiens
tggaaaactttggtggtgaggg

SEQ ID NO: 751 - DNA, 22 bp, Homo sapiens
aactaatacattaatacatgtg

SEQ ID NO: 752 - DNA, 22 bp, Homo sapiens
tgagtccgaagttgcagtgagc

SEQ ID NO: 753 - DNA, 22 bp, Homo sapiens
ctggaatctttggagaatgtgg

SEQ ID NO: 754 - DNA, 22 bp, Homo sapiens
accctcttgagggaagcacttt

SEQ ID NO: 755 - DNA, 22 bp, Homo sapiens
gccaggttgctgacgacgatct

SEQ ID NO: 756 - DNA, 22 bp, Homo sapiens
aggccaggaatccttgtcccag

SEQ ID NO: 757 - DNA, 22 bp, Homo sapiens
gaggttggttccaaccctccca

SEQ ID NO: 758 - DNA, 20 bp, Homo sapiens
gacatgtctttctcacacaa

SEQ ID NO: 759 - DNA, 22 bp, Homo sapiens
gacagctgcatcctcagacaca

SEQ ID NO: 760 - DNA, 22 bp, Homo sapiens
taatgcacccagagtttgaact

SEQ ID NO: 761 - DNA, 22 bp, Homo sapiens
cctcctgcacctccaggaactc

SEQ ID NO: 762 - DNA, 22 bp, Homo sapiens
gccccaagtccctatgtttcca

SEQ ID NO: 763 - DNA, 22 bp, Homo sapiens
tccgggttttacactcacatca

SEQ ID NO: 764 - DNA, 22 bp, Homo sapiens
aaaggcttcggatcagaaggta

SEQ ID NO: 765 - DNA, 22 bp, Homo sapiens
atccccctgtatctggaagaat

SEQ ID NO: 766 - DNA, 22 bp, Homo sapiens
tgtctattaattccacataaaa

SEQ ID NO: 767 - DNA, 22 bp, Homo sapiens
gtatcacttttgagagtgagaa

SEQ ID NO: 768 - DNA, 22 bp, Homo sapiens
tattgggtaaagatccagtttt

SEQ ID NO: 769 - DNA, 21 bp, Homo sapiens
tgctccaggagggggcagtcc

SEQ ID NO: 770 - DNA, 22 bp, Homo sapiens
ccaggagtgcagggatggtatc

SEQ ID NO: 771 - DNA, 22 bp, Homo sapiens
ttgcatgttccaaagaattttg

SEQ ID NO: 772 - DNA, 22 bp, Homo sapiens
ggctgccttccctgagccccgg

SEQ ID NO: 773 - DNA, 22 bp, Homo sapiens
gtagaggggtgattctgtgaga

SEQ ID NO: 774 - DNA, 22 bp, Homo sapiens
agacagctggtagcacttcctg

SEQ ID NO: 775 - DNA, 22 bp, Homo sapiens
ccctgcctacagggttttcttt

SEQ ID NO: 776 - DNA, 22 bp, Homo sapiens
ggcaatatggtgaaaccccatc

SEQ ID NO: 777 - DNA, 22 bp, Homo sapiens
gaggctgaggttgcagtgagcc

SEQ ID NO: 778 - DNA, 19 bp, Homo sapiens
aggtggctgaaactacaga

SEQ ID NO: 779 - DNA, 22 bp, Homo sapiens
gaaggaccctctggggtctcag

SEQ ID NO: 780 - DNA, 22 bp, Homo sapiens
gagcatcgctgagatcccagac

SEQ ID NO: 781 - DNA, 22 bp, Homo sapiens
gatgtggctgctctaaagccca

SEQ ID NO: 782 - DNA, 22 bp, Homo sapiens
aaggcggggggatcacgaggtc

SEQ ID NO: 783 - DNA, 22 bp, Homo sapiens
ttctatttttgtggaactgtag

SEQ ID NO: 784 - DNA, 22 bp, Homo sapiens
gctcgtacaccagcgtggaggt

SEQ ID NO: 785 - DNA, 22 bp, Homo sapiens
ggctgacttttatgcacactaa

SEQ ID NO: 786 - DNA, 22 bp, Homo sapiens
aggaaagcttggcaaactaaat

SEQ ID NO: 787 - DNA, 21 bp, Homo sapiens
caatggcgagatcttggctca

SEQ ID NO: 788 - DNA, 22 bp, Homo sapiens
taggcactgtgtttgtaggagt

SEQ ID NO: 789 - DNA, 23 bp, Homo sapiens
tctctgcatgtcctgagcacatc

SEQ ID NO: 790 - DNA, 21 bp, Homo sapiens
accactgcctccaaggttcag

SEQ ID NO: 791 - DNA, 22 bp, Homo sapiens
agtccaggactgtttcagctga

SEQ ID NO: 792 - DNA, 22 bp, Homo sapiens
acagattagctggggccattga

SEQ ID NO: 793 - DNA, 22 bp, Homo sapiens
ctgaggggtcgtgggagcccag

SEQ ID NO: 794 - DNA, 22 bp, Homo sapiens
gtggcttggaccagtcacagtg

SEQ ID NO: 795 - DNA, 22 bp, Homo sapiens
ggaaagtcttgtgtagatgtct

SEQ ID NO: 796 - DNA, 22 bp, Homo sapiens
aagatccttcatatgggttttg

SEQ ID NO: 797 - DNA, 22 bp, Homo sapiens
cccagggagagcgcggaggcgg

SEQ ID NO: 798 - DNA, 22 bp, Homo sapiens
tctgaatcgttcccatgcagga

SEQ ID NO: 799 - DNA, 22 bp, Homo sapiens
tgagatggagccactgcactct

SEQ ID NO: 800 - DNA, 22 bp, Homo sapiens
attaagtgactaaagtaatgct

SEQ ID NO: 801 - DNA, 19 bp, Homo sapiens
ttttggaaatgtgaacagc

SEQ ID NO: 802 - DNA, 22 bp, Homo sapiens
tgaggatgtctgtattttgcct

SEQ ID NO: 803 - DNA, 22 bp, Homo sapiens
agtggccagcagcctagcctag

SEQ ID NO: 804 - DNA, 22 bp, Homo sapiens
gtgagccgagtatagttcatag

SEQ ID NO: 805 - DNA, 22 bp, Homo sapiens
taggccacagagaggagatttc

SEQ ID NO: 806 - DNA, 22 bp, Homo sapiens
ttgctgccttggagaagctcct

SEQ ID NO: 807 - DNA, 22 bp, Homo sapiens
atctcagttcaggctccactgt

SEQ ID NO: 808 - DNA, 22 bp, Homo sapiens
aattatggtcactgttcctggg

SEQ ID NO: 809 - DNA, 22 bp, Homo sapiens
atgttattgatgcctgaggctt

SEQ ID NO: 810 - DNA, 22 bp, Homo sapiens
ttgcttgggctggagtgcaatg

SEQ ID NO: 811 - DNA, 22 bp, Homo sapiens
cactgcacttcagcctgggcaa

SEQ ID NO: 812 - DNA, 22 bp, Homo sapiens
attgtgtcctcattgaccttca

SEQ ID NO: 813 - DNA, 22 bp, Homo sapiens
gttgaaatcctaaccccctagt

SEQ ID NO: 814 - DNA, 22 bp, Homo sapiens
atcacagggtgaggattagacc

SEQ ID NO: 815 - DNA, 22 bp, Homo sapiens
gggaagtgatggagccaggatt

SEQ ID NO: 816 - DNA, 22 bp, Homo sapiens
ttgcccactggctgttggtcag

SEQ ID NO: 817 - DNA, 22 bp, Homo sapiens
tttgctgcctctcccagctccc

SEQ ID NO: 818 - DNA, 22 bp, Homo sapiens
tttggaaattttcatccagaca

SEQ ID NO: 819 - DNA, 22 bp, Homo sapiens
tctctggactcgagcttactca

SEQ ID NO: 820 - DNA, 20 bp, Homo sapiens
tatgtgattttctcatcaat

SEQ ID NO: 821 - DNA, 22 bp, Homo sapiens
ccagaggagttgaggctttggg

SEQ ID NO: 822 - DNA, 22 bp, Homo sapiens
gcaccacatcaatgaggggagc

SEQ ID NO: 823 - DNA, 22 bp, Homo sapiens
gttgctcaggcaggagtacagt

SEQ ID NO: 824 - DNA, 22 bp, Homo sapiens
caatgcattattctcccacttc

SEQ ID NO: 825 - DNA, 22 bp, Homo sapiens
ctgcagggagaggggacagcct

SEQ ID NO: 826 - DNA, 22 bp, Homo sapiens
aaggatgattggtaatgacact

SEQ ID NO: 827 - DNA, 22 bp, Homo sapiens
ggggaaggaaagttattagcag

SEQ ID NO: 828 - DNA, 17 bp, Homo sapiens
cactagtagtctctggc

SEQ ID NO: 829 - DNA, 22 bp, Homo sapiens
ctatggtctggaccgaggtcct

SEQ ID NO: 830 - DNA, 19 bp, Homo sapiens
aggcttcaggccacatgct

SEQ ID NO: 831 - DNA, 22 bp, Homo sapiens
gctagtgcagggaaatctttgg

SEQ ID NO: 832 - DNA, 22 bp, Homo sapiens
cgctgctccgccttgtccatat

SEQ ID NO: 833 - DNA, 22 bp, Homo sapiens
agacaaagaaaccgtagaagca

SEQ ID NO: 834 - DNA, 22 bp, Homo sapiens
ggctctgcgcctgcggggactt

SEQ ID NO: 835 - DNA, 22 bp, Homo sapiens
caggttggagatctgtctatgg

SEQ ID NO: 836 - DNA, 22 bp, Homo sapiens
agcgcttgccgcactccaagca

SEQ ID NO: 837 - DNA, 22 bp, Homo sapiens
tgccctggctcttcttgttcca

SEQ ID NO: 838 - DNA, 22 bp, Homo sapiens
ccagctttatagcttcaaagga

SEQ ID NO: 839 - DNA, 22 bp, Homo sapiens
gtttcgtcaggcttattctatc

SEQ ID NO: 840 - DNA, 22 bp, Homo sapiens
tacagcctggcactaccctggg

SEQ ID NO: 841 - DNA, 22 bp, Homo sapiens
ccacagaattctgtctccagga

SEQ ID NO: 842 - DNA, 22 bp, Homo sapiens
ttttttgttgggtagaacggaa

SEQ ID NO: 843 - DNA, 22 bp, Homo sapiens
ctaccacacacacgtcttagga

SEQ ID NO: 844 - DNA, 22 bp, Homo sapiens
gcacagccacgtaatgtggtca

SEQ ID NO: 845 - DNA, 22 bp, Homo sapiens
atccctgtctcaaagccagcaa

SEQ ID NO: 846 - DNA, 20 bp, Homo sapiens
tatttctgggcaaccattta

SEQ ID NO: 847 - DNA, 22 bp, Homo sapiens
cctgcacatgtgtgcgcctgta

SEQ ID NO: 848 - DNA, 22 bp, Homo sapiens
gcccaggaggcagaggttgtgg

SEQ ID NO: 849 - DNA, 22 bp, Homo sapiens
tggacaacatagtgagacctca

SEQ ID NO: 850 - DNA, 22 bp, Homo sapiens
aaccccgctcaggctgggtgag

SEQ ID NO: 851 - DNA, 23 bp, Homo sapiens
tcatttggacaaggcacagcaga

SEQ ID NO: 852 - DNA, 22 bp, Homo sapiens
aatatttcttctaaagcccttt

SEQ ID NO: 853 - DNA, 22 bp, Homo sapiens
gaccttcttgctgtgtcctaac

SEQ ID NO: 854 - DNA, 22 bp, Homo sapiens
gaactctctcatctgtcagttg

SEQ ID NO: 855 - DNA, 22 bp, Homo sapiens
gttgaggtgatgccagccctgc

SEQ ID NO: 856 - DNA, 22 bp, Homo sapiens
tcatggggccacagctgccagc

SEQ ID NO: 857 - DNA, 22 bp, Homo sapiens
tgggggacaccagtctctctct

SEQ ID NO: 858 - DNA, 22 bp, Homo sapiens
tgatcaggtctgaacagggagg

SEQ ID NO: 859 - DNA, 20 bp, Homo sapiens
tgacgggaagctgaaggcac

SEQ ID NO: 860 - DNA, 20 bp, Homo sapiens
tggtccccatccttgcgatt

SEQ ID NO: 861 - DNA, 22 bp, Homo sapiens
aagtgctgggattacaggggtg

SEQ ID NO: 862 - DNA, 22 bp, Homo sapiens
agttctgacctaacctttctca

SEQ ID NO: 863 - DNA, 22 bp, Homo sapiens
cttgtccgaggagacgcggaag

SEQ ID NO: 864 - DNA, 22 bp, Homo sapiens
tcctgggaggcggaggttgcag

SEQ ID NO: 865 - DNA, 22 bp, Homo sapiens
ggctcacgcaattatcccggcc

SEQ ID NO: 866 - DNA, 22 bp, Homo sapiens
acgttttctagagaatatgcag

SEQ ID NO: 867 - DNA, 22 bp, Homo sapiens
gaaagtgctctctctatacaca

SEQ ID NO: 868 - DNA, 22 bp, Homo sapiens
ttggagttctgggcacagctgc

SEQ ID NO: 869 - DNA, 22 bp, Homo sapiens
tttgaagccatgtcaatagttt

SEQ ID NO: 870 - DNA, 22 bp, Homo sapiens
cagcagcattgctctggattcc

SEQ ID NO: 871 - DNA, 22 bp, Homo sapiens
cccaggctggagtgtaatggtg

SEQ ID NO: 872 - DNA, 22 bp, Homo sapiens
aggtgcccatgagctccatggc

SEQ ID NO: 873 - DNA, 22 bp, Homo sapiens
cagggtttcaccatgttagcag

SEQ ID NO: 874 - DNA, 22 bp, Homo sapiens
tccgggagctgaacgtcttgcg

SEQ ID NO: 875 - DNA, 17 bp, Homo sapiens
gacctttctctagcatt

SEQ ID NO: 876 - DNA, 22 bp, Homo sapiens
ttcagcagtgcagacacccagt

SEQ ID NO: 877 - DNA, 22 bp, Homo sapiens
agatggagtctcactcttgttg

SEQ ID NO: 878 - DNA, 22 bp, Homo sapiens
aagtgccccaggctgttaacat

SEQ ID NO: 879 - DNA, 19 bp, Homo sapiens
agtgccgggtggcgctcag

SEQ ID NO: 880 - DNA, 19 bp, Homo sapiens
agccccttggtactgtcct

SEQ ID NO: 881 - DNA, 22 bp, Homo sapiens
ggcataggcactttaatttgga

SEQ ID NO: 882 - DNA, 20 bp, Homo sapiens
ttggatgtgcatggccgtgc

SEQ ID NO: 883 - DNA, 22 bp, Homo sapiens
tttgagatctcaatgaggacta

SEQ ID NO: 884 - DNA, 21 bp, Homo sapiens
ctctgtttgcctgctgccatc

SEQ ID NO: 885 - DNA, 22 bp, Homo sapiens
gtgggggctggaaatcttgcca

SEQ ID NO: 886 - DNA, 22 bp, Homo sapiens
gtttgtgcgggacatgatccgg

SEQ ID NO: 887 - DNA, 22 bp, Homo sapiens
tgtgtcattgccatgaaaaggc

SEQ ID NO: 888 - DNA, 22 bp, Homo sapiens
gtctcccagcctacatctttct

SEQ ID NO: 889 - DNA, 22 bp, Homo sapiens
ttacatgtttatgtggtacatg

SEQ ID NO: 890 - DNA, 22 bp, Homo sapiens
atacaaagtattaatcctggat

SEQ ID NO: 891 - DNA, 22 bp, Homo sapiens
catggggcccatgtgctccaag

SEQ ID NO: 892 - DNA, 22 bp, Homo sapiens
gcacacggcagcctcctcctga

SEQ ID NO: 893 - DNA, 22 bp, Homo sapiens
ctcctgcttcacgggcaccgcc

SEQ ID NO: 894 - DNA, 22 bp, Homo sapiens
tgagatgagatttcactgtcct

SEQ ID NO: 895 - DNA, 22 bp, Homo sapiens
ccctttagcccctgcagagact

SEQ ID NO: 896 - DNA, 22 bp, Homo sapiens
tattgagaccagtgcttgctta

SEQ ID NO: 897 - DNA, 22 bp, Homo sapiens
tggggcacagtctgaatgtttc

SEQ ID NO: 898 - DNA, 22 bp, Homo sapiens
tcgcccaggctggaagtgcagt

SEQ ID NO: 899 - DNA, 22 bp, Homo sapiens
agaccaccaaaactttctccat

SEQ ID NO: 900 - DNA, 18 bp, Homo sapiens
acgtgctgtgccttttgc

SEQ ID NO: 901 - DNA, 22 bp, Homo sapiens
aatgctctttaacctattctga

SEQ ID NO: 902 - DNA, 22 bp, Homo sapiens
gaacactgctgttgggttctga

SEQ ID NO: 903 - DNA, 21 bp, Homo sapiens
gttgtggttggggctgcagct

SEQ ID NO: 904 - DNA, 22 bp, Homo sapiens
ctgctgagagccccagctgaga

SEQ ID NO: 905 - DNA, 22 bp, Homo sapiens
gacactctttcctcttctggaa

SEQ ID NO: 906 - DNA, 22 bp, Homo sapiens
tgacaggcaggacagaggtgtg

SEQ ID NO: 907 - DNA, 21 bp, Homo sapiens
gctgttcggcggccctcgcgc

SEQ ID NO: 908 - DNA, 22 bp, Homo sapiens
gctctgccagcccaaggcgcag

SEQ ID NO: 909 - DNA, 22 bp, Homo sapiens
atgatccaaagccacaggggca

SEQ ID NO: 910 - DNA, 22 bp, Homo sapiens
cctcggtttccacatctgtaca

SEQ ID NO: 911 - DNA, 22 bp, Homo sapiens
ctgtccatggtccttattacca

SEQ ID NO: 912 - DNA, 22 bp, Homo sapiens
acttttgtggagtctgcggagc

SEQ ID NO: 913 - DNA, 22 bp, Homo sapiens
ggaggcggaggttgcagtgagc

SEQ ID NO: 914 - DNA, 17 bp, Homo sapiens
ccctcactcctgccggg

SEQ ID NO: 915 - DNA, 22 bp, Homo sapiens
agaggggcccggttctccgtct

SEQ ID NO: 916 - DNA, 22 bp, Homo sapiens
gcccctgcctttgaacctggag

SEQ ID NO: 917 - DNA, 22 bp, Homo sapiens
tgatggctgtagggtccggggc

SEQ ID NO: 918 - DNA, 20 bp, Homo sapiens
ttctccagtgcggtagccat

SEQ ID NO: 919 - DNA, 22 bp, Homo sapiens
ttcacctgtgacaggtagagtt

SEQ ID NO: 920 - DNA, 22 bp, Homo sapiens
gctcctttattttctctcgtgt

SEQ ID NO: 921 - DNA, 22 bp, Homo sapiens
aggtgtcccggcctgcggggct

SEQ ID NO: 922 - DNA, 22 bp, Homo sapiens
gttatgatggcaccactgcact

SEQ ID NO: 923 - DNA, 22 bp, Homo sapiens
aacttgtgggctcaagcaattt

SEQ ID NO: 924 - DNA, 22 bp, Homo sapiens
atatcactagagaagttgttaa

SEQ ID NO: 925 - DNA, 22 bp, Homo sapiens
ccatgtacatgaacacggcggc

SEQ ID NO: 926 - DNA, 22 bp, Homo sapiens
cacagagatggtctggcaggtg

SEQ ID NO: 927 - DNA, 22 bp, Homo sapiens
ccagaagtcaagtaagatgaag

SEQ ID NO: 928 - DNA, 22 bp, Homo sapiens
cattctcagtatcagccagccc

SEQ ID NO: 929 - DNA, 19 bp, Homo sapiens
tcttgggtcgagacataga

SEQ ID NO: 930 - DNA, 22 bp, Homo sapiens
tccagtttccaatcactgcacg

SEQ ID NO: 931 - DNA, 22 bp, Homo sapiens
tagcagaagttgcaaactaggg

SEQ ID NO: 932 - DNA, 22 bp, Homo sapiens
tctagttctagatccctgagga

SEQ ID NO: 933 - DNA, 22 bp, Homo sapiens
gttgggaatttattccttttct

SEQ ID NO: 934 - DNA, 22 bp, Homo sapiens
ttccggacgcccgtcttccagc

SEQ ID NO: 935 - DNA, 22 bp, Homo sapiens
ccaagcagagcagcctctctgg

SEQ ID NO: 936 - DNA, 22 bp, Homo sapiens
ctaggctggagtgcagtggcac

SEQ ID NO: 937 - DNA, 22 bp, Homo sapiens
atggcctgcagtgctgccacag

SEQ ID NO: 938 - DNA, 22 bp, Homo sapiens
ttacatccaggaaggtgggagc

SEQ ID NO: 939 - DNA, 22 bp, Homo sapiens
ttcctgcgcccttctcgcccgc

SEQ ID NO: 940 - DNA, 22 bp, Homo sapiens
gggccctgggattcagagcaag

SEQ ID NO: 941 - DNA, 22 bp, Homo sapiens
ctgtgctgggtccttcttttga

SEQ ID NO: 942 - DNA, 22 bp, Homo sapiens
acgggctgggacggggaagctc

SEQ ID NO: 943 - DNA, 22 bp, Homo sapiens
tcgctgcatgaagccaggccag

SEQ ID NO: 944 - DNA, 22 bp, Homo sapiens
agctcaccacaacctccgcctc

SEQ ID NO: 945 - DNA, 22 bp, Homo sapiens
agtcttcccagaggaggtgcca

SEQ ID NO: 946 - DNA, 22 bp, Homo sapiens
gggctaaatgcagaaatgcaga

SEQ ID NO: 947 - DNA, 22 bp, Homo sapiens
tggttggatggctcttgtggct

SEQ ID NO: 948 - DNA, 22 bp, Homo sapiens
acagtcaaatgtctatcttctt

SEQ ID NO: 949 - DNA, 22 bp, Homo sapiens
cttcatgtcggcggctctcggg

SEQ ID NO: 950 - DNA, 22 bp, Homo sapiens
gaggcggaggttgcagtgagcc

SEQ ID NO: 951 - DNA, 22 bp, Homo sapiens
aggcttttctccagaatgtact

SEQ ID NO: 952 - DNA, 19 bp, Homo sapiens
gggaatgatggaagacttc

SEQ ID NO: 953 - DNA, 22 bp, Homo sapiens
gccctcctgagctagcacgtgt

SEQ ID NO: 954 - DNA, 22 bp, Homo sapiens
tgtacttgaacttgactgtaga

SEQ ID NO: 955 - DNA, 22 bp, Homo sapiens
acttgccccagaattgctgctg

SEQ ID NO: 956 - DNA, 20 bp, Homo sapiens
gataatatttactaggtact

SEQ ID NO: 957 - DNA, 22 bp, Homo sapiens
cctgacaggcggaggctgcagt

SEQ ID NO: 958 - DNA, 22 bp, Homo sapiens
ggtgactggtttatctggcagt

SEQ ID NO: 959 - DNA, 22 bp, Homo sapiens
atacacgtgccatgttggtgtg

SEQ ID NO: 960 - DNA, 22 bp, Homo sapiens
cattgcacaccagcctgggcaa

SEQ ID NO: 961 - DNA, 22 bp, Homo sapiens
tcctgggccctccggatcaggt

SEQ ID NO: 962 - DNA, 22 bp, Homo sapiens
ccggggacagcaggtccgactt

SEQ ID NO: 963 - DNA, 22 bp, Homo sapiens
cacgaatggaagggtcttggct

SEQ ID NO: 964 - DNA, 21 bp, Homo sapiens
acataggcgaatgttcgggag

SEQ ID NO: 965 - DNA, 22 bp, Homo sapiens
tcaccagatctctctgtaatgg

SEQ ID NO: 966 - DNA, 22 bp, Homo sapiens
tagccgggtgttgtgtcatgca

SEQ ID NO: 967 - DNA, 22 bp, Homo sapiens
gcggtagctcaagcttgtaatc

SEQ ID NO: 968 - DNA, 22 bp, Homo sapiens
cttggtgccacagcagcttgcg

SEQ ID NO: 969 - DNA, 22 bp, Homo sapiens
ctcgcatccaggataccctgag

SEQ ID NO: 970 - DNA, 22 bp, Homo sapiens
agagcacggccaccatttacaa

SEQ ID NO: 971 - DNA, 22 bp, Homo sapiens
ggccaattccaggagccggcgg

SEQ ID NO: 972 - DNA, 22 bp, Homo sapiens
ttctcctacttaaggccttcca

SEQ ID NO: 973 - DNA, 22 bp, Homo sapiens
ttggcctggcgcggtggctcac

SEQ ID NO: 974 - DNA, 22 bp, Homo sapiens
aacttaggaaaataaggcatga

SEQ ID NO: 975 - DNA, 22 bp, Homo sapiens
tgatttatgcattatactgttg

SEQ ID NO: 976 - DNA, 19 bp, Homo sapiens
ggcgaagcgcttggagtag

SEQ ID NO: 977 - DNA, 22 bp, Homo sapiens
tcttcctggatgggggttgatg

SEQ ID NO: 978 - DNA, 22 bp, Homo sapiens
gcgggttgaagggcgcatcgaa

SEQ ID NO: 979 - DNA, 22 bp, Homo sapiens
agaaggcatagaccggattatg

SEQ ID NO: 980 - DNA, 22 bp, Homo sapiens
ttgaagaaccatctgtgccact

SEQ ID NO: 981 - DNA, 22 bp, Homo sapiens
aacccaggagatggaggttgtg

SEQ ID NO: 982 - DNA, 22 bp, Homo sapiens
gcctccagggatgattccttcc

SEQ ID NO: 983 - DNA, 22 bp, Homo sapiens
atcccgaacctctacttctttc

SEQ ID NO: 984 - DNA, 20 bp, Homo sapiens
aaattactgccacacatttc

SEQ ID NO: 985 - DNA, 22 bp, Homo sapiens
tttaatgtagcgtgaaatgatt

SEQ ID NO: 986 - DNA, 22 bp, Homo sapiens
tgaagctttaggatgggttcat

SEQ ID NO: 987 - DNA, 22 bp, Homo sapiens
tcgtggatgcgcagggcggcct

SEQ ID NO: 988 - DNA, 22 bp, Homo sapiens
caaatctctgctactagctatg

SEQ ID NO: 989 - DNA, 22 bp, Homo sapiens
ttgcaattgctatggagagcgt

SEQ ID NO: 990 - DNA, 22 bp, Homo sapiens
gtccctgagcctggcatttccc

SEQ ID NO: 991 - DNA, 22 bp, Homo sapiens
ttcagcactgactgagtggtta

SEQ ID NO: 992 - DNA, 21 bp, Homo sapiens
agtttcaggaagttcagctgc

SEQ ID NO: 993 - DNA, 22 bp, Homo sapiens
acactgaaagaagccagcttgt

SEQ ID NO: 994 - DNA, 22 bp, Homo sapiens
tgggagaaagaaccctgagtga

SEQ ID NO: 995 - DNA, 22 bp, Homo sapiens
actggccagccaacaacaatag

SEQ ID NO: 996 - DNA, 22 bp, Homo sapiens
atggcatttgaatctgtctttt

SEQ ID NO: 997 - DNA, 22 bp, Homo sapiens
ccaagtgttttataagggacag

SEQ ID NO: 998 - DNA, 22 bp, Homo sapiens
tgctccatctagagctctgcag

SEQ ID NO: 999 - DNA, 22 bp, Homo sapiens
gttgtgaatagtgccgcaataa

SEQ ID NO: 1000 - DNA, 22 bp, Homo sapiens
gcccagtagttcaaggttgcag

SEQ ID NO: 1001 - DNA, 22 bp, Homo sapiens
ggggtgaaggttttctgaaagc

SEQ ID NO: 1002 - DNA, 22 bp, Homo sapiens
gtctgctttgtctttcatgata

SEQ ID NO: 1003 - DNA, 22 bp, Homo sapiens
atccctgtgacgagcatcccta

SEQ ID NO: 1004 - DNA, 22 bp, Homo sapiens
tttacgaatggggtgacaactt

SEQ ID NO: 1005 - DNA, 22 bp, Homo sapiens
gcaacaatggaggtttggaggg

SEQ ID NO: 1006 - DNA, 22 bp, Homo sapiens
aactagaaaaagactttctgag

SEQ ID NO: 1007 - DNA, 22 bp, Homo sapiens
aagctcctttggctcgagatct

SEQ ID NO: 1008 - DNA, 22 bp, Homo sapiens
atgttgactcagagtgagggta

SEQ ID NO: 1009 - DNA, 22 bp, Homo sapiens
cagaaaccaaatgggatgggga

SEQ ID NO: 1010 - DNA, 22 bp, Homo sapiens
gccagggtcctgaagaccaagt

SEQ ID NO: 1011 - DNA, 18 bp, Homo sapiens
agctccatctgtcagcat

SEQ ID NO: 1012 - DNA, 22 bp, Homo sapiens
ctttggctggcaccccagcggg

SEQ ID NO: 1013 - DNA, 15 bp, Homo sapiens
tggtggtgttgagac

SEQ ID NO: 1014 - DNA, 22 bp, Homo sapiens
gccccagcctcccgagtagctg

SEQ ID NO: 1015 - DNA, 22 bp, Homo sapiens
gaaagagaacctgggcctagat

SEQ ID NO: 1016 - DNA, 22 bp, Homo sapiens
ggtgccctggaagctgctgcat

SEQ ID NO: 1017 - DNA, 22 bp, Homo sapiens
gaagcttgaacagggccaggct

SEQ ID NO: 1018 - DNA, 22 bp, Homo sapiens
gaagcgcggcgtcggcgtgggt

SEQ ID NO: 1019 - DNA, 22 bp, Homo sapiens
gatttgtggtgtgaggaagagc

SEQ ID NO: 1020 - DNA, 22 bp, Homo sapiens
tctgggtccgggactgtggatg

SEQ ID NO: 1021 - DNA, 22 bp, Homo sapiens
ttgattatagactcactaatct

SEQ ID NO: 1022 - DNA, 22 bp, Homo sapiens
ttgggattacaggtgtaagcca

SEQ ID NO: 1023 - DNA, 22 bp, Homo sapiens
tggcatggagtggatggcccca

SEQ ID NO: 1024 - DNA, 22 bp, Homo sapiens
atcacaaaggtctcagagcaca

SEQ ID NO: 1025 - DNA, 22 bp, Homo sapiens
ggccgcggattttcccgctggc

SEQ ID NO: 1026 - DNA, 22 bp, Homo sapiens
tcagtttttctatactttgtag

SEQ ID NO: 1027 - DNA, 22 bp, Homo sapiens
cctcagacccctgctgagcttc

SEQ ID NO: 1028 - DNA, 22 bp, Homo sapiens
tcaggctcaggttaggggccaa

SEQ ID NO: 1029 - DNA, 22 bp, Homo sapiens
cactgcactccagcccgggcaa

SEQ ID NO: 1030 - DNA, 23 bp, Homo sapiens
tgacctcatgatccgcccacctc

SEQ ID NO: 1031 - DNA, 22 bp, Homo sapiens
agtccaaagcagatgagggcca

SEQ ID NO: 1032 - DNA, 22 bp, Homo sapiens
gcaccaggtgcagccgggcccc

SEQ ID NO: 1033 - DNA, 22 bp, Homo sapiens
cggcccgctgcgagtgcaccgt

SEQ ID NO: 1034 - DNA, 19 bp, Homo sapiens
ttctctgctacattctcag

SEQ ID NO: 1035 - DNA, 21 bp, Homo sapiens
atcagggatgggttggacacc

SEQ ID NO: 1036 - DNA, 22 bp, Homo sapiens
gtcgatcacctcgtcctccgtg

SEQ ID NO: 1037 - DNA, 22 bp, Homo sapiens
ccagggtggcgtagatgctggg

SEQ ID NO: 1038 - DNA, 22 bp, Homo sapiens
ctgcaccgtgtctcgggctgcc

SEQ ID NO: 1039 - DNA, 22 bp, Homo sapiens
ggctgtgtggccgtgggctcta

SEQ ID NO: 1040 - DNA, 22 bp, Homo sapiens
accgggctaatttttgtatctt

SEQ ID NO: 1041 - DNA, 22 bp, Homo sapiens
atgacaagagtgttcagggaga

SEQ ID NO: 1042 - DNA, 22 bp, Homo sapiens
tgaggcaggaggttgagaactg

SEQ ID NO: 1043 - DNA, 22 bp, Homo sapiens
agccagggacgctgcaggctac

SEQ ID NO: 1044 - DNA, 22 bp, Homo sapiens
aagtagttaggaacattctctc

SEQ ID NO: 1045 - DNA, 22 bp, Homo sapiens
gggccaccccactgcccacgct

SEQ ID NO: 1046 - DNA, 22 bp, Homo sapiens
gggggctaccgtctctggagct

SEQ ID NO: 1047 - DNA, 22 bp, Homo sapiens
aagaacgaactttgctaattgt

SEQ ID NO: 1048 - DNA, 22 bp, Homo sapiens
tacccagtctggagtgcagtga

SEQ ID NO: 1049 - DNA, 22 bp, Homo sapiens
ctacattaaattggcttactta

SEQ ID NO: 1050 - DNA, 22 bp, Homo sapiens
agttcagaggcaggagaaggct

SEQ ID NO: 1051 - DNA, 22 bp, Homo sapiens
agtctagtaggatctctgggct

SEQ ID NO: 1052 - DNA, 22 bp, Homo sapiens
gttaggtagaagtttactttga

SEQ ID NO: 1053 - DNA, 22 bp, Homo sapiens
ctgggctagaaggaccaggatg

SEQ ID NO: 1054 - DNA, 22 bp, Homo sapiens
atgattgaaaatgacattgcca

SEQ ID NO: 1055 - DNA, 22 bp, Homo sapiens
ttgttgccggaaagatctcgac

SEQ ID NO: 1056 - DNA, 22 bp, Homo sapiens
gccctgttgtcggacgtcaagg

SEQ ID NO: 1057 - DNA, 22 bp, Homo sapiens
ggagtgcagtggcgtgagctcg

SEQ ID NO: 1058 - DNA, 22 bp, Homo sapiens
tttgtgaataggttggcttcca

SEQ ID NO: 1059 - DNA, 22 bp, Homo sapiens
aaacccagggttttgtcttccc

SEQ ID NO: 1060 - DNA, 23 bp, Homo sapiens
agctataaaatctgtgacagcag

SEQ ID NO: 1061 - DNA, 22 bp, Homo sapiens
agtggactcttcccagtgcttg

SEQ ID NO: 1062 - DNA, 22 bp, Homo sapiens
gaggaccactgcttagtaagat

SEQ ID NO: 1063 - DNA, 22 bp, Homo sapiens
gatatgttgagtagagtttttg

SEQ ID NO: 1064 - DNA, 22 bp, Homo sapiens
tagaataatctgaggaaatgct

SEQ ID NO: 1065 - DNA, 22 bp, Homo sapiens
gtgagatggagttggtgtcttt

SEQ ID NO: 1066 - DNA, 18 bp, Homo sapiens
tggtcactgtggatagtg

SEQ ID NO: 1067 - DNA, 22 bp, Homo sapiens
ggtcattatagtggggaggtgg

SEQ ID NO: 1068 - DNA, 22 bp, Homo sapiens
atttactcgtgcttcattgaat

SEQ ID NO: 1069 - DNA, 23 bp, Homo sapiens
caccccaccctgaggaggaggga

SEQ ID NO: 1070 - DNA, 18 bp, Homo sapiens
gctctgcaggtgctcggt

SEQ ID NO: 1071 - DNA, 22 bp, Homo sapiens
ttccaaagaagttcacatttac

SEQ ID NO: 1072 - DNA, 22 bp, Homo sapiens
aaacactcatgtgttactctcc

SEQ ID NO: 1073 - DNA, 22 bp, Homo sapiens
caagtggtttatgggagttcca

SEQ ID NO: 1074 - DNA, 22 bp, Homo sapiens
gcaccaccaccatcggcacctc

SEQ ID NO: 1075 - DNA, 22 bp, Homo sapiens
caagtagaacagagctaccttg

SEQ ID NO: 1076 - DNA, 22 bp, Homo sapiens
actccacatttgaacacagttc

SEQ ID NO: 1077 - DNA, 22 bp, Homo sapiens
ttctcaagaacatatgtagggt

SEQ ID NO: 1078 - DNA, 22 bp, Homo sapiens
cacctcaggcagcaaagtctca

SEQ ID NO: 1079 - DNA, 22 bp, Homo sapiens
cttgtttatctctgtagccctg

SEQ ID NO: 1080 - DNA, 22 bp, Homo sapiens
gtgggttcgtggtctcgctggc

SEQ ID NO: 1081 - DNA, 22 bp, Homo sapiens
gggaaactttcacaatgtccag

SEQ ID NO: 1082 - DNA, 22 bp, Homo sapiens
ggtgccacagctacatcctaga

SEQ ID NO: 1083 - DNA, 22 bp, Homo sapiens
ttattccccatcttcctctggt

SEQ ID NO: 1084 - DNA, 22 bp, Homo sapiens
aaagactcactttcagctctgg

SEQ ID NO: 1085 - DNA, 22 bp, Homo sapiens
ttctttgcccatgtttcctaag

SEQ ID NO: 1086 - DNA, 22 bp, Homo sapiens
ggttgctgggggtggcagagct

SEQ ID NO: 1087 - DNA, 22 bp, Homo sapiens
atcggcaagccccacaccgtcc

SEQ ID NO: 1088 - DNA, 22 bp, Homo sapiens
gtggatggagctggaagccatt

SEQ ID NO: 1089 - DNA, 21 bp, Homo sapiens
agcctcaggttgttggttctt

SEQ ID NO: 1090 - DNA, 23 bp, Homo sapiens
aatggtcttcctccacccctctg

SEQ ID NO: 1091 - DNA, 20 bp, Homo sapiens
cggtgcagacagcccctcgt

SEQ ID NO: 1092 - DNA, 22 bp, Homo sapiens
gagtgtatggaaggaagagatt

SEQ ID NO: 1093 - DNA, 22 bp, Homo sapiens
tcactgcaagctctgccttccg

SEQ ID NO: 1094 - DNA, 22 bp, Homo sapiens
tgaagaaacgcagagaggtagg

SEQ ID NO: 1095 - DNA, 22 bp, Homo sapiens
gtcacccgtttgactatccacc

SEQ ID NO: 1096 - DNA, 19 bp, Homo sapiens
atcttcattttacaggcag

SEQ ID NO: 1097 - DNA, 22 bp, Homo sapiens
gcagcgaggtgatgaaatagct

SEQ ID NO: 1098 - DNA, 23 bp, Homo sapiens
tgcatgtgattcatagagtccag

SEQ ID NO: 1099 - DNA, 22 bp, Homo sapiens
cagggccctgctcaatttctcc

SEQ ID NO: 1100 - DNA, 22 bp, Homo sapiens
tgaagcaaattgtttagcctga

SEQ ID NO: 1101 - DNA, 22 bp, Homo sapiens
aaggtgggcagatcacaaggtc

SEQ ID NO: 1102 - DNA, 22 bp, Homo sapiens
ccgggctggagtgcaatggctc

SEQ ID NO: 1103 - DNA, 22 bp, Homo sapiens
gggataagagagtatttatgca

SEQ ID NO: 1104 - DNA, 22 bp, Homo sapiens
aaggggtgagcagaggcttcgc

SEQ ID NO: 1105 - DNA, 22 bp, Homo sapiens
ctgactgggttaagttcatgta

SEQ ID NO: 1106 - DNA, 22 bp, Homo sapiens
agtggctgagtgactgtgactc

SEQ ID NO: 1107 - DNA, 22 bp, Homo sapiens
aagcatgaatcgactcggcaac

SEQ ID NO: 1108 - DNA, 22 bp, Homo sapiens
gagcctggagctggaacgaagc

SEQ ID NO: 1109 - DNA, 22 bp, Homo sapiens
tggtatttctgtgcccagctca

SEQ ID NO: 1110 - DNA, 22 bp, Homo sapiens
tacaccattcccaggtggattt

SEQ ID NO: 1111 - DNA, 22 bp, Homo sapiens
tgccatctcctggtcaactggt

SEQ ID NO: 1112 - DNA, 22 bp, Homo sapiens
gctaggagtggtgggtcaagga

SEQ ID NO: 1113 - DNA, 22 bp, Homo sapiens
ttcatcttgatggcttcctaat

SEQ ID NO: 1114 - DNA, 22 bp, Homo sapiens
gtagagcagggagcaggaagct

SEQ ID NO: 1115 - DNA, 22 bp, Homo sapiens
tggaagaatatgggggtacaga

SEQ ID NO: 1116 - DNA, 22 bp, Homo sapiens
ttttgcaacacaggctacttca

SEQ ID NO: 1117 - DNA, 22 bp, Homo sapiens
gcctgtgacccagggcccagga

SEQ ID NO: 1118 - DNA, 22 bp, Homo sapiens
ccactgcactccagcctgccaa

SEQ ID NO: 1119 - DNA, 22 bp, Homo sapiens
gctgctaagcgtttctgttcca

SEQ ID NO: 1120 - DNA, 22 bp, Homo sapiens
tgagtcatgggcttgaggttac

SEQ ID NO: 1121 - DNA, 22 bp, Homo sapiens
aggaatgacagatgtccgcacc

SEQ ID NO: 1122 - DNA, 22 bp, Homo sapiens
agaggcagtatacaatccgagc

SEQ ID NO: 1123 - DNA, 22 bp, Homo sapiens
atatttagataaaaatgggctt

SEQ ID NO: 1124 - DNA, 18 bp, Homo sapiens
gcagtgaagaaagagctt

SEQ ID NO: 1125 - DNA, 22 bp, Homo sapiens
cactgcactgcagcctggagac

SEQ ID NO: 1126 - DNA, 20 bp, Homo sapiens
atggggtgagtgacgccctc

SEQ ID NO: 1127 - DNA, 22 bp, Homo sapiens
tgtcctgtgattccagctcttc

SEQ ID NO: 1128 - DNA, 22 bp, Homo sapiens
tatattgagatttgagcattgt

SEQ ID NO: 1129 - DNA, 22 bp, Homo sapiens
caggcgggcaggtgcggcccct

SEQ ID NO: 1130 - DNA, 22 bp, Homo sapiens
tcttcattttacaggcagacct

SEQ ID NO: 1131 - DNA, 22 bp, Homo sapiens
tccaaggagcagtcttcaacct

SEQ ID NO: 1132 - DNA, 22 bp, Homo sapiens
atctttgattgaagggaccctg

SEQ ID NO: 1133 - DNA, 23 bp, Homo sapiens
cagggccctgctcaatttctcca

SEQ ID NO: 1134 - DNA, 22 bp, Homo sapiens
gcaagatgttaccattagggaa

SEQ ID NO: 1135 - DNA, 22 bp, Homo sapiens
ggacttgagccgctcggagttc

SEQ ID NO: 1136 - DNA, 22 bp, Homo sapiens
ctgtatctgtgttggatgagtt

SEQ ID NO: 1137 - DNA, 22 bp, Homo sapiens
ttcagtttcaagtccctctggg

SEQ ID NO: 1138 - DNA, 22 bp, Homo sapiens
agataaagtccaaactgtgtag

SEQ ID NO: 1139 - DNA, 22 bp, Homo sapiens
cccaggaggcagaagttgcagt

SEQ ID NO: 1140 - DNA, 22 bp, Homo sapiens
catggcggtcaggatgtaggtg

SEQ ID NO: 1141 - DNA, 22 bp, Homo sapiens
atgccactgcacttcagcttgg

SEQ ID NO: 1142 - DNA, 22 bp, Homo sapiens
tttacaacccaagtccagagag

SEQ ID NO: 1143 - DNA, 22 bp, Homo sapiens
acatcctcccgatctactggct

SEQ ID NO: 1144 - DNA, 22 bp, Homo sapiens
ctggaaggcagaggttgcagtg

SEQ ID NO: 1145 - DNA, 22 bp, Homo sapiens
aaggaggttatcccagtggact

SEQ ID NO: 1146 - DNA, 22 bp, Homo sapiens
ccagcttgctcctctgcaatgg

SEQ ID NO: 1147 - DNA, 22 bp, Homo sapiens
gtctccggccgccctggtgctg

SEQ ID NO: 1148 - DNA, 19 bp, Homo sapiens
agcggttctcaaagtcagg

SEQ ID NO: 1149 - DNA, 22 bp, Homo sapiens
actgtccgggacaggcccatcc

SEQ ID NO: 1150 - DNA, 22 bp, Homo sapiens
tgacaatgaggccctccacaaa

SEQ ID NO: 1151 - DNA, 22 bp, Homo sapiens
cttgtgcttttatgaatgcaga

SEQ ID NO: 1152 - DNA, 22 bp, Homo sapiens
ttaagtgcaaaaatgaaagtat

SEQ ID NO: 1153 - DNA, 22 bp, Homo sapiens
cagggccagggacacgctgtca

SEQ ID NO: 1154 - DNA, 22 bp, Homo sapiens
gcgctgaggctggaggcgcacg

SEQ ID NO: 1155 - DNA, 22 bp, Homo sapiens
aaagagccgctgatgtcagccc

SEQ ID NO: 1156 - DNA, 22 bp, Homo sapiens
gtgcgcttcttcctgagccagg

SEQ ID NO: 1157 - DNA, 22 bp, Homo sapiens
aagtgctgagactacaggcatg

SEQ ID NO: 1158 - DNA, 22 bp, Homo sapiens
agtagtcctactgaaggaatga

SEQ ID NO: 1159 - DNA, 22 bp, Homo sapiens
gtggctgcagcggctgtggaga

SEQ ID NO: 1160 - DNA, 22 bp, Homo sapiens
ggaattgtctagtactcacggc

SEQ ID NO: 1161 - DNA, 22 bp, Homo sapiens
ggtcacacaccaggacctgcag

SEQ ID NO: 1162 - DNA, 22 bp, Homo sapiens
actcctacatattagcattaac

SEQ ID NO: 1163 - DNA, 22 bp, Homo sapiens
aatccttatttgtctagttcca

SEQ ID NO: 1164 - DNA, 23 bp, Homo sapiens
tgctggagaagcaaagttctgag

SEQ ID NO: 1165 - DNA, 22 bp, Homo sapiens
gtcgttctctgccagggcgttg

SEQ ID NO: 1166 - DNA, 22 bp, Homo sapiens
accctctagagggaagcacttt

SEQ ID NO: 1167 - DNA, 20 bp, Homo sapiens
tgacctcctgggctcaagcc

SEQ ID NO: 1168 - DNA, 20 bp, Homo sapiens
gttaggaggttggacatgga

SEQ ID NO: 1169 - DNA, 22 bp, Homo sapiens
tgtgcccaacgtgcaggtttgt

SEQ ID NO: 1170 - DNA, 22 bp, Homo sapiens
agcataagttggtacagccact

SEQ ID NO: 1171 - DNA, 22 bp, Homo sapiens
ccgcggggcgtgggctcttacc

SEQ ID NO: 1172 - DNA, 22 bp, Homo sapiens
ctcgttgctgaagccaaagtca

SEQ ID NO: 1173 - DNA, 22 bp, Homo sapiens
gtgtcctttccgggcctggagg

SEQ ID NO: 1174 - DNA, 18 bp, Homo sapiens
ttcggcagatacgcttgg

SEQ ID NO: 1175 - DNA, 22 bp, Homo sapiens
ggtggcagtagcactgggcctg

SEQ ID NO: 1176 - DNA, 22 bp, Homo sapiens
ttgaataatatgcttcgttctc

SEQ ID NO: 1177 - DNA, 22 bp, Homo sapiens
cagggagtgtacaccatgtgta

SEQ ID NO: 1178 - DNA, 22 bp, Homo sapiens
gcggctgccgagacaagccggt

SEQ ID NO: 1179 - DNA, 22 bp, Homo sapiens
caattgtcagtgctgtttaaat

SEQ ID NO: 1180 - DNA, 22 bp, Homo sapiens
cccattcttcatacaagtctaa

SEQ ID NO: 1181 - DNA, 22 bp, Homo sapiens
ttttctgtttgcttcaagacat

SEQ ID NO: 1182 - DNA, 22 bp, Homo sapiens
ggggccttttctgaatgtggaa

SEQ ID NO: 1183 - DNA, 22 bp, Homo sapiens
tccttgtgctgagggtgttgct

SEQ ID NO: 1184 - DNA, 19 bp, Homo sapiens
cccaggaagcggaggttgc

SEQ ID NO: 1185 - DNA, 17 bp, Homo sapiens
caggtgttctgtttttc

SEQ ID NO: 1186 - DNA, 22 bp, Homo sapiens
tctggcttccctctgttctggg

SEQ ID NO: 1187 - DNA, 22 bp, Homo sapiens
acagttaataagtagtaagtca

SEQ ID NO: 1188 - DNA, 20 bp, Homo sapiens
aaactaaaggtgtttggttt

SEQ ID NO: 1189 - DNA, 22 bp, Homo sapiens
ttgagatgtcttttggcattat

SEQ ID NO: 1190 - DNA, 22 bp, Homo sapiens
cccagcaaggccagctcagggc

SEQ ID NO: 1191 - DNA, 22 bp, Homo sapiens
agctgaacgtgcttctgcagca

SEQ ID NO: 1192 - DNA, 22 bp, Homo sapiens
tggatatccttgttaactttct

SEQ ID NO: 1193 - DNA, 22 bp, Homo sapiens
ttagctcagaaaatttaaactt

SEQ ID NO: 1194 - DNA, 22 bp, Homo sapiens
tcttttgtgattctttagttac

SEQ ID NO: 1195 - DNA, 22 bp, Homo sapiens
gaccacacttttcccctgctag

SEQ ID NO: 1196 - DNA, 22 bp, Homo sapiens
ccggcgggcagcggcagtgagc

SEQ ID NO: 1197 - DNA, 22 bp, Homo sapiens
atcacctgggaggaaccatcta

SEQ ID NO: 1198 - DNA, 22 bp, Homo sapiens
taaccaagcaaactttcattgt

SEQ ID NO: 1199 - DNA, 22 bp, Homo sapiens
aaggagaggttgtccgtgttgt

SEQ ID NO: 1200 - DNA, 22 bp, Homo sapiens
ggatgtcgaggatggggtagca

SEQ ID NO: 1201 - DNA, 22 bp, Homo sapiens
tcgcccaggatggagtgcagta

SEQ ID NO: 1202 - DNA, 20 bp, Homo sapiens
agaattcccaagcatgacca

SEQ ID NO: 1203 - DNA, 22 bp, Homo sapiens
atgttctacagatggaaagggg

SEQ ID NO: 1204 - DNA, 22 bp, Homo sapiens
cttagtgacatgtattcttcat

SEQ ID NO: 1205 - DNA, 22 bp, Homo sapiens
tagggggctttgctgcttgaca

SEQ ID NO: 1206 - DNA, 22 bp, Homo sapiens
gctatgtataaccaaagtacaa

SEQ ID NO: 1207 - DNA, 22 bp, Homo sapiens
ttcatgtgtttgttgtcaaggg

SEQ ID NO: 1208 - DNA, 22 bp, Homo sapiens
cagtgcagccaaggacaggcac

SEQ ID NO: 1209 - DNA, 22 bp, Homo sapiens
agaagcctgttgagagggccgt

SEQ ID NO: 1210 - DNA, 22 bp, Homo sapiens
gtgagactcgcctttgtgtagc

SEQ ID NO: 1211 - DNA, 22 bp, Homo sapiens
agggcactgcaagggttgaagg

SEQ ID NO: 1212 - DNA, 22 bp, Homo sapiens
tcccccaggctggagtgcagtg

SEQ ID NO: 1213 - DNA, 22 bp, Homo sapiens
cttaactctacactgcacttta

SEQ ID NO: 1214 - DNA, 22 bp, Homo sapiens
ctgggcgcgtcccctgaggcgg

SEQ ID NO: 1215 - DNA, 22 bp, Homo sapiens
cttcatcagctggcttactgtt

SEQ ID NO: 1216 - DNA, 22 bp, Homo sapiens
gcagagctgggatatgaaccca

SEQ ID NO: 1217 - DNA, 19 bp, Homo sapiens
tctagttttgagagacttc

SEQ ID NO: 1218 - DNA, 22 bp, Homo sapiens
gggggaagaaagaacatggcat

SEQ ID NO: 1219 - DNA, 22 bp, Homo sapiens
gaatgtcttcaaaactagactg

SEQ ID NO: 1220 - DNA, 22 bp, Homo sapiens
caggtgtcggtcaggcggtttt

SEQ ID NO: 1221 - DNA, 22 bp, Homo sapiens
cctggaggcggaggttgcagtg

SEQ ID NO: 1222 - DNA, 22 bp, Homo sapiens
tcaggcaatctgacagctggag

SEQ ID NO: 1223 - DNA, 22 bp, Homo sapiens
gagccaggggtcagctccgagg

SEQ ID NO: 1224 - DNA, 22 bp, Homo sapiens
ccaggtaggagagtcaacatgt

SEQ ID NO: 1225 - DNA, 17 bp, Homo sapiens
tactgaggggtctggag

SEQ ID NO: 1226 - DNA, 22 bp, Homo sapiens
tcgaactcatagtcgtagctgt

SEQ ID NO: 1227 - DNA, 22 bp, Homo sapiens
acctttcagtgccctttctgtc

SEQ ID NO: 1228 - DNA, 22 bp, Homo sapiens
gtagagttgagtagtggtaaca

SEQ ID NO: 1229 - DNA, 22 bp, Homo sapiens
cttgtattaggaagaatgcttt

SEQ ID NO: 1230 - DNA, 22 bp, Homo sapiens
tcaatgtgaattaagaatactt

SEQ ID NO: 1231 - DNA, 22 bp, Homo sapiens
tatcagtccagggttttgtgac

SEQ ID NO: 1232 - DNA, 17 bp, Homo sapiens
tgtatttatcatgtcag

SEQ ID NO: 1233 - DNA, 22 bp, Homo sapiens
tataactacttgaagagttcag

SEQ ID NO: 1234 - DNA, 22 bp, Homo sapiens
cgagtgtccctaccatttccta

SEQ ID NO: 1235 - DNA, 22 bp, Homo sapiens
tgagaaacacaggcatgaatag

SEQ ID NO: 1236 - DNA, 22 bp, Homo sapiens
atcacccaggctggagtgcagt

SEQ ID NO: 1237 - DNA, 22 bp, Homo sapiens
aaaagcaattgcagttcttgcc

SEQ ID NO: 1238 - DNA, 22 bp, Homo sapiens
aaaaatcacttttataggcagc

SEQ ID NO: 1239 - DNA, 22 bp, Homo sapiens
tatcgagctggacgggctggtc

SEQ ID NO: 1240 - DNA, 22 bp, Homo sapiens
caggctggagtacaattgtgtg

SEQ ID NO: 1241 - DNA, 22 bp, Homo sapiens
acccatacacacatatttatgt

SEQ ID NO: 1242 - DNA, 20 bp, Homo sapiens
ctcttccggaggggcgctcc

SEQ ID NO: 1243 - DNA, 22 bp, Homo sapiens
agctctgaaagttatgtcgccg

SEQ ID NO: 1244 - DNA, 22 bp, Homo sapiens
cacagagctggaaaggctgggc

SEQ ID NO: 1245 - DNA, 20 bp, Homo sapiens
tcaggtgacacacgtggcac

SEQ ID NO: 1246 - DNA, 22 bp, Homo sapiens
tgaggaattgtgttgtagtgga

SEQ ID NO: 1247 - DNA, 22 bp, Homo sapiens
agttggagtgaacatgagattg

SEQ ID NO: 1248 - DNA, 22 bp, Homo sapiens
ggagtgcaatggcttgatcttg

SEQ ID NO: 1249 - DNA, 22 bp, Homo sapiens
cgtcttggagatattctgggct

SEQ ID NO: 1250 - DNA, 22 bp, Homo sapiens
cactaggcgccgggtggctgtg

SEQ ID NO: 1251 - DNA, 23 bp, Homo sapiens
ggctgggagctccgggtgcacgt

SEQ ID NO: 1252 - DNA, 23 bp, Homo sapiens
gaggtggcaatgagggcagttgg

SEQ ID NO: 1253 - DNA, 22 bp, Homo sapiens
ttcactcttcggcatctctgta

SEQ ID NO: 1254 - DNA, 22 bp, Homo sapiens
cagcatgttcttgtctcactgg

SEQ ID NO: 1255 - DNA, 22 bp, Homo sapiens
cctgcttaacattgccatgaca

SEQ ID NO: 1256 - DNA, 22 bp, Homo sapiens
ttgtttaatccttgtacccatg

SEQ ID NO: 1257 - DNA, 23 bp, Homo sapiens
tctcccaagcctggcaggggcac

SEQ ID NO: 1258 - DNA, 22 bp, Homo sapiens
atacatgcgccatgttggtgtg

SEQ ID NO: 1259 - DNA, 22 bp, Homo sapiens
gacaggtgctaagggacctggc

SEQ ID NO: 1260 - DNA, 22 bp, Homo sapiens
aggggttggacataagacagaa

SEQ ID NO: 1261 - DNA, 22 bp, Homo sapiens
ttgggctcaggagtttgagacc

SEQ ID NO: 1262 - DNA, 20 bp, Homo sapiens
gctctgtggtttgagtctcc

SEQ ID NO: 1263 - DNA, 18 bp, Homo sapiens
cttttcccctttggactc

SEQ ID NO: 1264 - DNA, 22 bp, Homo sapiens
caagcttgtttctcctgggggt

SEQ ID NO: 1265 - DNA, 22 bp, Homo sapiens
gtcagtgtcttaacagagatta

SEQ ID NO: 1266 - DNA, 22 bp, Homo sapiens
acatagttgatgagcgtgtacg

SEQ ID NO: 1267 - DNA, 22 bp, Homo sapiens
ccagcctggttcagaattggct

SEQ ID NO: 1268 - DNA, 22 bp, Homo sapiens
ctgaggctggagtgcagtggtg

SEQ ID NO: 1269 - DNA, 22 bp, Homo sapiens
atattgaaccctacagactgta

SEQ ID NO: 1270 - DNA, 22 bp, Homo sapiens
gccatgactctccataccaaag

SEQ ID NO: 1271 - DNA, 22 bp, Homo sapiens
tgtccaggttagcttcaaacac

SEQ ID NO: 1272 - DNA, 22 bp, Homo sapiens
cctgctggctctgttgctcggc

SEQ ID NO: 1273 - DNA, 22 bp, Homo sapiens
ccctgccttgtctgggctaggt

SEQ ID NO: 1274 - DNA, 22 bp, Homo sapiens
tgtttcttacgtttttagaggc

SEQ ID NO: 1275 - DNA, 22 bp, Homo sapiens
caggccctgtgctgggtgatgt

SEQ ID NO: 1276 - DNA, 22 bp, Homo sapiens
tacgggcacgcaccacgatgcc

SEQ ID NO: 1277 - DNA, 22 bp, Homo sapiens
ggttgtagttggaggttgtata

SEQ ID NO: 1278 - DNA, 21 bp, Homo sapiens
ttggtagatgcagcaccagta

SEQ ID NO: 1279 - DNA, 22 bp, Homo sapiens
cctggggtcacttgcagccgca

SEQ ID NO: 1280 - DNA, 22 bp, Homo sapiens
aagaggtttaactgactcacag

SEQ ID NO: 1281 - DNA, 22 bp, Homo sapiens
tgatttacagtagtgtctaaac

SEQ ID NO: 1282 - DNA, 22 bp, Homo sapiens
gtgggacaggtcaaatcttaaa

SEQ ID NO: 1283 - DNA, 22 bp, Homo sapiens
tttggtaagtacccacctgggt

SEQ ID NO: 1284 - DNA, 22 bp, Homo sapiens
aagcagaatagaggcccttccc

SEQ ID NO: 1285 - DNA, 19 bp, Homo sapiens
ccatggcaatgatctgatg

SEQ ID NO: 1286 - DNA, 22 bp, Homo sapiens
cttgcctttgtcttcaaaggct

SEQ ID NO: 1287 - DNA, 22 bp, Homo sapiens
tcagaagactgtcttttccatg

SEQ ID NO: 1288 - DNA, 22 bp, Homo sapiens
ccgggaggctaaggttgcagtg

SEQ ID NO: 1289 - DNA, 22 bp, Homo sapiens
aggtgcttggctcgtgcacaca

SEQ ID NO: 1290 - DNA, 22 bp, Homo sapiens
gggatttcaccatgttggttgg

SEQ ID NO: 1291 - DNA, 22 bp, Homo sapiens
ccgggagcaggcgccaccgcca

SEQ ID NO: 1292 - DNA, 22 bp, Homo sapiens
ttgagactgagtctcgccctgt

SEQ ID NO: 1293 - DNA, 22 bp, Homo sapiens
agtgattctcctgcctcagcct

SEQ ID NO: 1294 - DNA, 22 bp, Homo sapiens
ttagatttacaagcactgttta

SEQ ID NO: 1295 - DNA, 22 bp, Homo sapiens
tgggagtgtaaattagttcaac

SEQ ID NO: 1296 - DNA, 22 bp, Homo sapiens
ttgcactccagcccgagcaaca

SEQ ID NO: 1297 - DNA, 22 bp, Homo sapiens
agttggcactgagctgtgattg

SEQ ID NO: 1298 - DNA, 22 bp, Homo sapiens
aaggtgggtggatcacgaggtc

SEQ ID NO: 1299 - DNA, 19 bp, Homo sapiens
tcctggggaggggcatggc

SEQ ID NO: 1300 - DNA, 18 bp, Homo sapiens
cagctgccagctcatgga

SEQ ID NO: 1301 - DNA, 22 bp, Homo sapiens
gaatcccttgcattatcccttt

SEQ ID NO: 1302 - DNA, 22 bp, Homo sapiens
ttccagctaactcacatccctt

SEQ ID NO: 1303 - DNA, 22 bp, Homo sapiens
atgcagttccacaggcgcatgg

SEQ ID NO: 1304 - DNA, 22 bp, Homo sapiens
aaggcggaggttgcagtgagct

SEQ ID NO: 1305 - DNA, 22 bp, Homo sapiens
agctttgtttgctcacccgccg

SEQ ID NO: 1306 - DNA, 22 bp, Homo sapiens
aacacagcatcccttaggtcgt

SEQ ID NO: 1307 - DNA, 22 bp, Homo sapiens
aaccagactctccaaaggcaaa

SEQ ID NO: 1308 - DNA, 22 bp, Homo sapiens
ctgtaacctcctctttccattc

SEQ ID NO: 1309 - DNA, 22 bp, Homo sapiens
atgcggagccccaagcttgaag

SEQ ID NO: 1310 - DNA, 22 bp, Homo sapiens
tccccaagcaggcaatctcccg

SEQ ID NO: 1311 - DNA, 22 bp, Homo sapiens
atacaatgacccgggtccaagg

SEQ ID NO: 1312 - DNA, 22 bp, Homo sapiens
agtcttcctgcccagcaggagg

SEQ ID NO: 1313 - DNA, 22 bp, Homo sapiens
aatgtcctggagggcggccgct

SEQ ID NO: 1314 - DNA, 22 bp, Homo sapiens
gggtggagagaaagaaacgtga

SEQ ID NO: 1315 - DNA, 22 bp, Homo sapiens
aactgcgattacttttgcacca

SEQ ID NO: 1316 - DNA, 22 bp, Homo sapiens
ttatatgtttctgtttggaggc

SEQ ID NO: 1317 - DNA, 22 bp, Homo sapiens
taggtagatttaaagattttct

SEQ ID NO: 1318 - DNA, 22 bp, Homo sapiens
tgaggtgccacccaagagcctt

SEQ ID NO: 1319 - DNA, 22 bp, Homo sapiens
tccatgaggaccaaattcgtag

SEQ ID NO: 1320 - DNA, 22 bp, Homo sapiens
cctggggccccgagccagaagc

SEQ ID NO: 1321 - DNA, 22 bp, Homo sapiens
gggttactgcttcaaaaaatta

SEQ ID NO: 1322 - DNA, 22 bp, Homo sapiens
ttcatgcttggtgtggggatta

SEQ ID NO: 1323 - DNA, 22 bp, Homo sapiens
ttgtaacaggtactaaataact

SEQ ID NO: 1324 - DNA, 22 bp, Homo sapiens
cctgccagagcagcttgtcctc

SEQ ID NO: 1325 - DNA, 22 bp, Homo sapiens
ttattagagtgctttgagaaag

SEQ ID NO: 1326 - DNA, 22 bp, Homo sapiens
gagacctcttggtatcgctagg

SEQ ID NO: 1327 - DNA, 22 bp, Homo sapiens
ggggctgaacctggaggtggtc

SEQ ID NO: 1328 - DNA, 22 bp, Homo sapiens
tctgctctgtggcttcagctaa

SEQ ID NO: 1329 - DNA, 22 bp, Homo sapiens
agtgaaaacctaatcatgcagt

SEQ ID NO: 1330 - DNA, 22 bp, Homo sapiens
tgtacttcacctggtccactag

SEQ ID NO: 1331 - DNA, 22 bp, Homo sapiens
tgatgaccgccaacgtttaggt

SEQ ID NO: 1332 - DNA, 22 bp, Homo sapiens
atttttggctgttgtcagaggt

SEQ ID NO: 1333 - DNA, 22 bp, Homo sapiens
gcctggcgccgggctgcctgtc

SEQ ID NO: 1334 - DNA, 21 bp, Homo sapiens
agatcctggggtctggggagg

SEQ ID NO: 1335 - DNA, 22 bp, Homo sapiens
catcgccctggggtcctgcctt

SEQ ID NO: 1336 - DNA, 22 bp, Homo sapiens
tgggtggcagcttcagcatgtt

SEQ ID NO: 1337 - DNA, 22 bp, Homo sapiens
gtgcatgtcggggtgcatgtca

SEQ ID NO: 1338 - DNA, 21 bp, Homo sapiens
tacaatgcacaggagagcctc

SEQ ID NO: 1339 - DNA, 22 bp, Homo sapiens
ttcttctaaatgtgcttattaa

SEQ ID NO: 1340 - DNA, 22 bp, Homo sapiens
ttactttgcttcaggaagagga

SEQ ID NO: 1341 - DNA, 18 bp, Homo sapiens
tcatgagaatagcagggg

SEQ ID NO: 1342 - DNA, 22 bp, Homo sapiens
atacctgtgtatccacaagcgt

SEQ ID NO: 1343 - DNA, 21 bp, Homo sapiens
ccgtgctcggctatggaccac

SEQ ID NO: 1344 - DNA, 22 bp, Homo sapiens
tgaaatgtgtaatgtggatgcc

SEQ ID NO: 1345 - DNA, 22 bp, Homo sapiens
tggcctcggcatccagcaagag

SEQ ID NO: 1346 - DNA, 22 bp, Homo sapiens
cccagcaggaggaggttgcagt

SEQ ID NO: 1347 - DNA, 22 bp, Homo sapiens
tgagtagagaattcagctaagg

SEQ ID NO: 1348 - DNA, 17 bp, Homo sapiens
catcaaagaaatttcca

SEQ ID NO: 1349 - DNA, 22 bp, Homo sapiens
atatgggggggcgtgcagagga

SEQ ID NO: 1350 - DNA, 22 bp, Homo sapiens
ggcagggcaggaaagtcaggaa

SEQ ID NO: 1351 - DNA, 23 bp, Homo sapiens
acagtcgtaggtatccttttcct

SEQ ID NO: 1352 - DNA, 22 bp, Homo sapiens
ccacgggcagatgtggttggtt

SEQ ID NO: 1353 - DNA, 22 bp, Homo sapiens
ctggagggtggagagaagtctc

SEQ ID NO: 1354 - DNA, 21 bp, Homo sapiens
gggcctggctgcgcaggacgg

SEQ ID NO: 1355 - DNA, 22 bp, Homo sapiens
actgtactccagcctgggggac

SEQ ID NO: 1356 - DNA, 22 bp, Homo sapiens
ggggtctgggcttagctggaat

SEQ ID NO: 1357 - DNA, 22 bp, Homo sapiens
cactctcacatgccctgtcagt

SEQ ID NO: 1358 - DNA, 22 bp, Homo sapiens
ctgagatggagttttgctcttg

SEQ ID NO: 1359 - DNA, 22 bp, Homo sapiens
acattaaaattgggtggggtaa

SEQ ID NO: 1360 - DNA, 14 bp, Homo sapiens
aagatcaccttcct

SEQ ID NO: 1361 - DNA, 22 bp, Homo sapiens
taaaatttgtccctgagtgttg

SEQ ID NO: 1362 - DNA, 22 bp, Homo sapiens
ggcgggaagttcttgcccactt

SEQ ID NO: 1363 - DNA, 22 bp, Homo sapiens
tctccccagtatggattctctg

SEQ ID NO: 1364 - DNA, 22 bp, Homo sapiens
tgagtacaagcagtgctttctc

SEQ ID NO: 1365 - DNA, 19 bp, Homo sapiens
gtgtccatggagcatggag

SEQ ID NO: 1366 - DNA, 22 bp, Homo sapiens
aagaagagaactggcatcctaa

SEQ ID NO: 1367 - DNA, 19 bp, Homo sapiens
gcccacggccctgctctgc

SEQ ID NO: 1368 - DNA, 19 bp, Homo sapiens
atgtacccagtgtcaatcc

SEQ ID NO: 1369 - DNA, 22 bp, Homo sapiens
agctcctgaaaatccagactgg

SEQ ID NO: 1370 - DNA, 15 bp, Homo sapiens
ccttcccacccaccc

SEQ ID NO: 1371 - DNA, 22 bp, Homo sapiens
ctccaatctgggcaacagagca

SEQ ID NO: 1372 - DNA, 21 bp, Homo sapiens
ggagcctctggcagggggcca

SEQ ID NO: 1373 - DNA, 21 bp, Homo sapiens
cccgcacagcggtaggccgcc

SEQ ID NO: 1374 - DNA, 22 bp, Homo sapiens
tctggtgtcagtattctttgaa

SEQ ID NO: 1375 - DNA, 17 bp, Homo sapiens
tggtccaggtggagcca

SEQ ID NO: 1376 - DNA, 22 bp, Homo sapiens
aggcaaggtgctacagacagtg

SEQ ID NO: 1377 - DNA, 22 bp, Homo sapiens
gccacgtagaagtgccgcgaga

SEQ ID NO: 1378 - DNA, 22 bp, Homo sapiens
atttcccagggcctgggatttg

SEQ ID NO: 1379 - DNA, 22 bp, Homo sapiens
aggggaccaaaatgtcctgcct

SEQ ID NO: 1380 - DNA, 22 bp, Homo sapiens
tcccagattcctgctcttatat

SEQ ID NO: 1381 - DNA, 22 bp, Homo sapiens
tcttgccacttcatcccctttc

SEQ ID NO: 1382 - DNA, 22 bp, Homo sapiens
gcttccacctactaaatgccac

SEQ ID NO: 1383 - DNA, 22 bp, Homo sapiens
gcgtctcatcctcccgctaatt

SEQ ID NO: 1384 - DNA, 22 bp, Homo sapiens
agaaaacataggagacaggaaa

SEQ ID NO: 1385 - DNA, 22 bp, Homo sapiens
ttcacagtggtagtgcatttag

SEQ ID NO: 1386 - DNA, 20 bp, Homo sapiens
tccaaagaagttcacattta

SEQ ID NO: 1387 - DNA, 22 bp, Homo sapiens
ccttacactgcctggggccacg

SEQ ID NO: 1388 - DNA, 22 bp, Homo sapiens
gggcaggggtcagtggccccaa

SEQ ID NO: 1389 - DNA, 22 bp, Homo sapiens
ggggccgaccgcggttcaggcc

SEQ ID NO: 1390 - DNA, 22 bp, Homo sapiens
ccttcccacattccttacatgc

SEQ ID NO: 1391 - DNA, 22 bp, Homo sapiens
gatatcatgggaaggtgtactt

SEQ ID NO: 1392 - DNA, 20 bp, Homo sapiens
atgctttcttgtgtgctgct

SEQ ID NO: 1393 - DNA, 22 bp, Homo sapiens
ggagtgcggtggcaccatctca

SEQ ID NO: 1394 - DNA, 22 bp, Homo sapiens
cgcgctctccttctggcaccca

SEQ ID NO: 1395 - DNA, 22 bp, Homo sapiens
gggtcgcttggagaggcttcct

SEQ ID NO: 1396 - DNA, 22 bp, Homo sapiens
gaggcgggcagatcacctgagg

SEQ ID NO: 1397 - DNA, 22 bp, Homo sapiens
cgttttcatgggtagaggttct

SEQ ID NO: 1398 - DNA, 21 bp, Homo sapiens
cccagaagttccatggggggc

SEQ ID NO: 1399 - DNA, 22 bp, Homo sapiens
tggggccatctcacccactgtt

SEQ ID NO: 1400 - DNA, 22 bp, Homo sapiens
agctggaattacaggagcccat

SEQ ID NO: 1401 - DNA, 22 bp, Homo sapiens
gagcacgttgaagcgcactgtc

SEQ ID NO: 1402 - DNA, 22 bp, Homo sapiens
tatgttaacatgttaggaactg

SEQ ID NO: 1403 - DNA, 22 bp, Homo sapiens
gcaaatacatgttgagcaccta

SEQ ID NO: 1404 - DNA, 19 bp, Homo sapiens
cgcctggcaggccctgcgc

SEQ ID NO: 1405 - DNA, 22 bp, Homo sapiens
tcctgtgatattgtttgttata

SEQ ID NO: 1406 - DNA, 22 bp, Homo sapiens
gggagaggttacccgagcaact

SEQ ID NO: 1407 - DNA, 22 bp, Homo sapiens
acagcagcaatagcagtgacat

SEQ ID NO: 1408 - DNA, 22 bp, Homo sapiens
tcaaatgaagacagttgacttg

SEQ ID NO: 1409 - DNA, 22 bp, Homo sapiens
aggatttctgtgcctggaaaat

SEQ ID NO: 1410 - DNA, 22 bp, Homo sapiens
aggtggaagatgaacccaaatt

SEQ ID NO: 1411 - DNA, 22 bp, Homo sapiens
cttggggaagccactgatccct

SEQ ID NO: 1412 - DNA, 22 bp, Homo sapiens
tagcccttgatgctgcggccag

SEQ ID NO: 1413 - DNA, 22 bp, Homo sapiens
gggaacagcttgggctctgcca

SEQ ID NO: 1414 - DNA, 22 bp, Homo sapiens
ttagattttaagaagggaggta

SEQ ID NO: 1415 - DNA, 22 bp, Homo sapiens
tgagggaatattgatagatccg

SEQ ID NO: 1416 - DNA, 22 bp, Homo sapiens
aagtcacttcttaggaaaggag

SEQ ID NO: 1417 - DNA, 22 bp, Homo sapiens
atacaaaaattagccgggagta

SEQ ID NO: 1418 - DNA, 22 bp, Homo sapiens
ccctaaaagtctcattttccag

SEQ ID NO: 1419 - DNA, 22 bp, Homo sapiens
tcactgcaagctccgcctcccg

SEQ ID NO: 1420 - DNA, 22 bp, Homo sapiens
ctgggttggggttacatgactg

SEQ ID NO: 1421 - DNA, 22 bp, Homo sapiens
cttgctactatgcctggctaat

SEQ ID NO: 1422 - DNA, 19 bp, Homo sapiens
aggagcactgccagcacca

SEQ ID NO: 1423 - DNA, 22 bp, Homo sapiens
ttgagcagatcgggctgtgggg

SEQ ID NO: 1424 - DNA, 22 bp, Homo sapiens
aaccagatgcttccccagatgc

SEQ ID NO: 1425 - DNA, 22 bp, Homo sapiens
aagctgattccactttttccac

SEQ ID NO: 1426 - DNA, 22 bp, Homo sapiens
tatgcaggattatctactacca

SEQ ID NO: 1427 - DNA, 22 bp, Homo sapiens
ctggacacactggagtctggca

SEQ ID NO: 1428 - DNA, 22 bp, Homo sapiens
cctgaccagcaggacgggggca

SEQ ID NO: 1429 - DNA, 22 bp, Homo sapiens
aaatcgcttgaacccaggaagt

SEQ ID NO: 1430 - DNA, 18 bp, Homo sapiens
atactagagctctttgcc

SEQ ID NO: 1431 - DNA, 22 bp, Homo sapiens
gggacatctttctagtcagggt

SEQ ID NO: 1432 - DNA, 22 bp, Homo sapiens
acacttctttgtcacctgcttc

SEQ ID NO: 1433 - DNA, 22 bp, Homo sapiens
cagcggagggcagccttgcagc

SEQ ID NO: 1434 - DNA, 22 bp, Homo sapiens
tcaggcaccttcctcttatctg

SEQ ID NO: 1435 - DNA, 23 bp, Homo sapiens
cgggttcacgccattctcctgcc

SEQ ID NO: 1436 - DNA, 22 bp, Homo sapiens
accgggtaggtgtcaactctga

SEQ ID NO: 1437 - DNA, 18 bp, Homo sapiens
gaggatggaaggagatgc

SEQ ID NO: 1438 - DNA, 22 bp, Homo sapiens
aagtgattctccctacgcggga

SEQ ID NO: 1439 - DNA, 22 bp, Homo sapiens
tcttagaaattccccagtggct

SEQ ID NO: 1440 - DNA, 22 bp, Homo sapiens
ccaggctgctgttggtgtccgc

SEQ ID NO: 1441 - DNA, 22 bp, Homo sapiens
tggaagactcaaggtggtgaat

SEQ ID NO: 1442 - DNA, 22 bp, Homo sapiens
tagattccattggcccagagaa

SEQ ID NO: 1443 - DNA, 22 bp, Homo sapiens
ttttaagctacaagagacatat

SEQ ID NO: 1444 - DNA, 22 bp, Homo sapiens
aaagtgcttctctttggtgggt

SEQ ID NO: 1445 - DNA, 23 bp, Homo sapiens
atgacactcctgtgcgcaccctg

SEQ ID NO: 1446 - DNA, 22 bp, Homo sapiens
gagagtctagtgcacctagttt

SEQ ID NO: 1447 - DNA, 20 bp, Homo sapiens
gccctcatgtacaggctgga

SEQ ID NO: 1448 - DNA, 22 bp, Homo sapiens
acccagccatgttcagttctct

SEQ ID NO: 1449 - DNA, 22 bp, Homo sapiens
ggctccctgcaacctccgcctc

SEQ ID NO: 1450 - DNA, 22 bp, Homo sapiens
caggaattcatagcattgttct

SEQ ID NO: 1451 - DNA, 22 bp, Homo sapiens
aattgcaaattcagacttaaga

SEQ ID NO: 1452 - DNA, 22 bp, Homo sapiens
gtgctttgttaagtctgaaatt

SEQ ID NO: 1453 - DNA, 22 bp, Homo sapiens
aatgttgcagagtgattgtcca

SEQ ID NO: 1454 - DNA, 22 bp, Homo sapiens
agttgttcgtggtggattcgct

SEQ ID NO: 1455 - DNA, 22 bp, Homo sapiens
ggagcatgcgctctgtgaccga

SEQ ID NO: 1456 - DNA, 22 bp, Homo sapiens
tgttatatctaaatagccacat

SEQ ID NO: 1457 - DNA, 22 bp, Homo sapiens
gctcactgcaacctctgcctcc

SEQ ID NO: 1458 - DNA, 22 bp, Homo sapiens
ctcctccacccgctggggccca

SEQ ID NO: 1459 - DNA, 22 bp, Homo sapiens
tcccctttgtcttcctgtgggt

SEQ ID NO: 1460 - DNA, 22 bp, Homo sapiens
gctgctttggaaagcatggaaa

SEQ ID NO: 1461 - DNA, 22 bp, Homo sapiens
ttgctaccattgataccagcac

SEQ ID NO: 1462 - DNA, 22 bp, Homo sapiens
cctgggccctcaccgccggtgg

SEQ ID NO: 1463 - DNA, 22 bp, Homo sapiens
ctgctttagacggctttcgctg

SEQ ID NO: 1464 - DNA, 22 bp, Homo sapiens
actgtactccagcctgggagac

SEQ ID NO: 1465 - DNA, 21 bp, Homo sapiens
ggagtttttctggaagggact

SEQ ID NO: 1466 - DNA, 22 bp, Homo sapiens
actgtactccagcctgggaaac

SEQ ID NO: 1467 - DNA, 22 bp, Homo sapiens
ttgtccttcttcattcagtccc

SEQ ID NO: 1468 - DNA, 22 bp, Homo sapiens
tgacttgtctctttgggagaca

SEQ ID NO: 1469 - DNA, 22 bp, Homo sapiens
acgcggtgcggcaagttcatgg

SEQ ID NO: 1470 - DNA, 22 bp, Homo sapiens
aagctggagtgcagtgcaatgg

SEQ ID NO: 1471 - DNA, 22 bp, Homo sapiens
tcacattttcaaaagctggtgc

SEQ ID NO: 1472 - DNA, 22 bp, Homo sapiens
tcttgaacttctgcacactcag

SEQ ID NO: 1473 - DNA, 22 bp, Homo sapiens
taagcattgtttctgaggatgg

SEQ ID NO: 1474 - DNA, 22 bp, Homo sapiens
ttccacaatggttaagctcgtt

SEQ ID NO: 1475 - DNA, 22 bp, Homo sapiens
ggctttctgtctgcgtctgtgt

SEQ ID NO: 1476 - DNA, 22 bp, Homo sapiens
tttcttaggctctaaaatgact

SEQ ID NO: 1477 - DNA, 22 bp, Homo sapiens
cgcaccccactgtccctcaacc

SEQ ID NO: 1478 - DNA, 21 bp, Homo sapiens
tgcaatgagattgcgcagggc

SEQ ID NO: 1479 - DNA, 22 bp, Homo sapiens
ttgtgttaaggtgcatctagtg

SEQ ID NO: 1480 - DNA, 22 bp, Homo sapiens
catcccttcccccgagcatggc

SEQ ID NO: 1481 - DNA, 22 bp, Homo sapiens
gcggggggaggaacatcttgca

SEQ ID NO: 1482 - DNA, 18 bp, Homo sapiens
accttcattcctttgcct

SEQ ID NO: 1483 - DNA, 22 bp, Homo sapiens
gtaaaaaggccaagcccttgtg

SEQ ID NO: 1484 - DNA, 22 bp, Homo sapiens
aggaaataggaccagacaaagc

SEQ ID NO: 1485 - DNA, 22 bp, Homo sapiens
gaatatcccgctatgcaaagta

SEQ ID NO: 1486 - DNA, 22 bp, Homo sapiens
agtgcaatggtgccatcatagc

SEQ ID NO: 1487 - DNA, 22 bp, Homo sapiens
agtagatttctgctgaagcttt

SEQ ID NO: 1488 - DNA, 22 bp, Homo sapiens
agagcccctgggtcacacagcc

SEQ ID NO: 1489 - DNA, 22 bp, Homo sapiens
attgtggactgatcagggctag

SEQ ID NO: 1490 - DNA, 22 bp, Homo sapiens
aatcaactgagccctggttctc

SEQ ID NO: 1491 - DNA, 22 bp, Homo sapiens
acggtgaccaagcatcaccgag

SEQ ID NO: 1492 - DNA, 22 bp, Homo sapiens
ctatacagcagcttactagtta

SEQ ID NO: 1493 - DNA, 22 bp, Homo sapiens
ccaagggcgcctccgttccccc

SEQ ID NO: 1494 - DNA, 23 bp, Homo sapiens
aatgggtgcaactatccatgaca

SEQ ID NO: 1495 - DNA, 22 bp, Homo sapiens
gcaactgaacatgtgtgtggcc

SEQ ID NO: 1496 - DNA, 22 bp, Homo sapiens
cccaggagttggaggctgcagt

SEQ ID NO: 1497 - DNA, 22 bp, Homo sapiens
caggagttcaaggttgcagtga

SEQ ID NO: 1498 - DNA, 20 bp, Homo sapiens
aatgctgcttctttttgcat

SEQ ID NO: 1499 - DNA, 22 bp, Homo sapiens
gcctccggagtcacagtgtctt

SEQ ID NO: 1500 - DNA, 22 bp, Homo sapiens
aaaactgaaatacgatccaatg

SEQ ID NO: 1501 - DNA, 22 bp, Homo sapiens
caaagttgcagttatgtgatta

SEQ ID NO: 1502 - DNA, 22 bp, Homo sapiens
catcgatggaagtagtataggg

SEQ ID NO: 1503 - DNA, 22 bp, Homo sapiens
caggaggttgagggtgcagtga

SEQ ID NO: 1504 - DNA, 22 bp, Homo sapiens
gccctgagaagaagtcggaggg

SEQ ID NO: 1505 - DNA, 22 bp, Homo sapiens
tgggatgctcagggcctggagc

SEQ ID NO: 1506 - DNA, 22 bp, Homo sapiens
aataatctcactttatgtggaa

SEQ ID NO: 1507 - DNA, 22 bp, Homo sapiens
atttacaggtagaattttaagt

SEQ ID NO: 1508 - DNA, 22 bp, Homo sapiens
aggaatggtgctcagcagaaat

SEQ ID NO: 1509 - DNA, 22 bp, Homo sapiens
aatctgttgatgcaaacctccc

SEQ ID NO: 1510 - DNA, 22 bp, Homo sapiens
ggtttgtggagctggaaacact

SEQ ID NO: 1511 - DNA, 22 bp, Homo sapiens
gccacctcggctttctctgctc

SEQ ID NO: 1512 - DNA, 22 bp, Homo sapiens
cgtctggcttctccacggtaaa

SEQ ID NO: 1513 - DNA, 22 bp, Homo sapiens
tgtcatagtgtggtagcagtgg

SEQ ID NO: 1514 - DNA, 22 bp, Homo sapiens
ttaattctgcctttcatgtaac

SEQ ID NO: 1515 - DNA, 22 bp, Homo sapiens
cacattggcaaacggggttgca

SEQ ID NO: 1516 - DNA, 22 bp, Homo sapiens
gctggaaatgattaaatggtga

SEQ ID NO: 1517 - DNA, 22 bp, Homo sapiens
tagccaaagaccttttcaaccc

SEQ ID NO: 1518 - DNA, 22 bp, Homo sapiens
tctttgggccgacactcgtcaa

SEQ ID NO: 1519 - DNA, 22 bp, Homo sapiens
ccagcagagcatggggaggaag

SEQ ID NO: 1520 - DNA, 22 bp, Homo sapiens
aggaatgtgaaacaggtggctg

SEQ ID NO: 1521 - DNA, 22 bp, Homo sapiens
atctacaagaggttctcctctc

SEQ ID NO: 1522 - DNA, 23 bp, Homo sapiens
cagtctgcagcccacttgggcag

SEQ ID NO: 1523 - DNA, 22 bp, Homo sapiens
tcgtgaggctctgcatcgcaca

SEQ ID NO: 1524 - DNA, 22 bp, Homo sapiens
acagcccagctctttctctgca

SEQ ID NO: 1525 - DNA, 22 bp, Homo sapiens
tgcatggtgtaattctaatgct

SEQ ID NO: 1526 - DNA, 22 bp, Homo sapiens
agaagtataactatttgctttc

SEQ ID NO: 1527 - DNA, 22 bp, Homo sapiens
tcccattgcccaggtagtgtac

SEQ ID NO: 1528 - DNA, 22 bp, Homo sapiens
agagaagagtcttgtcaaatta

SEQ ID NO: 1529 - DNA, 22 bp, Homo sapiens
ggcaatgagcttgacctcctgg

SEQ ID NO: 1530 - DNA, 22 bp, Homo sapiens
cgctgcgaggcgcccttgttgc

SEQ ID NO: 1531 - DNA, 22 bp, Homo sapiens
ctctgcctgtctcatcctgcaa

SEQ ID NO: 1532 - DNA, 22 bp, Homo sapiens
tatcttaaaaatcgaagcagat

SEQ ID NO: 1533 - DNA, 22 bp, Homo sapiens
catctttgcccatccacttcca

SEQ ID NO: 1534 - DNA, 22 bp, Homo sapiens
aatcagaccgttctggctgtcc

SEQ ID NO: 1535 - DNA, 22 bp, Homo sapiens
attcagagcactgggtagaatt

SEQ ID NO: 1536 - DNA, 22 bp, Homo sapiens
tccctgatgccttgatccgtgg

SEQ ID NO: 1537 - DNA, 22 bp, Homo sapiens
ggggcaggagcccttcttcagc

SEQ ID NO: 1538 - DNA, 22 bp, Homo sapiens
ggctgcaggttggttggcagct

SEQ ID NO: 1539 - DNA, 22 bp, Homo sapiens
ttacttaaacagaaatgcagaa

SEQ ID NO: 1540 - DNA, 22 bp, Homo sapiens
agtggtcttagcttgctgggct

SEQ ID NO: 1541 - DNA, 22 bp, Homo sapiens
acgtgctggagaagagctcgcc

SEQ ID NO: 1542 - DNA, 22 bp, Homo sapiens
ttctttcagaacacaagtgatt

SEQ ID NO: 1543 - DNA, 22 bp, Homo sapiens
gaggcaaagcatgtggctcagg

SEQ ID NO: 1544 - DNA, 22 bp, Homo sapiens
ctggagagaatgtggaatgatt

SEQ ID NO: 1545 - DNA, 22 bp, Homo sapiens
aatccaggtggcggaggttgtg

SEQ ID NO: 1546 - DNA, 22 bp, Homo sapiens
cctcggaggcggaggctgcagt

SEQ ID NO: 1547 - DNA, 22 bp, Homo sapiens
aagtcagacagctgagctgcct

SEQ ID NO: 1548 - DNA, 22 bp, Homo sapiens
gaaactctcgcatcctgggaac

SEQ ID NO: 1549 - DNA, 20 bp, Homo sapiens
tgaggcccagcagagtcggg

SEQ ID NO: 1550 - DNA, 22 bp, Homo sapiens
ccttacctgattgctggcatcc

SEQ ID NO: 1551 - DNA, 22 bp, Homo sapiens
gcaggcagatcacctgtcagga

SEQ ID NO: 1552 - DNA, 19 bp, Homo sapiens
agccagccagcaggtatgc

SEQ ID NO: 1553 - DNA, 22 bp, Homo sapiens
ctagtgcaatgatgaatacaag

SEQ ID NO: 1554 - DNA, 22 bp, Homo sapiens
actcatgtcctaggagtaaagc

SEQ ID NO: 1555 - DNA, 22 bp, Homo sapiens
ttcagagaattggataattcgt

SEQ ID NO: 1556 - DNA, 22 bp, Homo sapiens
gctctgagtcacactgccctgt

SEQ ID NO: 1557 - DNA, 22 bp, Homo sapiens
gaggctgaggcaggaggatcac

SEQ ID NO: 1558 - DNA, 22 bp, Homo sapiens
gttggctatgagagctttagtg

SEQ ID NO: 1559 - DNA, 22 bp, Homo sapiens
atgagcacactgataagcccct

SEQ ID NO: 1560 - DNA, 22 bp, Homo sapiens
agtgctatcgagttctaatgct

SEQ ID NO: 1561 - DNA, 22 bp, Homo sapiens
caccgcggagtgatggagaaac

SEQ ID NO: 1562 - DNA, 22 bp, Homo sapiens
ttccatcattaacaccacaagg

SEQ ID NO: 1563 - DNA, 22 bp, Homo sapiens
cagcctgtagtctggtccaggt

SEQ ID NO: 1564 - DNA, 22 bp, Homo sapiens
ctggctcctgtttaaccagctg

SEQ ID NO: 1565 - DNA, 22 bp, Homo sapiens
aatttgtataaaatggtgtttt

SEQ ID NO: 1566 - DNA, 20 bp, Homo sapiens
tgagacccgctgacaagttc

SEQ ID NO: 1567 - DNA, 22 bp, Homo sapiens
aggtcagagcaatgtattgctt

SEQ ID NO: 1568 - DNA, 22 bp, Homo sapiens
tgtgctggagatcagcttattt

SEQ ID NO: 1569 - DNA, 22 bp, Homo sapiens
gtcccctgtccagggccagcca

SEQ ID NO: 1570 - DNA, 22 bp, Homo sapiens
tatgctctgagacctttgtgca

SEQ ID NO: 1571 - DNA, 22 bp, Homo sapiens
actcggggtggagagagcggtg

SEQ ID NO: 1572 - DNA, 22 bp, Homo sapiens
tccaggatggtgacggtggcca

SEQ ID NO: 1573 - DNA, 22 bp, Homo sapiens
tcccgtaggttgctgtagtcgg

SEQ ID NO: 1574 - DNA, 22 bp, Homo sapiens
gttggccaggctggtctcaatc

SEQ ID NO: 1575 - DNA, 22 bp, Homo sapiens
gtctgtctgccaggttaggctg

SEQ ID NO: 1576 - DNA, 22 bp, Homo sapiens
ggatgtgtcactctcaggaggt

SEQ ID NO: 1577 - DNA, 22 bp, Homo sapiens
ttttaagttggattgctaagta

SEQ ID NO: 1578 - DNA, 22 bp, Homo sapiens
ggctttgacatgctgaattaaa

SEQ ID NO: 1579 - DNA, 22 bp, Homo sapiens
ctgggcgtggcagcggagctgg

SEQ ID NO: 1580 - DNA, 22 bp, Homo sapiens
aagactgtgtctatggctactc

SEQ ID NO: 1581 - DNA, 22 bp, Homo sapiens
ttggacgctcctaagaccaagc

SEQ ID NO: 1582 - DNA, 16 bp, Homo sapiens
gcaggcagatcacatg

SEQ ID NO: 1583 - DNA, 22 bp, Homo sapiens
ggaccaggactggtggtatctc

SEQ ID NO: 1584 - DNA, 22 bp, Homo sapiens
tgcatttcccattgtgtggctc

SEQ ID NO: 1585 - DNA, 22 bp, Homo sapiens
ggtagccaatttaaacatttcc

SEQ ID NO: 1586 - DNA, 23 bp, Homo sapiens
gattcaggattagttgtccagag

SEQ ID NO: 1587 - DNA, 22 bp, Homo sapiens
gcctcctggggtgccatcatct

SEQ ID NO: 1588 - DNA, 22 bp, Homo sapiens
caagggaattgtgtgtgagagg

SEQ ID NO: 1589 - DNA, 22 bp, Homo sapiens
aactattatgaaagacagtgtg

SEQ ID NO: 1590 - DNA, 23 bp, Homo sapiens
atcattaacagtgcaggggtagg

SEQ ID NO: 1591 - DNA, 22 bp, Homo sapiens
tggccaccaccaatacttgcct

SEQ ID NO: 1592 - DNA, 22 bp, Homo sapiens
gcttcaggctgaattcctccta

SEQ ID NO: 1593 - DNA, 22 bp, Homo sapiens
aataaacaaatccttccttccc

SEQ ID NO: 1594 - DNA, 22 bp, Homo sapiens
tgggactcactcttttggccag

SEQ ID NO: 1595 - DNA, 22 bp, Homo sapiens
ggtgacggggcccaggtttcct

SEQ ID NO: 1596 - DNA, 22 bp, Homo sapiens
gggcaccttgggtctcaggcaa

SEQ ID NO: 1597 - DNA, 22 bp, Homo sapiens
tggtccttctgtcttccgcacc

SEQ ID NO: 1598 - DNA, 21 bp, Homo sapiens
ggcctcccggaccgcagcgcc

SEQ ID NO: 1599 - DNA, 22 bp, Homo sapiens
agcccaggtccagttcactgca

SEQ ID NO: 1600 - DNA, 22 bp, Homo sapiens
aggttttggtgatcattggaga

SEQ ID NO: 1601 - DNA, 22 bp, Homo sapiens
aagattttcagtgcctaaaaca

SEQ ID NO: 1602 - DNA, 22 bp, Homo sapiens
aggaaaacagaccaaggagctc

SEQ ID NO: 1603 - DNA, 22 bp, Homo sapiens
ctggcctagacagaccctgatc

SEQ ID NO: 1604 - DNA, 22 bp, Homo sapiens
ccttggttgtgcttcaacttct

SEQ ID NO: 1605 - DNA, 22 bp, Homo sapiens
ccctggctgcgtgatggatgaa

SEQ ID NO: 1606 - DNA, 22 bp, Homo sapiens
gtaggccatggtggttgtctct

SEQ ID NO: 1607 - DNA, 22 bp, Homo sapiens
tgtggctcaggcggcttctcct

SEQ ID NO: 1608 - DNA, 22 bp, Homo sapiens
tccctgtgtcctgggggcacct

SEQ ID NO: 1609 - DNA, 22 bp, Homo sapiens
ggctcgtctgagttctagtctc

SEQ ID NO: 1610 - DNA, 22 bp, Homo sapiens
ttcagcccaggagttggaggct

SEQ ID NO: 1611 - DNA, 22 bp, Homo sapiens
agacgctattttgaggggtcta

SEQ ID NO: 1612 - DNA, 22 bp, Homo sapiens
tttgattgtcacctaccttgca

SEQ ID NO: 1613 - DNA, 22 bp, Homo sapiens
cagacttacctaaggtcacaca

SEQ ID NO: 1614 - DNA, 22 bp, Homo sapiens
tcgggctcgctctcctagcgga

SEQ ID NO: 1615 - DNA, 22 bp, Homo sapiens
tgtgcatgtgtctttatagtag

SEQ ID NO: 1616 - DNA, 22 bp, Homo sapiens
caggagtgtctccacacagcaa

SEQ ID NO: 1617 - DNA, 22 bp, Homo sapiens
gagtccaagctagagccactca

SEQ ID NO: 1618 - DNA, 22 bp, Homo sapiens
tttgtagcagcatgatttataa

SEQ ID NO: 1619 - DNA, 22 bp, Homo sapiens
gttcagaaattaggagaataaa

SEQ ID NO: 1620 - DNA, 22 bp, Homo sapiens
ttcccactgtggcagagcctcg

SEQ ID NO: 1621 - DNA, 22 bp, Homo sapiens
gggccccaagaacctcctcctg

SEQ ID NO: 1622 - DNA, 22 bp, Homo sapiens
cctgtcacctaggtactgagca

SEQ ID NO: 1623 - DNA, 22 bp, Homo sapiens
agaggacagagtgctggattta

SEQ ID NO: 1624 - DNA, 22 bp, Homo sapiens
cattcatctatcaaatggtacc

SEQ ID NO: 1625 - DNA, 22 bp, Homo sapiens
cgtgtagcatgcgccaccacca

SEQ ID NO: 1626 - DNA, 22 bp, Homo sapiens
tgttaaaccagttttgcatcat

SEQ ID NO: 1627 - DNA, 22 bp, Homo sapiens
cagtggcaggatttcagctcag

SEQ ID NO: 1628 - DNA, 22 bp, Homo sapiens
attgcagatgatccccaagtta

SEQ ID NO: 1629 - DNA, 22 bp, Homo sapiens
gtagggttggagagcacaacca

SEQ ID NO: 1630 - DNA, 22 bp, Homo sapiens
tgcctaggctggagtgtagtgg

SEQ ID NO: 1631 - DNA, 22 bp, Homo sapiens
tcgccatggaagtccttgcgga

SEQ ID NO: 1632 - DNA, 22 bp, Homo sapiens
tactcttttagccccacagaga

SEQ ID NO: 1633 - DNA, 22 bp, Homo sapiens
aatgtcctctttagagggttac

SEQ ID NO: 1634 - DNA, 22 bp, Homo sapiens
tcacatgtgtacagtcctccca

SEQ ID NO: 1635 - DNA, 20 bp, Homo sapiens
caaatccctgctctgtgctg

SEQ ID NO: 1636 - DNA, 22 bp, Homo sapiens
ttaaggttcagaaatcaatacc

SEQ ID NO: 1637 - DNA, 22 bp, Homo sapiens
atgtttaaagggttgagaaata

SEQ ID NO: 1638 - DNA, 22 bp, Homo sapiens
ttcagcttgctgactgcggcag

SEQ ID NO: 1639 - DNA, 22 bp, Homo sapiens
tatccgtgatgtttataaacca

SEQ ID NO: 1640 - DNA, 22 bp, Homo sapiens
aaacatggccattcagactgtg

SEQ ID NO: 1641 - DNA, 22 bp, Homo sapiens
tcacccctccattctctcatgt

SEQ ID NO: 1642 - DNA, 22 bp, Homo sapiens
tcactgtatcatgttgcactta

SEQ ID NO: 1643 - DNA, 22 bp, Homo sapiens
attctaatggcagagactcctg

SEQ ID NO: 1644 - DNA, 22 bp, Homo sapiens
taggggcaggatcctttgagcc

SEQ ID NO: 1645 - DNA, 17 bp, Homo sapiens
aggtgggtggatcacct

SEQ ID NO: 1646 - DNA, 22 bp, Homo sapiens
gtgtgtccaaggcacggatgac

SEQ ID NO: 1647 - DNA, 22 bp, Homo sapiens
tcgtctgtgaaattgggataag

SEQ ID NO: 1648 - DNA, 22 bp, Homo sapiens
cagtgccagctgcttggcctac

SEQ ID NO: 1649 - DNA, 22 bp, Homo sapiens
tgctatgttgcccagggtggcc

SEQ ID NO: 1650 - DNA, 22 bp, Homo sapiens
agcccaatcctagcactttgag

SEQ ID NO: 1651 - DNA, 22 bp, Homo sapiens
tttggtattgcacactgtcttc

SEQ ID NO: 1652 - DNA, 22 bp, Homo sapiens
gaagccagtgtttgaagaattt

SEQ ID NO: 1653 - DNA, 16 bp, Homo sapiens
aggcgaaggttcattt

SEQ ID NO: 1654 - DNA, 22 bp, Homo sapiens
ctcagggccaaggatgctgttg

SEQ ID NO: 1655 - DNA, 22 bp, Homo sapiens
actttcttggtcccatgtttga

SEQ ID NO: 1656 - DNA, 22 bp, Homo sapiens
tgttataacatcggttgactaa

SEQ ID NO: 1657 - DNA, 19 bp, Homo sapiens
tttgatagggcataatata

SEQ ID NO: 1658 - DNA, 22 bp, Homo sapiens
tgtctcatctcttaaccccact

SEQ ID NO: 1659 - DNA, 22 bp, Homo sapiens
gcagggtctgaggccacagagg

SEQ ID NO: 1660 - DNA, 22 bp, Homo sapiens
ttctcatgaaactcgcttcctc

SEQ ID NO: 1661 - DNA, 22 bp, Homo sapiens
gtcgcttgaacccaggaagtgg

SEQ ID NO: 1662 - DNA, 22 bp, Homo sapiens
tcctgagccctactctagacga

SEQ ID NO: 1663 - DNA, 22 bp, Homo sapiens
acccggagtcggaggttgcagt

SEQ ID NO: 1664 - DNA, 22 bp, Homo sapiens
gaatgctaagcatgtgggagtt

SEQ ID NO: 1665 - DNA, 22 bp, Homo sapiens
gtgcgtcctgggggctgggtcg

SEQ ID NO: 1666 - DNA, 22 bp, Homo sapiens
gacgcatcaggaggcgaggagc

SEQ ID NO: 1667 - DNA, 22 bp, Homo sapiens
ttaaactgcttgaattgggttt

SEQ ID NO: 1668 - DNA, 22 bp, Homo sapiens
taggcctggatctctgggagca

SEQ ID NO: 1669 - DNA, 22 bp, Homo sapiens
ttctgtgctcaaaactttccaa

SEQ ID NO: 1670 - DNA, 22 bp, Homo sapiens
ccaaggtgggaggattgcttga

SEQ ID NO: 1671 - DNA, 22 bp, Homo sapiens
ttaggttggtgcaaaagtaatt

SEQ ID NO: 1672 - DNA, 22 bp, Homo sapiens
tgggcagttttctatgctgcaa

SEQ ID NO: 1673 - DNA, 22 bp, Homo sapiens
aggctatttccactcttctcat

SEQ ID NO: 1674 - DNA, 22 bp, Homo sapiens
ggcaggaacacagatggtgccg

SEQ ID NO: 1675 - DNA, 22 bp, Homo sapiens
ccagactgcttgcttcccagcc

SEQ ID NO: 1676 - DNA, 22 bp, Homo sapiens
gagccaggttggaggctgcagt

SEQ ID NO: 1677 - DNA, 22 bp, Homo sapiens
cgtgggtcgggactccgcctcg

SEQ ID NO: 1678 - DNA, 22 bp, Homo sapiens
ttgcttcattttgggtgtgcag

SEQ ID NO: 1679 - DNA, 22 bp, Homo sapiens
gagcagtgccaaagaatttgcg

SEQ ID NO: 1680 - DNA, 22 bp, Homo sapiens
ttttggctctgtctgtatcttt

SEQ ID NO: 1681 - DNA, 22 bp, Homo sapiens
ctctgcaagtccagcccctggc

SEQ ID NO: 1682 - DNA, 22 bp, Homo sapiens
tgtgagactttctttggcctct

SEQ ID NO: 1683 - DNA, 22 bp, Homo sapiens
tgtggcccgatcttgggagaca

SEQ ID NO: 1684 - DNA, 22 bp, Homo sapiens
atcgcaagtttaaaaatctttg

SEQ ID NO: 1685 - DNA, 22 bp, Homo sapiens
tgagaaattacttcagtgatgg

SEQ ID NO: 1686 - DNA, 19 bp, Homo sapiens
actgcactttagcctgggc

SEQ ID NO: 1687 - DNA, 22 bp, Homo sapiens
ggccgtgctccaaagtcatcgt

SEQ ID NO: 1688 - DNA, 22 bp, Homo sapiens
attaagactgcccatgttttta

SEQ ID NO: 1689 - DNA, 22 bp, Homo sapiens
tggggcagttaataaacattct

SEQ ID NO: 1690 - DNA, 22 bp, Homo sapiens
atatacacatctttttaaatat

SEQ ID NO: 1691 - DNA, 22 bp, Homo sapiens
gacactgcacttggggcccaca

SEQ ID NO: 1692 - DNA, 22 bp, Homo sapiens
actgtctgtagacatttttggt

SEQ ID NO: 1693 - DNA, 22 bp, Homo sapiens
ttataagctctgaaatctccta

SEQ ID NO: 1694 - DNA, 22 bp, Homo sapiens
caggcagaagaagtggaaggac

SEQ ID NO: 1695 - DNA, 17 bp, Homo sapiens
ggctgcagtccaggagg

SEQ ID NO: 1696 - DNA, 22 bp, Homo sapiens
cgcccccagggcctcgagcatg

SEQ ID NO: 1697 - DNA, 22 bp, Homo sapiens
cttgtgcatttcattcctcagg

SEQ ID NO: 1698 - DNA, 22 bp, Homo sapiens
gagatcggtaaagagcatgcac

SEQ ID NO: 1699 - DNA, 22 bp, Homo sapiens
agcagctcctgtttttgggata

SEQ ID NO: 1700 - DNA, 22 bp, Homo sapiens
gtgcctgcaggtgccggcttca

SEQ ID NO: 1701 - DNA, 22 bp, Homo sapiens
ggagaggggaacttgttgcttg

SEQ ID NO: 1702 - DNA, 20 bp, Homo sapiens
tcagccattccttacctttc

SEQ ID NO: 1703 - DNA, 22 bp, Homo sapiens
gtaaactattctttcaggagct

SEQ ID NO: 1704 - DNA, 22 bp, Homo sapiens
caaatgtataaatgtactttct

SEQ ID NO: 1705 - DNA, 18 bp, Homo sapiens
aggtttggtggaaacata

SEQ ID NO: 1706 - DNA, 22 bp, Homo sapiens
cattccttaacgtggggagtct

SEQ ID NO: 1707 - DNA, 22 bp, Homo sapiens
cacagcgtgatgaatgtagcgt

SEQ ID NO: 1708 - DNA, 21 bp, Homo sapiens
cagagctgtccaaaccctgac

SEQ ID NO: 1709 - DNA, 23 bp, Homo sapiens
aatatcaaggtgatgttcccaga

SEQ ID NO: 1710 - DNA, 22 bp, Homo sapiens
tgaaatgtgttctagtgttttg

SEQ ID NO: 1711 - DNA, 22 bp, Homo sapiens
ccgcaaggcagaggttgcagtg

SEQ ID NO: 1712 - DNA, 22 bp, Homo sapiens
ctccaacgaggctggggtacaa

SEQ ID NO: 1713 - DNA, 22 bp, Homo sapiens
caccttggccttgctatttctc

SEQ ID NO: 1714 - DNA, 22 bp, Homo sapiens
atgcacacgtaccctacaaggc

SEQ ID NO: 1715 - DNA, 22 bp, Homo sapiens
ctgggattacaggcacccgtca

SEQ ID NO: 1716 - DNA, 22 bp, Homo sapiens
tgactcagtacatctggagttg

SEQ ID NO: 1717 - DNA, 22 bp, Homo sapiens
gggggagagacgagcggctctg

SEQ ID NO: 1718 - DNA, 22 bp, Homo sapiens
tgatctaggttggcttcaactg

SEQ ID NO: 1719 - DNA, 22 bp, Homo sapiens
cctgggggccaggaaggtgtga

SEQ ID NO: 1720 - DNA, 22 bp, Homo sapiens
tcactgaaacctccacctctcg

SEQ ID NO: 1721 - DNA, 22 bp, Homo sapiens
gtagggctcagtaaatactttg

SEQ ID NO: 1722 - DNA, 22 bp, Homo sapiens
attgtaacagacacatcagatt

SEQ ID NO: 1723 - DNA, 22 bp, Homo sapiens
atcatgacatacttttgagaag

SEQ ID NO: 1724 - DNA, 22 bp, Homo sapiens
atgggatgatcacctgagctca

SEQ ID NO: 1725 - DNA, 22 bp, Homo sapiens
ttgtggttaaccgcacattttt

SEQ ID NO: 1726 - DNA, 22 bp, Homo sapiens
cagtaatagaggctttgagtct

SEQ ID NO: 1727 - DNA, 22 bp, Homo sapiens
ctgagatctttatacgaggcac

SEQ ID NO: 1728 - DNA, 22 bp, Homo sapiens
agcaccgttcaaacccaggtta

SEQ ID NO: 1729 - DNA, 22 bp, Homo sapiens
gggctgggattgcttgctgtga

SEQ ID NO: 1730 - DNA, 22 bp, Homo sapiens
agatttggtgtctggttgatat

SEQ ID NO: 1731 - DNA, 22 bp, Homo sapiens
ttcctgttcaggaaagttgtgt

SEQ ID NO: 1732 - DNA, 22 bp, Homo sapiens
atatagacagatgacagggata

SEQ ID NO: 1733 - DNA, 22 bp, Homo sapiens
ctttgcttgacactgtgattgt

SEQ ID NO: 1734 - DNA, 22 bp, Homo sapiens
cagatctgtggtatctctattt

SEQ ID NO: 1735 - DNA, 22 bp, Homo sapiens
gctcagacctgtaatcttagca

SEQ ID NO: 1736 - DNA, 22 bp, Homo sapiens
gcctcggggacacccgcaccac

SEQ ID NO: 1737 - DNA, 22 bp, Homo sapiens
tcccagtttttctccactaagg

SEQ ID NO: 1738 - DNA, 22 bp, Homo sapiens
tggagaattctatgttgagggg

SEQ ID NO: 1739 - DNA, 22 bp, Homo sapiens
agcttgggcaacacagcaagac

SEQ ID NO: 1740 - DNA, 22 bp, Homo sapiens
tggcaaaatgagcaattacttt

SEQ ID NO: 1741 - DNA, 22 bp, Homo sapiens
tgccaggcgtggtggtgcgcac

SEQ ID NO: 1742 - DNA, 22 bp, Homo sapiens
gacttctgaattcctatcaggt

SEQ ID NO: 1743 - DNA, 22 bp, Homo sapiens
attctggacaaggcaagctcct

SEQ ID NO: 1744 - DNA, 22 bp, Homo sapiens
aacagtgtttttcttcagcact

SEQ ID NO: 1745 - DNA, 20 bp, Homo sapiens
atcaggtgttcagccactgc

SEQ ID NO: 1746 - DNA, 19 bp, Homo sapiens
caggcctcttaccctctct

SEQ ID NO: 1747 - DNA, 22 bp, Homo sapiens
tgcgcggctcagtcatctccag

SEQ ID NO: 1748 - DNA, 22 bp, Homo sapiens
gggagcctgtggatgtctgact

SEQ ID NO: 1749 - DNA, 22 bp, Homo sapiens
aagaggagaaaggctggctttg

SEQ ID NO: 1750 - DNA, 22 bp, Homo sapiens
cctgtggcgggggccagtgcct

SEQ ID NO: 1751 - DNA, 22 bp, Homo sapiens
tgtcttcaggagtaaatatcat

SEQ ID NO: 1752 - DNA, 22 bp, Homo sapiens
tgtaccgccttgtggggttggg

SEQ ID NO: 1753 - DNA, 22 bp, Homo sapiens
gcccccgaggaggtgatgtcgc

SEQ ID NO: 1754 - DNA, 22 bp, Homo sapiens
tgtgagttattttcaggagttt

SEQ ID NO: 1755 - DNA, 22 bp, Homo sapiens
tttggcggactgagaacgcggg

SEQ ID NO: 1756 - DNA, 22 bp, Homo sapiens
gtgcaattcactgttatgtctg

SEQ ID NO: 1757 - DNA, 22 bp, Homo sapiens
gaggttggggctgcagtgagct

SEQ ID NO: 1758 - DNA, 22 bp, Homo sapiens
tgaaatcttcactaagtctctt

SEQ ID NO: 1759 - DNA, 22 bp, Homo sapiens
aaagggaagttgcacatgttcc

SEQ ID NO: 1760 - DNA, 22 bp, Homo sapiens
gttactcttgagaggctgaggt

SEQ ID NO: 1761 - DNA, 22 bp, Homo sapiens
gaaacactcaatttagtaattc

SEQ ID NO: 1762 - DNA, 22 bp, Homo sapiens
acccaataatgcaactccactt

SEQ ID NO: 1763 - DNA, 22 bp, Homo sapiens
ctgtgatttctaaagagtagca

SEQ ID NO: 1764 - DNA, 22 bp, Homo sapiens
agtgagagtattaatgtgaact

SEQ ID NO: 1765 - DNA, 22 bp, Homo sapiens
actgcactccagcctgggcggc

SEQ ID NO: 1766 - DNA, 22 bp, Homo sapiens
ctctgtggtggagtgggtcacc

SEQ ID NO: 1767 - DNA, 22 bp, Homo sapiens
tggtatgaccgtggtgcaagca

SEQ ID NO: 1768 - DNA, 22 bp, Homo sapiens
aacggctgtggctggcggcagc

SEQ ID NO: 1769 - DNA, 22 bp, Homo sapiens
ttccgagtctccaaggggttgt

SEQ ID NO: 1770 - DNA, 22 bp, Homo sapiens
tgcgcctctaatctcgggcgtc

SEQ ID NO: 1771 - DNA, 22 bp, Homo sapiens
gtcagtaggaacctagggtcaa

SEQ ID NO: 1772 - DNA, 22 bp, Homo sapiens
gcaggatgagtgagtacattta

SEQ ID NO: 1773 - DNA, 23 bp, Homo sapiens
cgtcttgtcctcgggcgcctggg

SEQ ID NO: 1774 - DNA, 22 bp, Homo sapiens
ttaatgaaaggcagtttggaac

SEQ ID NO: 1775 - DNA, 22 bp, Homo sapiens
aggctgtgtgctccttatgaga

SEQ ID NO: 1776 - DNA, 22 bp, Homo sapiens
agagcacagccaccatttacaa

SEQ ID NO: 1777 - DNA, 22 bp, Homo sapiens
agccacatggacctgatgctag

SEQ ID NO: 1778 - DNA, 22 bp, Homo sapiens
taagcccaggaatgcacttcag

SEQ ID NO: 1779 - DNA, 22 bp, Homo sapiens
gttctgagtcctcctttgaagg

SEQ ID NO: 1780 - DNA, 22 bp, Homo sapiens
atgcaactacccccaggatttt

SEQ ID NO: 1781 - DNA, 22 bp, Homo sapiens
gagagttagttgagcagtctga

SEQ ID NO: 1782 - DNA, 22 bp, Homo sapiens
tgagccaggagtttgaggctgt

SEQ ID NO: 1783 - DNA, 22 bp, Homo sapiens
ttgctgacctttgctctccgtt

SEQ ID NO: 1784 - DNA, 22 bp, Homo sapiens
ttatgggagcaattggggaggt

SEQ ID NO: 1785 - DNA, 22 bp, Homo sapiens
gcaagacctatctagttgctgt

SEQ ID NO: 1786 - DNA, 22 bp, Homo sapiens
agttcaacaccagcctgaccaa

SEQ ID NO: 1787 - DNA, 22 bp, Homo sapiens
ctctccattccctacagttttc

SEQ ID NO: 1788 - DNA, 22 bp, Homo sapiens
agcagcttgaggctggattcca

SEQ ID NO: 1789 - DNA, 21 bp, Homo sapiens
ctacttaagtaggggattagg

SEQ ID NO: 1790 - DNA, 22 bp, Homo sapiens
aagtgctgggattacaggtgtg

SEQ ID NO: 1791 - DNA, 22 bp, Homo sapiens
cttcaggggtgttagttttgtg

SEQ ID NO: 1792 - DNA, 20 bp, Homo sapiens
aaacgagccatcattctggt

SEQ ID NO: 1793 - DNA, 22 bp, Homo sapiens
ggtgccagatgaggcccgcgat

SEQ ID NO: 1794 - DNA, 22 bp, Homo sapiens
cagcagagaaattacatatttg

SEQ ID NO: 1795 - DNA, 22 bp, Homo sapiens
tggctttctcacagaccacctc

SEQ ID NO: 1796 - DNA, 22 bp, Homo sapiens
cctgaggatgccagcatgggtg

SEQ ID NO: 1797 - DNA, 22 bp, Homo sapiens
tgctgaataagacgtggcttgt

SEQ ID NO: 1798 - DNA, 22 bp, Homo sapiens
tctggctccaggaccgggcaca

SEQ ID NO: 1799 - DNA, 19 bp, Homo sapiens
tctgaagaattagagagca

SEQ ID NO: 1800 - DNA, 22 bp, Homo sapiens
aataaacaaaggacaaggaggt

SEQ ID NO: 1801 - DNA, 22 bp, Homo sapiens
gttatacgcctgtcaggaagct

SEQ ID NO: 1802 - DNA, 22 bp, Homo sapiens
gctcggtggccagcctgaggcc

SEQ ID NO: 1803 - DNA, 22 bp, Homo sapiens
acatgtttaagtttgttatatg

SEQ ID NO: 1804 - DNA, 22 bp, Homo sapiens
aaagaggcaatcaatgtagcaa

SEQ ID NO: 1805 - DNA, 22 bp, Homo sapiens
tacttttcctggaaccactgct

SEQ ID NO: 1806 - DNA, 22 bp, Homo sapiens
acctgtgctttcaaggagctca

SEQ ID NO: 1807 - DNA, 22 bp, Homo sapiens
tagtggatgttcagagatttga

SEQ ID NO: 1808 - DNA, 22 bp, Homo sapiens
ccggtcccaggtgccccggtga

SEQ ID NO: 1809 - DNA, 22 bp, Homo sapiens
tggaagggagctggaatttgga

SEQ ID NO: 1810 - DNA, 22 bp, Homo sapiens
gctaatcaatgttaaggctgtg

SEQ ID NO: 1811 - DNA, 22 bp, Homo sapiens
tgatattttatgagctttcata

SEQ ID NO: 1812 - DNA, 22 bp, Homo sapiens
tgtgggtggcatcgtcctggcc

SEQ ID NO: 1813 - DNA, 22 bp, Homo sapiens
gccgggttcaagccattctcct

SEQ ID NO: 1814 - DNA, 22 bp, Homo sapiens
gccagccagaaacgtcacactg

SEQ ID NO: 1815 - DNA, 22 bp, Homo sapiens
tgcctctgaggaagattgtgtt

SEQ ID NO: 1816 - DNA, 22 bp, Homo sapiens
gagcagtgtttgtggacctgga

SEQ ID NO: 1817 - DNA, 22 bp, Homo sapiens
ccctgctgtcaggtgctgggag

SEQ ID NO: 1818 - DNA, 22 bp, Homo sapiens
tgtgatgaagagtccaagaaca

SEQ ID NO: 1819 - DNA, 22 bp, Homo sapiens
tctgacattttgagaatgacat

SEQ ID NO: 1820 - DNA, 22 bp, Homo sapiens
ccacccgtcctgctcgggccgc

SEQ ID NO: 1821 - DNA, 22 bp, Homo sapiens
tctaccctgcggtcttggggca

SEQ ID NO: 1822 - DNA, 22 bp, Homo sapiens
cctgagcttacaatttaagaac

SEQ ID NO: 1823 - DNA, 22 bp, Homo sapiens
atttggcagtataaattctggc

SEQ ID NO: 1824 - DNA, 22 bp, Homo sapiens
tcccagcgcggggggaggatcc

SEQ ID NO: 1825 - DNA, 22 bp, Homo sapiens
tttagggacaagggtctggggt

SEQ ID NO: 1826 - DNA, 22 bp, Homo sapiens
ctcactgaaacctccgcctccc

SEQ ID NO: 1827 - DNA, 22 bp, Homo sapiens
aggaggcagtctgtcccttagc

SEQ ID NO: 1828 - DNA, 22 bp, Homo sapiens
ctttttcactgtgtcctcacac

SEQ ID NO: 1829 - DNA, 22 bp, Homo sapiens
cctggtgctgctatcaggggta

SEQ ID NO: 1830 - DNA, 22 bp, Homo sapiens
gcagccatcacgatgaactcag

SEQ ID NO: 1831 - DNA, 22 bp, Homo sapiens
gctgggtgattcatttccataa

SEQ ID NO: 1832 - DNA, 22 bp, Homo sapiens
acccattgctagagagagtgtg

SEQ ID NO: 1833 - DNA, 22 bp, Homo sapiens
taattagtgtccagcttctgct

SEQ ID NO: 1834 - DNA, 18 bp, Homo sapiens
tggaggaaaaatctcatg

SEQ ID NO: 1835 - DNA, 22 bp, Homo sapiens
gccacctggtggcatcttctgg

SEQ ID NO: 1836 - DNA, 22 bp, Homo sapiens
aatgccttggagagcctagagg

SEQ ID NO: 1837 - DNA, 22 bp, Homo sapiens
caggccggggcggcgccatctt

SEQ ID NO: 1838 - DNA, 22 bp, Homo sapiens
tcgggggcttgaggatcaaatg

SEQ ID NO: 1839 - DNA, 22 bp, Homo sapiens
gccttgagctgcacggccaggt

SEQ ID NO: 1840 - DNA, 22 bp, Homo sapiens
aggggtgacacatatcagtgca

SEQ ID NO: 1841 - DNA, 22 bp, Homo sapiens
ccaggctagaaactgaggcaca

SEQ ID NO: 1842 - DNA, 22 bp, Homo sapiens
cccgactagctgggattacagg

SEQ ID NO: 1843 - DNA, 22 bp, Homo sapiens
tcccacacagcccgctcaccgg

SEQ ID NO: 1844 - DNA, 22 bp, Homo sapiens
tgcccaggctggagtgcagtgg

SEQ ID NO: 1845 - DNA, 22 bp, Homo sapiens
gggcagagactcagaaacagaa

SEQ ID NO: 1846 - DNA, 22 bp, Homo sapiens
tagagtgtcataacagtgccca

SEQ ID NO: 1847 - DNA, 22 bp, Homo sapiens
cctctgatgggcacagggtggc

SEQ ID NO: 1848 - DNA, 20 bp, Homo sapiens
tctgcggaaagggagggtgg

SEQ ID NO: 1849 - DNA, 22 bp, Homo sapiens
ctttcaggagaggattataaca

SEQ ID NO: 1850 - DNA, 22 bp, Homo sapiens
acgcagtttgtggacatttttt

SEQ ID NO: 1851 - DNA, 22 bp, Homo sapiens
accgcagtgacgtgggacttcc

SEQ ID NO: 1852 - DNA, 20 bp, Homo sapiens
gtgtggccaggagctgcgct

SEQ ID NO: 1853 - DNA, 22 bp, Homo sapiens
tatgccactgctctccatccta

SEQ ID NO: 1854 - DNA, 22 bp, Homo sapiens
tgcaaatgtgttttaaaccaaa

SEQ ID NO: 1855 - DNA, 22 bp, Homo sapiens
tggtctgctgaacagccgtatc

SEQ ID NO: 1856 - DNA, 19 bp, Homo sapiens
gatgctcattcaggtggaa

SEQ ID NO: 1857 - DNA, 22 bp, Homo sapiens
aagagggctgcaatcttattgc

SEQ ID NO: 1858 - DNA, 21 bp, Homo sapiens
agtggctctcagcttgctaag

SEQ ID NO: 1859 - DNA, 22 bp, Homo sapiens
gcgacgcaggcacgacgtgttg

SEQ ID NO: 1860 - DNA, 22 bp, Homo sapiens
ggtattgttctagctttaaagg

SEQ ID NO: 1861 - DNA, 22 bp, Homo sapiens
accagcctggccaacatggtga

SEQ ID NO: 1862 - DNA, 22 bp, Homo sapiens
ctctgcctcagtgatttcttta

SEQ ID NO: 1863 - DNA, 22 bp, Homo sapiens
ggttcccggatctccgagtccc

SEQ ID NO: 1864 - DNA, 22 bp, Homo sapiens
ttgttccaacctaatagatgat

SEQ ID NO: 1865 - DNA, 22 bp, Homo sapiens
ttgtgaatagtgccgcaataaa

SEQ ID NO: 1866 - DNA, 22 bp, Homo sapiens
atgaagcgttcgagataggtag

SEQ ID NO: 1867 - DNA, 22 bp, Homo sapiens
gccagcagcttcttctcatcct

SEQ ID NO: 1868 - DNA, 22 bp, Homo sapiens
gggtccctggaattacttgaca

SEQ ID NO: 1869 - DNA, 22 bp, Homo sapiens
agagctaagaaacagaattgct

SEQ ID NO: 1870 - DNA, 22 bp, Homo sapiens
gggcaggaacaaatcaaatgat

SEQ ID NO: 1871 - DNA, 22 bp, Homo sapiens
gcttttgcctacatcttggtct

SEQ ID NO: 1872 - DNA, 22 bp, Homo sapiens
ggtcctgtgagatgtatgcatt

SEQ ID NO: 1873 - DNA, 17 bp, Homo sapiens
tggctctgtcctcagct

SEQ ID NO: 1874 - DNA, 22 bp, Homo sapiens
atggccaggcacctctggctga

SEQ ID NO: 1875 - DNA, 20 bp, Homo sapiens
aagcagtgaggtgaggagtg

SEQ ID NO: 1876 - DNA, 22 bp, Homo sapiens
ttccagttcactccatttctgg

SEQ ID NO: 1877 - DNA, 22 bp, Homo sapiens
acccaggctggagtgcagtggc

SEQ ID NO: 1878 - DNA, 22 bp, Homo sapiens
ttactttaagggtgtcttatta

SEQ ID NO: 1879 - DNA, 22 bp, Homo sapiens
tccccagcttgctacttctgct

SEQ ID NO: 1880 - DNA, 22 bp, Homo sapiens
atgaggcaggtggaggctgcca

SEQ ID NO: 1881 - DNA, 22 bp, Homo sapiens
ctagcctgggatttgaacttat

SEQ ID NO: 1882 - DNA, 22 bp, Homo sapiens
cttccctctgctccttggtcca

SEQ ID NO: 1883 - DNA, 22 bp, Homo sapiens
cccaggaggtcgaagctgcagt

SEQ ID NO: 1884 - DNA, 22 bp, Homo sapiens
cccagaaggtcgaggctgcagt

SEQ ID NO: 1885 - DNA, 22 bp, Homo sapiens
tgtatattctgcctaaaagctt

SEQ ID NO: 1886 - DNA, 22 bp, Homo sapiens
gaattcgggtactctaggccag

SEQ ID NO: 1887 - DNA, 22 bp, Homo sapiens
aaaccgcaatcacttttgcacc

SEQ ID NO: 1888 - DNA, 22 bp, Homo sapiens
gtgcgccagctcaaggggaggc

SEQ ID NO: 1889 - DNA, 22 bp, Homo sapiens
tgggatgccggcaggaggcaat

SEQ ID NO: 1890 - DNA, 22 bp, Homo sapiens
tgagcaggcgcagcaggaggtc

SEQ ID NO: 1891 - DNA, 22 bp, Homo sapiens
cttctcggggttcccgcgccct

SEQ ID NO: 1892 - DNA, 22 bp, Homo sapiens
tcttggattttaatggatcaaa

SEQ ID NO: 1893 - DNA, 20 bp, Homo sapiens
ctgtggaattttaccatgcg

SEQ ID NO: 1894 - DNA, 22 bp, Homo sapiens
aataaaatggtcagttttctca

SEQ ID NO: 1895 - DNA, 22 bp, Homo sapiens
ggtttgttggggtccaggccca

SEQ ID NO: 1896 - DNA, 22 bp, Homo sapiens
aaccattcactgaacagttcaa

SEQ ID NO: 1897 - DNA, 21 bp, Homo sapiens
agaaggcaaaagcagacatct

SEQ ID NO: 1898 - DNA, 22 bp, Homo sapiens
actgcactccagcctcggggtc

SEQ ID NO: 1899 - DNA, 22 bp, Homo sapiens
gagaactttctgtgtttttatc

SEQ ID NO: 1900 - DNA, 22 bp, Homo sapiens
tgcaataactactttaatgttg

SEQ ID NO: 1901 - DNA, 22 bp, Homo sapiens
gcgaatctcagctggtgctgcg

SEQ ID NO: 1902 - DNA, 22 bp, Homo sapiens
tggtatgtaaattgtaactcaa

SEQ ID NO: 1903 - DNA, 22 bp, Homo sapiens
ttacaggtgtgagccaccccac

SEQ ID NO: 1904 - DNA, 22 bp, Homo sapiens
atcgccgaggtcctgctccaag

SEQ ID NO: 1905 - DNA, 22 bp, Homo sapiens
tccacaggtccggcatgaacag

SEQ ID NO: 1906 - DNA, 20 bp, Homo sapiens
agatacagtggtttctttag

SEQ ID NO: 1907 - DNA, 22 bp, Homo sapiens
ctggaggccactgtacagattg

SEQ ID NO: 1908 - DNA, 22 bp, Homo sapiens
gttggtcctttgagcaagatcc

SEQ ID NO: 1909 - DNA, 23 bp, Homo sapiens
ttgtcctctggatcggtttggtt

SEQ ID NO: 1910 - DNA, 22 bp, Homo sapiens
ctgccgttgtgaagctcttaga

SEQ ID NO: 1911 - DNA, 22 bp, Homo sapiens
gctccgccacgcccactcctac

SEQ ID NO: 1912 - DNA, 22 bp, Homo sapiens
tgggcttaggtcggaggcggcc

SEQ ID NO: 1913 - DNA, 22 bp, Homo sapiens
tgagccaagatcatgccgttgt

SEQ ID NO: 1914 - DNA, 22 bp, Homo sapiens
gggtccaggcggcatagttgta

SEQ ID NO: 1915 - DNA, 22 bp, Homo sapiens
ccgcggggtcatggctgggccg

SEQ ID NO: 1916 - DNA, 22 bp, Homo sapiens
aacgtcctcacctgtaacttgg

SEQ ID NO: 1917 - DNA, 22 bp, Homo sapiens
agggaagaaaatccatcgctgc

SEQ ID NO: 1918 - DNA, 22 bp, Homo sapiens
aggaattggcacggccttctca

SEQ ID NO: 1919 - DNA, 22 bp, Homo sapiens
ctgccgtgtttttcatgttaaa

SEQ ID NO: 1920 - DNA, 22 bp, Homo sapiens
gactttgctgtgtcagcttcag

SEQ ID NO: 1921 - DNA, 22 bp, Homo sapiens
tctacatgcagcgaggggactt

SEQ ID NO: 1922 - DNA, 22 bp, Homo sapiens
tggtgccatcatagctcactgc

SEQ ID NO: 1923 - DNA, 22 bp, Homo sapiens
aacactgcctacactttatgaa

SEQ ID NO: 1924 - DNA, 22 bp, Homo sapiens
attgtcagtttaatatagtcaa

SEQ ID NO: 1925 - DNA, 22 bp, Homo sapiens
ctggcctaggaatggttttccg

SEQ ID NO: 1926 - DNA, 22 bp, Homo sapiens
gctgtgcagaggtgagaatcca

SEQ ID NO: 1927 - DNA, 23 bp, Homo sapiens
tgtgggcgcattgtaagggtagc

SEQ ID NO: 1928 - DNA, 22 bp, Homo sapiens
gctggtgtttcccgcggctcca

SEQ ID NO: 1929 - DNA, 22 bp, Homo sapiens
tttcggccaactcttttcagtt

SEQ ID NO: 1930 - DNA, 22 bp, Homo sapiens
caaagggaaaagccatgtgggc

SEQ ID NO: 1931 - DNA, 22 bp, Homo sapiens
gattcagcctctgcttccctga

SEQ ID NO: 1932 - DNA, 21 bp, Homo sapiens
ggtgtgggatggactgaacca

SEQ ID NO: 1933 - DNA, 22 bp, Homo sapiens
tcctggcttgtcacatctacgt

SEQ ID NO: 1934 - DNA, 22 bp, Homo sapiens
gggtcgggcaggcgccctcgtc

SEQ ID NO: 1935 - DNA, 22 bp, Homo sapiens
aagtcgtggcaggcttgcacga

SEQ ID NO: 1936 - DNA, 22 bp, Homo sapiens
caggcggtggctcctggctgag

SEQ ID NO: 1937 - DNA, 22 bp, Homo sapiens
cattgcactcctgcctgggcaa

SEQ ID NO: 1938 - DNA, 18 bp, Homo sapiens
atgagaggtgtcagaaga

SEQ ID NO: 1939 - DNA, 22 bp, Homo sapiens
aagggcatgagaagcttgaaag

SEQ ID NO: 1940 - DNA, 22 bp, Homo sapiens
ggcctcttatctggctcctgca

SEQ ID NO: 1941 - DNA, 22 bp, Homo sapiens
gtagatgagctcacatgacctt

SEQ ID NO: 1942 - DNA, 22 bp, Homo sapiens
agaacctctggatacagtttaa

SEQ ID NO: 1943 - DNA, 22 bp, Homo sapiens
acccccaagaggggccttcagc

SEQ ID NO: 1944 - DNA, 19 bp, Homo sapiens
tggctattccttggacaca

SEQ ID NO: 1945 - DNA, 22 bp, Homo sapiens
ttcatataccttgcgtttcaca

SEQ ID NO: 1946 - DNA, 22 bp, Homo sapiens
ctgcgtggtaggactcagttct

SEQ ID NO: 1947 - DNA, 22 bp, Homo sapiens
gcctcatcgctgctcggcccgg

SEQ ID NO: 1948 - DNA, 21 bp, Homo sapiens
tctgagactgggttagaatgt

SEQ ID NO: 1949 - DNA, 22 bp, Homo sapiens
gttaagtgagggcttttgagtc

SEQ ID NO: 1950 - DNA, 22 bp, Homo sapiens
gctccccaaaagctccaggaaa

SEQ ID NO: 1951 - DNA, 22 bp, Homo sapiens
ctgggcacagcgttgggctctt

SEQ ID NO: 1952 - DNA, 22 bp, Homo sapiens
gctccgtgggcattgctaggtg

SEQ ID NO: 1953 - DNA, 22 bp, Homo sapiens
ggagactgatctgagtgataac

SEQ ID NO: 1954 - DNA, 22 bp, Homo sapiens
cagtgagctcatggccaagtca

SEQ ID NO: 1955 - DNA, 22 bp, Homo sapiens
gcctcaaatgtggagcactatt

SEQ ID NO: 1956 - DNA, 22 bp, Homo sapiens
ccaggaggttgaggctgcagtg

SEQ ID NO: 1957 - DNA, 14 bp, Homo sapiens
gcaggcagatcacc

SEQ ID NO: 1958 - DNA, 23 bp, Homo sapiens
actctcaggttctttccagcagg

SEQ ID NO: 1959 - DNA, 21 bp, Homo sapiens
acagcctccatctcctgggct

SEQ ID NO: 1960 - DNA, 22 bp, Homo sapiens
agtgcattcctggggaagaagc

SEQ ID NO: 1961 - DNA, 23 bp, Homo sapiens
tgaggcaggcggatcacgaggtc

SEQ ID NO: 1962 - DNA, 22 bp, Homo sapiens
aagaggtagcagtcacaaaaga

SEQ ID NO: 1963 - DNA, 22 bp, Homo sapiens
ccctaagaagcaaagtgatacc

SEQ ID NO: 1964 - DNA, 22 bp, Homo sapiens
ccgtggtcacctgagctccttg

SEQ ID NO: 1965 - DNA, 22 bp, Homo sapiens
caatcaatgctgctagttcctt

SEQ ID NO: 1966 - DNA, 22 bp, Homo sapiens
aatgcaatgcagcacctccttg

SEQ ID NO: 1967 - DNA, 22 bp, Homo sapiens
cagtttcttcctcccccagaga

SEQ ID NO: 1968 - DNA, 22 bp, Homo sapiens
tcccaggccacacttggggaac

SEQ ID NO: 1969 - DNA, 22 bp, Homo sapiens
tctcccaggcaggagtgcagtg

SEQ ID NO: 1970 - DNA, 22 bp, Homo sapiens
tcacccaggctggagtgcagtg

SEQ ID NO: 1971 - DNA, 22 bp, Homo sapiens
cgcggtgtagtcgtacatccca

SEQ ID NO: 1972 - DNA, 21 bp, Homo sapiens
tttcaagggaccctggggatc

SEQ ID NO: 1973 - DNA, 22 bp, Homo sapiens
ggtcccaggttgacagggagac

SEQ ID NO: 1974 - DNA, 22 bp, Homo sapiens
ggtgactagataagccccatgg

SEQ ID NO: 1975 - DNA, 22 bp, Homo sapiens
gcttagtcaattataaataggc

SEQ ID NO: 1976 - DNA, 22 bp, Homo sapiens
aaactagctcttagtttagagg

SEQ ID NO: 1977 - DNA, 22 bp, Homo sapiens
tctttcattctagtctgaggtt

SEQ ID NO: 1978 - DNA, 22 bp, Homo sapiens
tctgtgttgagaaggatcatga

SEQ ID NO: 1979 - DNA, 22 bp, Homo sapiens
ttcgctgggagtggccaggcac

SEQ ID NO: 1980 - DNA, 22 bp, Homo sapiens
ggcgcggtgactcagcctcgct

SEQ ID NO: 1981 - DNA, 22 bp, Homo sapiens
tgtaatcccagctactcgggag

SEQ ID NO: 1982 - DNA, 22 bp, Homo sapiens
acaatgaagctccactgagctt

SEQ ID NO: 1983 - DNA, 22 bp, Homo sapiens
atttagacatgtatctgatagc

SEQ ID NO: 1984 - DNA, 21 bp, Homo sapiens
agtagtttagcacagggtttg

SEQ ID NO: 1985 - DNA, 22 bp, Homo sapiens
agagcagctcgctacctctcta

SEQ ID NO: 1986 - DNA, 22 bp, Homo sapiens
ctgatctcaagtgatccaccca

SEQ ID NO: 1987 - DNA, 18 bp, Homo sapiens
taggttacagccagccag

SEQ ID NO: 1988 - DNA, 22 bp, Homo sapiens
tgttcttaggtatttgacagtc

SEQ ID NO: 1989 - DNA, 22 bp, Homo sapiens
cctctgtgtctccaagaggcct

SEQ ID NO: 1990 - DNA, 22 bp, Homo sapiens
tggggatcataaattgatggag

SEQ ID NO: 1991 - DNA, 22 bp, Homo sapiens
aatttctgctgagcactgggcc

SEQ ID NO: 1992 - DNA, 22 bp, Homo sapiens
gagccaggtcgggccgcggcga

SEQ ID NO: 1993 - DNA, 22 bp, Homo sapiens
gtggtgtaggtcacagttagga

SEQ ID NO: 1994 - DNA, 22 bp, Homo sapiens
tgaagactcagaagctaagata

SEQ ID NO: 1995 - DNA, 22 bp, Homo sapiens
tcttcatgtcatggtatattga

SEQ ID NO: 1996 - DNA, 21 bp, Homo sapiens
gccagcggccgccctccagga

SEQ ID NO: 1997 - DNA, 22 bp, Homo sapiens
aaagtgctgaaattacaggggt

SEQ ID NO: 1998 - DNA, 22 bp, Homo sapiens
atgaggcaggagtgcagtggca

SEQ ID NO: 1999 - DNA, 22 bp, Homo sapiens
tctccgatcacaggttttcaat

SEQ ID NO: 2000 - DNA, 22 bp, Homo sapiens
ttaaattttagaaacagactct

SEQ ID NO: 2001 - DNA, 22 bp, Homo sapiens
ggggaaagccagccctgcttcc

SEQ ID NO: 2002 - DNA, 22 bp, Homo sapiens
ggagtgcagtggtgggatctca

SEQ ID NO: 2003 - DNA, 22 bp, Homo sapiens
caatttctaacattccatggat

SEQ ID NO: 2004 - DNA, 22 bp, Homo sapiens
ttcccaggaagcctctccaagc

SEQ ID NO: 2005 - DNA, 22 bp, Homo sapiens
gagccgaggcgcacagctcggg

SEQ ID NO: 2006 - DNA, 22 bp, Homo sapiens
ttccaatagtgtgaccttatag

SEQ ID NO: 2007 - DNA, 20 bp, Homo sapiens
gggcagtggcgctatctcag

SEQ ID NO: 2008 - DNA, 20 bp, Homo sapiens
gagattaactgagaatctag

SEQ ID NO: 2009 - DNA, 22 bp, Homo sapiens
atgcagaagactgaaaagctga

SEQ ID NO: 2010 - DNA, 22 bp, Homo sapiens
acacagggctgcgcctgacccc

SEQ ID NO: 2011 - DNA, 22 bp, Homo sapiens
atcgatcccgcgtaaggccccg

SEQ ID NO: 2012 - DNA, 22 bp, Homo sapiens
cactccagatcacaccccttgg

SEQ ID NO: 2013 - DNA, 22 bp, Homo sapiens
tcacagctctgtcaattttata

SEQ ID NO: 2014 - DNA, 22 bp, Homo sapiens
tctgtgctaggcagcctggccc

SEQ ID NO: 2015 - DNA, 22 bp, Homo sapiens
tcgcggggaagtggtgggctaa

SEQ ID NO: 2016 - DNA, 22 bp, Homo sapiens
tctgactttggacagtggcgaa

SEQ ID NO: 2017 - DNA, 22 bp, Homo sapiens
aaagcagggaaatctatttgca

SEQ ID NO: 2018 - DNA, 22 bp, Homo sapiens
ctggatcatgggaaagggatca

SEQ ID NO: 2019 - DNA, 22 bp, Homo sapiens
ctgtccccacccaaatctcatc

SEQ ID NO: 2020 - DNA, 22 bp, Homo sapiens
ctctgcaacttctagcagtgtc

SEQ ID NO: 2021 - DNA, 22 bp, Homo sapiens
tccagatgctgcacattcctga

SEQ ID NO: 2022 - DNA, 22 bp, Homo sapiens
caaccgcggggcccagcggttc

SEQ ID NO: 2023 - DNA, 22 bp, Homo sapiens
ttggagaggcagtcttgctctg

SEQ ID NO: 2024 - DNA, 18 bp, Homo sapiens
tccctcagaattatagaa

SEQ ID NO: 2025 - DNA, 22 bp, Homo sapiens
ctgtcctgccagtcctggactc

SEQ ID NO: 2026 - DNA, 22 bp, Homo sapiens
ccacaggggcccacgagccgct

SEQ ID NO: 2027 - DNA, 22 bp, Homo sapiens
ggcgggcagcgtcttgctggcc

SEQ ID NO: 2028 - DNA, 22 bp, Homo sapiens
tgttatcctcagctcacctcta

SEQ ID NO: 2029 - DNA, 22 bp, Homo sapiens
tgattatgcatgagacagtact

SEQ ID NO: 2030 - DNA, 22 bp, Homo sapiens
gaatgcaaactggggcaccgtt

SEQ ID NO: 2031 - DNA, 22 bp, Homo sapiens
agttggcttcaaaggcagagag

SEQ ID NO: 2032 - DNA, 22 bp, Homo sapiens
acatcttttactctggttcggg

SEQ ID NO: 2033 - DNA, 22 bp, Homo sapiens
gtctcttagaaccttgttttgg

SEQ ID NO: 2034 - DNA, 22 bp, Homo sapiens
cccaactactctcaggcagctt

SEQ ID NO: 2035 - DNA, 19 bp, Homo sapiens
agataagagttgactgtgg

SEQ ID NO: 2036 - DNA, 22 bp, Homo sapiens
gagctctgactgctgggtgaca

SEQ ID NO: 2037 - DNA, 22 bp, Homo sapiens
cagtggcctctggctttgctgt

SEQ ID NO: 2038 - DNA, 22 bp, Homo sapiens
tgtaagtagtaatggaaggaca

SEQ ID NO: 2039 - DNA, 22 bp, Homo sapiens
aacccacaaaggatttcagctc

SEQ ID NO: 2040 - DNA, 22 bp, Homo sapiens
cctgggacttggtctggggttt

SEQ ID NO: 2041 - DNA, 22 bp, Homo sapiens
tgagcctgtcattattcagaga

SEQ ID NO: 2042 - DNA, 20 bp, Homo sapiens
tgttctgtcgtctttcttca

SEQ ID NO: 2043 - DNA, 22 bp, Homo sapiens
gccaccccataggtgttaggtg

SEQ ID NO: 2044 - DNA, 22 bp, Homo sapiens
acttgctggctccttgcttcta

SEQ ID NO: 2045 - DNA, 21 bp, Homo sapiens
taggtgggagccccagtatgc

SEQ ID NO: 2046 - DNA, 22 bp, Homo sapiens
gggcactcagctgtagagcagg

SEQ ID NO: 2047 - DNA, 22 bp, Homo sapiens
agcgagtgggtcagcgttgcag

SEQ ID NO: 2048 - DNA, 22 bp, Homo sapiens
gagggaaaggttaatacatgat

SEQ ID NO: 2049 - DNA, 22 bp, Homo sapiens
ctgagcagatgaccagccccag

SEQ ID NO: 2050 - DNA, 21 bp, Homo sapiens
aggattccagcacactgcttc

SEQ ID NO: 2051 - DNA, 22 bp, Homo sapiens
aggtcacccgtttgactatcca

SEQ ID NO: 2052 - DNA, 22 bp, Homo sapiens
tccgttttcacactgctataaa

SEQ ID NO: 2053 - DNA, 22 bp, Homo sapiens
ctacttgttcactgtaggtcgc

SEQ ID NO: 2054 - DNA, 22 bp, Homo sapiens
cagtaatgggcaagacaatatg

SEQ ID NO: 2055 - DNA, 22 bp, Homo sapiens
gggatcgtcatggaaagtgcta

SEQ ID NO: 2056 - DNA, 23 bp, Homo sapiens
ctgtggatctagagggggcccta

SEQ ID NO: 2057 - DNA, 22 bp, Homo sapiens
tttgggcaggcttttccctaga

SEQ ID NO: 2058 - DNA, 22 bp, Homo sapiens
cctggctgacagcttaattcca

SEQ ID NO: 2059 - DNA, 22 bp, Homo sapiens
cacggcctgtaaggacccagga

SEQ ID NO: 2060 - DNA, 22 bp, Homo sapiens
gcggccttgtggcggagcaggc

SEQ ID NO: 2061 - DNA, 22 bp, Homo sapiens
tcaatcacgtgttccatgttct

SEQ ID NO: 2062 - DNA, 22 bp, Homo sapiens
atttattcctttatggctggag

SEQ ID NO: 2063 - DNA, 19 bp, Homo sapiens
ggtatatgggcctcacttg

SEQ ID NO: 2064 - DNA, 22 bp, Homo sapiens
ttcccacattctttacattcat

SEQ ID NO: 2065 - DNA, 22 bp, Homo sapiens
gggctgtaggagctggaatggg

SEQ ID NO: 2066 - DNA, 22 bp, Homo sapiens
tgtcatggggttgttttgtaca

SEQ ID NO: 2067 - DNA, 22 bp, Homo sapiens
tccttcagcctcccagctcaaa

SEQ ID NO: 2068 - DNA, 20 bp, Homo sapiens
atcggcttgcctggaaacaa

SEQ ID NO: 2069 - DNA, 20 bp, Homo sapiens
atgaatattttggtctttcc

SEQ ID NO: 2070 - DNA, 22 bp, Homo sapiens
gcaggtccagtcaccagagaga

SEQ ID NO: 2071 - DNA, 19 bp, Homo sapiens
ggctgccttctgctcatct

SEQ ID NO: 2072 - DNA, 22 bp, Homo sapiens
agtggggattgtgacatattac

SEQ ID NO: 2073 - DNA, 22 bp, Homo sapiens
ccttctagcaaatcaacataaa

SEQ ID NO: 2074 - DNA, 22 bp, Homo sapiens
tgagctcgagagctttggtcca

SEQ ID NO: 2075 - DNA, 22 bp, Homo sapiens
gttcaagaccagcctggccaac

SEQ ID NO: 2076 - DNA, 22 bp, Homo sapiens
gagcacagtaaagcagtgtcac

SEQ ID NO: 2077 - DNA, 22 bp, Homo sapiens
ggaggctgaggcaggcggatca

SEQ ID NO: 2078 - DNA, 22 bp, Homo sapiens
tcctacacagataacagagacg

SEQ ID NO: 2079 - DNA, 22 bp, Homo sapiens
gaggtgatggttgcacaatgct

SEQ ID NO: 2080 - DNA, 22 bp, Homo sapiens
ttcaatagaaagtccctagtta

SEQ ID NO: 2081 - DNA, 22 bp, Homo sapiens
ttctcccatctcagtcttacat

SEQ ID NO: 2082 - DNA, 22 bp, Homo sapiens
ctgattaaaaacaggttctgag

SEQ ID NO: 2083 - DNA, 22 bp, Homo sapiens
tctgagacaggaagtggagggt

SEQ ID NO: 2084 - DNA, 20 bp, Homo sapiens
gccaacgcgctggggctgcc

SEQ ID NO: 2085 - DNA, 19 bp, Homo sapiens
agaatcccaggccccactg

SEQ ID NO: 2086 - DNA, 22 bp, Homo sapiens
actgcactccagcctgggtgac

SEQ ID NO: 2087 - DNA, 22 bp, Homo sapiens
ttaagtctctttgaagtgctct

SEQ ID NO: 2088 - DNA, 22 bp, Homo sapiens
tcctgccaggagatggtagcca

SEQ ID NO: 2089 - DNA, 22 bp, Homo sapiens
gtgccccagacacgcatgtggg

SEQ ID NO: 2090 - DNA, 22 bp, Homo sapiens
tggtggggccagacttcagctc

SEQ ID NO: 2091 - DNA, 22 bp, Homo sapiens
cctcattctcgcgtgtgtttct

SEQ ID NO: 2092 - DNA, 22 bp, Homo sapiens
gtgaccatcatctcagctagtt

SEQ ID NO: 2093 - DNA, 18 bp, Homo sapiens
ctgtaccaccctgagggc

SEQ ID NO: 2094 - DNA, 22 bp, Homo sapiens
actgttttctgtaaagggccag

SEQ ID NO: 2095 - DNA, 22 bp, Homo sapiens
cagagctgtccaaaccctgaca

SEQ ID NO: 2096 - DNA, 22 bp, Homo sapiens
ttatttaatgtgatctgaagag

SEQ ID NO: 2097 - DNA, 22 bp, Homo sapiens
cagccctcctaccctgccaggc

SEQ ID NO: 2098 - DNA, 22 bp, Homo sapiens
cccatgaggtggaggttgcagt

SEQ ID NO: 2099 - DNA, 22 bp, Homo sapiens
cggggcgagcagacggcggcaa

SEQ ID NO: 2100 - DNA, 22 bp, Homo sapiens
tttcacagaggaggaagctgag

SEQ ID NO: 2101 - DNA, 22 bp, Homo sapiens
agtgagcaagttgataatggcc

SEQ ID NO: 2102 - DNA, 22 bp, Homo sapiens
gagagtctaggaacctcatata

SEQ ID NO: 2103 - DNA, 22 bp, Homo sapiens
agttgctgggaaagatttcagt

SEQ ID NO: 2104 - DNA, 22 bp, Homo sapiens
tgtgactaggcctgagctcttg

SEQ ID NO: 2105 - DNA, 22 bp, Homo sapiens
caacatggcgaaaccccatctc

SEQ ID NO: 2106 - DNA, 22 bp, Homo sapiens
tagagcaatgctctactccttg

SEQ ID NO: 2107 - DNA, 22 bp, Homo sapiens
ttgagacacagtttcactctgt

SEQ ID NO: 2108 - DNA, 22 bp, Homo sapiens
gggagctgagctggaagagaat

SEQ ID NO: 2109 - DNA, 22 bp, Homo sapiens
ggagtagctgcattccgagcac

SEQ ID NO: 2110 - DNA, 22 bp, Homo sapiens
atgttcctattgcagaggatga

SEQ ID NO: 2111 - DNA, 22 bp, Homo sapiens
cctcatcgtttccagaatgtgg

SEQ ID NO: 2112 - DNA, 17 bp, Homo sapiens
ttgaatgcattacttgg

SEQ ID NO: 2113 - DNA, 22 bp, Homo sapiens
atgtttcaataatgctgtgagt

SEQ ID NO: 2114 - DNA, 22 bp, Homo sapiens
cttgagtcatataaagacagag

SEQ ID NO: 2115 - DNA, 22 bp, Homo sapiens
caggaagaccagggctgtggct

SEQ ID NO: 2116 - DNA, 22 bp, Homo sapiens
accctcaacaaattcactctat

SEQ ID NO: 2117 - DNA, 22 bp, Homo sapiens
cactgctacctctgcctcccgg

SEQ ID NO: 2118 - DNA, 22 bp, Homo sapiens
tgcagagtgaagacatcacccc

SEQ ID NO: 2119 - DNA, 22 bp, Homo sapiens
gatgctgagaggtggagggaac

SEQ ID NO: 2120 - DNA, 18 bp, Homo sapiens
gctgtggaagtctttata

SEQ ID NO: 2121 - DNA, 22 bp, Homo sapiens
agagcaattctcaaggaggtgt

SEQ ID NO: 2122 - DNA, 22 bp, Homo sapiens
tcgggctgctcgctgcggaact

SEQ ID NO: 2123 - DNA, 22 bp, Homo sapiens
gagaaatgcatgcatgtcatca

SEQ ID NO: 2124 - DNA, 22 bp, Homo sapiens
cctggaagttggaggttgcagt

SEQ ID NO: 2125 - DNA, 22 bp, Homo sapiens
atgttgtgtttgactgttaccc

SEQ ID NO: 2126 - DNA, 22 bp, Homo sapiens
tactgatattttcaactagaag

SEQ ID NO: 2127 - DNA, 22 bp, Homo sapiens
gggggactggaccgtcctgggt

SEQ ID NO: 2128 - DNA, 22 bp, Homo sapiens
tctgagccagggtctcctccct

SEQ ID NO: 2129 - DNA, 22 bp, Homo sapiens
tcttggccactaccacctggag

SEQ ID NO: 2130 - DNA, 22 bp, Homo sapiens
tcttaagcagagaagaagttga

SEQ ID NO: 2131 - DNA, 22 bp, Homo sapiens
attgcactccagcctgggtgac

SEQ ID NO: 2132 - DNA, 22 bp, Homo sapiens
cgagagatgggttggcaggggc

SEQ ID NO: 2133 - DNA, 22 bp, Homo sapiens
atgtacataaaatgtataatga

SEQ ID NO: 2134 - DNA, 22 bp, Homo sapiens
gggcgcatcacctgaggtcagg

SEQ ID NO: 2135 - DNA, 22 bp, Homo sapiens
gcctgtgtctgggtggccagag

SEQ ID NO: 2136 - DNA, 22 bp, Homo sapiens
ccaggagttggaggttgcagtg

SEQ ID NO: 2137 - DNA, 22 bp, Homo sapiens
acgtggcggccgccgtgagcgg

SEQ ID NO: 2138 - DNA, 22 bp, Homo sapiens
tgtcctcgtccgcctcgaactc

SEQ ID NO: 2139 - DNA, 22 bp, Homo sapiens
caggcaggtcagtgaagaagga

SEQ ID NO: 2140 - DNA, 22 bp, Homo sapiens
aggggaatgggtagactgttga

SEQ ID NO: 2141 - DNA, 22 bp, Homo sapiens
cactgcactccagcactccagc

SEQ ID NO: 2142 - DNA, 22 bp, Homo sapiens
aggaaataagggacaagacaaa

SEQ ID NO: 2143 - DNA, 23 bp, Homo sapiens
ggcactcggccgtgaactcgtgc

SEQ ID NO: 2144 - DNA, 22 bp, Homo sapiens
ggtatttcagtattatacaact

SEQ ID NO: 2145 - DNA, 22 bp, Homo sapiens
caccttgtgatcctcttgcctt

SEQ ID NO: 2146 - DNA, 22 bp, Homo sapiens
cttgatctacatagtgaaaccc

SEQ ID NO: 2147 - DNA, 22 bp, Homo sapiens
accatgttggccaagctggtct

SEQ ID NO: 2148 - DNA, 22 bp, Homo sapiens
ggtcttttctgctgcaggttgt

SEQ ID NO: 2149 - DNA, 22 bp, Homo sapiens
tccaggattgtcagccagaagg

SEQ ID NO: 2150 - DNA, 22 bp, Homo sapiens
ataagattgtcatagtatggac

SEQ ID NO: 2151 - DNA, 22 bp, Homo sapiens
gagggccctggctggctccagc

SEQ ID NO: 2152 - DNA, 22 bp, Homo sapiens
atgtgtattacctcgattgtga

SEQ ID NO: 2153 - DNA, 21 bp, Homo sapiens
gacattgcatggtggcctctt

SEQ ID NO: 2154 - DNA, 22 bp, Homo sapiens
cgcgcggccttgtggggcttgt

SEQ ID NO: 2155 - DNA, 22 bp, Homo sapiens
agtactgtcagcagggtgttga

SEQ ID NO: 2156 - DNA, 22 bp, Homo sapiens
tggtgctgccaggctcctgcca

SEQ ID NO: 2157 - DNA, 22 bp, Homo sapiens
accaggttggtgtccttctggc

SEQ ID NO: 2158 - DNA, 19 bp, Homo sapiens
ggagccgccgcccttcatt

SEQ ID NO: 2159 - DNA, 22 bp, Homo sapiens
ttgaaaagttttgaaacactct

SEQ ID NO: 2160 - DNA, 22 bp, Homo sapiens
tgtcttcagcagtcatctgggg

SEQ ID NO: 2161 - DNA, 22 bp, Homo sapiens
tttggtgttccggtcattgctg

SEQ ID NO: 2162 - DNA, 22 bp, Homo sapiens
gggcttggcacatgggctcagc

SEQ ID NO: 2163 - DNA, 22 bp, Homo sapiens
accccactcacacatggacctg

SEQ ID NO: 2164 - DNA, 22 bp, Homo sapiens
agacgcggtggtgcatgcctgt

SEQ ID NO: 2165 - DNA, 22 bp, Homo sapiens
acagagcaatgcgtgttctcta

SEQ ID NO: 2166 - DNA, 22 bp, Homo sapiens
tcacaactgggtgtcttcatca

SEQ ID NO: 2167 - DNA, 22 bp, Homo sapiens
tgggtgctctgcgaccgtaggg

SEQ ID NO: 2168 - DNA, 22 bp, Homo sapiens
ttcctggaaattatgctcacct

SEQ ID NO: 2169 - DNA, 22 bp, Homo sapiens
cccacgttgaaccgcttacaga

SEQ ID NO: 2170 - DNA, 20 bp, Homo sapiens
cttctggctggtcaaggact

SEQ ID NO: 2171 - DNA, 22 bp, Homo sapiens
ccagatgtccctctcaggtttg

SEQ ID NO: 2172 - DNA, 22 bp, Homo sapiens
ggagtttgcctattgcttttgg

SEQ ID NO: 2173 - DNA, 22 bp, Homo sapiens
cccttagaattttgtagttatt

SEQ ID NO: 2174 - DNA, 22 bp, Homo sapiens
atggagttgagctctgttgtcc

SEQ ID NO: 2175 - DNA, 21 bp, Homo sapiens
cctgtggtgccagatcgccag

SEQ ID NO: 2176 - DNA, 22 bp, Homo sapiens
ggatgttgattgaatggccatt

SEQ ID NO: 2177 - DNA, 21 bp, Homo sapiens
ggtgctcgctgatgaggagtg

SEQ ID NO: 2178 - DNA, 22 bp, Homo sapiens
caggctggagtgcaatgacgcc

SEQ ID NO: 2179 - DNA, 22 bp, Homo sapiens
agggcagagctgtctaaatggc

SEQ ID NO: 2180 - DNA, 22 bp, Homo sapiens
ctccgcagcgggccaatccgga

SEQ ID NO: 2181 - DNA, 22 bp, Homo sapiens
tctgtgaagctctgaacagcag

SEQ ID NO: 2182 - DNA, 20 bp, Homo sapiens
cagagccagggttttgtttt

SEQ ID NO: 2183 - DNA, 22 bp, Homo sapiens
gtgaattacatgtatttttaag

SEQ ID NO: 2184 - DNA, 22 bp, Homo sapiens
ggctgcttgatggaaggggacg

SEQ ID NO: 2185 - DNA, 22 bp, Homo sapiens
gtatgtgctgagctttccccgc

SEQ ID NO: 2186 - DNA, 22 bp, Homo sapiens
ggtctcttgtccaaggtcacac

SEQ ID NO: 2187 - DNA, 22 bp, Homo sapiens
ctgcttgcaaagtgttggtgat

SEQ ID NO: 2188 - DNA, 22 bp, Homo sapiens
tacactgtttgaactgtggtcg

SEQ ID NO: 2189 - DNA, 22 bp, Homo sapiens
tacaaaaaattgatactgacga

SEQ ID NO: 2190 - DNA, 22 bp, Homo sapiens
cctcggggcaccgcggcctgct

SEQ ID NO: 2191 - DNA, 22 bp, Homo sapiens
tgtgtgcatgcttggggcagca

SEQ ID NO: 2192 - DNA, 22 bp, Homo sapiens
tgtccaggctaaagtgcagtgg

SEQ ID NO: 2193 - DNA, 22 bp, Homo sapiens
ttcctggcttgtcacatctacg

SEQ ID NO: 2194 - DNA, 23 bp, Homo sapiens
tcagaacagttcttggtgcatag

SEQ ID NO: 2195 - DNA, 22 bp, Homo sapiens
acagattcactgcactggccat

SEQ ID NO: 2196 - DNA, 18 bp, Homo sapiens
tctggaacaacttcatgt

SEQ ID NO: 2197 - DNA, 22 bp, Homo sapiens
tggacaggcaagcaagacatac

SEQ ID NO: 2198 - DNA, 22 bp, Homo sapiens
tagggcaatatttcccagaaaa

SEQ ID NO: 2199 - DNA, 22 bp, Homo sapiens
ggaaggcagaggtgtcgtgggg

SEQ ID NO: 2200 - DNA, 22 bp, Homo sapiens
cacctgtaatcccagcacttca

SEQ ID NO: 2201 - DNA, 22 bp, Homo sapiens
gtgggacaaggatgaagatatt

SEQ ID NO: 2202 - DNA, 22 bp, Homo sapiens
ttggaggttccatgatttgtct

SEQ ID NO: 2203 - DNA, 22 bp, Homo sapiens
tctcatgaagatagaatagtat

SEQ ID NO: 2204 - DNA, 22 bp, Homo sapiens
cttctgagatgttgttttacag

SEQ ID NO: 2205 - DNA, 22 bp, Homo sapiens
tcaagagttggtcaaatccaaa

SEQ ID NO: 2206 - DNA, 22 bp, Homo sapiens
taggtttactgaattagtggaa

SEQ ID NO: 2207 - DNA, 22 bp, Homo sapiens
agtcatgtgttcatctttcatt

SEQ ID NO: 2208 - DNA, 22 bp, Homo sapiens
gtgggccagcttttctcctggg

SEQ ID NO: 2209 - DNA, 22 bp, Homo sapiens
aagtcctactacctattgtgca

SEQ ID NO: 2210 - DNA, 22 bp, Homo sapiens
cccctacacacccctcttggca

SEQ ID NO: 2211 - DNA, 22 bp, Homo sapiens
tttgagtagtgagactaggcag

SEQ ID NO: 2212 - DNA, 19 bp, Homo sapiens
cggtccatccgattttaca

SEQ ID NO: 2213 - DNA, 22 bp, Homo sapiens
agagggtgggcacgtgatggat

SEQ ID NO: 2214 - DNA, 22 bp, Homo sapiens
ctgattgagaaggaaggggatc

SEQ ID NO: 2215 - DNA, 22 bp, Homo sapiens
caggctgaagtgcagtggtgtg

SEQ ID NO: 2216 - DNA, 22 bp, Homo sapiens
atcttcccaggctggggagagg

SEQ ID NO: 2217 - DNA, 22 bp, Homo sapiens
actgatggcagggtaggggtca

SEQ ID NO: 2218 - DNA, 22 bp, Homo sapiens
cctccctgccggctggactagt

SEQ ID NO: 2219 - DNA, 22 bp, Homo sapiens
cggagtcttgctatgttgccca

SEQ ID NO: 2220 - DNA, 22 bp, Homo sapiens
tctgcaggtaagcgttcttgga

SEQ ID NO: 2221 - DNA, 22 bp, Homo sapiens
atcaacatgtcataaagtgaaa

SEQ ID NO: 2222 - DNA, 22 bp, Homo sapiens
tctgcaacattcctctccccac

SEQ ID NO: 2223 - DNA, 22 bp, Homo sapiens
gaagccttgaactgcaaacccc

SEQ ID NO: 2224 - DNA, 22 bp, Homo sapiens
aagcactttatgtcaatgtcct

SEQ ID NO: 2225 - DNA, 22 bp, Homo sapiens
gccatcctgatgacaggccact

SEQ ID NO: 2226 - DNA, 22 bp, Homo sapiens
gctcactgcaacctccgccttc

SEQ ID NO: 2227 - DNA, 22 bp, Homo sapiens
gatgcacggtcatgtcttttca

SEQ ID NO: 2228 - DNA, 22 bp, Homo sapiens
ttagtttataattcatttctgt

SEQ ID NO: 2229 - DNA, 22 bp, Homo sapiens
cagaatcaagtccaattagcac

SEQ ID NO: 2230 - DNA, 18 bp, Homo sapiens
tcaagccattctcctgcc

SEQ ID NO: 2231 - DNA, 22 bp, Homo sapiens
atgccaggaacaaacagtggtg

SEQ ID NO: 2232 - DNA, 22 bp, Homo sapiens
tattccagccgcttgagctcgc

SEQ ID NO: 2233 - DNA, 22 bp, Homo sapiens
gcagcctgggcaacagagtgag

SEQ ID NO: 2234 - DNA, 22 bp, Homo sapiens
cctgtaatctcagctactcggg

SEQ ID NO: 2235 - DNA, 22 bp, Homo sapiens
ttggttttgaaatagcttattg

SEQ ID NO: 2236 - DNA, 22 bp, Homo sapiens
gagtagaactggttatctaata

SEQ ID NO: 2237 - DNA, 22 bp, Homo sapiens
agttacagaatgtacagaggtt

SEQ ID NO: 2238 - DNA, 22 bp, Homo sapiens
tccatcaagatgacttttgcta

SEQ ID NO: 2239 - DNA, 22 bp, Homo sapiens
tcaccaggctggagtgcagtgg

SEQ ID NO: 2240 - DNA, 22 bp, Homo sapiens
ggcagcactgcagcttgttggg

SEQ ID NO: 2241 - DNA, 22 bp, Homo sapiens
ggaacagttgcgtcatgggcct

SEQ ID NO: 2242 - DNA, 22 bp, Homo sapiens
cggatcctcagtcgtgcgggag

SEQ ID NO: 2243 - DNA, 22 bp, Homo sapiens
tgtgacactggccatctgggtt

SEQ ID NO: 2244 - DNA, 22 bp, Homo sapiens
gcagggcacaaggacgcacagg

SEQ ID NO: 2245 - DNA, 22 bp, Homo sapiens
tatgttgcaccaacctaataat

SEQ ID NO: 2246 - DNA, 22 bp, Homo sapiens
tgcaatccccgcctcaacagga

SEQ ID NO: 2247 - DNA, 22 bp, Homo sapiens
aggaaaatggaccagagttgtt

SEQ ID NO: 2248 - DNA, 22 bp, Homo sapiens
agagtactgcctcagttatgaa

SEQ ID NO: 2249 - DNA, 22 bp, Homo sapiens
gtgtcgtatgtaatatggtcca

SEQ ID NO: 2250 - DNA, 22 bp, Homo sapiens
atgactagaggagggatggcca

SEQ ID NO: 2251 - DNA, 22 bp, Homo sapiens
cttgcctacttgtcaaccagca

SEQ ID NO: 2252 - DNA, 20 bp, Homo sapiens
aaaatatgtataactcttct

SEQ ID NO: 2253 - DNA, 22 bp, Homo sapiens
tggttgatgtgtctgttttagg

SEQ ID NO: 2254 - DNA, 22 bp, Homo sapiens
tgcctgttgcccacctgataaa

SEQ ID NO: 2255 - DNA, 22 bp, Homo sapiens
cttgtagaattgaaatggtctc

SEQ ID NO: 2256 - DNA, 22 bp, Homo sapiens
gtcacctgtgccacatactggg

SEQ ID NO: 2257 - DNA, 22 bp, Homo sapiens
tgggggtgtcctggtgcacaca

SEQ ID NO: 2258 - DNA, 22 bp, Homo sapiens
gtgcaggacagcacatctcctg

SEQ ID NO: 2259 - DNA, 22 bp, Homo sapiens
tcaggagtgccagtaccttttg

SEQ ID NO: 2260 - DNA, 21 bp, Homo sapiens
ttgctgttttcccaatgcagt

SEQ ID NO: 2261 - DNA, 22 bp, Homo sapiens
atggctctgttttttatgctct

SEQ ID NO: 2262 - DNA, 22 bp, Homo sapiens
tgcgcgccagctcccaggttcg

SEQ ID NO: 2263 - DNA, 22 bp, Homo sapiens
gtgtggaatggagtttttgccc

SEQ ID NO: 2264 - DNA, 22 bp, Homo sapiens
acaactccttcttgggtcctgg

SEQ ID NO: 2265 - DNA, 20 bp, Homo sapiens
tttcttgtcggctgttgctg

SEQ ID NO: 2266 - DNA, 22 bp, Homo sapiens
ccaggagttggaggctgcagtg

SEQ ID NO: 2267 - DNA, 22 bp, Homo sapiens
agcaggaaggggatgatgggca

SEQ ID NO: 2268 - DNA, 22 bp, Homo sapiens
aggacttccatggatggattgg

SEQ ID NO: 2269 - DNA, 19 bp, Homo sapiens
tccaggggctccacctcct

SEQ ID NO: 2270 - DNA, 22 bp, Homo sapiens
ccctcccagatgggcttgaggt

SEQ ID NO: 2271 - DNA, 22 bp, Homo sapiens
aagatattcaaagatttattag

SEQ ID NO: 2272 - DNA, 22 bp, Homo sapiens
atttcctgtaggggcttgcgaa

SEQ ID NO: 2273 - DNA, 22 bp, Homo sapiens
aagtctctcacatatctggtcc

SEQ ID NO: 2274 - DNA, 22 bp, Homo sapiens
cacgcacgctgggtggaggcgc

SEQ ID NO: 2275 - DNA, 22 bp, Homo sapiens
cggctgggttcggctgcaggcc

SEQ ID NO: 2276 - DNA, 22 bp, Homo sapiens
gaattttattactagtcaactg

SEQ ID NO: 2277 - DNA, 22 bp, Homo sapiens
agaatttcctatgagagattcc

SEQ ID NO: 2278 - DNA, 22 bp, Homo sapiens
cactgcaatctccatctcctgg

SEQ ID NO: 2279 - DNA, 22 bp, Homo sapiens
tgtcagtgtctatgaagaattt

SEQ ID NO: 2280 - DNA, 22 bp, Homo sapiens
tgcagtacagtataatcttgct

SEQ ID NO: 2281 - DNA, 22 bp, Homo sapiens
tctctctgcagcccgggacact

SEQ ID NO: 2282 - DNA, 22 bp, Homo sapiens
gctgtgtccaggtgggggtgac

SEQ ID NO: 2283 - DNA, 22 bp, Homo sapiens
atccccactgctgctggtgtag

SEQ ID NO: 2284 - DNA, 23 bp, Homo sapiens
tatgaactgcattgctggtgtgt

SEQ ID NO: 2285 - DNA, 22 bp, Homo sapiens
aactatgttaataagtttcatt

SEQ ID NO: 2286 - DNA, 22 bp, Homo sapiens
ccggagtgtctggcctgctggg

SEQ ID NO: 2287 - DNA, 22 bp, Homo sapiens
tcccctggtgccacgatctgct

SEQ ID NO: 2288 - DNA, 22 bp, Homo sapiens
ctcaggatattgggctggagca

SEQ ID NO: 2289 - DNA, 22 bp, Homo sapiens
tcttgggcagcttgctcgcccc

SEQ ID NO: 2290 - DNA, 22 bp, Homo sapiens
tattgctatgagcattgttctt

SEQ ID NO: 2291 - DNA, 22 bp, Homo sapiens
tagaggccgaatgctgagctgg

SEQ ID NO: 2292 - DNA, 22 bp, Homo sapiens
tttagcgtagctgacagctaat

SEQ ID NO: 2293 - DNA, 22 bp, Homo sapiens
tggattgtaacatagagtaaat

SEQ ID NO: 2294 - DNA, 22 bp, Homo sapiens
aaagcagaggttgcagtgagct

SEQ ID NO: 2295 - DNA, 22 bp, Homo sapiens
ggctctgcttgaggccagcctg

SEQ ID NO: 2296 - DNA, 22 bp, Homo sapiens
gacgagacacgaagggttgaca

SEQ ID NO: 2297 - DNA, 22 bp, Homo sapiens
caggtcttcttcagcacttgga

SEQ ID NO: 2298 - DNA, 22 bp, Homo sapiens
tgagacgaagtcttgctctgtt

SEQ ID NO: 2299 - DNA, 22 bp, Homo sapiens
gcccgcagagatctttaacaaa

SEQ ID NO: 2300 - DNA, 22 bp, Homo sapiens
ggaaactagaagaatactagtc

SEQ ID NO: 2301 - DNA, 22 bp, Homo sapiens
gagggcccgcacctcgaaactc

SEQ ID NO: 2302 - DNA, 22 bp, Homo sapiens
ctgacttgcctaggtcattgtg

SEQ ID NO: 2303 - DNA, 22 bp, Homo sapiens
gcagctattgtctcctgggccc

SEQ ID NO: 2304 - DNA, 22 bp, Homo sapiens
catcagaacgtgagctccttgt

SEQ ID NO: 2305 - DNA, 19 bp, Homo sapiens
gccttcccaccacccgtcc

SEQ ID NO: 2306 - DNA, 22 bp, Homo sapiens
gtggagacctcctaggatgtgt

SEQ ID NO: 2307 - DNA, 22 bp, Homo sapiens
gacctcgtgatccgcccgcttt

SEQ ID NO: 2308 - DNA, 22 bp, Homo sapiens
ttgcatcagaattacttggagg

SEQ ID NO: 2309 - DNA, 22 bp, Homo sapiens
gtatgtctatagtttttaaata

SEQ ID NO: 2310 - DNA, 22 bp, Homo sapiens
tgagccaagttcacaccattgc

SEQ ID NO: 2311 - DNA, 22 bp, Homo sapiens
aaggggaagagaccgcagagtc

SEQ ID NO: 2312 - DNA, 20 bp, Homo sapiens
tgttatggtgttctgatggg

SEQ ID NO: 2313 - DNA, 22 bp, Homo sapiens
caaagtgctggaattacaggtg

SEQ ID NO: 2314 - DNA, 22 bp, Homo sapiens
tttctagttgttcatgaaagga

SEQ ID NO: 2315 - DNA, 22 bp, Homo sapiens
agagggcattaactctgtcttg

SEQ ID NO: 2316 - DNA, 22 bp, Homo sapiens
cttgaatgtcctgtggcaaagt

SEQ ID NO: 2317 - DNA, 22 bp, Homo sapiens
tgcgaccctagccccctcactt

SEQ ID NO: 2318 - DNA, 22 bp, Homo sapiens
aagcccttggcgcacaccgggc

SEQ ID NO: 2319 - DNA, 22 bp, Homo sapiens
ctgtcctggggaaagccagccc

SEQ ID NO: 2320 - DNA, 22 bp, Homo sapiens
aggtatatattctggtccttat

SEQ ID NO: 2321 - DNA, 22 bp, Homo sapiens
agtcaggggatctagacttgaa

SEQ ID NO: 2322 - DNA, 22 bp, Homo sapiens
ggcatgcatgttgttttaggtg

SEQ ID NO: 2323 - DNA, 22 bp, Homo sapiens
cacccaggctggagtgcagtgg

SEQ ID NO: 2324 - DNA, 22 bp, Homo sapiens
gaatttcacaaggtgaggataa

SEQ ID NO: 2325 - DNA, 22 bp, Homo sapiens
catcaagtaggtcctttcaaga

SEQ ID NO: 2326 - DNA, 17 bp, Homo sapiens
aatgtccttggaccaca

SEQ ID NO: 2327 - DNA, 22 bp, Homo sapiens
catggtgatttgcgccttctat

SEQ ID NO: 2328 - DNA, 22 bp, Homo sapiens
tggagagttctgtagatatcta

SEQ ID NO: 2329 - DNA, 22 bp, Homo sapiens
agccctcgtttctgcatcctgt

SEQ ID NO: 2330 - DNA, 22 bp, Homo sapiens
attgcacttcagcctgggtgac

SEQ ID NO: 2331 - DNA, 22 bp, Homo sapiens
ccttagggactaatagactgtc

SEQ ID NO: 2332 - DNA, 22 bp, Homo sapiens
ggctttagtgtaggtttctgtt

SEQ ID NO: 2333 - DNA, 21 bp, Homo sapiens
taagagcctaacacagaaagg

SEQ ID NO: 2334 - DNA, 22 bp, Homo sapiens
caacggctctggcttccaggcg

SEQ ID NO: 2335 - DNA, 22 bp, Homo sapiens
tgcgttgcgctcctgcagcagg

SEQ ID NO: 2336 - DNA, 22 bp, Homo sapiens
tcttctatcctcagcccctgcc

SEQ ID NO: 2337 - DNA, 22 bp, Homo sapiens
agcggcgccgagcttggccagg

SEQ ID NO: 2338 - DNA, 22 bp, Homo sapiens
caaagtaattacggttttggcc

SEQ ID NO: 2339 - DNA, 22 bp, Homo sapiens
tggaatgtcagctacaagaggg

SEQ ID NO: 2340 - DNA, 21 bp, Homo sapiens
cgggaaggaggttctgaccct

SEQ ID NO: 2341 - DNA, 22 bp, Homo sapiens
gaaatctttgccttagctgtgt

SEQ ID NO: 2342 - DNA, 22 bp, Homo sapiens
ctggcagagttgggtctcaaat

SEQ ID NO: 2343 - DNA, 22 bp, Homo sapiens
gtggctcacacctgtaatccca

SEQ ID NO: 2344 - DNA, 22 bp, Homo sapiens
cactgcaagctccgcctcctgg

SEQ ID NO: 2345 - DNA, 22 bp, Homo sapiens
tgaccttatttggaaatagggt

SEQ ID NO: 2346 - DNA, 22 bp, Homo sapiens
tgaggcaggagttcaggctgcg

SEQ ID NO: 2347 - DNA, 22 bp, Homo sapiens
cccacaggtgtgagcttgctgg

SEQ ID NO: 2348 - DNA, 22 bp, Homo sapiens
gtggcagaccttcccttctcct

SEQ ID NO: 2349 - DNA, 22 bp, Homo sapiens
gctcactgcaacctccacctcc

SEQ ID NO: 2350 - DNA, 22 bp, Homo sapiens
tgagtactgatttaagatacac

SEQ ID NO: 2351 - DNA, 22 bp, Homo sapiens
aggggaggtgtccccaaatctc

SEQ ID NO: 2352 - DNA, 22 bp, Homo sapiens
ttgttcttgtctttgccttcac

SEQ ID NO: 2353 - DNA, 22 bp, Homo sapiens
cctcgggctgaggctcccaggc

SEQ ID NO: 2354 - DNA, 22 bp, Homo sapiens
tcaggaggtccgcccgggaggg

SEQ ID NO: 2355 - DNA, 22 bp, Homo sapiens
aagccaaagtgggcatgcctca

SEQ ID NO: 2356 - DNA, 22 bp, Homo sapiens
ccaggctggagtgcagtggcac

SEQ ID NO: 2357 - DNA, 21 bp, Homo sapiens
tgttttccaccttgaggcaag

SEQ ID NO: 2358 - DNA, 22 bp, Homo sapiens
tcccgcttcttccgaatcgcga

SEQ ID NO: 2359 - DNA, 23 bp, Homo sapiens
agcctcttgtggatggtcagcga

SEQ ID NO: 2360 - DNA, 22 bp, Homo sapiens
tagatgatgtgactctcttgca

SEQ ID NO: 2361 - DNA, 17 bp, Homo sapiens
aggcgagaggaacatag

SEQ ID NO: 2362 - DNA, 22 bp, Homo sapiens
aaagtgcttcctttttgagggt

SEQ ID NO: 2363 - DNA, 22 bp, Homo sapiens
tccaaatgagctctgccttcca

SEQ ID NO: 2364 - DNA, 22 bp, Homo sapiens
attgtctctgaatttccagctg

SEQ ID NO: 2365 - DNA, 22 bp, Homo sapiens
gcctgtaatcccagcactttgt

SEQ ID NO: 2366 - DNA, 22 bp, Homo sapiens
ggagttgacggccgacacccag

SEQ ID NO: 2367 - DNA, 22 bp, Homo sapiens
gtgggcggggcctctcaagctg

SEQ ID NO: 2368 - DNA, 22 bp, Homo sapiens
tgactctgataagacatatggc

SEQ ID NO: 2369 - DNA, 18 bp, Homo sapiens
acttcccagatgagggga

SEQ ID NO: 2370 - DNA, 22 bp, Homo sapiens
ggcttggaccagtcacagtggt

SEQ ID NO: 2371 - DNA, 22 bp, Homo sapiens
gggcgccgtgggaaacagccgg

SEQ ID NO: 2372 - DNA, 22 bp, Homo sapiens
aatgtgttgaataaattgtgcc

SEQ ID NO: 2373 - DNA, 22 bp, Homo sapiens
gtctcttgttatcatttctgag

SEQ ID NO: 2374 - DNA, 20 bp, Homo sapiens
agagtgagactccatctcag

SEQ ID NO: 2375 - DNA, 22 bp, Homo sapiens
gcagagatctgagaaggctgcc

SEQ ID NO: 2376 - DNA, 22 bp, Homo sapiens
accctgctttatgccgtcctct

SEQ ID NO: 2377 - DNA, 22 bp, Homo sapiens
ccagcccgaatccctggccagg

SEQ ID NO: 2378 - DNA, 22 bp, Homo sapiens
caccaagaatcttcacttttta

SEQ ID NO: 2379 - DNA, 22 bp, Homo sapiens
tgttattctagtggatcacgtc

SEQ ID NO: 2380 - DNA, 22 bp, Homo sapiens
ctagataacttattttcaagga

SEQ ID NO: 2381 - DNA, 22 bp, Homo sapiens
gcttggaagtaggattgggaga

SEQ ID NO: 2382 - DNA, 22 bp, Homo sapiens
gggcagagagctggaactcctt

SEQ ID NO: 2383 - DNA, 22 bp, Homo sapiens
atttcatactaaggctcaaaaa

SEQ ID NO: 2384 - DNA, 22 bp, Homo sapiens
aagcccggttgggaacgtggtg

SEQ ID NO: 2385 - DNA, 22 bp, Homo sapiens
gactcgctcccttttgtcttat

SEQ ID NO: 2386 - DNA, 22 bp, Homo sapiens
aacttgccaagagctttgctag

SEQ ID NO: 2387 - DNA, 22 bp, Homo sapiens
tctttgaccaaattatcctgtt

SEQ ID NO: 2388 - DNA, 22 bp, Homo sapiens
ctcattgcccagatccccacag

SEQ ID NO: 2389 - DNA, 22 bp, Homo sapiens
gtggggacgggatggctcactg

SEQ ID NO: 2390 - DNA, 22 bp, Homo sapiens
tatgacttttcccaattcagga

SEQ ID NO: 2391 - DNA, 22 bp, Homo sapiens
ctgctgagccgcacccaggagc

SEQ ID NO: 2392 - DNA, 22 bp, Homo sapiens
cccaggaggcgcaggttgcggt

SEQ ID NO: 2393 - DNA, 22 bp, Homo sapiens
ttctccgctaagttctctgcag

SEQ ID NO: 2394 - DNA, 22 bp, Homo sapiens
ccccggaggcggaggttgcagt

SEQ ID NO: 2395 - DNA, 21 bp, Homo sapiens
agggttttatagatctcttcc

SEQ ID NO: 2396 - DNA, 22 bp, Homo sapiens
atcctttcatctggtaatatat

SEQ ID NO: 2397 - DNA, 22 bp, Homo sapiens
ttcaggaagtgctgcctggtgt

SEQ ID NO: 2398 - DNA, 22 bp, Homo sapiens
ctgtgggatcccatgactttcc

SEQ ID NO: 2399 - DNA, 21 bp, Homo sapiens
ctgtggtacagctgggacgga

SEQ ID NO: 2400 - DNA, 23 bp, Homo sapiens
ttggggacaaacatgctactttc

SEQ ID NO: 2401 - DNA, 21 bp, Homo sapiens
ccaggccaggcctacggggat

SEQ ID NO: 2402 - DNA, 22 bp, Homo sapiens
ctgcattgatcaggcagaatct

SEQ ID NO: 2403 - DNA, 22 bp, Homo sapiens
gtggtccagaagagcgcatatg

SEQ ID NO: 2404 - DNA, 22 bp, Homo sapiens
tttaagtaataaagtagcagct

SEQ ID NO: 2405 - DNA, 22 bp, Homo sapiens
tcttcccccgtgctccagtgca

SEQ ID NO: 2406 - DNA, 23 bp, Homo sapiens
aaggggatacttccactttcttt

SEQ ID NO: 2407 - DNA, 22 bp, Homo sapiens
gatctccatctgcagtgtctgg

SEQ ID NO: 2408 - DNA, 22 bp, Homo sapiens
ggtgacctcacctggtcccacc

SEQ ID NO: 2409 - DNA, 22 bp, Homo sapiens
ctgaattatttaaggtgaaggg

SEQ ID NO: 2410 - DNA, 22 bp, Homo sapiens
gtgccgctggagctggaattga

SEQ ID NO: 2411 - DNA, 22 bp, Homo sapiens
ccagagctgcaggtaaaatgct

SEQ ID NO: 2412 - DNA, 22 bp, Homo sapiens
ccaaccattggctaagaattgg

SEQ ID NO: 2413 - DNA, 22 bp, Homo sapiens
tgcagtggcgccatctcagctc

SEQ ID NO: 2414 - DNA, 22 bp, Homo sapiens
tgagtgaccagaagtccccctc

SEQ ID NO: 2415 - DNA, 22 bp, Homo sapiens
acaagcatgggctttgacatca

SEQ ID NO: 2416 - DNA, 22 bp, Homo sapiens
ccagactcatctgccattgctg

SEQ ID NO: 2417 - DNA, 22 bp, Homo sapiens
ttgatcttttcttgctgcccca

SEQ ID NO: 2418 - DNA, 22 bp, Homo sapiens
tggccagctttgactgtaaacc

SEQ ID NO: 2419 - DNA, 22 bp, Homo sapiens
tttcagaacataatgtgagcat

SEQ ID NO: 2420 - DNA, 22 bp, Homo sapiens
attgtgaatagtgccgcagtaa

SEQ ID NO: 2421 - DNA, 22 bp, Homo sapiens
cattaggacgccccgcccatac

SEQ ID NO: 2422 - DNA, 22 bp, Homo sapiens
ggtggttcacgcctataatccc

SEQ ID NO: 2423 - DNA, 22 bp, Homo sapiens
cgaggaggaaacgcggagaact

SEQ ID NO: 2424 - DNA, 22 bp, Homo sapiens
gtagctctgtttaaagttcttt

SEQ ID NO: 2425 - DNA, 22 bp, Homo sapiens
aggcgcctgcgggatccttgcc

SEQ ID NO: 2426 - DNA, 21 bp, Homo sapiens
cagaggcctatcacagactcc

SEQ ID NO: 2427 - DNA, 22 bp, Homo sapiens
aacactctctgttggtaaggct

SEQ ID NO: 2428 - DNA, 22 bp, Homo sapiens
cagctttgccaagtaaggtctt

SEQ ID NO: 2429 - DNA, 22 bp, Homo sapiens
cagtgggtcctgcgtctgccag

SEQ ID NO: 2430 - DNA, 22 bp, Homo sapiens
gtaagggatttgaacataggtt

SEQ ID NO: 2431 - DNA, 22 bp, Homo sapiens
gaggtgttgggtgaggtgcctg

SEQ ID NO: 2432 - DNA, 22 bp, Homo sapiens
tcggagctgtagatgaaaccct

SEQ ID NO: 2433 - DNA, 22 bp, Homo sapiens
tgagacaggcttccttcttggg

SEQ ID NO: 2434 - DNA, 22 bp, Homo sapiens
gatgcactgcagtatatactgt

SEQ ID NO: 2435 - DNA, 22 bp, Homo sapiens
gtacccagtgattccttcttca

SEQ ID NO: 2436 - DNA, 22 bp, Homo sapiens
tgcttttagctagtaactagta

SEQ ID NO: 2437 - DNA, 22 bp, Homo sapiens
tttggcatgggctatttgcttt

SEQ ID NO: 2438 - DNA, 22 bp, Homo sapiens
aatttaagagcatagctccaac

SEQ ID NO: 2439 - DNA, 22 bp, Homo sapiens
ttgtgctctgtgttatttaagg

SEQ ID NO: 2440 - DNA, 22 bp, Homo sapiens
agtacccttttcactgtcacaa

SEQ ID NO: 2441 - DNA, 22 bp, Homo sapiens
gtccaggagctcagggcttatt

SEQ ID NO: 2442 - DNA, 22 bp, Homo sapiens
aatgtcaaaggctatacattca

SEQ ID NO: 2443 - DNA, 22 bp, Homo sapiens
tcacctctactcagcctagttc

SEQ ID NO: 2444 - DNA, 22 bp, Homo sapiens
ttgggctgcagcaattattagt

SEQ ID NO: 2445 - DNA, 22 bp, Homo sapiens
cacccaggcaaggattctgcaa

SEQ ID NO: 2446 - DNA, 20 bp, Homo sapiens
actgcactccagccttccag

SEQ ID NO: 2447 - DNA, 22 bp, Homo sapiens
ccaggaggcagaagttgcagtg

SEQ ID NO: 2448 - DNA, 22 bp, Homo sapiens
caaattccattcatgctccctt

SEQ ID NO: 2449 - DNA, 22 bp, Homo sapiens
aggagggagcttaagccaggca

SEQ ID NO: 2450 - DNA, 22 bp, Homo sapiens
cgggtcccctcgggaggctgct

SEQ ID NO: 2451 - DNA, 19 bp, Homo sapiens
gccatcccaagcattttgg

SEQ ID NO: 2452 - DNA, 22 bp, Homo sapiens
actgtactcaagcctgggcaat

SEQ ID NO: 2453 - DNA, 22 bp, Homo sapiens
tgtcaagccccagctgtcacgc

SEQ ID NO: 2454 - DNA, 22 bp, Homo sapiens
tgcagcttcactcctgaagcca

SEQ ID NO: 2455 - DNA, 21 bp, Homo sapiens
tcgacctgctgggctcgggct

SEQ ID NO: 2456 - DNA, 22 bp, Homo sapiens
actgaataaggtgaatgctctg

SEQ ID NO: 2457 - DNA, 22 bp, Homo sapiens
ggacaaatttttgtgatgtgct

SEQ ID NO: 2458 - DNA, 22 bp, Homo sapiens
catcttggatgacataactgtg

SEQ ID NO: 2459 - DNA, 22 bp, Homo sapiens
gacaagctcccggtggccctcc

SEQ ID NO: 2460 - DNA, 22 bp, Homo sapiens
gagctgaacgggaattccccga

SEQ ID NO: 2461 - DNA, 22 bp, Homo sapiens
gccagatttacagatttgccct

SEQ ID NO: 2462 - DNA, 22 bp, Homo sapiens
aagcctggactatcgcgtgtgc

SEQ ID NO: 2463 - DNA, 22 bp, Homo sapiens
agctacctgatccttcttctga

SEQ ID NO: 2464 - DNA, 22 bp, Homo sapiens
ctcttagtaatgccatgaagca

SEQ ID NO: 2465 - DNA, 22 bp, Homo sapiens
tgttgcacggccttcacagagc

SEQ ID NO: 2466 - DNA, 22 bp, Homo sapiens
caacatggtgaaaccccgtctc

SEQ ID NO: 2467 - DNA, 22 bp, Homo sapiens
agcttgacagacagatggtagc

SEQ ID NO: 2468 - DNA, 22 bp, Homo sapiens
tggtccgctcctattcgccgca

SEQ ID NO: 2469 - DNA, 22 bp, Homo sapiens
aaagctaaggtagcattggaga

SEQ ID NO: 2470 - DNA, 22 bp, Homo sapiens
tgtgtctttgttccaggtacga

SEQ ID NO: 2471 - DNA, 22 bp, Homo sapiens
aggggcacgagtagagctctag

SEQ ID NO: 2472 - DNA, 22 bp, Homo sapiens
ctttggagaaaagttcttgggc

SEQ ID NO: 2473 - DNA, 22 bp, Homo sapiens
aagcctgaacattactagttgt

SEQ ID NO: 2474 - DNA, 22 bp, Homo sapiens
ttctcaaagtgtgctccctgga

SEQ ID NO: 2475 - DNA, 22 bp, Homo sapiens
ctggtctggctacccagcgaat

SEQ ID NO: 2476 - DNA, 22 bp, Homo sapiens
tcgaatggcaaggaaagaggct

SEQ ID NO: 2477 - DNA, 22 bp, Homo sapiens
tattcatagtaaacaaaagtgg

SEQ ID NO: 2478 - DNA, 23 bp, Homo sapiens
gtgccgacgctccagcaccatcc

SEQ ID NO: 2479 - DNA, 17 bp, Homo sapiens
tgggatccgtctctgtg

SEQ ID NO: 2480 - DNA, 22 bp, Homo sapiens
ttcaggatccccaccgcgttta

SEQ ID NO: 2481 - DNA, 22 bp, Homo sapiens
gaggctgcagctatcagacatt

SEQ ID NO: 2482 - DNA, 22 bp, Homo sapiens
ggggtccctgcaccagcatgtc

SEQ ID NO: 2483 - DNA, 22 bp, Homo sapiens
atttcacttagtgtaatgtctt

SEQ ID NO: 2484 - DNA, 22 bp, Homo sapiens
aagacccacaaggctgaatgtt

SEQ ID NO: 2485 - DNA, 22 bp, Homo sapiens
ttcattcttcagagctgcgctt

SEQ ID NO: 2486 - DNA, 22 bp, Homo sapiens
ctggcttttttcccattatgca

SEQ ID NO: 2487 - DNA, 22 bp, Homo sapiens
tattgtgaataatgccgcaata

SEQ ID NO: 2488 - DNA, 22 bp, Homo sapiens
atggggggatgaaggagtccaa

SEQ ID NO: 2489 - DNA, 22 bp, Homo sapiens
aggcctgaggaccagataaatg

SEQ ID NO: 2490 - DNA, 22 bp, Homo sapiens
gctgcagtgagccaagatcgtg

SEQ ID NO: 2491 - DNA, 22 bp, Homo sapiens
acatttatataactcactagga

SEQ ID NO: 2492 - DNA, 22 bp, Homo sapiens
actgtactccagcctggtggca

SEQ ID NO: 2493 - DNA, 22 bp, Homo sapiens
tgtcaccttgctcatcctcgga

SEQ ID NO: 2494 - DNA, 22 bp, Homo sapiens
tggctccgttgtacaggctgga

SEQ ID NO: 2495 - DNA, 22 bp, Homo sapiens
cctgtctctgcagggccctgcc

SEQ ID NO: 2496 - DNA, 22 bp, Homo sapiens
agaaaatttaaagagacacaca

SEQ ID NO: 2497 - DNA, 22 bp, Homo sapiens
tcactgcaacctccgcctgctg

SEQ ID NO: 2498 - DNA, 22 bp, Homo sapiens
aaaaagtattggccatggttga

SEQ ID NO: 2499 - DNA, 22 bp, Homo sapiens
cgtcattgtcctggacttgcaa

SEQ ID NO: 2500 - DNA, 22 bp, Homo sapiens
agtgggtgtagtcttcctcctg

SEQ ID NO: 2501 - DNA, 22 bp, Homo sapiens
tctgcggtccccttctcgccct

SEQ ID NO: 2502 - DNA, 22 bp, Homo sapiens
gccagggttgccaatgggggca

SEQ ID NO: 2503 - DNA, 22 bp, Homo sapiens
caggctggagtgcagtggtgcc

SEQ ID NO: 2504 - DNA, 22 bp, Homo sapiens
atggcagaatatctgcatcgca

SEQ ID NO: 2505 - DNA, 22 bp, Homo sapiens
caaatgaatatttccatgggtt

SEQ ID NO: 2506 - DNA, 22 bp, Homo sapiens
tgctcccaaacctgacaggctc

SEQ ID NO: 2507 - DNA, 22 bp, Homo sapiens
aagactgagtggcttaagaaaa

SEQ ID NO: 2508 - DNA, 20 bp, Homo sapiens
ttgttgagctcttcaaagaa

SEQ ID NO: 2509 - DNA, 22 bp, Homo sapiens
ctgtggctcaggcctgtaagcc

SEQ ID NO: 2510 - DNA, 22 bp, Homo sapiens
ggaggtgactggatcatgggca

SEQ ID NO: 2511 - DNA, 22 bp, Homo sapiens
ttcaccagacctgtgagcttcc

SEQ ID NO: 2512 - DNA, 22 bp, Homo sapiens
gcttcttgcctgtgtagagaat

SEQ ID NO: 2513 - DNA, 21 bp, Homo sapiens
cactccacttagaacagggtt

SEQ ID NO: 2514 - DNA, 22 bp, Homo sapiens
caggctgctgcctagaatgaca

SEQ ID NO: 2515 - DNA, 22 bp, Homo sapiens
aatatttccaaggcctgtcagg

SEQ ID NO: 2516 - DNA, 22 bp, Homo sapiens
ggcatcgtcctgggcataggga

SEQ ID NO: 2517 - DNA, 22 bp, Homo sapiens
caattctgaggcctgctttgtt

SEQ ID NO: 2518 - DNA, 22 bp, Homo sapiens
tcacaggtacagctaatgctac

SEQ ID NO: 2519 - DNA, 22 bp, Homo sapiens
aggcaggaggatcatggatgca

SEQ ID NO: 2520 - DNA, 22 bp, Homo sapiens
ttgccatgttgccaaggctggt

SEQ ID NO: 2521 - DNA, 22 bp, Homo sapiens
ctgagctcacgccattctcctt

SEQ ID NO: 2522 - DNA, 22 bp, Homo sapiens
tgggtgagcggctgcacacccg

SEQ ID NO: 2523 - DNA, 22 bp, Homo sapiens
taatgcacatagaagtacttag

SEQ ID NO: 2524 - DNA, 22 bp, Homo sapiens
aggtcacgtcctgtgatgtcat

SEQ ID NO: 2525 - DNA, 22 bp, Homo sapiens
agtaatcaatttttcggtggat

SEQ ID NO: 2526 - DNA, 22 bp, Homo sapiens
ggtgatccaccagcctcggcct

SEQ ID NO: 2527 - DNA, 17 bp, Homo sapiens
caggtgacctggtgatg

SEQ ID NO: 2528 - DNA, 22 bp, Homo sapiens
tttcttctatgtgtgatatttt

SEQ ID NO: 2529 - DNA, 22 bp, Homo sapiens
tgacccctatatcctgtttctt

SEQ ID NO: 2530 - DNA, 22 bp, Homo sapiens
atgaattgtccgatgttgtgca

SEQ ID NO: 2531 - DNA, 22 bp, Homo sapiens
ttctacagtgactgcagccata

SEQ ID NO: 2532 - DNA, 22 bp, Homo sapiens
tgcactactgtgatacacagcc

SEQ ID NO: 2533 - DNA, 22 bp, Homo sapiens
tgagtgactccactggggcaga

SEQ ID NO: 2534 - DNA, 22 bp, Homo sapiens
atggaatgtttatacacagttg

SEQ ID NO: 2535 - DNA, 22 bp, Homo sapiens
gggacaatggaggcctctctcc

SEQ ID NO: 2536 - DNA, 17 bp, Homo sapiens
acttcccacccctccag

SEQ ID NO: 2537 - DNA, 22 bp, Homo sapiens
ctttatgaaaacctgaattatg

SEQ ID NO: 2538 - DNA, 22 bp, Homo sapiens
tctagggtgtataaggaagcct

SEQ ID NO: 2539 - DNA, 22 bp, Homo sapiens
caaggtagttctggtcattgac

SEQ ID NO: 2540 - DNA, 22 bp, Homo sapiens
ggcatagatttctttaggttta

SEQ ID NO: 2541 - DNA, 22 bp, Homo sapiens
ctagggtcaggggcctgcgtcg

SEQ ID NO: 2542 - DNA, 22 bp, Homo sapiens
ccttgctcaagctagtgacggg

SEQ ID NO: 2543 - DNA, 22 bp, Homo sapiens
cggctcactgcagctccgcctc

SEQ ID NO: 2544 - DNA, 22 bp, Homo sapiens
tcgaaataatttagaatataga

SEQ ID NO: 2545 - DNA, 22 bp, Homo sapiens
tgttattgtcgctgcactggga

SEQ ID NO: 2546 - DNA, 22 bp, Homo sapiens
tctagcaagctcgtgctcaagg

SEQ ID NO: 2547 - DNA, 22 bp, Homo sapiens
gtgccactgataaatcagaatg

SEQ ID NO: 2548 - DNA, 22 bp, Homo sapiens
aaagccttcttgtatcgagcca

SEQ ID NO: 2549 - DNA, 22 bp, Homo sapiens
ctattgtttctatgctctgagg

SEQ ID NO: 2550 - DNA, 22 bp, Homo sapiens
tgtgattgtagtatacatatta

SEQ ID NO: 2551 - DNA, 22 bp, Homo sapiens
aaatggaagctatttatgattc

SEQ ID NO: 2552 - DNA, 22 bp, Homo sapiens
agaggtgagtcattacctagtg

SEQ ID NO: 2553 - DNA, 22 bp, Homo sapiens
tgggtagagtgctgacaatgcc

SEQ ID NO: 2554 - DNA, 22 bp, Homo sapiens
tgggaagaggagcactggaatg

SEQ ID NO: 2555 - DNA, 22 bp, Homo sapiens
tttagtgcatcagacaccctct

SEQ ID NO: 2556 - DNA, 22 bp, Homo sapiens
atgaattgaggaaaacagtcgt

SEQ ID NO: 2557 - DNA, 22 bp, Homo sapiens
tggagacacaggaccagactgc

SEQ ID NO: 2558 - DNA, 22 bp, Homo sapiens
gtgaccaatattatgctaatta

SEQ ID NO: 2559 - DNA, 22 bp, Homo sapiens
catgagataatttttctccagt

SEQ ID NO: 2560 - DNA, 22 bp, Homo sapiens
acttatagaataatgtttttag

SEQ ID NO: 2561 - DNA, 22 bp, Homo sapiens
aaattcttttgtgcggtgaagt

SEQ ID NO: 2562 - DNA, 22 bp, Homo sapiens
tgtgaatggacaattaaatcta

SEQ ID NO: 2563 - DNA, 22 bp, Homo sapiens
aggagtcccactgtcaatgcta

SEQ ID NO: 2564 - DNA, 22 bp, Homo sapiens
agtgttgtcaaacggctcagca

SEQ ID NO: 2565 - DNA, 22 bp, Homo sapiens
aagaggcgccgggtacgtggcg

SEQ ID NO: 2566 - DNA, 22 bp, Homo sapiens
ttgagagttctgaatgagtaac

SEQ ID NO: 2567 - DNA, 22 bp, Homo sapiens
acatgagactgggtttgtaggg

SEQ ID NO: 2568 - DNA, 22 bp, Homo sapiens
cctcgacctccccaggctcagg

SEQ ID NO: 2569 - DNA, 22 bp, Homo sapiens
ttccgagggctcggcggccgcc

SEQ ID NO: 2570 - DNA, 22 bp, Homo sapiens
ctgggtggcagagcctgcagtg

SEQ ID NO: 2571 - DNA, 22 bp, Homo sapiens
actgaactccagcctgggtggc

SEQ ID NO: 2572 - DNA, 22 bp, Homo sapiens
ggatgctctgtctcttgctgtt

SEQ ID NO: 2573 - DNA, 22 bp, Homo sapiens
gacagacacaattgatccatga

SEQ ID NO: 2574 - DNA, 22 bp, Homo sapiens
ttcatgggtccagagccctggg

SEQ ID NO: 2575 - DNA, 22 bp, Homo sapiens
taagatgtttacagtatggaga

SEQ ID NO: 2576 - DNA, 23 bp, Homo sapiens
catcatgcaatcttgggatttct

SEQ ID NO: 2577 - DNA, 22 bp, Homo sapiens
tgctcgaggtccccaccggctc

SEQ ID NO: 2578 - DNA, 22 bp, Homo sapiens
ggctggacgatctccccttcct

SEQ ID NO: 2579 - DNA, 22 bp, Homo sapiens
taaacgtgcttcatatttttag

SEQ ID NO: 2580 - DNA, 22 bp, Homo sapiens
ggaggactcaggtctggccatg

SEQ ID NO: 2581 - DNA, 22 bp, Homo sapiens
agcgctgtgggcgtgcgaggag

SEQ ID NO: 2582 - DNA, 22 bp, Homo sapiens
tgtatatacacactcccatgtt

SEQ ID NO: 2583 - DNA, 22 bp, Homo sapiens
tgagtgtggggaatgtcatgag

SEQ ID NO: 2584 - DNA, 22 bp, Homo sapiens
gctgtagtgaatggccgcgttc

SEQ ID NO: 2585 - DNA, 22 bp, Homo sapiens
agcattccacactgaagtctgc

SEQ ID NO: 2586 - DNA, 22 bp, Homo sapiens
tttggagaatgttttggtcaga

SEQ ID NO: 2587 - DNA, 22 bp, Homo sapiens
tccacatggctgggaggcctca

SEQ ID NO: 2588 - DNA, 22 bp, Homo sapiens
ccccagtggaggtgagggtcct

SEQ ID NO: 2589 - DNA, 22 bp, Homo sapiens
ggctctgtaagtgttgcaggta

SEQ ID NO: 2590 - DNA, 22 bp, Homo sapiens
tgagcctgagttcaaggctgca

SEQ ID NO: 2591 - DNA, 22 bp, Homo sapiens
aatcagaaattgagggtctggt

SEQ ID NO: 2592 - DNA, 22 bp, Homo sapiens
gttggacagtttgggaagggag

SEQ ID NO: 2593 - DNA, 20 bp, Homo sapiens
tgtttgtgtggggccttggc

SEQ ID NO: 2594 - DNA, 22 bp, Homo sapiens
cctcacctcagtctgggcctca

SEQ ID NO: 2595 - DNA, 22 bp, Homo sapiens
tgtgccataggcagcgtggcca

SEQ ID NO: 2596 - DNA, 22 bp, Homo sapiens
cacctagggtttcgcctttctt

SEQ ID NO: 2597 - DNA, 22 bp, Homo sapiens
ctgtgttctccaggggcagctg

SEQ ID NO: 2598 - DNA, 22 bp, Homo sapiens
actgggcctacccagattggca

SEQ ID NO: 2599 - DNA, 22 bp, Homo sapiens
atcaagagcacagtgctggcat

SEQ ID NO: 2600 - DNA, 22 bp, Homo sapiens
gaaccattgttgaaaagaatag

SEQ ID NO: 2601 - DNA, 15 bp, Homo sapiens
catatcactgggaat

SEQ ID NO: 2602 - DNA, 22 bp, Homo sapiens
agctggaattacaggcacgcac

SEQ ID NO: 2603 - DNA, 22 bp, Homo sapiens
ctagttgaagaggctgtcatca

SEQ ID NO: 2604 - DNA, 22 bp, Homo sapiens
cccacacacatttatgatagga

SEQ ID NO: 2605 - DNA, 22 bp, Homo sapiens
ctgggaggcggaggttgcagtg

SEQ ID NO: 2606 - DNA, 22 bp, Homo sapiens
tcactgcaacctccgcctcccg

SEQ ID NO: 2607 - DNA, 22 bp, Homo sapiens
tctctatttgcctaggcttgtg

SEQ ID NO: 2608 - DNA, 22 bp, Homo sapiens
aaatgtaagtctttgtttctta

SEQ ID NO: 2609 - DNA, 22 bp, Homo sapiens
gtggcgtgatctcggctcactg

SEQ ID NO: 2610 - DNA, 22 bp, Homo sapiens
tattgcaggttccaaccgggaa

SEQ ID NO: 2611 - DNA, 22 bp, Homo sapiens
tactttaatatatgtgaagttc

SEQ ID NO: 2612 - DNA, 22 bp, Homo sapiens
ctgctgaggtggagattgcagt

SEQ ID NO: 2613 - DNA, 22 bp, Homo sapiens
tgaagctacagaccttcgcggt

SEQ ID NO: 2614 - DNA, 22 bp, Homo sapiens
tggcacttttcccagttttggt

SEQ ID NO: 2615 - DNA, 22 bp, Homo sapiens
tcgttaccatagccttgtccct

SEQ ID NO: 2616 - DNA, 22 bp, Homo sapiens
gactggtaaggaaattcactaa

SEQ ID NO: 2617 - DNA, 22 bp, Homo sapiens
cgctgcagaagcgtgttcagga

SEQ ID NO: 2618 - DNA, 22 bp, Homo sapiens
attgggatgccggctgataaga

SEQ ID NO: 2619 - DNA, 22 bp, Homo sapiens
gcttctgagttcttgcttaata

SEQ ID NO: 2620 - DNA, 22 bp, Homo sapiens
caaccccactacacgttggaga

SEQ ID NO: 2621 - DNA, 22 bp, Homo sapiens
cccaggaggcctgcctggccgg

SEQ ID NO: 2622 - DNA, 22 bp, Homo sapiens
ctcaagtgtgagttttaaagtc

SEQ ID NO: 2623 - DNA, 22 bp, Homo sapiens
gggacctcgcatgcacgaagcc

SEQ ID NO: 2624 - DNA, 22 bp, Homo sapiens
tttatagcagcatgatttatag

SEQ ID NO: 2625 - DNA, 22 bp, Homo sapiens
ttatagcagcatgatttatagt

SEQ ID NO: 2626 - DNA, 22 bp, Homo sapiens
gcagagccatgggaggtttttg

SEQ ID NO: 2627 - DNA, 22 bp, Homo sapiens
tcaagcggactgagatactctg

SEQ ID NO: 2628 - DNA, 22 bp, Homo sapiens
cagctcgggcctccctctcccg

SEQ ID NO: 2629 - DNA, 22 bp, Homo sapiens
ctccaggctcgtccaagatcga

SEQ ID NO: 2630 - DNA, 22 bp, Homo sapiens
actgcactccagcctgggcgac

SEQ ID NO: 2631 - DNA, 22 bp, Homo sapiens
tccaagatctacagcagtttag

SEQ ID NO: 2632 - DNA, 22 bp, Homo sapiens
gctgcagctgtaggacacaatt

SEQ ID NO: 2633 - DNA, 22 bp, Homo sapiens
ggaggtaaagtaactcgcccag

SEQ ID NO: 2634 - DNA, 22 bp, Homo sapiens
atcactgtgtatgtatatgcag

SEQ ID NO: 2635 - DNA, 17 bp, Homo sapiens
gattagagaactaagga

SEQ ID NO: 2636 - DNA, 22 bp, Homo sapiens
tgcgcctgcgcaaaggtttctg

SEQ ID NO: 2637 - DNA, 22 bp, Homo sapiens
ttttctaacatctagtaatttg

SEQ ID NO: 2638 - DNA, 22 bp, Homo sapiens
ttaggatttgaaaaggggcaga

SEQ ID NO: 2639 - DNA, 22 bp, Homo sapiens
atgagatgaggaatggccctcc

SEQ ID NO: 2640 - DNA, 22 bp, Homo sapiens
tgcagcaccgtcccactggcta

SEQ ID NO: 2641 - DNA, 22 bp, Homo sapiens
aggccgaggcgggcggatcacc

SEQ ID NO: 2642 - DNA, 22 bp, Homo sapiens
acggtgcagcctgtcccttctc

SEQ ID NO: 2643 - DNA, 22 bp, Homo sapiens
gatccttcagttcgatggggat

SEQ ID NO: 2644 - DNA, 22 bp, Homo sapiens
ctttggaacacccagctctgtg

SEQ ID NO: 2645 - DNA, 22 bp, Homo sapiens
tggcccgaagatccgagggtca

SEQ ID NO: 2646 - DNA, 22 bp, Homo sapiens
tgtaccactctactaagggttc

SEQ ID NO: 2647 - DNA, 19 bp, Homo sapiens
aatgctgcttctttttgca

SEQ ID NO: 2648 - DNA, 22 bp, Homo sapiens
gtgctttgtcttcaggatcata

SEQ ID NO: 2649 - DNA, 22 bp, Homo sapiens
tgcgatgcaacagcttggcgga

SEQ ID NO: 2650 - DNA, 22 bp, Homo sapiens
cttgcacgcacatatttgtgca

SEQ ID NO: 2651 - DNA, 22 bp, Homo sapiens
aaggtagggatgtattcagctt

SEQ ID NO: 2652 - DNA, 22 bp, Homo sapiens
ttcttttaattgtgggggagtg

SEQ ID NO: 2653 - DNA, 22 bp, Homo sapiens
cagcagcagtggctgcagaaca

SEQ ID NO: 2654 - DNA, 22 bp, Homo sapiens
tattgacagtgactattggtag

SEQ ID NO: 2655 - DNA, 22 bp, Homo sapiens
atatgtggcattatttctgagg

SEQ ID NO: 2656 - DNA, 22 bp, Homo sapiens
tgggtgacagagcaagactctg

SEQ ID NO: 2657 - DNA, 22 bp, Homo sapiens
tgggcgacagagcaagactccg

SEQ ID NO: 2658 - DNA, 22 bp, Homo sapiens
gcggtatttgtgtgggtgtcga

SEQ ID NO: 2659 - DNA, 22 bp, Homo sapiens
gctgtatgtttatttgggaatt

SEQ ID NO: 2660 - DNA, 22 bp, Homo sapiens
ggggacctgggcttcaagggtt

SEQ ID NO: 2661 - DNA, 22 bp, Homo sapiens
accaggcccgctgctatggtgg

SEQ ID NO: 2662 - DNA, 22 bp, Homo sapiens
ggagttgattttggatatatta

SEQ ID NO: 2663 - DNA, 22 bp, Homo sapiens
cggtgggattcccagcgacttc

SEQ ID NO: 2664 - DNA, 22 bp, Homo sapiens
tgcgggcgttcgttaccacttt

SEQ ID NO: 2665 - DNA, 22 bp, Homo sapiens
gagatttccatattttgtaaca

SEQ ID NO: 2666 - DNA, 22 bp, Homo sapiens
tgcacgtgggctctctgctctt

SEQ ID NO: 2667 - DNA, 22 bp, Homo sapiens
agaaggacccggtgggagatga

SEQ ID NO: 2668 - DNA, 22 bp, Homo sapiens
tgtgcacctcatccaccagacc

SEQ ID NO: 2669 - DNA, 22 bp, Homo sapiens
tctgccacttgaggtcattggc

SEQ ID NO: 2670 - DNA, 22 bp, Homo sapiens
tctaaattactttgggcagtat

SEQ ID NO: 2671 - DNA, 22 bp, Homo sapiens
ttttgacaatgctaatctcaat

SEQ ID NO: 2672 - DNA, 22 bp, Homo sapiens
atttctctgcagtgttcggaat

SEQ ID NO: 2673 - DNA, 22 bp, Homo sapiens
atgtgagctggggcccggccag

SEQ ID NO: 2674 - DNA, 22 bp, Homo sapiens
acaagcgggccacagtgctggt

SEQ ID NO: 2675 - DNA, 22 bp, Homo sapiens
aatgtgaggccttggtagttat

SEQ ID NO: 2676 - DNA, 22 bp, Homo sapiens
gctgccttgccctcttcccata

SEQ ID NO: 2677 - DNA, 22 bp, Homo sapiens
cttgtagacccctggactcacg

SEQ ID NO: 2678 - DNA, 22 bp, Homo sapiens
aggtagttttgacttcatggct

SEQ ID NO: 2679 - DNA, 22 bp, Homo sapiens
ggcggtcagcgtgggagaggct

SEQ ID NO: 2680 - DNA, 22 bp, Homo sapiens
ccccatgaagtagggtctctga

SEQ ID NO: 2681 - DNA, 22 bp, Homo sapiens
ttgtggaactcatctgcctggt

SEQ ID NO: 2682 - DNA, 23 bp, Homo sapiens
cagtacaatgtggaaaaggagtg

SEQ ID NO: 2683 - DNA, 22 bp, Homo sapiens
acccgggaggcaggagtcatag

SEQ ID NO: 2684 - DNA, 22 bp, Homo sapiens
cattggctcctgtgggacatga

SEQ ID NO: 2685 - DNA, 22 bp, Homo sapiens
gaatgacgccctgtggtcactt

SEQ ID NO: 2686 - DNA, 22 bp, Homo sapiens
gcctcactgcagccccaggaag

SEQ ID NO: 2687 - DNA, 20 bp, Homo sapiens
tgtccccaccaaaatttcat

SEQ ID NO: 2688 - DNA, 22 bp, Homo sapiens
ttcattttctttcacgctgctg

SEQ ID NO: 2689 - DNA, 22 bp, Homo sapiens
gctaggttggggaagttctcct

SEQ ID NO: 2690 - DNA, 19 bp, Homo sapiens
gcgctttattgattgcaag

SEQ ID NO: 2691 - DNA, 22 bp, Homo sapiens
ttgagcaggatggctatgcaca

SEQ ID NO: 2692 - DNA, 22 bp, Homo sapiens
aagccaggttccatggaggagc

SEQ ID NO: 2693 - DNA, 17 bp, Homo sapiens
tgtagcttctccttctc

SEQ ID NO: 2694 - DNA, 22 bp, Homo sapiens
ggagagggtaggggtcctgccc

SEQ ID NO: 2695 - DNA, 22 bp, Homo sapiens
tgaactcgggaggaggctgcag

SEQ ID NO: 2696 - DNA, 22 bp, Homo sapiens
taaggggcccagaccgggcgcc

SEQ ID NO: 2697 - DNA, 22 bp, Homo sapiens
cccaagaggtggaggttgcagt

SEQ ID NO: 2698 - DNA, 22 bp, Homo sapiens
tggtcacctatagaggagatgt

SEQ ID NO: 2699 - DNA, 22 bp, Homo sapiens
ggcctctgccccgcggggctcg

SEQ ID NO: 2700 - DNA, 22 bp, Homo sapiens
tcctcagcttttatttcacttg

SEQ ID NO: 2701 - DNA, 22 bp, Homo sapiens
cgcaggtgaaagaggctgggca

SEQ ID NO: 2702 - DNA, 22 bp, Homo sapiens
tcatcagaggcatctggcaagg

SEQ ID NO: 2703 - DNA, 22 bp, Homo sapiens
gctcaagccttctgcccacctc

SEQ ID NO: 2704 - DNA, 22 bp, Homo sapiens
gagcccaggagtttgatgctgc

SEQ ID NO: 2705 - DNA, 22 bp, Homo sapiens
tgagtcagccttggcagcccct

SEQ ID NO: 2706 - DNA, 22 bp, Homo sapiens
tcagcagtgagaattaatgttg

SEQ ID NO: 2707 - DNA, 22 bp, Homo sapiens
cggggacacactggcagctcct

SEQ ID NO: 2708 - DNA, 23 bp, Homo sapiens
tcctcgcaggagggagatgatgc

SEQ ID NO: 2709 - DNA, 22 bp, Homo sapiens
tctcatgttgcttaactctatg

SEQ ID NO: 2710 - DNA, 22 bp, Homo sapiens
caggtggcagtgcctgcattct

SEQ ID NO: 2711 - DNA, 19 bp, Homo sapiens
agggaatccggctgaggga

SEQ ID NO: 2712 - DNA, 22 bp, Homo sapiens
ggccagcctggggctcccagac

SEQ ID NO: 2713 - DNA, 22 bp, Homo sapiens
gttaggatatggtgaaatggag

SEQ ID NO: 2714 - DNA, 22 bp, Homo sapiens
ggcgcagttgagcgtgctgttc

SEQ ID NO: 2715 - DNA, 22 bp, Homo sapiens
gctgctgcttgaaggctcggag

SEQ ID NO: 2716 - DNA, 22 bp, Homo sapiens
ttagtattaggatcatatttga

SEQ ID NO: 2717 - DNA, 22 bp, Homo sapiens
ttctggtgggactcaggctttc

SEQ ID NO: 2718 - DNA, 22 bp, Homo sapiens
cttcatgctgatatcctcgatg

SEQ ID NO: 2719 - DNA, 22 bp, Homo sapiens
cgagcatgatgacggctgtggc

SEQ ID NO: 2720 - DNA, 22 bp, Homo sapiens
ggtgaattaccaaaggggcaga

SEQ ID NO: 2721 - DNA, 22 bp, Homo sapiens
gccgtgtcatctgcgggtggca

SEQ ID NO: 2722 - DNA, 22 bp, Homo sapiens
aaatatcttaggagtatatgag

SEQ ID NO: 2723 - DNA, 22 bp, Homo sapiens
gggacgacaggctctgtggtag

SEQ ID NO: 2724 - DNA, 22 bp, Homo sapiens
tctgaggaactggcaaagatgg

SEQ ID NO: 2725 - DNA, 22 bp, Homo sapiens
cttgatgagtcagaactgaagg

SEQ ID NO: 2726 - DNA, 18 bp, Homo sapiens
taggagagaatttattta

SEQ ID NO: 2727 - DNA, 20 bp, Homo sapiens
ggcctcggacttcatcgtag

SEQ ID NO: 2728 - DNA, 22 bp, Homo sapiens
tttcaccatcttggccaggctg

SEQ ID NO: 2729 - DNA, 22 bp, Homo sapiens
tctgtatctcacttctttgtgg

SEQ ID NO: 2730 - DNA, 22 bp, Homo sapiens
ggacacgtggctgaaggcggcc

SEQ ID NO: 2731 - DNA, 22 bp, Homo sapiens
ttgcagattcggctgctcagga

SEQ ID NO: 2732 - DNA, 22 bp, Homo sapiens
ctaaaatgtttggggcagaacc

SEQ ID NO: 2733 - DNA, 21 bp, Homo sapiens
agtgcaatggctcgatctcgg

SEQ ID NO: 2734 - DNA, 22 bp, Homo sapiens
tgggttcacgccattctcctgc

SEQ ID NO: 2735 - DNA, 22 bp, Homo sapiens
acccaaaagtcactcaggagca

SEQ ID NO: 2736 - DNA, 22 bp, Homo sapiens
tcttggtctgtggcaggtgccg

SEQ ID NO: 2737 - DNA, 22 bp, Homo sapiens
gagtcggaggcaggagacctgg

SEQ ID NO: 2738 - DNA, 22 bp, Homo sapiens
acaggtcctcaagtcagctggg

SEQ ID NO: 2739 - DNA, 22 bp, Homo sapiens
gccaggaaagggaattccctga

SEQ ID NO: 2740 - DNA, 22 bp, Homo sapiens
acatgtaatacatccagcaata

SEQ ID NO: 2741 - DNA, 22 bp, Homo sapiens
taggctgggggtaggaattgag

SEQ ID NO: 2742 - DNA, 22 bp, Homo sapiens
tcacagtgttaaacctttcttt

SEQ ID NO: 2743 - DNA, 22 bp, Homo sapiens
ggggtggatttcaggcggtgtc

SEQ ID NO: 2744 - DNA, 22 bp, Homo sapiens
acggtgctgggtattggggttc

SEQ ID NO: 2745 - DNA, 22 bp, Homo sapiens
attgtggtgtcagttataggca

SEQ ID NO: 2746 - DNA, 21 bp, Homo sapiens
ttgatggtgggtgatgctctg

SEQ ID NO: 2747 - DNA, 22 bp, Homo sapiens
cggggttcatccatgctgtggc

SEQ ID NO: 2748 - DNA, 22 bp, Homo sapiens
agtttccatcccacacttgctt

SEQ ID NO: 2749 - DNA, 19 bp, Homo sapiens
agtcctggcctgggggacc

SEQ ID NO: 2750 - DNA, 22 bp, Homo sapiens
ttggattcgtgcaaaagtaata

SEQ ID NO: 2751 - DNA, 22 bp, Homo sapiens
caggtggtcaggcaaggacacg

SEQ ID NO: 2752 - DNA, 22 bp, Homo sapiens
tttctaatctgattctcctacc

SEQ ID NO: 2753 - DNA, 22 bp, Homo sapiens
aaaagtaattgtggttttggcc

SEQ ID NO: 2754 - DNA, 22 bp, Homo sapiens
tgatgcgtctcctctttcaggt

SEQ ID NO: 2755 - DNA, 22 bp, Homo sapiens
tgctgttagtaaggaacatgac

SEQ ID NO: 2756 - DNA, 22 bp, Homo sapiens
cccaggaggtggagttcacagt

SEQ ID NO: 2757 - DNA, 22 bp, Homo sapiens
acttaccagagaggatccgccc

SEQ ID NO: 2758 - DNA, 22 bp, Homo sapiens
gccgggaccaaggccacggagc

SEQ ID NO: 2759 - DNA, 22 bp, Homo sapiens
gcgagggcacgcggttgaaggc

SEQ ID NO: 2760 - DNA, 22 bp, Homo sapiens
gacagtgaacaggttcccactg

SEQ ID NO: 2761 - DNA, 22 bp, Homo sapiens
cccctcgcctgcagagcacagc

SEQ ID NO: 2762 - DNA, 22 bp, Homo sapiens
tgggctgcaggggttgagagct

SEQ ID NO: 2763 - DNA, 22 bp, Homo sapiens
atgcagccccctggtgcccggg

SEQ ID NO: 2764 - DNA, 22 bp, Homo sapiens
actctgtcttcatatttgcatt

SEQ ID NO: 2765 - DNA, 22 bp, Homo sapiens
ttagggttacaccagcctcctg

SEQ ID NO: 2766 - DNA, 22 bp, Homo sapiens
tcattctcacactcgtcaatgt

SEQ ID NO: 2767 - DNA, 22 bp, Homo sapiens
tcaaatgctgtattgtagtaat

SEQ ID NO: 2768 - DNA, 21 bp, Homo sapiens
ctggaggcaggtggtgccagg

SEQ ID NO: 2769 - DNA, 22 bp, Homo sapiens
cagcccaggactgcaggtgttt

SEQ ID NO: 2770 - DNA, 22 bp, Homo sapiens
cctttaggagtgaggaccgagc

SEQ ID NO: 2771 - DNA, 22 bp, Homo sapiens
agatttatgtggtcacactcag

SEQ ID NO: 2772 - DNA, 22 bp, Homo sapiens
gtctctatcatagctgaaccct

SEQ ID NO: 2773 - DNA, 22 bp, Homo sapiens
tccggtccgggtactcctctct

SEQ ID NO: 2774 - DNA, 22 bp, Homo sapiens
caactgctgggatggggtagag

SEQ ID NO: 2775 - DNA, 22 bp, Homo sapiens
gtggctcacgcctgtaatccca

SEQ ID NO: 2776 - DNA, 22 bp, Homo sapiens
gggccggagctgggtcccgcgc

SEQ ID NO: 2777 - DNA, 22 bp, Homo sapiens
gagcaacacgcagtagtatacg

SEQ ID NO: 2778 - DNA, 19 bp, Homo sapiens
gcataaatacactattgtc

SEQ ID NO: 2779 - DNA, 22 bp, Homo sapiens
ccattgcactccatcctgggca

SEQ ID NO: 2780 - DNA, 22 bp, Homo sapiens
gaccttgtgatctgcctgcctt

SEQ ID NO: 2781 - DNA, 22 bp, Homo sapiens
tgtccccacccaaatctcatct

SEQ ID NO: 2782 - DNA, 22 bp, Homo sapiens
gcaaaagtacagccggatttct

SEQ ID NO: 2783 - DNA, 22 bp, Homo sapiens
atacttctttagcatattgaac

SEQ ID NO: 2784 - DNA, 23 bp, Homo sapiens
acctgtctgcctcccaccatcaa

SEQ ID NO: 2785 - DNA, 22 bp, Homo sapiens
gttggccaggctggtctcaaac

SEQ ID NO: 2786 - DNA, 22 bp, Homo sapiens
tcccttgggagtggtgaccaca

SEQ ID NO: 2787 - DNA, 22 bp, Homo sapiens
agagtactgctgctgggtactg

SEQ ID NO: 2788 - DNA, 22 bp, Homo sapiens
cctgggaatcggtgcgttgagg

SEQ ID NO: 2789 - DNA, 22 bp, Homo sapiens
ctcagagtcccttccctcgtgg

SEQ ID NO: 2790 - DNA, 22 bp, Homo sapiens
gcgttggggaccccgaagctgg

SEQ ID NO: 2791 - DNA, 22 bp, Homo sapiens
ggctgtggcagctggaagtggt

SEQ ID NO: 2792 - DNA, 22 bp, Homo sapiens
cagctgttcattgttgccaccc

SEQ ID NO: 2793 - DNA, 22 bp, Homo sapiens
ttgcttcctctagtttcttgaa

SEQ ID NO: 2794 - DNA, 22 bp, Homo sapiens
agctatgggtgtgggttccatt

SEQ ID NO: 2795 - DNA, 22 bp, Homo sapiens
cagggtgctgcaccatccctca

SEQ ID NO: 2796 - DNA, 19 bp, Homo sapiens
tccagatgatatggattac

SEQ ID NO: 2797 - DNA, 22 bp, Homo sapiens
tcataaattctggtgctgtgag

SEQ ID NO: 2798 - DNA, 22 bp, Homo sapiens
tgttctctaagccacccatttt

SEQ ID NO: 2799 - DNA, 22 bp, Homo sapiens
tatgcagtgagcactatttata

SEQ ID NO: 2800 - DNA, 22 bp, Homo sapiens
gatgcgggcccgctccactgcc

SEQ ID NO: 2801 - DNA, 22 bp, Homo sapiens
cagctggttgaagaggagctgg

SEQ ID NO: 2802 - DNA, 22 bp, Homo sapiens
acgaatcattcacggacaacac

SEQ ID NO: 2803 - DNA, 22 bp, Homo sapiens
tcctcctgtctaccagttcctg

SEQ ID NO: 2804 - DNA, 22 bp, Homo sapiens
gcggggacagaaggcggttctc

SEQ ID NO: 2805 - DNA, 22 bp, Homo sapiens
taggtcagaacaagcagtatcg

SEQ ID NO: 2806 - DNA, 22 bp, Homo sapiens
agggccagcactcctggcagga

SEQ ID NO: 2807 - DNA, 22 bp, Homo sapiens
caatagtaaattacggaggaga

SEQ ID NO: 2808 - DNA, 22 bp, Homo sapiens
tgctttgtgacagattagtttt

SEQ ID NO: 2809 - DNA, 22 bp, Homo sapiens
tgagctgtatattgttttaata

SEQ ID NO: 2810 - DNA, 22 bp, Homo sapiens
agcgcccaggggcagggctctc

SEQ ID NO: 2811 - DNA, 22 bp, Homo sapiens
ggcctttgcgtccacgccgctt

SEQ ID NO: 2812 - DNA, 22 bp, Homo sapiens
ctggggaacgcagcgagcagcg

SEQ ID NO: 2813 - DNA, 22 bp, Homo sapiens
gtgggctgcccttgaggtcagc

SEQ ID NO: 2814 - DNA, 22 bp, Homo sapiens
agtggcctggagccccgcctgg

SEQ ID NO: 2815 - DNA, 22 bp, Homo sapiens
ggccgtcagccccgatttgcca

SEQ ID NO: 2816 - DNA, 18 bp, Homo sapiens
gaattgtgctaaggtgat

SEQ ID NO: 2817 - DNA, 22 bp, Homo sapiens
gctgacccctacaggttgtgtt

SEQ ID NO: 2818 - DNA, 22 bp, Homo sapiens
gacatagctcagagctcagcac

SEQ ID NO: 2819 - DNA, 22 bp, Homo sapiens
atgagctagaaaaccatgtgga

SEQ ID NO: 2820 - DNA, 22 bp, Homo sapiens
tactgtactgcagttctgcaaa

SEQ ID NO: 2821 - DNA, 22 bp, Homo sapiens
gcgggtgatcacctgaggtcag

SEQ ID NO: 2822 - DNA, 22 bp, Homo sapiens
gagactgtcacttgggacctgt

SEQ ID NO: 2823 - DNA, 22 bp, Homo sapiens
cctggctcctacgggtattttg

SEQ ID NO: 2824 - DNA, 22 bp, Homo sapiens
agagtgtaccaaatatcctaca

SEQ ID NO: 2825 - DNA, 22 bp, Homo sapiens
tctttggatggaaattggagtc

SEQ ID NO: 2826 - DNA, 16 bp, Homo sapiens
ccacctgcagctctca

SEQ ID NO: 2827 - DNA, 22 bp, Homo sapiens
gtctttcttaaacaacagaaca

SEQ ID NO: 2828 - DNA, 22 bp, Homo sapiens
ttgatgagaccattgccgcgtc

SEQ ID NO: 2829 - DNA, 17 bp, Homo sapiens
tctgagaatgctggagg

SEQ ID NO: 2830 - DNA, 22 bp, Homo sapiens
gtcatcatcaggcagatgctgc

SEQ ID NO: 2831 - DNA, 22 bp, Homo sapiens
gtggcaagatgactactcactg

SEQ ID NO: 2832 - DNA, 22 bp, Homo sapiens
ggggtcggggcatagccactta

SEQ ID NO: 2833 - DNA, 22 bp, Homo sapiens
ctcagcttggcctggacgtagc

SEQ ID NO: 2834 - DNA, 19 bp, Homo sapiens
ctccttgccatttcttttc

SEQ ID NO: 2835 - DNA, 22 bp, Homo sapiens
tcctgggacaagccgtggaagt

SEQ ID NO: 2836 - DNA, 22 bp, Homo sapiens
cactgcactccagcctgggcca

SEQ ID NO: 2837 - DNA, 22 bp, Homo sapiens
ttatagcagcatgatttacaat

SEQ ID NO: 2838 - DNA, 23 bp, Homo sapiens
tcatcttcctcatttctccaggg

SEQ ID NO: 2839 - DNA, 22 bp, Homo sapiens
gatctggaatctgaaggctgag

SEQ ID NO: 2840 - DNA, 22 bp, Homo sapiens
atctgagctccgcctcctgtca

SEQ ID NO: 2841 - DNA, 22 bp, Homo sapiens
ctgatattctattttgcttgct

SEQ ID NO: 2842 - DNA, 22 bp, Homo sapiens
atgggtcagttcagtggccaac

SEQ ID NO: 2843 - DNA, 20 bp, Homo sapiens
tttgaatgtaaagcatgtca

SEQ ID NO: 2844 - DNA, 21 bp, Homo sapiens
gtgacctgcgcggggcgcagc

SEQ ID NO: 2845 - DNA, 22 bp, Homo sapiens
tctgccttttactagctggatg

SEQ ID NO: 2846 - DNA, 22 bp, Homo sapiens
ttgcttcagagggagacacttt

SEQ ID NO: 2847 - DNA, 22 bp, Homo sapiens
gagcgcacagaaggaagcagcc

SEQ ID NO: 2848 - DNA, 22 bp, Homo sapiens
catcatactgtttacactcaaa

SEQ ID NO: 2849 - DNA, 22 bp, Homo sapiens
ttaagggccattatggatgggt

SEQ ID NO: 2850 - DNA, 22 bp, Homo sapiens
tagttcaacgagttggggttgc

SEQ ID NO: 2851 - DNA, 22 bp, Homo sapiens
tctatgtctcgacccaagacaa

SEQ ID NO: 2852 - DNA, 22 bp, Homo sapiens
ccgggaggtggagattgcggtg

SEQ ID NO: 2853 - DNA, 22 bp, Homo sapiens
ccaggaggtggagattgcagtg

SEQ ID NO: 2854 - DNA, 22 bp, Homo sapiens
atgggttcaagtgattctcctg

SEQ ID NO: 2855 - DNA, 22 bp, Homo sapiens
tctttctacatcatttgcttct

SEQ ID NO: 2856 - DNA, 22 bp, Homo sapiens
cgagagagacatggtgacctgc

SEQ ID NO: 2857 - DNA, 22 bp, Homo sapiens
tgaagttgttaaggttgccatt

SEQ ID NO: 2858 - DNA, 22 bp, Homo sapiens
gagctgtgtatgcatcattctg

SEQ ID NO: 2859 - DNA, 22 bp, Homo sapiens
atgtccttcctgagatccctgt

SEQ ID NO: 2860 - DNA, 22 bp, Homo sapiens
tcacgtgagggacctgtgtctg

SEQ ID NO: 2861 - DNA, 22 bp, Homo sapiens
catgtgtcttgctgccctccat

SEQ ID NO: 2862 - DNA, 19 bp, Homo sapiens
tgagggtgagctttggaga

SEQ ID NO: 2863 - DNA, 22 bp, Homo sapiens
agagctccagggttttgtagtg

SEQ ID NO: 2864 - DNA, 22 bp, Homo sapiens
tggggcatgtgaacctggatgt

SEQ ID NO: 2865 - DNA, 22 bp, Homo sapiens
gcctcctgtcccaggctgagga

SEQ ID NO: 2866 - DNA, 22 bp, Homo sapiens
ccaggtagccaaggggtctggg

SEQ ID NO: 2867 - DNA, 22 bp, Homo sapiens
ggaaaatgggaacctgaagcca

SEQ ID NO: 2868 - DNA, 22 bp, Homo sapiens
ctgcccccagcctgggcttcga

SEQ ID NO: 2869 - DNA, 22 bp, Homo sapiens
ttgctcagtggcagggctggta

SEQ ID NO: 2870 - DNA, 22 bp, Homo sapiens
ttgaggcctgctggaaggtgtt

SEQ ID NO: 2871 - DNA, 22 bp, Homo sapiens
tcacagagatgaacttttgata

SEQ ID NO: 2872 - DNA, 22 bp, Homo sapiens
tagggtagtaccatgctgccag

SEQ ID NO: 2873 - DNA, 22 bp, Homo sapiens
cttgcacgtcagatcttcctca

SEQ ID NO: 2874 - DNA, 15 bp, Homo sapiens
tggcccacccgttga

SEQ ID NO: 2875 - DNA, 20 bp, Homo sapiens
tgggtgaagacagctgtagc

SEQ ID NO: 2876 - DNA, 22 bp, Homo sapiens
ctaccgggttctcagccaggca

SEQ ID NO: 2877 - DNA, 22 bp, Homo sapiens
agggagatcgaccgtgttatat

SEQ ID NO: 2878 - DNA, 22 bp, Homo sapiens
cagcctttgggtcagaagattc

SEQ ID NO: 2879 - DNA, 22 bp, Homo sapiens
tttgagaagcatggctgtattc

SEQ ID NO: 2880 - DNA, 22 bp, Homo sapiens
aaggcaggatgggaaaagattt

SEQ ID NO: 2881 - DNA, 22 bp, Homo sapiens
agtcttagaactacagtgccta

SEQ ID NO: 2882 - DNA, 22 bp, Homo sapiens
ctgaggaggctaatttgaggat

SEQ ID NO: 2883 - DNA, 18 bp, Homo sapiens
cttgttcttctcttggcg

SEQ ID NO: 2884 - DNA, 22 bp, Homo sapiens
tgagtgattaggtttttccttc

SEQ ID NO: 2885 - DNA, 22 bp, Homo sapiens
gaatccctaagatttttataaa

SEQ ID NO: 2886 - DNA, 22 bp, Homo sapiens
gcccttacagggtggtcagcca

SEQ ID NO: 2887 - DNA, 22 bp, Homo sapiens
ggaggacaggggctgcagcaca

SEQ ID NO: 2888 - DNA, 22 bp, Homo sapiens
ttgggatacatcttgctgagcc

SEQ ID NO: 2889 - DNA, 22 bp, Homo sapiens
agtccgtcctgtcaagcagctg

SEQ ID NO: 2890 - DNA, 23 bp, Homo sapiens
gcaagagacagagcatcctgttc

SEQ ID NO: 2891 - DNA, 22 bp, Homo sapiens
tagcataacaggtaagagtgag

SEQ ID NO: 2892 - DNA, 22 bp, Homo sapiens
cactgaacaacaaatagtgaat

SEQ ID NO: 2893 - DNA, 22 bp, Homo sapiens
tactgcattatcaaggggaagg

SEQ ID NO: 2894 - DNA, 22 bp, Homo sapiens
ccggggtaggccctgaggcagc

SEQ ID NO: 2895 - DNA, 22 bp, Homo sapiens
gcctctgagctcctttgaccac

SEQ ID NO: 2896 - DNA, 22 bp, Homo sapiens
tgctggacagggcacggcccat

SEQ ID NO: 2897 - DNA, 22 bp, Homo sapiens
atgccactgcgctctagcctgg

SEQ ID NO: 2898 - DNA, 22 bp, Homo sapiens
aggagcagaccgtagtcctgca

SEQ ID NO: 2899 - DNA, 22 bp, Homo sapiens
gctggagaggatcccaaagcca

SEQ ID NO: 2900 - DNA, 22 bp, Homo sapiens
cacctgccaaatggggatgctg

SEQ ID NO: 2901 - DNA, 22 bp, Homo sapiens
gcctatctgtcaaatttctctg

SEQ ID NO: 2902 - DNA, 22 bp, Homo sapiens
atagacgcggccgctgatgcag

SEQ ID NO: 2903 - DNA, 20 bp, Homo sapiens
tgcagcacgggccctttcca

SEQ ID NO: 2904 - DNA, 22 bp, Homo sapiens
acccggcggagcctgcagtgag

SEQ ID NO: 2905 - DNA, 22 bp, Homo sapiens
ttgtcagccagctcgcactctt

SEQ ID NO: 2906 - DNA, 22 bp, Homo sapiens
ataaaatttgctactgttaaat

SEQ ID NO: 2907 - DNA, 22 bp, Homo sapiens
agattgtcattgacgatgagca

SEQ ID NO: 2908 - DNA, 22 bp, Homo sapiens
aacttgatcctgctgggtacta

SEQ ID NO: 2909 - DNA, 22 bp, Homo sapiens
gctgagactgacatgaagaggt

SEQ ID NO: 2910 - DNA, 22 bp, Homo sapiens
agaatacttgggaatgggttaa

SEQ ID NO: 2911 - DNA, 22 bp, Homo sapiens
gggcccttcagcttcctctgca

SEQ ID NO: 2912 - DNA, 22 bp, Homo sapiens
cccccagctctgctgggtcccg

SEQ ID NO: 2913 - DNA, 22 bp, Homo sapiens
actgcactccagcctgggcaac

SEQ ID NO: 2914 - DNA, 22 bp, Homo sapiens
tttgaagggcacgacaatagtt

SEQ ID NO: 2915 - DNA, 22 bp, Homo sapiens
tgtatgtatgaataagcaagat

SEQ ID NO: 2916 - DNA, 22 bp, Homo sapiens
agcgccaagtgtgtggaggagg

SEQ ID NO: 2917 - DNA, 22 bp, Homo sapiens
tgtgttaaggtgcatctagtgc

SEQ ID NO: 2918 - DNA, 22 bp, Homo sapiens
cttcatagtgagtttaatgatg

SEQ ID NO: 2919 - DNA, 22 bp, Homo sapiens
cacagctgaagtagccatgtgg

SEQ ID NO: 2920 - DNA, 22 bp, Homo sapiens
gatcctgggcccttctgggtca

SEQ ID NO: 2921 - DNA, 22 bp, Homo sapiens
aatgccagtgtgttgattccag

SEQ ID NO: 2922 - DNA, 22 bp, Homo sapiens
tcctcggctgggccccaggctt

SEQ ID NO: 2923 - DNA, 22 bp, Homo sapiens
tatgccgcagccggatttcccc

SEQ ID NO: 2924 - DNA, 18 bp, Homo sapiens
acacttcctggtggtgtg

SEQ ID NO: 2925 - DNA, 19 bp, Homo sapiens
tctcacagctctactatgt

SEQ ID NO: 2926 - DNA, 22 bp, Homo sapiens
acaaccaagaacagagggaaag

SEQ ID NO: 2927 - DNA, 22 bp, Homo sapiens
agatgcttactatggttgtatg

SEQ ID NO: 2928 - DNA, 22 bp, Homo sapiens
tgcctaggctggagtgcaatgg

SEQ ID NO: 2929 - DNA, 22 bp, Homo sapiens
tgtgcattaactccacaagcag

SEQ ID NO: 2930 - DNA, 22 bp, Homo sapiens
gggcggggggagctggaatgaa

SEQ ID NO: 2931 - DNA, 22 bp, Homo sapiens
ctggcctggcgcagtggctcac

SEQ ID NO: 2932 - DNA, 22 bp, Homo sapiens
tgaaatctttagtttctgtccc

SEQ ID NO: 2933 - DNA, 22 bp, Homo sapiens
agcttggccagcagccgcgacg

SEQ ID NO: 2934 - DNA, 22 bp, Homo sapiens
ctccttctgggcctggcagtgg

SEQ ID NO: 2935 - DNA, 22 bp, Homo sapiens
ccagtaacacctcgcagactcc

SEQ ID NO: 2936 - DNA, 20 bp, Homo sapiens
catgtgtcagttctcaccca

SEQ ID NO: 2937 - DNA, 22 bp, Homo sapiens
caaggtgccatgctgggcgggg

SEQ ID NO: 2938 - DNA, 22 bp, Homo sapiens
agtgggccggacagcccaggcc

SEQ ID NO: 2939 - DNA, 22 bp, Homo sapiens
cgtgccctgcgcaagtgctgct

SEQ ID NO: 2940 - DNA, 22 bp, Homo sapiens
tgcttatatttcattggcccaa

SEQ ID NO: 2941 - DNA, 22 bp, Homo sapiens
tgcgcctgtaagtccagagtcc

SEQ ID NO: 2942 - DNA, 22 bp, Homo sapiens
ccaaagtgctaggattacaggc

SEQ ID NO: 2943 - DNA, 22 bp, Homo sapiens
cagtgatatttatcctactcac

SEQ ID NO: 2944 - DNA, 22 bp, Homo sapiens
actgctggggctcattcatctc

SEQ ID NO: 2945 - DNA, 22 bp, Homo sapiens
agaaagagatgaatgctttaag

SEQ ID NO: 2946 - DNA, 22 bp, Homo sapiens
ccgccgtgtcgacaggccctgg

SEQ ID NO: 2947 - DNA, 22 bp, Homo sapiens
tgccgcaagtactgctgcctgt

SEQ ID NO: 2948 - DNA, 22 bp, Homo sapiens
cgtgccactgcactctagcctg

SEQ ID NO: 2949 - DNA, 22 bp, Homo sapiens
catggcagctcctccagtgtga

SEQ ID NO: 2950 - DNA, 22 bp, Homo sapiens
aaggagcacacaatctagaacc

SEQ ID NO: 2951 - DNA, 22 bp, Homo sapiens
aaagtgctcggattacaggtat

SEQ ID NO: 2952 - DNA, 22 bp, Homo sapiens
tcccgggcaggtcgagcgagcc

SEQ ID NO: 2953 - DNA, 22 bp, Homo sapiens
tccaccctgcttttgtctttga

SEQ ID NO: 2954 - DNA, 22 bp, Homo sapiens
actgcactccagcccgagcaac

SEQ ID NO: 2955 - DNA, 22 bp, Homo sapiens
caactcgatgggtggagaaaat

SEQ ID NO: 2956 - DNA, 22 bp, Homo sapiens
aggctgaggcaagaggatcact

SEQ ID NO: 2957 - DNA, 22 bp, Homo sapiens
acatacttctttacattccata

SEQ ID NO: 2958 - DNA, 22 bp, Homo sapiens
ggcttagcaactcctgaggctc

SEQ ID NO: 2959 - DNA, 22 bp, Homo sapiens
gtggcatctcagaggccaagaa

SEQ ID NO: 2960 - DNA, 22 bp, Homo sapiens
gaaaaggcagagttccggggaa

SEQ ID NO: 2961 - DNA, 22 bp, Homo sapiens
actgtgaacggactgaagccca

SEQ ID NO: 2962 - DNA, 22 bp, Homo sapiens
ctggggaccagtgtctgtttgt

SEQ ID NO: 2963 - DNA, 22 bp, Homo sapiens
gaacccaggaggcagaggttgc

SEQ ID NO: 2964 - DNA, 22 bp, Homo sapiens
ccagcatccatgctccctcggg

SEQ ID NO: 2965 - DNA, 22 bp, Homo sapiens
ggaatcctgccagctctgcccc

SEQ ID NO: 2966 - DNA, 22 bp, Homo sapiens
aacagtgctgttataaatgtac

SEQ ID NO: 2967 - DNA, 22 bp, Homo sapiens
ctgagcacgtagttagggtcca

SEQ ID NO: 2968 - DNA, 22 bp, Homo sapiens
aaagtgctgggattacaggtgt

SEQ ID NO: 2969 - DNA, 22 bp, Homo sapiens
cctgtaactccttggctcaagt

SEQ ID NO: 2970 - DNA, 22 bp, Homo sapiens
actgggccaggtgtgggtgagt

SEQ ID NO: 2971 - DNA, 22 bp, Homo sapiens
gtgcacttgatctagacagatt

SEQ ID NO: 2972 - DNA, 22 bp, Homo sapiens
tctgttgcaatgtgcatggtga

SEQ ID NO: 2973 - DNA, 22 bp, Homo sapiens
actggggtttaggcctgggcaa

SEQ ID NO: 2974 - DNA, 22 bp, Homo sapiens
gaacccggggaggttgcagtga

SEQ ID NO: 2975 - DNA, 22 bp, Homo sapiens
tgagagttctctcttcaggtgg

SEQ ID NO: 2976 - DNA, 22 bp, Homo sapiens
ctggcctaaaaatacagaacaa

SEQ ID NO: 2977 - DNA, 22 bp, Homo sapiens
tatgcacaacatgcaggtttgt

SEQ ID NO: 2978 - DNA, 22 bp, Homo sapiens
cagagactggagtgcagtggcg

SEQ ID NO: 2979 - DNA, 22 bp, Homo sapiens
caggtgcctcaggatgagacaa

SEQ ID NO: 2980 - DNA, 22 bp, Homo sapiens
gcggcccgagcaggacgggtgg

SEQ ID NO: 2981 - DNA, 23 bp, Homo sapiens
catctagcatccagtgagtagtg

SEQ ID NO: 2982 - DNA, 20 bp, Homo sapiens
ctgccgaccacagccatgga

SEQ ID NO: 2983 - DNA, 22 bp, Homo sapiens
cactgcagcctcaaattcctgg

SEQ ID NO: 2984 - DNA, 22 bp, Homo sapiens
gatttttatataaagtgagaaa

SEQ ID NO: 2985 - DNA, 22 bp, Homo sapiens
ggcagggagtggagactcccta

SEQ ID NO: 2986 - DNA, 22 bp, Homo sapiens
tacccaaggccctttcaatttc

SEQ ID NO: 2987 - DNA, 18 bp, Homo sapiens
agagtgttctcagtgaaa

SEQ ID NO: 2988 - DNA, 22 bp, Homo sapiens
ggagtgtgattgttctctgtta

SEQ ID NO: 2989 - DNA, 22 bp, Homo sapiens
agcccgcatctcgctaaagata

SEQ ID NO: 2990 - DNA, 22 bp, Homo sapiens
tgcaggctcttggtgacgtggg

SEQ ID NO: 2991 - DNA, 22 bp, Homo sapiens
attacctatttcattttctgtc

SEQ ID NO: 2992 - DNA, 22 bp, Homo sapiens
accaccttcctgcgtgtctctt

SEQ ID NO: 2993 - DNA, 22 bp, Homo sapiens
aaactgtcctcccgaggtttcc

SEQ ID NO: 2994 - DNA, 21 bp, Homo sapiens
aaccaagccagccagcctctc

SEQ ID NO: 2995 - DNA, 22 bp, Homo sapiens
tccccatgtctgcagggagggt

SEQ ID NO: 2996 - DNA, 22 bp, Homo sapiens
tccactgctacaacctcccaga

SEQ ID NO: 2997 - DNA, 22 bp, Homo sapiens
gatataggttcatagtgttaca

SEQ ID NO: 2998 - DNA, 22 bp, Homo sapiens
gcccaggctggagttcagtggt

SEQ ID NO: 2999 - DNA, 22 bp, Homo sapiens
gagcctcatggtcatcttgagt

SEQ ID NO: 3000 - DNA, 22 bp, Homo sapiens
agcctgcgatcccacctggcct

SEQ ID NO: 3001 - DNA, 22 bp, Homo sapiens
atgagttgaagctacaagaggc

SEQ ID NO: 3002 - DNA, 22 bp, Homo sapiens
ttgtgctcctgtgagaatctag

SEQ ID NO: 3003 - DNA, 21 bp, Homo sapiens
ttcagcttgctgactgcggca

SEQ ID NO: 3004 - DNA, 22 bp, Homo sapiens
aaggctgtggttctatacagaa

SEQ ID NO: 3005 - DNA, 22 bp, Homo sapiens
ggaggtcccaggcctggcagca

SEQ ID NO: 3006 - DNA, 22 bp, Homo sapiens
ctgatgaggatatagatacaca

SEQ ID NO: 3007 - DNA, 22 bp, Homo sapiens
tggttcgtctcttttacagttc

SEQ ID NO: 3008 - DNA, 22 bp, Homo sapiens
acccagtgttgggcagaactgt

SEQ ID NO: 3009 - DNA, 22 bp, Homo sapiens
aggtgacaggacaggagctggt

SEQ ID NO: 3010 - DNA, 23 bp, Homo sapiens
tctacaaagctgtgtcaggaccc

SEQ ID NO: 3011 - DNA, 22 bp, Homo sapiens
tggtctgtcccactctgccctt

SEQ ID NO: 3012 - DNA, 22 bp, Homo sapiens
taacctctctgtgcctcagttt

SEQ ID NO: 3013 - DNA, 22 bp, Homo sapiens
atgaaatgctattttggctaga

SEQ ID NO: 3014 - DNA, 22 bp, Homo sapiens
agccttacataaacagccttat

SEQ ID NO: 3015 - DNA, 22 bp, Homo sapiens
ttttaatactgctattgtagga

SEQ ID NO: 3016 - DNA, 22 bp, Homo sapiens
tgtgtctgtgtatacacggcat

SEQ ID NO: 3017 - DNA, 22 bp, Homo sapiens
atgattgaccatctgctgggct

SEQ ID NO: 3018 - DNA, 22 bp, Homo sapiens
tccaaagtgttgggattatagg

SEQ ID NO: 3019 - DNA, 22 bp, Homo sapiens
tgtcaccatgcgaggctaattt

SEQ ID NO: 3020 - DNA, 22 bp, Homo sapiens
gcctccggagttgcagtgtctt

SEQ ID NO: 3021 - DNA, 22 bp, Homo sapiens
cagcctggtccccggctcaccc

SEQ ID NO: 3022 - DNA, 22 bp, Homo sapiens
gtgcctcagttggaaatgcaga

SEQ ID NO: 3023 - DNA, 22 bp, Homo sapiens
gcccaggctggagtgcagtggc

SEQ ID NO: 3024 - DNA, 22 bp, Homo sapiens
cagctacaaatacttttgtatg

SEQ ID NO: 3025 - DNA, 22 bp, Homo sapiens
cagtgcatgcacacacatggta

SEQ ID NO: 3026 - DNA, 22 bp, Homo sapiens
ccaggctggagtgcaatggcat

SEQ ID NO: 3027 - DNA, 22 bp, Homo sapiens
agcaccaaagtcctgttagggt

SEQ ID NO: 3028 - DNA, 22 bp, Homo sapiens
cctgtacttgtattaaaggtcc

SEQ ID NO: 3029 - DNA, 23 bp, Homo sapiens
cactgcaatctctgcctcctggg

SEQ ID NO: 3030 - DNA, 22 bp, Homo sapiens
caggtgttggaagggcagtggg

SEQ ID NO: 3031 - DNA, 23 bp, Homo sapiens
tccctgactctgggagctcccag

SEQ ID NO: 3032 - DNA, 22 bp, Homo sapiens
tggtttgtctaaatgagtaata

SEQ ID NO: 3033 - DNA, 22 bp, Homo sapiens
ttgagtttcctgacagcgaagg

SEQ ID NO: 3034 - DNA, 22 bp, Homo sapiens
tcaacaccacaatttcttaact

SEQ ID NO: 3035 - DNA, 22 bp, Homo sapiens
tgcctcaagccctccactgcac

SEQ ID NO: 3036 - DNA, 22 bp, Homo sapiens
ttccccttgggctgtggaggag

SEQ ID NO: 3037 - DNA, 22 bp, Homo sapiens
cctccagagggaagtactttct

SEQ ID NO: 3038 - DNA, 22 bp, Homo sapiens
tagctcaaaggttaagtgtgga

SEQ ID NO: 3039 - DNA, 22 bp, Homo sapiens
aggagaagccaagttgtgagca

SEQ ID NO: 3040 - DNA, 22 bp, Homo sapiens
ctccccattatgcagtcattat

SEQ ID NO: 3041 - DNA, 22 bp, Homo sapiens
atctgggagcggaggttgcagt

SEQ ID NO: 3042 - DNA, 22 bp, Homo sapiens
acccatggtctggtggggccct

SEQ ID NO: 3043 - DNA, 22 bp, Homo sapiens
tcccggcgctgggaggtgggtc

SEQ ID NO: 3044 - DNA, 22 bp, Homo sapiens
tggtacctgaatgaagggagga

SEQ ID NO: 3045 - DNA, 19 bp, Homo sapiens
agggttacccgctgccacc

SEQ ID NO: 3046 - DNA, 22 bp, Homo sapiens
cgccaggcttggtagctcatgc

SEQ ID NO: 3047 - DNA, 22 bp, Homo sapiens
ggcgagaagttgttagtggctt

SEQ ID NO: 3048 - DNA, 22 bp, Homo sapiens
acaattctgatggtttcccagt

SEQ ID NO: 3049 - DNA, 22 bp, Homo sapiens
ggaggtggagctggaagttcca

SEQ ID NO: 3050 - DNA, 22 bp, Homo sapiens
ctgccttttaaagccagtgtta

SEQ ID NO: 3051 - DNA, 22 bp, Homo sapiens
aagaatgagctcaaagatctta

SEQ ID NO: 3052 - DNA, 22 bp, Homo sapiens
ggcgccccatgatgagggctag

SEQ ID NO: 3053 - DNA, 22 bp, Homo sapiens
tgagaacggatactaagggctg

SEQ ID NO: 3054 - DNA, 22 bp, Homo sapiens
tatcagcgtgcaaatctttgga

SEQ ID NO: 3055 - DNA, 22 bp, Homo sapiens
tgctgtgttactgagatccggc

SEQ ID NO: 3056 - DNA, 22 bp, Homo sapiens
aggtgggcgctgctcccgctgg

SEQ ID NO: 3057 - DNA, 22 bp, Homo sapiens
cactgcaagctccgcctcccgg

SEQ ID NO: 3058 - DNA, 22 bp, Homo sapiens
ctaggaccactgtaacaaagta

SEQ ID NO: 3059 - DNA, 20 bp, Homo sapiens
ccaccctgtccggggcggag

SEQ ID NO: 3060 - DNA, 22 bp, Homo sapiens
ctgggcctggggctgttgagag

SEQ ID NO: 3061 - DNA, 22 bp, Homo sapiens
attcttggatttggctctagtg

SEQ ID NO: 3062 - DNA, 22 bp, Homo sapiens
tgctgagcccagaacggcctgg

SEQ ID NO: 3063 - DNA, 20 bp, Homo sapiens
tgtcattcttctttcacagg

SEQ ID NO: 3064 - DNA, 22 bp, Homo sapiens
atgaaatatcttgaagaaattc

SEQ ID NO: 3065 - DNA, 22 bp, Homo sapiens
ggaaggggtgggtgagcctcag

SEQ ID NO: 3066 - DNA, 22 bp, Homo sapiens
gaggttcattcagctctgtcac

SEQ ID NO: 3067 - DNA, 22 bp, Homo sapiens
ctgcgggctgtcaggcgtgcca

SEQ ID NO: 3068 - DNA, 22 bp, Homo sapiens
tctgctggaaaaccagggaatt

SEQ ID NO: 3069 - DNA, 22 bp, Homo sapiens
aggccgaactccaactcctggg

SEQ ID NO: 3070 - DNA, 22 bp, Homo sapiens
ggagaagaggagctggaagcct

SEQ ID NO: 3071 - DNA, 22 bp, Homo sapiens
ctcattccatgtgtattttgag

SEQ ID NO: 3072 - DNA, 22 bp, Homo sapiens
tagaagaaagtgaagctgggga

SEQ ID NO: 3073 - DNA, 22 bp, Homo sapiens
caggggcgggtaaaaggcctcc

SEQ ID NO: 3074 - DNA, 22 bp, Homo sapiens
gcagttctcagccaggcggcag

SEQ ID NO: 3075 - DNA, 22 bp, Homo sapiens
gttcacagtttctaatcccagc

SEQ ID NO: 3076 - DNA, 22 bp, Homo sapiens
gcaaacaaggacatacatcctg

SEQ ID NO: 3077 - DNA, 22 bp, Homo sapiens
tcagggattaaggtcaaaggtg

SEQ ID NO: 3078 - DNA, 22 bp, Homo sapiens
agcttagtggttgtatgagtta

SEQ ID NO: 3079 - DNA, 22 bp, Homo sapiens
gcccaggctggagtgcagtggt

SEQ ID NO: 3080 - DNA, 22 bp, Homo sapiens
catctgctgttccttggactca

SEQ ID NO: 3081 - DNA, 22 bp, Homo sapiens
tttcatctgagtagcgtcggat

SEQ ID NO: 3082 - DNA, 22 bp, Homo sapiens
catgtctgagtcatggtacttc

SEQ ID NO: 3083 - DNA, 22 bp, Homo sapiens
agaacctcaattatttttgcac

SEQ ID NO: 3084 - DNA, 22 bp, Homo sapiens
gggtaggcaaagcaatgacgtt

SEQ ID NO: 3085 - DNA, 22 bp, Homo sapiens
acactgtgtgacttctgagact

SEQ ID NO: 3086 - DNA, 22 bp, Homo sapiens
agggcgctgaaatactaacatg

SEQ ID NO: 3087 - DNA, 22 bp, Homo sapiens
tgaatgtatggtcctgtgaatt

SEQ ID NO: 3088 - DNA, 22 bp, Homo sapiens
ggtggctgcaatggctaacttc

SEQ ID NO: 3089 - DNA, 22 bp, Homo sapiens
ttaagcttcagaacgcaatgat

SEQ ID NO: 3090 - DNA, 22 bp, Homo sapiens
cccgtgtgtgcgaggctcccgc

SEQ ID NO: 3091 - DNA, 21 bp, Homo sapiens
agtatcgtacctttaaggcag

SEQ ID NO: 3092 - DNA, 22 bp, Homo sapiens
cacatgaaggctggggtcgtga

SEQ ID NO: 3093 - DNA, 22 bp, Homo sapiens
tgagagcaacacgcagtagtat

SEQ ID NO: 3094 - DNA, 22 bp, Homo sapiens
ccacactccccgcaggcgtagg

SEQ ID NO: 3095 - DNA, 22 bp, Homo sapiens
ttgtgaatagtgccgctataaa

SEQ ID NO: 3096 - DNA, 22 bp, Homo sapiens
attcgcgggcctggagggtggg

SEQ ID NO: 3097 - DNA, 22 bp, Homo sapiens
gctgcctacgcttgagccctgg

SEQ ID NO: 3098 - DNA, 22 bp, Homo sapiens
ctgcgttctgcctggcggccta

SEQ ID NO: 3099 - DNA, 22 bp, Homo sapiens
ggcagccccatcagagacgctg

SEQ ID NO: 3100 - DNA, 22 bp, Homo sapiens
tcactgcaagctccacctcccg

SEQ ID NO: 3101 - DNA, 22 bp, Homo sapiens
tcctttaaacaaccagctctca

SEQ ID NO: 3102 - DNA, 22 bp, Homo sapiens
gtaaactcagagaatacttctt

SEQ ID NO: 3103 - DNA, 22 bp, Homo sapiens
ggcctctcttgggacagctgtc

SEQ ID NO: 3104 - DNA, 22 bp, Homo sapiens
ccagagtcccttgcagctcagt

SEQ ID NO: 3105 - DNA, 22 bp, Homo sapiens
atctgggaatggaagccttctg

SEQ ID NO: 3106 - DNA, 22 bp, Homo sapiens
gaagagtggttatccctgctgt

SEQ ID NO: 3107 - DNA, 18 bp, Homo sapiens
ggctcaagtgatcctcct

SEQ ID NO: 3108 - DNA, 22 bp, Homo sapiens
ttaagctagtgaagtccctcaa

SEQ ID NO: 3109 - DNA, 22 bp, Homo sapiens
gggatcgggcttgaggggccct

SEQ ID NO: 3110 - DNA, 22 bp, Homo sapiens
gaggcctcatgaggtgagcatt

SEQ ID NO: 3111 - DNA, 22 bp, Homo sapiens
ggccctctttagacagagtagg

SEQ ID NO: 3112 - DNA, 22 bp, Homo sapiens
tacaggacattgtgcatttgtc

SEQ ID NO: 3113 - DNA, 22 bp, Homo sapiens
attgtgaataatgctgcaataa

SEQ ID NO: 3114 - DNA, 22 bp, Homo sapiens
cctttcccgctttgagggcaag

SEQ ID NO: 3115 - DNA, 22 bp, Homo sapiens
ccctgatagcccctatcatcag

SEQ ID NO: 3116 - DNA, 22 bp, Homo sapiens
ctcgggtaccatgctaggcact

SEQ ID NO: 3117 - DNA, 22 bp, Homo sapiens
cactgcaacctctgcctcctgg

SEQ ID NO: 3118 - DNA, 22 bp, Homo sapiens
ggagctgttcaggactgcttca

SEQ ID NO: 3119 - DNA, 23 bp, Homo sapiens
aagtggttttgaacccggaccct

SEQ ID NO: 3120 - DNA, 22 bp, Homo sapiens
attgagaagaaaatctaatata

SEQ ID NO: 3121 - DNA, 20 bp, Homo sapiens
gcgtggcctgggatcccaag

SEQ ID NO: 3122 - DNA, 22 bp, Homo sapiens
tgtgacaagcattgtatattgg

SEQ ID NO: 3123 - DNA, 22 bp, Homo sapiens
tgttcctgcaaggaactggtgc

SEQ ID NO: 3124 - DNA, 22 bp, Homo sapiens
cactgcaagcaagctccgcctc

SEQ ID NO: 3125 - DNA, 22 bp, Homo sapiens
agccagatgaagaggtccttaa

SEQ ID NO: 3126 - DNA, 22 bp, Homo sapiens
gcacatgcatgcatattcctgg

SEQ ID NO: 3127 - DNA, 22 bp, Homo sapiens
tccaggtgacagagacaggata

SEQ ID NO: 3128 - DNA, 22 bp, Homo sapiens
gctctctgcagcctccttggag

SEQ ID NO: 3129 - DNA, 22 bp, Homo sapiens
tcccaccttccgtggaacccgt

SEQ ID NO: 3130 - DNA, 22 bp, Homo sapiens
ggctcatatcccggccatcatt

SEQ ID NO: 3131 - DNA, 22 bp, Homo sapiens
aggcgactgttgatttgaaatt

SEQ ID NO: 3132 - DNA, 22 bp, Homo sapiens
ggagtgtcccgattttccaggt

SEQ ID NO: 3133 - DNA, 22 bp, Homo sapiens
ggctgagtctgtgacccatgcg

SEQ ID NO: 3134 - DNA, 22 bp, Homo sapiens
caggctggagttcagtggtgtg

SEQ ID NO: 3135 - DNA, 22 bp, Homo sapiens
ctccagattccgtttattcagg

SEQ ID NO: 3136 - DNA, 22 bp, Homo sapiens
acactgcagatgaaagcataag

SEQ ID NO: 3137 - DNA, 22 bp, Homo sapiens
gatcatgcttaaagttggagtc

SEQ ID NO: 3138 - DNA, 22 bp, Homo sapiens
tctagtcattcatgctatgatt

SEQ ID NO: 3139 - DNA, 22 bp, Homo sapiens
tcaacagtggcaaagaggcacg

SEQ ID NO: 3140 - DNA, 22 bp, Homo sapiens
gaccttgtgatccagccacctt

SEQ ID NO: 3141 - DNA, 22 bp, Homo sapiens
tgtggggatcttctagcttttc

SEQ ID NO: 3142 - DNA, 22 bp, Homo sapiens
cattcctggcccgggcgccgtc

SEQ ID NO: 3143 - DNA, 22 bp, Homo sapiens
tccacttccacgtgtgcagaat

SEQ ID NO: 3144 - DNA, 22 bp, Homo sapiens
gaggaggcagcctatcccttag

SEQ ID NO: 3145 - DNA, 23 bp, Homo sapiens
gtcacagtgggtggtgcctacat

SEQ ID NO: 3146 - DNA, 22 bp, Homo sapiens
ccaggaggcggaaggtacagtg

SEQ ID NO: 3147 - DNA, 22 bp, Homo sapiens
tctttggtttctgtctctgtaa

SEQ ID NO: 3148 - DNA, 22 bp, Homo sapiens
ttgaggtccccagtacccactg

SEQ ID NO: 3149 - DNA, 22 bp, Homo sapiens
gttcagtcacgtgcccaagttc

SEQ ID NO: 3150 - DNA, 22 bp, Homo sapiens
caggacatctacccagtgtttc

SEQ ID NO: 3151 - DNA, 22 bp, Homo sapiens
gggccagtgaacaatgagggaa

SEQ ID NO: 3152 - DNA, 22 bp, Homo sapiens
atcaggggagctgcgacctcag

SEQ ID NO: 3153 - DNA, 22 bp, Homo sapiens
tcgtggaatatggatgcttgtc

SEQ ID NO: 3154 - DNA, 22 bp, Homo sapiens
gactttggttcagggctcagag

SEQ ID NO: 3155 - DNA, 22 bp, Homo sapiens
ctggagcaaaagtgactcctct

SEQ ID NO: 3156 - DNA, 21 bp, Homo sapiens
acgggaatgaacatggtggag

SEQ ID NO: 3157 - DNA, 22 bp, Homo sapiens
ttatttttaaaagttcacacag

SEQ ID NO: 3158 - DNA, 22 bp, Homo sapiens
tcggcgctggaacgcagtagct

SEQ ID NO: 3159 - DNA, 22 bp, Homo sapiens
agtggagcttttcctatcagag

SEQ ID NO: 3160 - DNA, 22 bp, Homo sapiens
caggttcaagcgattctcctgc

SEQ ID NO: 3161 - DNA, 22 bp, Homo sapiens
gcctggccgggtcttggatttt

SEQ ID NO: 3162 - DNA, 22 bp, Homo sapiens
agggaacatttgcactgttggt

SEQ ID NO: 3163 - DNA, 22 bp, Homo sapiens
ttatttgtggcatatgagacga

SEQ ID NO: 3164 - DNA, 22 bp, Homo sapiens
cgcgaggtggaggttgcagtga

SEQ ID NO: 3165 - DNA, 22 bp, Homo sapiens
gagtctctgaccagggtgccaa

SEQ ID NO: 3166 - DNA, 22 bp, Homo sapiens
gtgccactgcactctagcctag

SEQ ID NO: 3167 - DNA, 22 bp, Homo sapiens
tagaaaagccccagctggaggg

SEQ ID NO: 3168 - DNA, 22 bp, Homo sapiens
tcactgcacttcagcttgggca

SEQ ID NO: 3169 - DNA, 22 bp, Homo sapiens
aagtgctgggattacaggcgtg

SEQ ID NO: 3170 - DNA, 22 bp, Homo sapiens
ttaccaaatgaaatagagattt

SEQ ID NO: 3171 - DNA, 22 bp, Homo sapiens
atgtgagtgctatgatagacag

SEQ ID NO: 3172 - DNA, 22 bp, Homo sapiens
tgttaaatgctcagctcgggga

SEQ ID NO: 3173 - DNA, 22 bp, Homo sapiens
agagggcgcccaggcccacgcc

SEQ ID NO: 3174 - DNA, 22 bp, Homo sapiens
tggaggccagaggtactgggac

SEQ ID NO: 3175 - DNA, 22 bp, Homo sapiens
cagtgacgtaaactgcatgtgc

SEQ ID NO: 3176 - DNA, 22 bp, Homo sapiens
cgaggcggcggaagtgcccgta

SEQ ID NO: 3177 - DNA, 22 bp, Homo sapiens
atggaaggctttatgactcaaa

SEQ ID NO: 3178 - DNA, 22 bp, Homo sapiens
agtaaaactcacaaaaggatgg

SEQ ID NO: 3179 - DNA, 22 bp, Homo sapiens
ttgccttcctgcccagcttctg

SEQ ID NO: 3180 - DNA, 22 bp, Homo sapiens
tctgttgactcctagcagccat

SEQ ID NO: 3181 - DNA, 22 bp, Homo sapiens
tcaccgaggctggagtgcagtg

SEQ ID NO: 3182 - DNA, 22 bp, Homo sapiens
gacctgaccgcgtccctgccga

SEQ ID NO: 3183 - DNA, 22 bp, Homo sapiens
gaactagaatgttctgatggag

SEQ ID NO: 3184 - DNA, 23 bp, Homo sapiens
gcgtccggcctctctcgctcccg

SEQ ID NO: 3185 - DNA, 18 bp, Homo sapiens
tgggaagaaattcttctc

SEQ ID NO: 3186 - DNA, 22 bp, Homo sapiens
catgtctgtgtacacatgcaca

SEQ ID NO: 3187 - DNA, 22 bp, Homo sapiens
caggctggagtgcagtggcgct

SEQ ID NO: 3188 - DNA, 22 bp, Homo sapiens
tcctgcagctgataaatacagt

SEQ ID NO: 3189 - DNA, 22 bp, Homo sapiens
ttttgagatggagtcttgctct

SEQ ID NO: 3190 - DNA, 21 bp, Homo sapiens
aggcaccacatctccctcccc

SEQ ID NO: 3191 - DNA, 22 bp, Homo sapiens
gcatacatgggtgcagggacat

SEQ ID NO: 3192 - DNA, 22 bp, Homo sapiens
taggatttaataaaagaataga

SEQ ID NO: 3193 - DNA, 18 bp, Homo sapiens
gatatggaaggccatgcc

SEQ ID NO: 3194 - DNA, 22 bp, Homo sapiens
gctgctctcagagctcatgctg

SEQ ID NO: 3195 - DNA, 22 bp, Homo sapiens
acttattagacatcttcattgt

SEQ ID NO: 3196 - DNA, 22 bp, Homo sapiens
tcattacaagatttccaatttg

SEQ ID NO: 3197 - DNA, 22 bp, Homo sapiens
agactggaggcattttgctcct

SEQ ID NO: 3198 - DNA, 22 bp, Homo sapiens
gccttgtttcattacacgtggt

SEQ ID NO: 3199 - DNA, 22 bp, Homo sapiens
gttgcctaggctggtcttgaac

SEQ ID NO: 3200 - DNA, 22 bp, Homo sapiens
agcacctccagagcttgaagct

SEQ ID NO: 3201 - DNA, 22 bp, Homo sapiens
cgtcctctagagggaagcactt

SEQ ID NO: 3202 - DNA, 22 bp, Homo sapiens
tgcatctgcctggagtagcgcc

SEQ ID NO: 3203 - DNA, 22 bp, Homo sapiens
gggttggcatcagggttctgtg

SEQ ID NO: 3204 - DNA, 22 bp, Homo sapiens
tccaggattgcaggtgcacaac

SEQ ID NO: 3205 - DNA, 22 bp, Homo sapiens
agtatggaggatggaatttgct

SEQ ID NO: 3206 - DNA, 23 bp, Homo sapiens
atgggccaagcaagacccatgac

SEQ ID NO: 3207 - DNA, 22 bp, Homo sapiens
acttgtgttaccaaggtttggt

SEQ ID NO: 3208 - DNA, 22 bp, Homo sapiens
ttcactgcaacctccgcctccc

SEQ ID NO: 3209 - DNA, 22 bp, Homo sapiens
ctcactgcaacctccgtctccc

SEQ ID NO: 3210 - DNA, 22 bp, Homo sapiens
gtcttaagaatgaatgctgaga

SEQ ID NO: 3211 - DNA, 22 bp, Homo sapiens
tgcctcagctgaggccgctcca

SEQ ID NO: 3212 - DNA, 22 bp, Homo sapiens
tgggctttgagctcggtcacct

SEQ ID NO: 3213 - DNA, 22 bp, Homo sapiens
cccattcatcctcgcttccttc

SEQ ID NO: 3214 - DNA, 22 bp, Homo sapiens
ttgcttgcattgtccctggtga

SEQ ID NO: 3215 - DNA, 22 bp, Homo sapiens
atatgcagtctcttgcccttct

SEQ ID NO: 3216 - DNA, 22 bp, Homo sapiens
ggcctgtaatcccagctactca

SEQ ID NO: 3217 - DNA, 23 bp, Homo sapiens
aggttatgattatagagcgagga

SEQ ID NO: 3218 - DNA, 22 bp, Homo sapiens
tctgtagcttcttgagaggcca

SEQ ID NO: 3219 - DNA, 22 bp, Homo sapiens
tctcatggagtcaggagcagaa

SEQ ID NO: 3220 - DNA, 20 bp, Homo sapiens
agcagagtgcccatcccgga

SEQ ID NO: 3221 - DNA, 22 bp, Homo sapiens
tgaaggtgggaattcaccaggt

SEQ ID NO: 3222 - DNA, 22 bp, Homo sapiens
tggccggggctgatggacagtg

SEQ ID NO: 3223 - DNA, 22 bp, Homo sapiens
ggcttctctccagtatgcattc

SEQ ID NO: 3224 - DNA, 22 bp, Homo sapiens
ggttccccaggcggcccttgga

SEQ ID NO: 3225 - DNA, 22 bp, Homo sapiens
attgggagtgtcctgatatccc

SEQ ID NO: 3226 - DNA, 22 bp, Homo sapiens
ctactttaacatggaggcactt

SEQ ID NO: 3227 - DNA, 22 bp, Homo sapiens
ctcactgcaagctctgcctcca

SEQ ID NO: 3228 - DNA, 20 bp, Homo sapiens
cctgtcatcccagcattttg

SEQ ID NO: 3229 - DNA, 22 bp, Homo sapiens
tatttcttttcgtgacttattg

SEQ ID NO: 3230 - DNA, 22 bp, Homo sapiens
tcccaagtactaccaatctaat

SEQ ID NO: 3231 - DNA, 22 bp, Homo sapiens
gaaccacaatgtgaagaaggag

SEQ ID NO: 3232 - DNA, 22 bp, Homo sapiens
actgatcaagggtttaatttta

SEQ ID NO: 3233 - DNA, 22 bp, Homo sapiens
tggtaaggttccagatctagaa

SEQ ID NO: 3234 - DNA, 22 bp, Homo sapiens
tagaggatgatccttccttgcc

SEQ ID NO: 3235 - DNA, 22 bp, Homo sapiens
gagtaaatgtcactgttgctgt

SEQ ID NO: 3236 - DNA, 22 bp, Homo sapiens
accagggaccgccacactgcaa

SEQ ID NO: 3237 - DNA, 22 bp, Homo sapiens
aatgagatggaattcccgccta

SEQ ID NO: 3238 - DNA, 21 bp, Homo sapiens
ctgtttgcaagcctatgtgtc

SEQ ID NO: 3239 - DNA, 22 bp, Homo sapiens
tggcggcgtgtggactgaggac

SEQ ID NO: 3240 - DNA, 22 bp, Homo sapiens
actgccctccagcctgggtgac

SEQ ID NO: 3241 - DNA, 22 bp, Homo sapiens
tcaagggcaaatgctacctata

SEQ ID NO: 3242 - DNA, 22 bp, Homo sapiens
aaactgaggctcccgagggtgt

SEQ ID NO: 3243 - DNA, 22 bp, Homo sapiens
aggagctcagctaagttggaga

SEQ ID NO: 3244 - DNA, 22 bp, Homo sapiens
gtcagatctttggggatgctgt

SEQ ID NO: 3245 - DNA, 22 bp, Homo sapiens
acccgtcagaatggctgttatt

SEQ ID NO: 3246 - DNA, 18 bp, Homo sapiens
gacatagctcagagctca

SEQ ID NO: 3247 - DNA, 22 bp, Homo sapiens
ccaaagctggctttcatggttt

SEQ ID NO: 3248 - DNA, 18 bp, Homo sapiens
atcccaaaagacaaggaa

SEQ ID NO: 3249 - DNA, 22 bp, Homo sapiens
gcgagtgccgagagggcagggc

SEQ ID NO: 3250 - DNA, 22 bp, Homo sapiens
tactggacacgtatatatagat

SEQ ID NO: 3251 - DNA, 22 bp, Homo sapiens
tgttatcagagagaggtgctgt

SEQ ID NO: 3252 - DNA, 21 bp, Homo sapiens
gggcagaggggcctcctgggt

SEQ ID NO: 3253 - DNA, 22 bp, Homo sapiens
aacaattactaccaaggcctgt

SEQ ID NO: 3254 - DNA, 20 bp, Homo sapiens
cagtgcattgcttctgattt

SEQ ID NO: 3255 - DNA, 22 bp, Homo sapiens
ctcagactagcctgtaccgaca

SEQ ID NO: 3256 - DNA, 22 bp, Homo sapiens
ccctctctgctgcatagaggaa

SEQ ID NO: 3257 - DNA, 22 bp, Homo sapiens
catccatagcttgatctgttcc

SEQ ID NO: 3258 - DNA, 22 bp, Homo sapiens
agctttggttgccatgatctga

SEQ ID NO: 3259 - DNA, 22 bp, Homo sapiens
ttggggccgggataaggttgtt

SEQ ID NO: 3260 - DNA, 22 bp, Homo sapiens
cataatttctaccagggccata

SEQ ID NO: 3261 - DNA, 22 bp, Homo sapiens
gggaagatagtgttgagggccc

SEQ ID NO: 3262 - DNA, 22 bp, Homo sapiens
cctgttttattctgttgtatct

SEQ ID NO: 3263 - DNA, 22 bp, Homo sapiens
aatatcatctctcttttctgca

SEQ ID NO: 3264 - DNA, 22 bp, Homo sapiens
ctgatagacaatcaccatggga

SEQ ID NO: 3265 - DNA, 22 bp, Homo sapiens
tagaatgtaaattccaagggca

SEQ ID NO: 3266 - DNA, 22 bp, Homo sapiens
gaactttataactgtaaatgtc

SEQ ID NO: 3267 - DNA, 22 bp, Homo sapiens
ttgcagatatttccgatgctat

SEQ ID NO: 3268 - DNA, 19 bp, Homo sapiens
tgaacgatgtctcagggca

SEQ ID NO: 3269 - DNA, 22 bp, Homo sapiens
aggcaaatgatcctgctccttg

SEQ ID NO: 3270 - DNA, 22 bp, Homo sapiens
taggcaagtggaccagaggttt

SEQ ID NO: 3271 - DNA, 22 bp, Homo sapiens
gaggccacggaagggagctgtg

SEQ ID NO: 3272 - DNA, 22 bp, Homo sapiens
atgttggccaggctggtcttga

SEQ ID NO: 3273 - DNA, 22 bp, Homo sapiens
gggacttaatgcagagagggac

SEQ ID NO: 3274 - DNA, 22 bp, Homo sapiens
gggacacgggctgagcagagcc

SEQ ID NO: 3275 - DNA, 22 bp, Homo sapiens
ttgagcaatgtcactgaggctt

SEQ ID NO: 3276 - DNA, 22 bp, Homo sapiens
agaaaatgtgaacttgtgaatt

SEQ ID NO: 3277 - DNA, 22 bp, Homo sapiens
gtccacagctctgaggtctccc

SEQ ID NO: 3278 - DNA, 20 bp, Homo sapiens
acgtggccaccagtggctta

SEQ ID NO: 3279 - DNA, 22 bp, Homo sapiens
tgagctgtgtcttggtgagagt

SEQ ID NO: 3280 - DNA, 22 bp, Homo sapiens
tgcgcatgagtctgtgcataca

SEQ ID NO: 3281 - DNA, 22 bp, Homo sapiens
gcggtttaggccaacctccctg

SEQ ID NO: 3282 - DNA, 22 bp, Homo sapiens
tggggaaaatgcttgtagtcag

SEQ ID NO: 3283 - DNA, 22 bp, Homo sapiens
ggtgtccgcgctgtagaaggtc

SEQ ID NO: 3284 - DNA, 22 bp, Homo sapiens
cttctggcgttggaggtctgag

SEQ ID NO: 3285 - DNA, 22 bp, Homo sapiens
aagaataagaggatttagaaca

SEQ ID NO: 3286 - DNA, 22 bp, Homo sapiens
ggcatggtggtacacatctgta

SEQ ID NO: 3287 - DNA, 22 bp, Homo sapiens
caggagctcaagaccaccctgg

SEQ ID NO: 3288 - DNA, 23 bp, Homo sapiens
gatgaggacctacaggtggccag

SEQ ID NO: 3289 - DNA, 19 bp, Homo sapiens
gagtattttccaacttggt

SEQ ID NO: 3290 - DNA, 22 bp, Homo sapiens
ccagccgcggtgagggtggctg

SEQ ID NO: 3291 - DNA, 22 bp, Homo sapiens
gtgtaagaaccttctagagccc

SEQ ID NO: 3292 - DNA, 22 bp, Homo sapiens
gttacagtcaggagatattttg

SEQ ID NO: 3293 - DNA, 22 bp, Homo sapiens
actgtaacctcaaactcctggg

SEQ ID NO: 3294 - DNA, 22 bp, Homo sapiens
tatctattatgttctatgtgtc

SEQ ID NO: 3295 - DNA, 18 bp, Homo sapiens
tcttccaacactgacacc

SEQ ID NO: 3296 - DNA, 22 bp, Homo sapiens
gtggccaacctggccctgaact

SEQ ID NO: 3297 - DNA, 22 bp, Homo sapiens
tatttgtctggtctaaggaggg

SEQ ID NO: 3298 - DNA, 22 bp, Homo sapiens
atagagtgatgtaaggtatgtg

SEQ ID NO: 3299 - DNA, 22 bp, Homo sapiens
tgccatagcaatggtaagctga

SEQ ID NO: 3300 - DNA, 22 bp, Homo sapiens
aagccgggcctgagaaatgaca

SEQ ID NO: 3301 - DNA, 22 bp, Homo sapiens
tgggcccgcgcaaaggactcca

SEQ ID NO: 3302 - DNA, 22 bp, Homo sapiens
tccaactttctcctccggcttg

SEQ ID NO: 3303 - DNA, 22 bp, Homo sapiens
ggagtgcagtggcgtgatctca

SEQ ID NO: 3304 - DNA, 20 bp, Homo sapiens
tgttgattggtgtcatctca

SEQ ID NO: 3305 - DNA, 22 bp, Homo sapiens
cgggcaccaccctggtgtgtcc

SEQ ID NO: 3306 - DNA, 22 bp, Homo sapiens
gctgtgtatcagatgccacggg

SEQ ID NO: 3307 - DNA, 22 bp, Homo sapiens
tatgtcactcggctcggcccac

SEQ ID NO: 3308 - DNA, 22 bp, Homo sapiens
cttagctgcgggccctcctcgc

SEQ ID NO: 3309 - DNA, 22 bp, Homo sapiens
tttctggcagcgggacaggggt

SEQ ID NO: 3310 - DNA, 22 bp, Homo sapiens
caccatttagtagcaagagctc

SEQ ID NO: 3311 - DNA, 22 bp, Homo sapiens
tctgtagtaggttgtagttctt

SEQ ID NO: 3312 - DNA, 22 bp, Homo sapiens
tcttaattctgtgtcttcacta

SEQ ID NO: 3313 - DNA, 22 bp, Homo sapiens
tgaggcccaccttggccccggc

SEQ ID NO: 3314 - DNA, 22 bp, Homo sapiens
ttaagcatttagttgtattgcc

SEQ ID NO: 3315 - DNA, 22 bp, Homo sapiens
tgtcactgcagaaattttctcc

SEQ ID NO: 3316 - DNA, 14 bp, Homo sapiens
gccataagggatgc

SEQ ID NO: 3317 - DNA, 22 bp, Homo sapiens
atgatggctaggctggttttga

SEQ ID NO: 3318 - DNA, 22 bp, Homo sapiens
accctccccaagaggtcgtgcc

SEQ ID NO: 3319 - DNA, 22 bp, Homo sapiens
cctgagagcattccacactgaa

SEQ ID NO: 3320 - DNA, 22 bp, Homo sapiens
tggaaccctcctactccagggc

SEQ ID NO: 3321 - DNA, 22 bp, Homo sapiens
taacagtatatttaccaaacct

SEQ ID NO: 3322 - DNA, 22 bp, Homo sapiens
cgccccggacgtctgaccaaac

SEQ ID NO: 3323 - DNA, 22 bp, Homo sapiens
ggagtgcaatggcacgatctca

SEQ ID NO: 3324 - DNA, 19 bp, Homo sapiens
gactcacaccttccgctgt

SEQ ID NO: 3325 - DNA, 22 bp, Homo sapiens
tcaaagtccttgctttttctgt

SEQ ID NO: 3326 - DNA, 22 bp, Homo sapiens
agtgaatgtccccgcgggtcag

SEQ ID NO: 3327 - DNA, 22 bp, Homo sapiens
tctgcaacagtgccctgtaaat

SEQ ID NO: 3328 - DNA, 22 bp, Homo sapiens
ggccgccctttccacggtttct

SEQ ID NO: 3329 - DNA, 22 bp, Homo sapiens
gtattagtttcctgttgctgct

SEQ ID NO: 3330 - DNA, 22 bp, Homo sapiens
tgacagtgcgggtacatcatag

SEQ ID NO: 3331 - DNA, 22 bp, Homo sapiens
agcaacacgcagtagtatacga

SEQ ID NO: 3332 - DNA, 22 bp, Homo sapiens
ggtgagcagctgtctgtatgga

SEQ ID NO: 3333 - DNA, 22 bp, Homo sapiens
actagctccaggctgaattgca

SEQ ID NO: 3334 - DNA, 22 bp, Homo sapiens
agggtggcactggtggctctat

SEQ ID NO: 3335 - DNA, 22 bp, Homo sapiens
taggtgcaggtcacaagggatg

SEQ ID NO: 3336 - DNA, 18 bp, Homo sapiens
aggcttacagcagcaggc

SEQ ID NO: 3337 - DNA, 22 bp, Homo sapiens
gtggctcacgtctgtcatctca

SEQ ID NO: 3338 - DNA, 22 bp, Homo sapiens
acggcttcttgactgtgggttg

SEQ ID NO: 3339 - DNA, 22 bp, Homo sapiens
gccaggacctcagatgcagggc

SEQ ID NO: 3340 - DNA, 22 bp, Homo sapiens
ataatggtagatgtccacgcag

SEQ ID NO: 3341 - DNA, 22 bp, Homo sapiens
tcactgcaacctccacctcccg

SEQ ID NO: 3342 - DNA, 22 bp, Homo sapiens
gaatgtgtactgagtgcccctt

SEQ ID NO: 3343 - DNA, 22 bp, Homo sapiens
atacagggacatccagtttttc

SEQ ID NO: 3344 - DNA, 22 bp, Homo sapiens
gcaccactacactccagcctgg

SEQ ID NO: 3345 - DNA, 22 bp, Homo sapiens
gtctatgcaacttttagtggga

SEQ ID NO: 3346 - DNA, 22 bp, Homo sapiens
tccaggctttggggcaggagcg

SEQ ID NO: 3347 - DNA, 22 bp, Homo sapiens
ggctgggcctctccctcagctg

SEQ ID NO: 3348 - DNA, 22 bp, Homo sapiens
ttttctcttccctctggacctg

SEQ ID NO: 3349 - DNA, 22 bp, Homo sapiens
aagcctggcacattggagtctg

SEQ ID NO: 3350 - DNA, 22 bp, Homo sapiens
aggccccctccacccattctgg

SEQ ID NO: 3351 - DNA, 22 bp, Homo sapiens
agcaagatttttcaggttagta

SEQ ID NO: 3352 - DNA, 22 bp, Homo sapiens
tccttagacaaagagtgggctt

SEQ ID NO: 3353 - DNA, 22 bp, Homo sapiens
ccctcgtgcatccatcatttag

SEQ ID NO: 3354 - DNA, 22 bp, Homo sapiens
tgtagatatagaaaaagactga

SEQ ID NO: 3355 - DNA, 22 bp, Homo sapiens
gtctttatttgagattgtcatt

SEQ ID NO: 3356 - DNA, 22 bp, Homo sapiens
tggctgagttacgaacagagca

SEQ ID NO: 3357 - DNA, 22 bp, Homo sapiens
cactgcactccagcctggcctg

SEQ ID NO: 3358 - DNA, 22 bp, Homo sapiens
gagtgccttccccatgctttgg

SEQ ID NO: 3359 - DNA, 20 bp, Homo sapiens
tcactgtaacatttgggggg

SEQ ID NO: 3360 - DNA, 22 bp, Homo sapiens
ttggatccatctcaggcatagg

SEQ ID NO: 3361 - DNA, 22 bp, Homo sapiens
ctgctgtttctcaaaattaagt

SEQ ID NO: 3362 - DNA, 22 bp, Homo sapiens
taggttttcctaaaattctggt

SEQ ID NO: 3363 - DNA, 22 bp, Homo sapiens
tatttggtgaatctatggtcag

SEQ ID NO: 3364 - DNA, 22 bp, Homo sapiens
gaggggcacagtaaagggtccc

SEQ ID NO: 3365 - DNA, 22 bp, Homo sapiens
atgttgagagctgagatcagcc

SEQ ID NO: 3366 - DNA, 22 bp, Homo sapiens
actgttgaagtgccagcttgat

SEQ ID NO: 3367 - DNA, 22 bp, Homo sapiens
aaacttgagccaagggcttggg

SEQ ID NO: 3368 - DNA, 22 bp, Homo sapiens
tagattatccctgatttgtcca

SEQ ID NO: 3369 - DNA, 22 bp, Homo sapiens
tgagtgacattttatattgcca

SEQ ID NO: 3370 - DNA, 22 bp, Homo sapiens
acacggcactttaggaaggggc

SEQ ID NO: 3371 - DNA, 22 bp, Homo sapiens
tctttcttgtgggtgccctttt

SEQ ID NO: 3372 - DNA, 22 bp, Homo sapiens
cagagctggtgtgtcctggcat

SEQ ID NO: 3373 - DNA, 22 bp, Homo sapiens
ggggatggaggcgtgtggtcct

SEQ ID NO: 3374 - DNA, 22 bp, Homo sapiens
tattggccgggcgcggtggctc

SEQ ID NO: 3375 - DNA, 22 bp, Homo sapiens
cacagcggcctccgatgctgat

SEQ ID NO: 3376 - DNA, 22 bp, Homo sapiens
agatacattgttctaagcattg

SEQ ID NO: 3377 - DNA, 22 bp, Homo sapiens
ttccctgtgtgcagatgggtgt

SEQ ID NO: 3378 - DNA, 22 bp, Homo sapiens
tgggaagctgcattttaacaag

SEQ ID NO: 3379 - DNA, 22 bp, Homo sapiens
gagtgttccagaaactggccct

SEQ ID NO: 3380 - DNA, 22 bp, Homo sapiens
aggtctcttgctgtctctgggc

SEQ ID NO: 3381 - DNA, 22 bp, Homo sapiens
tagcccaggctggagtgcaggg

SEQ ID NO: 3382 - DNA, 22 bp, Homo sapiens
ttaatgacaggataggctctga

SEQ ID NO: 3383 - DNA, 22 bp, Homo sapiens
cactgcacttcagcctgggtga

SEQ ID NO: 3384 - DNA, 22 bp, Homo sapiens
atgtatacgtgcaagtcacagg

SEQ ID NO: 3385 - DNA, 22 bp, Homo sapiens
ctgaacttattgagtgcttgct

SEQ ID NO: 3386 - DNA, 22 bp, Homo sapiens
tcaggtactgcagggcacgcag

SEQ ID NO: 3387 - DNA, 22 bp, Homo sapiens
gggcagcagccactcatttagc

SEQ ID NO: 3388 - DNA, 22 bp, Homo sapiens
gctgccgacccacaggggttaa

SEQ ID NO: 3389 - DNA, 22 bp, Homo sapiens
gactccccacgttaaggaatgt

SEQ ID NO: 3390 - DNA, 22 bp, Homo sapiens
ggagaagcagcttcttgatgaa

SEQ ID NO: 3391 - DNA, 20 bp, Homo sapiens
gaccagatcccttaccagct

SEQ ID NO: 3392 - DNA, 18 bp, Homo sapiens
gagtcgtcggagagtctg

SEQ ID NO: 3393 - DNA, 23 bp, Homo sapiens
agtgggctcagtcctccaacccc

SEQ ID NO: 3394 - DNA, 22 bp, Homo sapiens
tggagaataggggccactggtg

SEQ ID NO: 3395 - DNA, 22 bp, Homo sapiens
atttcctgcaaggagtgggttt

SEQ ID NO: 3396 - DNA, 20 bp, Homo sapiens
agacaccccctgacagggaa

SEQ ID NO: 3397 - DNA, 22 bp, Homo sapiens
ctctgctgtgccgccagggcct

SEQ ID NO: 3398 - DNA, 21 bp, Homo sapiens
tgcaatccagcctgggcgaca

SEQ ID NO: 3399 - DNA, 22 bp, Homo sapiens
gcccagtggtaaaagcaggcct

SEQ ID NO: 3400 - DNA, 22 bp, Homo sapiens
ggtcgggcactctccagggctg

SEQ ID NO: 3401 - DNA, 22 bp, Homo sapiens
gggaagtgagctggaatcaagg

SEQ ID NO: 3402 - DNA, 22 bp, Homo sapiens
agtgatccacccgcctcaacct

SEQ ID NO: 3403 - DNA, 22 bp, Homo sapiens
ctgtatttcttggacagttgct

SEQ ID NO: 3404 - DNA, 22 bp, Homo sapiens
tgccgtggggctgaggctggag

SEQ ID NO: 3405 - DNA, 22 bp, Homo sapiens
gtggtgagagtaggtgtcctct

SEQ ID NO: 3406 - DNA, 22 bp, Homo sapiens
tagtaagttctcgcattgttat

SEQ ID NO: 3407 - DNA, 22 bp, Homo sapiens
gccaccctggacgcactgttcg

SEQ ID NO: 3408 - DNA, 22 bp, Homo sapiens
tttagattgtgacctcccccca

SEQ ID NO: 3409 - DNA, 22 bp, Homo sapiens
cgtgatttctggctttctatat

SEQ ID NO: 3410 - DNA, 20 bp, Homo sapiens
tctgccacgtctggtgactg

SEQ ID NO: 3411 - DNA, 22 bp, Homo sapiens
ttcgggcccaggccgaggacct

SEQ ID NO: 3412 - DNA, 22 bp, Homo sapiens
tggaatggaaacaaactgagga

SEQ ID NO: 3413 - DNA, 22 bp, Homo sapiens
tgtgtgattgcaggagatgtgg

SEQ ID NO: 3414 - DNA, 22 bp, Homo sapiens
aaattgcaaaagtacttttagg

SEQ ID NO: 3415 - DNA, 22 bp, Homo sapiens
actcaaatagcaacggtgagaa

SEQ ID NO: 3416 - DNA, 22 bp, Homo sapiens
tgatatgtaactactccttata

SEQ ID NO: 3417 - DNA, 22 bp, Homo sapiens
cccaggaattggaggctgcagt

SEQ ID NO: 3418 - DNA, 22 bp, Homo sapiens
tgtgaactggcaggtggacggg

SEQ ID NO: 3419 - DNA, 16 bp, Homo sapiens
aaactgacggcatctg

SEQ ID NO: 3420 - DNA, 21 bp, Homo sapiens
tctgccagctgaagaggtgga

SEQ ID NO: 3421 - DNA, 22 bp, Homo sapiens
caggcttgtgactattccaaag

SEQ ID NO: 3422 - DNA, 22 bp, Homo sapiens
tgggtgtgtccatattttgact

SEQ ID NO: 3423 - DNA, 22 bp, Homo sapiens
ccaccgccttggcgtgttcccc

SEQ ID NO: 3424 - DNA, 22 bp, Homo sapiens
gcacttgtggatttgatataca

SEQ ID NO: 3425 - DNA, 22 bp, Homo sapiens
cagatagctgtaaataaatgga

SEQ ID NO: 3426 - DNA, 22 bp, Homo sapiens
ctggcctcggcagcaggaacag

SEQ ID NO: 3427 - DNA, 22 bp, Homo sapiens
tgtacacatggtgtacactccc

SEQ ID NO: 3428 - DNA, 22 bp, Homo sapiens
gagtgcagtggcgtgatctctg

SEQ ID NO: 3429 - DNA, 22 bp, Homo sapiens
agtttgaattttaatctcggtg

SEQ ID NO: 3430 - DNA, 22 bp, Homo sapiens
tgggaaatctttccgtatttat

SEQ ID NO: 3431 - DNA, 22 bp, Homo sapiens
aaacaacctaaagttactgatc

SEQ ID NO: 3432 - DNA, 22 bp, Homo sapiens
gacctggcaactgtagcttctg

SEQ ID NO: 3433 - DNA, 15 bp, Homo sapiens
aggagtcactgtgct

SEQ ID NO: 3434 - DNA, 22 bp, Homo sapiens
tcccgcatgccgccggtgaaca

SEQ ID NO: 3435 - DNA, 22 bp, Homo sapiens
gcccagagttcaaggctgcagt

SEQ ID NO: 3436 - DNA, 22 bp, Homo sapiens
tccctgcaggtgtgcaagctga

SEQ ID NO: 3437 - DNA, 22 bp, Homo sapiens
ctgcttctagcaccaagtccct

SEQ ID NO: 3438 - DNA, 20 bp, Homo sapiens
agagatggggtatcaccgta

SEQ ID NO: 3439 - DNA, 22 bp, Homo sapiens
tgttacagcagaattgaaagag

SEQ ID NO: 3440 - DNA, 22 bp, Homo sapiens
ggagctcctggcagtgacagag

SEQ ID NO: 3441 - DNA, 22 bp, Homo sapiens
attttctatgttgtaattgtta

SEQ ID NO: 3442 - DNA, 22 bp, Homo sapiens
agcaactgggctcattttttaa

SEQ ID NO: 3443 - DNA, 22 bp, Homo sapiens
gagaagtcatttgaccacctag

SEQ ID NO: 3444 - DNA, 22 bp, Homo sapiens
cactgggcacttgggttgcttc

SEQ ID NO: 3445 - DNA, 22 bp, Homo sapiens
tggttgtggtcctccacatcgc

SEQ ID NO: 3446 - DNA, 22 bp, Homo sapiens
tctaatccttgctacctgggtg

SEQ ID NO: 3447 - DNA, 22 bp, Homo sapiens
ccgggcctcgggacaccgggta

SEQ ID NO: 3448 - DNA, 22 bp, Homo sapiens
ccaggctagagtgcaatggcat

SEQ ID NO: 3449 - DNA, 22 bp, Homo sapiens
ccaggctggagtatagtggcgc

SEQ ID NO: 3450 - DNA, 22 bp, Homo sapiens
tatgaggtaggtattatactta

SEQ ID NO: 3451 - DNA, 22 bp, Homo sapiens
aggctctgtcaggcggagcagc

SEQ ID NO: 3452 - DNA, 22 bp, Homo sapiens
cactgcaacaacctctacctcc

SEQ ID NO: 3453 - DNA, 22 bp, Homo sapiens
ttgcacatctaataatgctaga

SEQ ID NO: 3454 - DNA, 22 bp, Homo sapiens
ataccaccatctatgaaaggta

SEQ ID NO: 3455 - DNA, 22 bp, Homo sapiens
ccagaccctccattcaagctcc

SEQ ID NO: 3456 - DNA, 22 bp, Homo sapiens
gcgctcagaaaagattttcttc

SEQ ID NO: 3457 - DNA, 22 bp, Homo sapiens
tatacgtgcaggtcacagggga

SEQ ID NO: 3458 - DNA, 22 bp, Homo sapiens
cttatttgcccatgtttcttta

SEQ ID NO: 3459 - DNA, 22 bp, Homo sapiens
cacgactgttaccggacccatg

SEQ ID NO: 3460 - DNA, 22 bp, Homo sapiens
tccagctgaggtggcctctgtg

SEQ ID NO: 3461 - DNA, 22 bp, Homo sapiens
cccatgcaccctctaagaagga

SEQ ID NO: 3462 - DNA, 22 bp, Homo sapiens
tggcccttgttcaaatatgtca

SEQ ID NO: 3463 - DNA, 22 bp, Homo sapiens
gaataatcatgaaattcagtga

SEQ ID NO: 3464 - DNA, 22 bp, Homo sapiens
aacatagaataaatgagttagg

SEQ ID NO: 3465 - DNA, 22 bp, Homo sapiens
tccttaggcaatttgggagagt

SEQ ID NO: 3466 - DNA, 22 bp, Homo sapiens
cactaggctggagtgcagtggc

SEQ ID NO: 3467 - DNA, 21 bp, Homo sapiens
cgcagagcgaacttgcggcgc

SEQ ID NO: 3468 - DNA, 22 bp, Homo sapiens
acgcccggtctccatagttttt

SEQ ID NO: 3469 - DNA, 22 bp, Homo sapiens
ctcttcatagcaaacatatggg

SEQ ID NO: 3470 - DNA, 22 bp, Homo sapiens
gggaggctctgctcagcccccg

SEQ ID NO: 3471 - DNA, 22 bp, Homo sapiens
tcactgcgcttcagcctgggtg

SEQ ID NO: 3472 - DNA, 22 bp, Homo sapiens
tacttagtgttcttgtattgac

SEQ ID NO: 3473 - DNA, 22 bp, Homo sapiens
tctttgctattgtgagtagtgc

SEQ ID NO: 3474 - DNA, 22 bp, Homo sapiens
gcttccgcgatgtcctaggtgg

SEQ ID NO: 3475 - DNA, 22 bp, Homo sapiens
ccaggggttggaggttgcagtg

SEQ ID NO: 3476 - DNA, 22 bp, Homo sapiens
catttggtcactatcctttttg

SEQ ID NO: 3477 - DNA, 19 bp, Homo sapiens
aaatccaagctcaggcctc

SEQ ID NO: 3478 - DNA, 21 bp, Homo sapiens
ctgtcatgcaaccattctcca

SEQ ID NO: 3479 - DNA, 22 bp, Homo sapiens
ttgtatagcccagagagtgaga

SEQ ID NO: 3480 - DNA, 22 bp, Homo sapiens
gatgaggcataaacacagtcac

SEQ ID NO: 3481 - DNA, 22 bp, Homo sapiens
tgaggcaggagaatcaccggaa

SEQ ID NO: 3482 - DNA, 22 bp, Homo sapiens
cattgcactccagcctgggcca

SEQ ID NO: 3483 - DNA, 22 bp, Homo sapiens
ccgccgtgcaggccgcgacgtg

SEQ ID NO: 3484 - DNA, 22 bp, Homo sapiens
aacagctttgtatacagtaact

SEQ ID NO: 3485 - DNA, 22 bp, Homo sapiens
tagttctagggcatcatcccag

SEQ ID NO: 3486 - DNA, 23 bp, Homo sapiens
gtgggcgcccaggagcgggacgg

SEQ ID NO: 3487 - DNA, 22 bp, Homo sapiens
tccattatacttctgattcaaa

SEQ ID NO: 3488 - DNA, 22 bp, Homo sapiens
tgacagcctcactttgttaatt

SEQ ID NO: 3489 - DNA, 22 bp, Homo sapiens
gtttgtcttaattaggcatcga

SEQ ID NO: 3490 - DNA, 22 bp, Homo sapiens
ctgcccgcaccatccccgggct

SEQ ID NO: 3491 - DNA, 22 bp, Homo sapiens
atgttggagtcgtaaggcatgg

SEQ ID NO: 3492 - DNA, 23 bp, Homo sapiens
caggagatggctgctgtgtcagc

SEQ ID NO: 3493 - DNA, 22 bp, Homo sapiens
cggcatgggcgtccccctcact

SEQ ID NO: 3494 - DNA, 20 bp, Homo sapiens
ggtggccgtagcgggcggcg

SEQ ID NO: 3495 - DNA, 22 bp, Homo sapiens
atgtgctgagtgtgtatataca

SEQ ID NO: 3496 - DNA, 22 bp, Homo sapiens
ttgcatttggttctgcctggta

SEQ ID NO: 3497 - DNA, 22 bp, Homo sapiens
cactcacccggtccttcccagt

SEQ ID NO: 3498 - DNA, 22 bp, Homo sapiens
tgtttacagctgatcaggcatc

SEQ ID NO: 3499 - DNA, 22 bp, Homo sapiens
ggggtgtggacggctgtgccag

SEQ ID NO: 3500 - DNA, 22 bp, Homo sapiens
gagccccaccctagacattctg

SEQ ID NO: 3501 - DNA, 23 bp, Homo sapiens
ggatggacgtgatgccttagcca

SEQ ID NO: 3502 - DNA, 22 bp, Homo sapiens
cctggaaagagaatgaatgagc

SEQ ID NO: 3503 - DNA, 19 bp, Homo sapiens
tgcctgctgtattccagag

SEQ ID NO: 3504 - DNA, 22 bp, Homo sapiens
ttacctctagctctttgcttgt

SEQ ID NO: 3505 - DNA, 22 bp, Homo sapiens
acatggcaaaaccccgtttcta

SEQ ID NO: 3506 - DNA, 22 bp, Homo sapiens
tcactgcagcctctgcctcccg

SEQ ID NO: 3507 - DNA, 22 bp, Homo sapiens
taagtcttcatagtctaatgtc

SEQ ID NO: 3508 - DNA, 22 bp, Homo sapiens
aggcaatcccctgaggatactt

SEQ ID NO: 3509 - DNA, 22 bp, Homo sapiens
actgtactccagccttggcgac

SEQ ID NO: 3510 - DNA, 22 bp, Homo sapiens
accttgatggggctgttggagt

SEQ ID NO: 3511 - DNA, 22 bp, Homo sapiens
gatctcaaagcagtgtgggttg

SEQ ID NO: 3512 - DNA, 22 bp, Homo sapiens
atagggcctaaaaagtattgct

SEQ ID NO: 3513 - DNA, 22 bp, Homo sapiens
gcccatttttagtagatttagt

SEQ ID NO: 3514 - DNA, 22 bp, Homo sapiens
tcagggattgcaaaattcatcc

SEQ ID NO: 3515 - DNA, 21 bp, Homo sapiens
tggctaaaccctagtaaatta

SEQ ID NO: 3516 - DNA, 22 bp, Homo sapiens
ctccagtcttctcatgtatccc

SEQ ID NO: 3517 - DNA, 22 bp, Homo sapiens
cttcttgctgggggcctcagtg

SEQ ID NO: 3518 - DNA, 22 bp, Homo sapiens
ctcagtgaattggaggatggcc

SEQ ID NO: 3519 - DNA, 22 bp, Homo sapiens
tagcagtgtctaggtaggccat

SEQ ID NO: 3520 - DNA, 22 bp, Homo sapiens
ttgtgcttgccctggaggtgcg

SEQ ID NO: 3521 - DNA, 22 bp, Homo sapiens
aattacagtcggagcagcactg

SEQ ID NO: 3522 - DNA, 22 bp, Homo sapiens
gtctgaatacgtacttgtgaag

SEQ ID NO: 3523 - DNA, 22 bp, Homo sapiens
catgtgtccacccttgaacaca

SEQ ID NO: 3524 - DNA, 22 bp, Homo sapiens
gcccttggcctctttggcccgg

SEQ ID NO: 3525 - DNA, 22 bp, Homo sapiens
gcaccgagaaggaagcatgcct

SEQ ID NO: 3526 - DNA, 22 bp, Homo sapiens
ctacaccggagcctggaaggta

SEQ ID NO: 3527 - DNA, 22 bp, Homo sapiens
acatcccttgctcggggcccct

SEQ ID NO: 3528 - DNA, 22 bp, Homo sapiens
gaggcccggcgcaggcggactt

SEQ ID NO: 3529 - DNA, 22 bp, Homo sapiens
gtctcgtcaatggcaggttccc

SEQ ID NO: 3530 - DNA, 22 bp, Homo sapiens
tgagagcctgtgttcaaatgcc

SEQ ID NO: 3531 - DNA, 22 bp, Homo sapiens
atattacacacggtatcacggg

SEQ ID NO: 3532 - DNA, 23 bp, Homo sapiens
ttttgcaataagtcactggaata

SEQ ID NO: 3533 - DNA, 22 bp, Homo sapiens
aggtaggcctgacgctggggtg

SEQ ID NO: 3534 - DNA, 22 bp, Homo sapiens
cattctgcgatcctcaagcaca

SEQ ID NO: 3535 - DNA, 22 bp, Homo sapiens
attcatcaactgatagccatag

SEQ ID NO: 3536 - DNA, 19 bp, Homo sapiens
ttactatgtgacaagcact

SEQ ID NO: 3537 - DNA, 22 bp, Homo sapiens
agcagctttcacctccccgcct

SEQ ID NO: 3538 - DNA, 22 bp, Homo sapiens
taggtaggtggaaaagtaattg

SEQ ID NO: 3539 - DNA, 22 bp, Homo sapiens
gaatttcctctaaacccctgag

SEQ ID NO: 3540 - DNA, 22 bp, Homo sapiens
tggagccagcggcctgctgagg

SEQ ID NO: 3541 - DNA, 22 bp, Homo sapiens
ttggaggcaatgggaaggaggc

SEQ ID NO: 3542 - DNA, 22 bp, Homo sapiens
ttcctagggcagagccgctggg

SEQ ID NO: 3543 - DNA, 22 bp, Homo sapiens
aaggctgagacagcacaggtcc

SEQ ID NO: 3544 - DNA, 22 bp, Homo sapiens
ttcatagtgtttccttccagtg

SEQ ID NO: 3545 - DNA, 22 bp, Homo sapiens
ctatgaccccagcatgaataag

SEQ ID NO: 3546 - DNA, 22 bp, Homo sapiens
cttttcattgtttgtacatgca

SEQ ID NO: 3547 - DNA, 22 bp, Homo sapiens
tgtgtacttccccctgacctgt

SEQ ID NO: 3548 - DNA, 22 bp, Homo sapiens
agctggggctgtggttgtgatt

SEQ ID NO: 3549 - DNA, 22 bp, Homo sapiens
tccttttgagctcctatgtggg

SEQ ID NO: 3550 - DNA, 22 bp, Homo sapiens
ccactattactgtgtggcagtc

SEQ ID NO: 3551 - DNA, 22 bp, Homo sapiens
ttttaggattcacatggattca

SEQ ID NO: 3552 - DNA, 22 bp, Homo sapiens
tgttggagcccgagtcagggag

SEQ ID NO: 3553 - DNA, 22 bp, Homo sapiens
ggagagtgggagcaactgttgc

SEQ ID NO: 3554 - DNA, 22 bp, Homo sapiens
gggctccgcccttggctgagct

SEQ ID NO: 3555 - DNA, 21 bp, Homo sapiens
acctgagctccacctcctgcc

SEQ ID NO: 3556 - DNA, 22 bp, Homo sapiens
cctggccgacatggtgaaacgc

SEQ ID NO: 3557 - DNA, 22 bp, Homo sapiens
cccagcgagtttgccggtgaac

SEQ ID NO: 3558 - DNA, 22 bp, Homo sapiens
tcagcctgctccaagtgctgcc

SEQ ID NO: 3559 - DNA, 22 bp, Homo sapiens
ttcaaagggaaaagcaggctgg

SEQ ID NO: 3560 - DNA, 22 bp, Homo sapiens
aggccagcagcatgacggcatc

SEQ ID NO: 3561 - DNA, 22 bp, Homo sapiens
tggcaagaaccgcaattacttt

SEQ ID NO: 3562 - DNA, 19 bp, Homo sapiens
cggcccctcctctcgcgcc

SEQ ID NO: 3563 - DNA, 22 bp, Homo sapiens
ttggcgcccaggacgccgccgc

SEQ ID NO: 3564 - DNA, 22 bp, Homo sapiens
gggaggcacgaggcgcgcagtg

SEQ ID NO: 3565 - DNA, 17 bp, Homo sapiens
aagtgattcagccctca

SEQ ID NO: 3566 - DNA, 22 bp, Homo sapiens
ggccactgacctacatctgggg

SEQ ID NO: 3567 - DNA, 22 bp, Homo sapiens
gagccaggaggcagagactgca

SEQ ID NO: 3568 - DNA, 22 bp, Homo sapiens
ggcctgggctccgggagttact

SEQ ID NO: 3569 - DNA, 22 bp, Homo sapiens
gctggtagacctcactgcactc

SEQ ID NO: 3570 - DNA, 22 bp, Homo sapiens
aagaggcgctcctcacttccta

SEQ ID NO: 3571 - DNA, 22 bp, Homo sapiens
tagcaccggcagtggtaggtgc

SEQ ID NO: 3572 - DNA, 22 bp, Homo sapiens
gaggagctgcccgtgtgtctgc

SEQ ID NO: 3573 - DNA, 22 bp, Homo sapiens
cagccacttgtgatgctgggga

SEQ ID NO: 3574 - DNA, 22 bp, Homo sapiens
gcatgcaatctatccttaggaa

SEQ ID NO: 3575 - DNA, 22 bp, Homo sapiens
ccttttatagatcagtgtgtta

SEQ ID NO: 3576 - DNA, 22 bp, Homo sapiens
gatactcttcaggtcttgcaga

SEQ ID NO: 3577 - DNA, 22 bp, Homo sapiens
gtaatagtctcaaactcctgga

SEQ ID NO: 3578 - DNA, 22 bp, Homo sapiens
tctgtgcctgcttccccaccca

SEQ ID NO: 3579 - DNA, 22 bp, Homo sapiens
aaagctgtcaaggcaggaggct

SEQ ID NO: 3580 - DNA, 22 bp, Homo sapiens
agggaattcactggaacgccct

SEQ ID NO: 3581 - DNA, 22 bp, Homo sapiens
cccaggagttagaggttgtggt

SEQ ID NO: 3582 - DNA, 18 bp, Homo sapiens
ctgcactcccgcctgggc

SEQ ID NO: 3583 - DNA, 22 bp, Homo sapiens
gtctgttttctcttctgtggga

SEQ ID NO: 3584 - DNA, 22 bp, Homo sapiens
tgcttacgagctattttcactt

SEQ ID NO: 3585 - DNA, 22 bp, Homo sapiens
ttcttctttccaattacatggt

SEQ ID NO: 3586 - DNA, 22 bp, Homo sapiens
ttgtaagtcacaccagggcagg

SEQ ID NO: 3587 - DNA, 22 bp, Homo sapiens
gcccagcacctctctcagggtt

SEQ ID NO: 3588 - DNA, 22 bp, Homo sapiens
gagatgggcgagaaggtggact

SEQ ID NO: 3589 - DNA, 22 bp, Homo sapiens
tgggagcagcctcagcttcggg

SEQ ID NO: 3590 - DNA, 22 bp, Homo sapiens
cccggcctctgcctggtggcct

SEQ ID NO: 3591 - DNA, 21 bp, Homo sapiens
tgctgggtttgcccatcaggc

SEQ ID NO: 3592 - DNA, 22 bp, Homo sapiens
cctgcctatgagacgttttgcc

SEQ ID NO: 3593 - DNA, 22 bp, Homo sapiens
agcttgtgctggaattacatgt

SEQ ID NO: 3594 - DNA, 22 bp, Homo sapiens
tgtgttgtgacattcttggatg

SEQ ID NO: 3595 - DNA, 22 bp, Homo sapiens
taaatgttttgtgggttgagtt

SEQ ID NO: 3596 - DNA, 22 bp, Homo sapiens
aattgcactttagcaatggtga

SEQ ID NO: 3597 - DNA, 22 bp, Homo sapiens
tttggctcagctcacagatccc

SEQ ID NO: 3598 - DNA, 22 bp, Homo sapiens
gtgcgggcctgggggtttctct

SEQ ID NO: 3599 - DNA, 22 bp, Homo sapiens
attcttcctcatcaatctgtag

SEQ ID NO: 3600 - DNA, 22 bp, Homo sapiens
aaggctgaggcagtgaggcaga

SEQ ID NO: 3601 - DNA, 22 bp, Homo sapiens
attaccgctgagtcctatggag

SEQ ID NO: 3602 - DNA, 22 bp, Homo sapiens
tgggaaagctgcagaaattctc

SEQ ID NO: 3603 - DNA, 22 bp, Homo sapiens
cagatcacttgaagccaggagt

SEQ ID NO: 3604 - DNA, 22 bp, Homo sapiens
ttttccttcatatcccttatgt

SEQ ID NO: 3605 - DNA, 22 bp, Homo sapiens
gggaaggccttgtcagcggatt

SEQ ID NO: 3606 - DNA, 22 bp, Homo sapiens
cctcgcggcactcgggccggat

SEQ ID NO: 3607 - DNA, 22 bp, Homo sapiens
cattgcactccagctctgggcg

SEQ ID NO: 3608 - DNA, 22 bp, Homo sapiens
atctgtcttttaatgttaatgc

SEQ ID NO: 3609 - DNA, 22 bp, Homo sapiens
gtgggcatctccttggaagcca

SEQ ID NO: 3610 - DNA, 22 bp, Homo sapiens
cagtggttgaacccaaatactt

SEQ ID NO: 3611 - DNA, 22 bp, Homo sapiens
ttccccttgataagcagggttg

SEQ ID NO: 3612 - DNA, 22 bp, Homo sapiens
gggaggttgaggctgcagtgag

SEQ ID NO: 3613 - DNA, 22 bp, Homo sapiens
agtgaagctggagaaaggcagt

SEQ ID NO: 3614 - DNA, 22 bp, Homo sapiens
aaaggctcagatgaggccctgg

SEQ ID NO: 3615 - DNA, 22 bp, Homo sapiens
atttactttgctgagatccatc

SEQ ID NO: 3616 - DNA, 18 bp, Homo sapiens
tcactgggtgtatgtggc

SEQ ID NO: 3617 - DNA, 22 bp, Homo sapiens
ctgaggcaggatggcctggctg

SEQ ID NO: 3618 - DNA, 22 bp, Homo sapiens
tgcagcacttgccaaactaact

SEQ ID NO: 3619 - DNA, 19 bp, Homo sapiens
tgtgactggttgtctcgct

SEQ ID NO: 3620 - DNA, 22 bp, Homo sapiens
aaggaattcaaattttctctgg

SEQ ID NO: 3621 - DNA, 22 bp, Homo sapiens
tcatgctatgagcgagggcctg

SEQ ID NO: 3622 - DNA, 22 bp, Homo sapiens
tttataatagatttggggcggc

SEQ ID NO: 3623 - DNA, 22 bp, Homo sapiens
cccagttttctgattgaagagc

SEQ ID NO: 3624 - DNA, 22 bp, Homo sapiens
tgtcacagtttgtactttatag

SEQ ID NO: 3625 - DNA, 21 bp, Homo sapiens
cggaaaggactagggctcaga

SEQ ID NO: 3626 - DNA, 22 bp, Homo sapiens
tctcctggtacccttcctagca

SEQ ID NO: 3627 - DNA, 22 bp, Homo sapiens
cacccaggctggattgcagtgg

SEQ ID NO: 3628 - DNA, 20 bp, Homo sapiens
tcccagtctttggtctgagc

SEQ ID NO: 3629 - DNA, 22 bp, Homo sapiens
cttgacactgtcactcaggcca

SEQ ID NO: 3630 - DNA, 22 bp, Homo sapiens
tggcacagcctccatgtcgtcc

SEQ ID NO: 3631 - DNA, 22 bp, Homo sapiens
gctgcagacttctcatctcatt

SEQ ID NO: 3632 - DNA, 22 bp, Homo sapiens
tgtccagcttttcccaccaagt

SEQ ID NO: 3633 - DNA, 22 bp, Homo sapiens
aggccagcctcaggcagggacc

SEQ ID NO: 3634 - DNA, 22 bp, Homo sapiens
gcctcagtctcccgagtagctg

SEQ ID NO: 3635 - DNA, 22 bp, Homo sapiens
tcttgggcatgtgtttgatttc

SEQ ID NO: 3636 - DNA, 22 bp, Homo sapiens
gctgggttttcttccgggccta

SEQ ID NO: 3637 - DNA, 22 bp, Homo sapiens
ggctagggatctagaccaggac

SEQ ID NO: 3638 - DNA, 19 bp, Homo sapiens
cgcgccgtcgggtccagcc

SEQ ID NO: 3639 - DNA, 22 bp, Homo sapiens
tgttttaagggtcaactgtcac

SEQ ID NO: 3640 - DNA, 20 bp, Homo sapiens
aagagcctgggtccctcaga

SEQ ID NO: 3641 - DNA, 22 bp, Homo sapiens
gagaggaagccttctgtacttg

SEQ ID NO: 3642 - DNA, 22 bp, Homo sapiens
gagtgcaatggcatgatctggg

SEQ ID NO: 3643 - DNA, 22 bp, Homo sapiens
ccccgaggctggagtgcagtgg

SEQ ID NO: 3644 - DNA, 22 bp, Homo sapiens
agcagagcaaagctcagaaatg

SEQ ID NO: 3645 - DNA, 22 bp, Homo sapiens
tcactgcactaggtaatgccac

SEQ ID NO: 3646 - DNA, 22 bp, Homo sapiens
attctcataggagcgtgaacct

SEQ ID NO: 3647 - DNA, 22 bp, Homo sapiens
cgtgctgggtctgcggggccgt

SEQ ID NO: 3648 - DNA, 22 bp, Homo sapiens
gagagattaccacgcttcctga

SEQ ID NO: 3649 - DNA, 22 bp, Homo sapiens
gggattacagatgtgagccatt

SEQ ID NO: 3650 - DNA, 22 bp, Homo sapiens
taggcccctagtgccacgtggc

SEQ ID NO: 3651 - DNA, 22 bp, Homo sapiens
gaccttgtgatccacccgcttt

SEQ ID NO: 3652 - DNA, 22 bp, Homo sapiens
gtggccaaatcatgtcaaaggc

SEQ ID NO: 3653 - DNA, 22 bp, Homo sapiens
gcgtccccatcatccagccgta

SEQ ID NO: 3654 - DNA, 22 bp, Homo sapiens
taattgtaaagtagtagtacag

SEQ ID NO: 3655 - DNA, 22 bp, Homo sapiens
tgtcctgtaggaggcagaacaa

SEQ ID NO: 3656 - DNA, 22 bp, Homo sapiens
gtggcaggagggcatcacttgg

SEQ ID NO: 3657 - DNA, 22 bp, Homo sapiens
agctgattccactttttcccca

SEQ ID NO: 3658 - DNA, 22 bp, Homo sapiens
ccctggctggctctgcccggac

SEQ ID NO: 3659 - DNA, 22 bp, Homo sapiens
gcactggccgcacgcgtagggc

SEQ ID NO: 3660 - DNA, 22 bp, Homo sapiens
gaggtagacttcttggaagtag

SEQ ID NO: 3661 - DNA, 21 bp, Homo sapiens
tggcggggacttgtggctgcc

SEQ ID NO: 3662 - DNA, 22 bp, Homo sapiens
gaccttgtgatccacccgcctt

SEQ ID NO: 3663 - DNA, 22 bp, Homo sapiens
caaagtgctgggattacaggct

SEQ ID NO: 3664 - DNA, 20 bp, Homo sapiens
caggtccagcacgtgcacgg

SEQ ID NO: 3665 - DNA, 22 bp, Homo sapiens
ttctgatgaggaggtctctaag

SEQ ID NO: 3666 - DNA, 22 bp, Homo sapiens
gggaaacaacaaagtatctatg

SEQ ID NO: 3667 - DNA, 23 bp, Homo sapiens
ctgagcaaagggggaagctgctt

SEQ ID NO: 3668 - DNA, 22 bp, Homo sapiens
actacagtgtgataagaggggc

SEQ ID NO: 3669 - DNA, 22 bp, Homo sapiens
caggctgatcagggctgggatg

SEQ ID NO: 3670 - DNA, 22 bp, Homo sapiens
tggtggctcacgtctgtaatct

SEQ ID NO: 3671 - DNA, 22 bp, Homo sapiens
tgggattcaccatgggcttcag

SEQ ID NO: 3672 - DNA, 22 bp, Homo sapiens
catccaggctgaagtgcagtgg

SEQ ID NO: 3673 - DNA, 20 bp, Homo sapiens
tgatatggtttggctgtgtt

SEQ ID NO: 3674 - DNA, 22 bp, Homo sapiens
tccgggaggcagaggttgcagt

SEQ ID NO: 3675 - DNA, 22 bp, Homo sapiens
aaaccctgagacttggggccag

SEQ ID NO: 3676 - DNA, 22 bp, Homo sapiens
aatcacacaaaggcaacttttg

SEQ ID NO: 3677 - DNA, 22 bp, Homo sapiens
ggtgaatttgcctcccgactga

SEQ ID NO: 3678 - DNA, 22 bp, Homo sapiens
gggtgctttggctcacgcctgt

SEQ ID NO: 3679 - DNA, 22 bp, Homo sapiens
ggccttggcctagccctccagg

SEQ ID NO: 3680 - DNA, 22 bp, Homo sapiens
ttcaccatgttggccaggctgg

SEQ ID NO: 3681 - DNA, 22 bp, Homo sapiens
cgtgatgaatggtgagacccgc

SEQ ID NO: 3682 - DNA, 22 bp, Homo sapiens
gtcgtggtcagacaccagaaaa

SEQ ID NO: 3683 - DNA, 22 bp, Homo sapiens
cctcggctgggccttggccact

SEQ ID NO: 3684 - DNA, 22 bp, Homo sapiens
ccctgctgtgtagcggaggaac

SEQ ID NO: 3685 - DNA, 22 bp, Homo sapiens
ctcactgcaatctccgtctccc

SEQ ID NO: 3686 - DNA, 22 bp, Homo sapiens
cctggcctttgaacgctagact

SEQ ID NO: 3687 - DNA, 20 bp, Homo sapiens
tgtgatgggttctttcctgg

SEQ ID NO: 3688 - DNA, 22 bp, Homo sapiens
cagtggcgtgatctctgctcac

SEQ ID NO: 3689 - DNA, 22 bp, Homo sapiens
aggtcaagggagctgagggcca

SEQ ID NO: 3690 - DNA, 22 bp, Homo sapiens
tcaaaatgccgagtgcccaggt

SEQ ID NO: 3691 - DNA, 21 bp, Homo sapiens
atgtagggtttgccttctcta

SEQ ID NO: 3692 - DNA, 22 bp, Homo sapiens
gcgggcgggggttcccaggtct

SEQ ID NO: 3693 - DNA, 22 bp, Homo sapiens
ctcgccccggcacagtgtccgt

SEQ ID NO: 3694 - DNA, 22 bp, Homo sapiens
catccgcatgcaagtgctgtcc

SEQ ID NO: 3695 - DNA, 22 bp, Homo sapiens
tgccttcgtacatgcaacatgc

SEQ ID NO: 3696 - DNA, 22 bp, Homo sapiens
tgtactgtatcattgcaacttt

SEQ ID NO: 3697 - DNA, 22 bp, Homo sapiens
gtggagagagataagcctggtc

SEQ ID NO: 3698 - DNA, 22 bp, Homo sapiens
ggcttcgcagctcggcagccgc

SEQ ID NO: 3699 - DNA, 22 bp, Homo sapiens
gtgcccagcagcagcgtccccg

SEQ ID NO: 3700 - DNA, 22 bp, Homo sapiens
tatgaagtctctgatgttgagt

SEQ ID NO: 3701 - DNA, 22 bp, Homo sapiens
gtgcaaaagtaattgtggtttt

SEQ ID NO: 3702 - DNA, 18 bp, Homo sapiens
gcaaccacagattctttg

SEQ ID NO: 3703 - DNA, 20 bp, Homo sapiens
tcagccttgaatgcttgaaa

SEQ ID NO: 3704 - DNA, 22 bp, Homo sapiens
tgtggttttggttcagaaacaa

SEQ ID NO: 3705 - DNA, 22 bp, Homo sapiens
ggatggtgacggcggcccgctt

SEQ ID NO: 3706 - DNA, 22 bp, Homo sapiens
catcctctccagcagtggagtg

SEQ ID NO: 3707 - DNA, 22 bp, Homo sapiens
attggtggtgaggacatgccag

SEQ ID NO: 3708 - DNA, 22 bp, Homo sapiens
acagtgcttagcacagagtaga

SEQ ID NO: 3709 - DNA, 22 bp, Homo sapiens
agaccactaaaactttctctat

SEQ ID NO: 3710 - DNA, 22 bp, Homo sapiens
ggtaccaccaattcagctgcca

SEQ ID NO: 3711 - DNA, 22 bp, Homo sapiens
actgtactccagctctgggtga

SEQ ID NO: 3712 - DNA, 22 bp, Homo sapiens
agtggctttgttccgtatggca

SEQ ID NO: 3713 - DNA, 22 bp, Homo sapiens
ctctggactttttgtggattct

SEQ ID NO: 3714 - DNA, 22 bp, Homo sapiens
aaaatcctgctgactcgagatg

SEQ ID NO: 3715 - DNA, 22 bp, Homo sapiens
ttgtgggatctccctgttgctc

SEQ ID NO: 3716 - DNA, 22 bp, Homo sapiens
aatgttacgatcaacaacacat

SEQ ID NO: 3717 - DNA, 22 bp, Homo sapiens
agcgtgaattagttggtacaca

SEQ ID NO: 3718 - DNA, 22 bp, Homo sapiens
ggaggcggaagttgcagtgagc

SEQ ID NO: 3719 - DNA, 22 bp, Homo sapiens
gagatggagtctttttctgtca

SEQ ID NO: 3720 - DNA, 19 bp, Homo sapiens
gcctatgtcttcaaatcat

SEQ ID NO: 3721 - DNA, 22 bp, Homo sapiens
ctccccgagagaggttgtccgc

SEQ ID NO: 3722 - DNA, 22 bp, Homo sapiens
cggggcctcgtcactctttgcg

SEQ ID NO: 3723 - DNA, 22 bp, Homo sapiens
ttggtttccttaacagcctaaa

SEQ ID NO: 3724 - DNA, 22 bp, Homo sapiens
gggaatgtagcaaatctgcaat

SEQ ID NO: 3725 - DNA, 22 bp, Homo sapiens
tttaagaagttatgttataaat

SEQ ID NO: 3726 - DNA, 20 bp, Homo sapiens
acctcctggcgggcatcctc

SEQ ID NO: 3727 - DNA, 22 bp, Homo sapiens
gggggctccaggcgagaatgtg

SEQ ID NO: 3728 - DNA, 22 bp, Homo sapiens
tagctgaattgtgggagaccta

SEQ ID NO: 3729 - DNA, 22 bp, Homo sapiens
tcctgccgtcctccggggcctc

SEQ ID NO: 3730 - DNA, 22 bp, Homo sapiens
attctaaatcagagagctctgt

SEQ ID NO: 3731 - DNA, 22 bp, Homo sapiens
gagtccaccacagctcaaagag

SEQ ID NO: 3732 - DNA, 19 bp, Homo sapiens
tggttgtgcacgggttggt

SEQ ID NO: 3733 - DNA, 22 bp, Homo sapiens
tgacaagaaagcgtcttctttt

SEQ ID NO: 3734 - DNA, 22 bp, Homo sapiens
tagaactaagagttatcattta

SEQ ID NO: 3735 - DNA, 22 bp, Homo sapiens
atgccaataaatgttaatatct

SEQ ID NO: 3736 - DNA, 22 bp, Homo sapiens
aggtattattagcatctctatt

SEQ ID NO: 3737 - DNA, 22 bp, Homo sapiens
tctcgtgcaggccttgctcgga

SEQ ID NO: 3738 - DNA, 22 bp, Homo sapiens
tgtccaggctggagtgcagtgg

SEQ ID NO: 3739 - DNA, 22 bp, Homo sapiens
ggtctgtctgcctcaggagatg

SEQ ID NO: 3740 - DNA, 22 bp, Homo sapiens
tgggaggtgattaaattatggg

SEQ ID NO: 3741 - DNA, 22 bp, Homo sapiens
atatgggtcatgtgatgttcaa

SEQ ID NO: 3742 - DNA, 22 bp, Homo sapiens
tcctccactttgtctagcaaca

SEQ ID NO: 3743 - DNA, 22 bp, Homo sapiens
tgtgtcagaaggcaatggggat

SEQ ID NO: 3744 - DNA, 22 bp, Homo sapiens
ggagtgaagtggcgcgatctcg

SEQ ID NO: 3745 - DNA, 22 bp, Homo sapiens
ggagacagggttgaaccacgca

SEQ ID NO: 3746 - DNA, 22 bp, Homo sapiens
caagggctcaaacggtggttgc

SEQ ID NO: 3747 - DNA, 22 bp, Homo sapiens
tctgctttcttactaaaaatga

SEQ ID NO: 3748 - DNA, 22 bp, Homo sapiens
aaagatgttgctgctccgccct

SEQ ID NO: 3749 - DNA, 22 bp, Homo sapiens
tggaaacacccacgcatgcata

SEQ ID NO: 3750 - DNA, 22 bp, Homo sapiens
cagatgtacatgaagggcaatg

SEQ ID NO: 3751 - DNA, 22 bp, Homo sapiens
ctgaagcagggagtgatgaagt

SEQ ID NO: 3752 - DNA, 22 bp, Homo sapiens
tgggaggccgaggcaggtggat

SEQ ID NO: 3753 - DNA, 22 bp, Homo sapiens
aagctcaaaccttggggctcag

SEQ ID NO: 3754 - DNA, 22 bp, Homo sapiens
cctcaagtcattccggagacct

SEQ ID NO: 3755 - DNA, 22 bp, Homo sapiens
tacggtcagtccgtgccccaag

SEQ ID NO: 3756 - DNA, 22 bp, Homo sapiens
tgcctaggctggaatgcagtgg

SEQ ID NO: 3757 - DNA, 22 bp, Homo sapiens
tgcctaggctggagtgcagtga

SEQ ID NO: 3758 - DNA, 22 bp, Homo sapiens
tgctccatgcgctcggccggcg

SEQ ID NO: 3759 - DNA, 22 bp, Homo sapiens
ctcggaatggaacaacagcggt

SEQ ID NO: 3760 - DNA, 22 bp, Homo sapiens
atctagattaggtataagagct

SEQ ID NO: 3761 - DNA, 22 bp, Homo sapiens
agaaagtgcttccctttggact

SEQ ID NO: 3762 - DNA, 22 bp, Homo sapiens
tcacaacgcctctgcaaatcct

SEQ ID NO: 3763 - DNA, 22 bp, Homo sapiens
ttgctcttgaaaattgatgctg

SEQ ID NO: 3764 - DNA, 22 bp, Homo sapiens
acattacctggcatttgatctt

SEQ ID NO: 3765 - DNA, 19 bp, Homo sapiens
acacagggatcagagggtt

SEQ ID NO: 3766 - DNA, 22 bp, Homo sapiens
ctgggaagaagggacaacagcg

SEQ ID NO: 3767 - DNA, 22 bp, Homo sapiens
aagccaatgctagcccacatgc

SEQ ID NO: 3768 - DNA, 22 bp, Homo sapiens
tcaaattgtcatcttgataatg

SEQ ID NO: 3769 - DNA, 22 bp, Homo sapiens
tctgaccctactcagcactttg

SEQ ID NO: 3770 - DNA, 22 bp, Homo sapiens
tctaatcctatggtggggaggg

SEQ ID NO: 3771 - DNA, 22 bp, Homo sapiens
ttcaggcccagcacagcgcgtg

SEQ ID NO: 3772 - DNA, 22 bp, Homo sapiens
gtccaaaagagccagccgggcg

SEQ ID NO: 3773 - DNA, 22 bp, Homo sapiens
cgtgccactgcactccagtctg

SEQ ID NO: 3774 - DNA, 22 bp, Homo sapiens
tttaaaaaactagtctgagtct

SEQ ID NO: 3775 - DNA, 22 bp, Homo sapiens
gggcccctgggaattctgtgat

SEQ ID NO: 3776 - DNA, 22 bp, Homo sapiens
ccactgcactccagccttggca

SEQ ID NO: 3777 - DNA, 22 bp, Homo sapiens
gctgtggcctggcgcagagctg

SEQ ID NO: 3778 - DNA, 22 bp, Homo sapiens
agggcactctgcagggaccacc

SEQ ID NO: 3779 - DNA, 22 bp, Homo sapiens
aaaccgggtccagatcttcagg

SEQ ID NO: 3780 - DNA, 22 bp, Homo sapiens
cgtcacttcttagtctattttc

SEQ ID NO: 3781 - DNA, 22 bp, Homo sapiens
tattactgtcaatatcacagaa

SEQ ID NO: 3782 - DNA, 22 bp, Homo sapiens
ggctccaccctgcttccagaag

SEQ ID NO: 3783 - DNA, 22 bp, Homo sapiens
caggcacggtggctcatgcctg

SEQ ID NO: 3784 - DNA, 22 bp, Homo sapiens
caaagtggaggctctggggcca

SEQ ID NO: 3785 - DNA, 22 bp, Homo sapiens
tgtctctgtgactccttccgcc

SEQ ID NO: 3786 - DNA, 22 bp, Homo sapiens
aaagtaattgtggttcttgcca

SEQ ID NO: 3787 - DNA, 22 bp, Homo sapiens
ggcggagcttgcagtgagccga

SEQ ID NO: 3788 - DNA, 22 bp, Homo sapiens
gtgctggatgaaataactggaa

SEQ ID NO: 3789 - DNA, 22 bp, Homo sapiens
tccctcaatgtgggtcaagacc

SEQ ID NO: 3790 - DNA, 22 bp, Homo sapiens
tgaattccatcctgttgcaacc

SEQ ID NO: 3791 - DNA, 22 bp, Homo sapiens
gatgatcatctgtaaagttaga

SEQ ID NO: 3792 - DNA, 20 bp, Homo sapiens
attagctcaggtgaggtcat

SEQ ID NO: 3793 - DNA, 22 bp, Homo sapiens
agctggagatgagtgacgtgcc

SEQ ID NO: 3794 - DNA, 22 bp, Homo sapiens
ttttggttgttgggtaagagta

SEQ ID NO: 3795 - DNA, 22 bp, Homo sapiens
ttgccgccgtctgctcgccccg

SEQ ID NO: 3796 - DNA, 21 bp, Homo sapiens
tgactgaggcttcttcacaca

SEQ ID NO: 3797 - DNA, 22 bp, Homo sapiens
gaaatggtcaagctgcaggata

SEQ ID NO: 3798 - DNA, 22 bp, Homo sapiens
tccagctctgctgtgcgccggt

SEQ ID NO: 3799 - DNA, 22 bp, Homo sapiens
ggatctgggctgcagtctaggc

SEQ ID NO: 3800 - DNA, 22 bp, Homo sapiens
tgctgggattacagtcatgagc

SEQ ID NO: 3801 - DNA, 22 bp, Homo sapiens
cccactgcatgagttggtatta

SEQ ID NO: 3802 - DNA, 22 bp, Homo sapiens
atctaagagaaaggaagttcag

SEQ ID NO: 3803 - DNA, 16 bp, Homo sapiens
tgcggcaacttgcggc

SEQ ID NO: 3804 - DNA, 22 bp, Homo sapiens
tgatgtggccccacttagctgt

SEQ ID NO: 3805 - DNA, 22 bp, Homo sapiens
tcaggtatttcttttagctgtg

SEQ ID NO: 3806 - DNA, 18 bp, Homo sapiens
gctatctctaagatcttt

SEQ ID NO: 3807 - DNA, 22 bp, Homo sapiens
tgacctcatgatccgcccacct

SEQ ID NO: 3808 - DNA, 17 bp, Homo sapiens
agccgggcatggaccag

SEQ ID NO: 3809 - DNA, 18 bp, Homo sapiens
gcactgaggaaaacctct

SEQ ID NO: 3810 - DNA, 22 bp, Homo sapiens
tttatgtagttacggactatca

SEQ ID NO: 3811 - DNA, 22 bp, Homo sapiens
tcacagagttaaaagtttcttt

SEQ ID NO: 3812 - DNA, 22 bp, Homo sapiens
cccaccagacctgcaccggcac

SEQ ID NO: 3813 - DNA, 22 bp, Homo sapiens
agatcacagtggcaactccctt

SEQ ID NO: 3814 - DNA, 22 bp, Homo sapiens
gccgtccacctcgatggccact

SEQ ID NO: 3815 - DNA, 22 bp, Homo sapiens
tcacaatatttatcttccaatt

SEQ ID NO: 3816 - DNA, 22 bp, Homo sapiens
tcctggatggcctgcaggcggt

SEQ ID NO: 3817 - DNA, 22 bp, Homo sapiens
actgagacagctccgctgcccg

SEQ ID NO: 3818 - DNA, 22 bp, Homo sapiens
tttcttggtcttcccgacctgg

SEQ ID NO: 3819 - DNA, 20 bp, Homo sapiens
ttcgctgggagtggccaggc

SEQ ID NO: 3820 - DNA, 22 bp, Homo sapiens
tctcccaagcctggcaggggca

SEQ ID NO: 3821 - DNA, 22 bp, Homo sapiens
ctatggtgatagaaatcagaat

SEQ ID NO: 3822 - DNA, 22 bp, Homo sapiens
attctacatgatagaagggaga

SEQ ID NO: 3823 - DNA, 22 bp, Homo sapiens
gacaggcttccactatgttgcc

SEQ ID NO: 3824 - DNA, 22 bp, Homo sapiens
tagattcagatatttaggacaa

SEQ ID NO: 3825 - DNA, 22 bp, Homo sapiens
gcagaagcacaggtgacgggcc

SEQ ID NO: 3826 - DNA, 22 bp, Homo sapiens
gttctgggagatcttgagcttc

SEQ ID NO: 3827 - DNA, 22 bp, Homo sapiens
agccaagagttctttagcggtg

SEQ ID NO: 3828 - DNA, 22 bp, Homo sapiens
gatccgaatcattgctctttta

SEQ ID NO: 3829 - DNA, 22 bp, Homo sapiens
tgagtgaggctgggcagtccct

SEQ ID NO: 3830 - DNA, 22 bp, Homo sapiens
tcacaaatgtttgcatgtgtct

SEQ ID NO: 3831 - DNA, 23 bp, Homo sapiens
ggggcctgcaccggtctgcgcgg

SEQ ID NO: 3832 - DNA, 22 bp, Homo sapiens
aaaggctttaaaatgtacatat

SEQ ID NO: 3833 - DNA, 22 bp, Homo sapiens
cttagatgaagtcacagaaccc

SEQ ID NO: 3834 - DNA, 21 bp, Homo sapiens
tatcagagacattgagaggca

SEQ ID NO: 3835 - DNA, 22 bp, Homo sapiens
ggtgagttctcagcttattgca

SEQ ID NO: 3836 - DNA, 22 bp, Homo sapiens
taatatctacttcatagagttt

SEQ ID NO: 3837 - DNA, 22 bp, Homo sapiens
ggtagaaggggaagaggtccat

SEQ ID NO: 3838 - DNA, 22 bp, Homo sapiens
tgattaatatcaccaccattgg

SEQ ID NO: 3839 - DNA, 22 bp, Homo sapiens
aacccgggaggtggaggttatg

SEQ ID NO: 3840 - DNA, 22 bp, Homo sapiens
ttgaccactgaatggttctgaa

SEQ ID NO: 3841 - DNA, 22 bp, Homo sapiens
tgatctttggtaatctggcaca

SEQ ID NO: 3842 - DNA, 22 bp, Homo sapiens
ctggtgggagataattgaatca

SEQ ID NO: 3843 - DNA, 19 bp, Homo sapiens
gctgaggtggaggaaggag

SEQ ID NO: 3844 - DNA, 22 bp, Homo sapiens
ccctctcgcggggcagcggagg

SEQ ID NO: 3845 - DNA, 22 bp, Homo sapiens
cactgcccaccaagtggctggt

SEQ ID NO: 3846 - DNA, 22 bp, Homo sapiens
tttggtgtgcaccttgcggtgc

SEQ ID NO: 3847 - DNA, 22 bp, Homo sapiens
gtcccaaactcctgacctcagg

SEQ ID NO: 3848 - DNA, 22 bp, Homo sapiens
ctcctaggtaacagggtggttt

SEQ ID NO: 3849 - DNA, 22 bp, Homo sapiens
gtgctgacaggagcctggcggt

SEQ ID NO: 3850 - DNA, 16 bp, Homo sapiens
gatctgaaggtgctgg

SEQ ID NO: 3851 - DNA, 22 bp, Homo sapiens
taggtgcctgcacgacccaaac

SEQ ID NO: 3852 - DNA, 22 bp, Homo sapiens
aaagcttaccttttcagtcttt

SEQ ID NO: 3853 - DNA, 22 bp, Homo sapiens
tgttagtcagacacacctaaat

SEQ ID NO: 3854 - DNA, 18 bp, Homo sapiens
tctgtgggatcagtgagg

SEQ ID NO: 3855 - DNA, 22 bp, Homo sapiens
tggcgcgacgtgccccctgctt

SEQ ID NO: 3856 - DNA, 21 bp, Homo sapiens
gcagcagtgttctagaatact

SEQ ID NO: 3857 - DNA, 22 bp, Homo sapiens
ctgggaggtggaggttgcattg

SEQ ID NO: 3858 - DNA, 22 bp, Homo sapiens
tcagacaactctggaggctggc

SEQ ID NO: 3859 - DNA, 19 bp, Homo sapiens
gggtcccactgcccgtctg

SEQ ID NO: 3860 - DNA, 22 bp, Homo sapiens
ggcgtgggcgaggtgctctatc

SEQ ID NO: 3861 - DNA, 22 bp, Homo sapiens
ctcgggcaccctggttctggtg

SEQ ID NO: 3862 - DNA, 22 bp, Homo sapiens
gtgggggagatgcttaggtccg

SEQ ID NO: 3863 - DNA, 22 bp, Homo sapiens
gggagctggagctggaagactc

SEQ ID NO: 3864 - DNA, 22 bp, Homo sapiens
atgggctgtccattgctggctg

SEQ ID NO: 3865 - DNA, 22 bp, Homo sapiens
tgagcttccctcctgcactaca

SEQ ID NO: 3866 - DNA, 22 bp, Homo sapiens
gtgcttgacgtgtagccgcccc

SEQ ID NO: 3867 - DNA, 22 bp, Homo sapiens
tttgctgctgtatatggagccc

SEQ ID NO: 3868 - DNA, 22 bp, Homo sapiens
gagatatgttggcagctggtat

SEQ ID NO: 3869 - DNA, 22 bp, Homo sapiens
atgctttctcttagttcattga

SEQ ID NO: 3870 - DNA, 22 bp, Homo sapiens
ctctgatgtcgagtaaggtgtg

SEQ ID NO: 3871 - DNA, 22 bp, Homo sapiens
agactttaacaatgggtatgaa

SEQ ID NO: 3872 - DNA, 23 bp, Homo sapiens
tgggttcattcttgaagtcagtg

SEQ ID NO: 3873 - DNA, 22 bp, Homo sapiens
tggagtgcaatagtaataaggt

SEQ ID NO: 3874 - DNA, 22 bp, Homo sapiens
acatgggcatctatgaggctct

SEQ ID NO: 3875 - DNA, 22 bp, Homo sapiens
ctgagcatcatggcagaatctt

SEQ ID NO: 3876 - DNA, 22 bp, Homo sapiens
ctcagctgcagcctggctggca

SEQ ID NO: 3877 - DNA, 18 bp, Homo sapiens
ggaaggtgattcagtttt

SEQ ID NO: 3878 - DNA, 22 bp, Homo sapiens
gattgggggtcaggctcaggtc

SEQ ID NO: 3879 - DNA, 22 bp, Homo sapiens
accccagaggcggaggctgcag

SEQ ID NO: 3880 - DNA, 20 bp, Homo sapiens
tttcaccatcttggccaggc

SEQ ID NO: 3881 - DNA, 22 bp, Homo sapiens
ctgggcagctgtatcagggagt

SEQ ID NO: 3882 - DNA, 22 bp, Homo sapiens
tagctgcttgaccaggcagtgg

SEQ ID NO: 3883 - DNA, 22 bp, Homo sapiens
ttccacggggctccccgctctt

SEQ ID NO: 3884 - DNA, 22 bp, Homo sapiens
gtgacaggccactgcggctctg

SEQ ID NO: 3885 - DNA, 22 bp, Homo sapiens
acctcctggcctcaagcaatcc

SEQ ID NO: 3886 - DNA, 22 bp, Homo sapiens
atattgttagtaatatttcgaa

SEQ ID NO: 3887 - DNA, 19 bp, Homo sapiens
agagtattgaatttgccct

SEQ ID NO: 3888 - DNA, 22 bp, Homo sapiens
tagccgggtgtggtggaactcc

SEQ ID NO: 3889 - DNA, 22 bp, Homo sapiens
tgggaggccaaggcaggcggat

SEQ ID NO: 3890 - DNA, 22 bp, Homo sapiens
gctgatggaaggacaggcgccg

SEQ ID NO: 3891 - DNA, 22 bp, Homo sapiens
tgtgggagaaggaagcaagctg

SEQ ID NO: 3892 - DNA, 22 bp, Homo sapiens
ttgggtgctgtcatggggcacg

SEQ ID NO: 3893 - DNA, 22 bp, Homo sapiens
gctgggacaacaggtgagcacc

SEQ ID NO: 3894 - DNA, 18 bp, Homo sapiens
gaaagatgaacttttttc

SEQ ID NO: 3895 - DNA, 22 bp, Homo sapiens
gaatgcagatggctggtgtatg

SEQ ID NO: 3896 - DNA, 22 bp, Homo sapiens
cttgaggctgcactccagggcc

SEQ ID NO: 3897 - DNA, 22 bp, Homo sapiens
ttgtgaatagtgccgcaatgaa

SEQ ID NO: 3898 - DNA, 22 bp, Homo sapiens
tgtccttcttgtcttgcccaaa

SEQ ID NO: 3899 - DNA, 22 bp, Homo sapiens
ccagatatcactgccgtgttgt

SEQ ID NO: 3900 - DNA, 23 bp, Homo sapiens
aaataggagtatctggatcatga

SEQ ID NO: 3901 - DNA, 21 bp, Homo sapiens
cagtggcacgatttcggctca

SEQ ID NO: 3902 - DNA, 22 bp, Homo sapiens
tgctgctccccagcacacagca

SEQ ID NO: 3903 - DNA, 22 bp, Homo sapiens
cccgggaggtggaggttgcagt

SEQ ID NO: 3904 - DNA, 22 bp, Homo sapiens
tgactcctggtatggatgacag

SEQ ID NO: 3905 - DNA, 20 bp, Homo sapiens
aaaattgctctgcagtcccc

SEQ ID NO: 3906 - DNA, 22 bp, Homo sapiens
tagagatggggtcttgctatga

SEQ ID NO: 3907 - DNA, 22 bp, Homo sapiens
tgggcccgcagctgctgctcca

SEQ ID NO: 3908 - DNA, 22 bp, Homo sapiens
tcctgagataaatctcatgtga

SEQ ID NO: 3909 - DNA, 22 bp, Homo sapiens
ttaaatattatgttgtctgcaa

SEQ ID NO: 3910 - DNA, 22 bp, Homo sapiens
gtttatggactgtgtatgttat

SEQ ID NO: 3911 - DNA, 22 bp, Homo sapiens
ggtctcatctttcagcgtcgag

SEQ ID NO: 3912 - DNA, 22 bp, Homo sapiens
gccactgagcccggccattgtt

SEQ ID NO: 3913 - DNA, 22 bp, Homo sapiens
caggctgctgacaggcttggag

SEQ ID NO: 3914 - DNA, 22 bp, Homo sapiens
tttgattgcaatagttttatga

SEQ ID NO: 3915 - DNA, 22 bp, Homo sapiens
gaagctgtgtgaagctctgaag

SEQ ID NO: 3916 - DNA, 22 bp, Homo sapiens
tttgggttcagacatgattaca

SEQ ID NO: 3917 - DNA, 22 bp, Homo sapiens
agctgaaacttcccattaattg

SEQ ID NO: 3918 - DNA, 22 bp, Homo sapiens
cggccgcagcagtgtcggccca

SEQ ID NO: 3919 - DNA, 22 bp, Homo sapiens
ctgtacttttgcaggtcacagc

SEQ ID NO: 3920 - DNA, 22 bp, Homo sapiens
ataatggaaaagatcatttcct

SEQ ID NO: 3921 - DNA, 22 bp, Homo sapiens
caggaggattgcttgaggccag

SEQ ID NO: 3922 - DNA, 22 bp, Homo sapiens
gggcttcagttctgaccatctt

SEQ ID NO: 3923 - DNA, 22 bp, Homo sapiens
agtggaccagaagactgaagct

SEQ ID NO: 3924 - DNA, 22 bp, Homo sapiens
aacccgtgatcctgactcccct

SEQ ID NO: 3925 - DNA, 22 bp, Homo sapiens
atacaaagtattgatcctgagt

SEQ ID NO: 3926 - DNA, 22 bp, Homo sapiens
ccacgtccagctaattttcgta

SEQ ID NO: 3927 - DNA, 22 bp, Homo sapiens
tgtaatactccattgtatggat

SEQ ID NO: 3928 - DNA, 22 bp, Homo sapiens
caatttgccctgttaaattttc

SEQ ID NO: 3929 - DNA, 22 bp, Homo sapiens
aagggaatgttgtggctggttt

SEQ ID NO: 3930 - DNA, 22 bp, Homo sapiens
ggaatgcactagactgtgaaac

SEQ ID NO: 3931 - DNA, 22 bp, Homo sapiens
agacccaggattggggctgccg

SEQ ID NO: 3932 - DNA, 22 bp, Homo sapiens
tatcacatttggagatttatga

SEQ ID NO: 3933 - DNA, 22 bp, Homo sapiens
cgtctctggcccggcccctggg

SEQ ID NO: 3934 - DNA, 22 bp, Homo sapiens
ctgaaatgacggtttggggcaa

SEQ ID NO: 3935 - DNA, 22 bp, Homo sapiens
gtggcctggctggcaccacctc

SEQ ID NO: 3936 - DNA, 22 bp, Homo sapiens
gagcctgagcaatgtgatgttt

SEQ ID NO: 3937 - DNA, 22 bp, Homo sapiens
ctggagggctgcagcgaggctg

SEQ ID NO: 3938 - DNA, 22 bp, Homo sapiens
ctgtccatattcaaggggtagg

SEQ ID NO: 3939 - DNA, 22 bp, Homo sapiens
tctgcctagaaacagtgtttgc

SEQ ID NO: 3940 - DNA, 21 bp, Homo sapiens
tcagataccagactcaagggg

SEQ ID NO: 3941 - DNA, 22 bp, Homo sapiens
gcctgctcccagttggcgcctc

SEQ ID NO: 3942 - DNA, 22 bp, Homo sapiens
cggccgcgtccagggccgccag

SEQ ID NO: 3943 - DNA, 22 bp, Homo sapiens
aaggccctgtctccaaatacag

SEQ ID NO: 3944 - DNA, 22 bp, Homo sapiens
ggacaattcagtgatttgggga

SEQ ID NO: 3945 - DNA, 22 bp, Homo sapiens
tctcatctgccatttgcaggag

SEQ ID NO: 3946 - DNA, 22 bp, Homo sapiens
gaactcattagcctgctttcag

SEQ ID NO: 3947 - DNA, 22 bp, Homo sapiens
tgctcatcaacatgatgatcat

SEQ ID NO: 3948 - DNA, 22 bp, Homo sapiens
cgggcaaggcgagactaggccc

SEQ ID NO: 3949 - DNA, 22 bp, Homo sapiens
cgtcagtttactgttgccatgg

SEQ ID NO: 3950 - DNA, 22 bp, Homo sapiens
ggggggcgccatggtctcttgg

SEQ ID NO: 3951 - DNA, 22 bp, Homo sapiens
tgccgcagtgcggggagggccc

SEQ ID NO: 3952 - DNA, 22 bp, Homo sapiens
atgccactgcactccagcctag

SEQ ID NO: 3953 - DNA, 22 bp, Homo sapiens
ggtctgtcttcccaatcgtggc

SEQ ID NO: 3954 - DNA, 22 bp, Homo sapiens
tgaccaatactgtggatgccag

SEQ ID NO: 3955 - DNA, 23 bp, Homo sapiens
ttaacaggatctcgggcaagagg

SEQ ID NO: 3956 - DNA, 18 bp, Homo sapiens
aggagcggctgcggctgc

SEQ ID NO: 3957 - DNA, 22 bp, Homo sapiens
cacggtggcccacaggtgcaag

SEQ ID NO: 3958 - DNA, 22 bp, Homo sapiens
agtggcacaattttgactcccc

SEQ ID NO: 3959 - DNA, 22 bp, Homo sapiens
ggctgtggagctgcagagttgg

SEQ ID NO: 3960 - DNA, 22 bp, Homo sapiens
caggctggagtgcagtggcgcc

SEQ ID NO: 3961 - DNA, 19 bp, Homo sapiens
gattttgctgaaacccaca

SEQ ID NO: 3962 - DNA, 22 bp, Homo sapiens
ccagggatgcagaggttgcagt

SEQ ID NO: 3963 - DNA, 22 bp, Homo sapiens
actcaagtggccttgatggctt

SEQ ID NO: 3964 - DNA, 22 bp, Homo sapiens
gcttccggagccaaaaggcccc

SEQ ID NO: 3965 - DNA, 19 bp, Homo sapiens
ggagtttccaatgggtaaa

SEQ ID NO: 3966 - DNA, 22 bp, Homo sapiens
tgagctgcttcttataatgtgt

SEQ ID NO: 3967 - DNA, 16 bp, Homo sapiens
gcgcctcctcggcctc

SEQ ID NO: 3968 - DNA, 22 bp, Homo sapiens
tagatatttctactgtggatta

SEQ ID NO: 3969 - DNA, 22 bp, Homo sapiens
acacatcctgaccaagttcagg

SEQ ID NO: 3970 - DNA, 22 bp, Homo sapiens
tatagtgtgaggtaagggtcca

SEQ ID NO: 3971 - DNA, 22 bp, Homo sapiens
ctggggtaggaggcagctgtgc

SEQ ID NO: 3972 - DNA, 22 bp, Homo sapiens
tcagaattgtggagaaagggga

SEQ ID NO: 3973 - DNA, 22 bp, Homo sapiens
acagttaattgttgttgggtgt

SEQ ID NO: 3974 - DNA, 22 bp, Homo sapiens
tgataaacttagaaagaatgtt

SEQ ID NO: 3975 - DNA, 22 bp, Homo sapiens
caccaggctggagtgcagtggc

SEQ ID NO: 3976 - DNA, 22 bp, Homo sapiens
cgctggaaattgccgttggctt

SEQ ID NO: 3977 - DNA, 22 bp, Homo sapiens
cctcttctaggacgtccttgtg

SEQ ID NO: 3978 - DNA, 22 bp, Homo sapiens
ctgggcatcatggtgcgggcac

SEQ ID NO: 3979 - DNA, 22 bp, Homo sapiens
tgctggtaccgcgcctccgcca

SEQ ID NO: 3980 - DNA, 22 bp, Homo sapiens
tggctaggctggtgtcaagctc

SEQ ID NO: 3981 - DNA, 22 bp, Homo sapiens
gcacatgaggctgtctttgtct

SEQ ID NO: 3982 - DNA, 22 bp, Homo sapiens
tgactcaagagcctgactcatc

SEQ ID NO: 3983 - DNA, 22 bp, Homo sapiens
gatagtcacctcccttaacttt

SEQ ID NO: 3984 - DNA, 22 bp, Homo sapiens
taagagaatgttgtggctaggt

SEQ ID NO: 3985 - DNA, 22 bp, Homo sapiens
actgggtctgaaggacagagca

SEQ ID NO: 3986 - DNA, 22 bp, Homo sapiens
agagaggtctcaggagaaacca

SEQ ID NO: 3987 - DNA, 22 bp, Homo sapiens
ggcatgagcacgaagtggtacc

SEQ ID NO: 3988 - DNA, 22 bp, Homo sapiens
tgagtttgtctgagtggtaaca

SEQ ID NO: 3989 - DNA, 22 bp, Homo sapiens
ggcgggacggggcgtgcacaga

SEQ ID NO: 3990 - DNA, 22 bp, Homo sapiens
tcggggtctttgacacgctctg

SEQ ID NO: 3991 - DNA, 22 bp, Homo sapiens
gctcagaggcacgacctcttgg

SEQ ID NO: 3992 - DNA, 22 bp, Homo sapiens
gtggagggtgattgccggctgt

SEQ ID NO: 3993 - DNA, 22 bp, Homo sapiens
ttggagagtgatattcagatgc

SEQ ID NO: 3994 - DNA, 22 bp, Homo sapiens
atctcttgccagtcagaatggt

SEQ ID NO: 3995 - DNA, 22 bp, Homo sapiens
agcacctgtcaagtccaggctg

SEQ ID NO: 3996 - DNA, 22 bp, Homo sapiens
aagatactttgcatgcatgaag

SEQ ID NO: 3997 - DNA, 21 bp, Homo sapiens
cctcaagtgcctcctgctgct

SEQ ID NO: 3998 - DNA, 22 bp, Homo sapiens
acccacaacagctctaggaagt

SEQ ID NO: 3999 - DNA, 22 bp, Homo sapiens
gaggtgggcggatcacaaggtc

SEQ ID NO: 4000 - DNA, 18 bp, Homo sapiens
cccacggtgctgtagggc

SEQ ID NO: 4001 - DNA, 22 bp, Homo sapiens
gtcaccagtgctaagaggtgga

SEQ ID NO: 4002 - DNA, 22 bp, Homo sapiens
ctctttggatagaattacaaag

SEQ ID NO: 4003 - DNA, 22 bp, Homo sapiens
gggctgtgaggtgagaacttac

SEQ ID NO: 4004 - DNA, 22 bp, Homo sapiens
acctggaggcagaggttgcagt

SEQ ID NO: 4005 - DNA, 21 bp, Homo sapiens
tcacgtggtcacatgagcttt

SEQ ID NO: 4006 - DNA, 22 bp, Homo sapiens
tctgagaatggtggatgtggtg

SEQ ID NO: 4007 - DNA, 21 bp, Homo sapiens
tggtttatgtgcttagggtct

SEQ ID NO: 4008 - DNA, 22 bp, Homo sapiens
tggaaaaccagaccgcgttggg

SEQ ID NO: 4009 - DNA, 22 bp, Homo sapiens
ggcaagagggcagatggagtgc

SEQ ID NO: 4010 - DNA, 22 bp, Homo sapiens
gctaagggataggctgcctcct

SEQ ID NO: 4011 - DNA, 22 bp, Homo sapiens
tcaccgccttgcccggccgggc

SEQ ID NO: 4012 - DNA, 22 bp, Homo sapiens
gttactcttccccggggtctgg

SEQ ID NO: 4013 - DNA, 22 bp, Homo sapiens
attgcactccagcctgggggac

SEQ ID NO: 4014 - DNA, 23 bp, Homo sapiens
ttctgggctgtggaagcctcggg

SEQ ID NO: 4015 - DNA, 22 bp, Homo sapiens
ttatgtctcaaccgggcacggt

SEQ ID NO: 4016 - DNA, 22 bp, Homo sapiens
ctctggaccctcctgctgagag

SEQ ID NO: 4017 - DNA, 22 bp, Homo sapiens
agcagcagtgttctggaattct

SEQ ID NO: 4018 - DNA, 22 bp, Homo sapiens
taagtcgtggatgattcttcgg

SEQ ID NO: 4019 - DNA, 22 bp, Homo sapiens
agaagcattggaccaggggccc

SEQ ID NO: 4020 - DNA, 22 bp, Homo sapiens
cctggcactgctgaagtcctgg

SEQ ID NO: 4021 - DNA, 22 bp, Homo sapiens
ggcaagttctaatgattagaat

SEQ ID NO: 4022 - DNA, 21 bp, Homo sapiens
ccaccaggtcttctgctcggg

SEQ ID NO: 4023 - DNA, 22 bp, Homo sapiens
gtcaaaagctaatttgttattt

SEQ ID NO: 4024 - DNA, 22 bp, Homo sapiens
ttggaatgcacactgagcctgc

SEQ ID NO: 4025 - DNA, 22 bp, Homo sapiens
aagagaattctggttttcctat

SEQ ID NO: 4026 - DNA, 22 bp, Homo sapiens
tgctattgtgaacagtgccaca

SEQ ID NO: 4027 - DNA, 22 bp, Homo sapiens
gctgatgtatatagtgattgag

SEQ ID NO: 4028 - DNA, 22 bp, Homo sapiens
ccatgaattcactccatgctag

SEQ ID NO: 4029 - DNA, 22 bp, Homo sapiens
tccttcactccctctgcatcca

SEQ ID NO: 4030 - DNA, 22 bp, Homo sapiens
gtatcggtttatttttgggata

SEQ ID NO: 4031 - DNA, 22 bp, Homo sapiens
tggatctcggcaatgcgggact

SEQ ID NO: 4032 - DNA, 17 bp, Homo sapiens
gctccagaattctagtc

SEQ ID NO: 4033 - DNA, 22 bp, Homo sapiens
tcagagtctgtgcattctgcta

SEQ ID NO: 4034 - DNA, 22 bp, Homo sapiens
gggaaacagcccaggctcaggg

SEQ ID NO: 4035 - DNA, 22 bp, Homo sapiens
gcggtcggcagaggggctctgc

SEQ ID NO: 4036 - DNA, 22 bp, Homo sapiens
gtggtggatgtctgtaatctca

SEQ ID NO: 4037 - DNA, 22 bp, Homo sapiens
ggagccgcacgtgctgggcccg

SEQ ID NO: 4038 - DNA, 22 bp, Homo sapiens
caggccagggttgagaagagaa

SEQ ID NO: 4039 - DNA, 22 bp, Homo sapiens
atggagttctgccagcgctgct

SEQ ID NO: 4040 - DNA, 22 bp, Homo sapiens
gaagcctgtcatgtgacgctga

SEQ ID NO: 4041 - DNA, 22 bp, Homo sapiens
tgtctcttttcaagctaccctt

SEQ ID NO: 4042 - DNA, 19 bp, Homo sapiens
ctctggagtcattgctccc

SEQ ID NO: 4043 - DNA, 22 bp, Homo sapiens
actgattgcattcatagggttt

SEQ ID NO: 4044 - DNA, 22 bp, Homo sapiens
cttggggcagcccaggctgagc

SEQ ID NO: 4045 - DNA, 22 bp, Homo sapiens
agcttgtgtttttctaagtatc

SEQ ID NO: 4046 - DNA, 22 bp, Homo sapiens
tgtttcaaattacttgaggatt

SEQ ID NO: 4047 - DNA, 22 bp, Homo sapiens
agtctgcaggaccgcgtcacat

SEQ ID NO: 4048 - DNA, 22 bp, Homo sapiens
ttgtggaatgtggctgtcaatt

SEQ ID NO: 4049 - DNA, 22 bp, Homo sapiens
agaggccggccgagcccatggg

SEQ ID NO: 4050 - DNA, 22 bp, Homo sapiens
tccaggttcaagcgattgtcct

SEQ ID NO: 4051 - DNA, 22 bp, Homo sapiens
cgatggtatcggccagccccgg

SEQ ID NO: 4052 - DNA, 22 bp, Homo sapiens
tgtatgaggcatacatcaggca

SEQ ID NO: 4053 - DNA, 22 bp, Homo sapiens
agaagccaccagctgaggaaga

SEQ ID NO: 4054 - DNA, 22 bp, Homo sapiens
tattctcatcatcactggagct

SEQ ID NO: 4055 - DNA, 22 bp, Homo sapiens
aggtggggaggagtgtctcttt

SEQ ID NO: 4056 - DNA, 23 bp, Homo sapiens
tgcatggggctatactgctgttc

SEQ ID NO: 4057 - DNA, 22 bp, Homo sapiens
agatctgagggtccaagggagg

SEQ ID NO: 4058 - DNA, 22 bp, Homo sapiens
ctgagctcaagcgatcctccca

SEQ ID NO: 4059 - DNA, 22 bp, Homo sapiens
tcattaatcccggggtccaggg

SEQ ID NO: 4060 - DNA, 22 bp, Homo sapiens
tccttgactgtgaggaactagc

SEQ ID NO: 4061 - DNA, 22 bp, Homo sapiens
attgaaaataaggccagaaaca

SEQ ID NO: 4062 - DNA, 22 bp, Homo sapiens
gcctgttctccagcatccaggt

SEQ ID NO: 4063 - DNA, 22 bp, Homo sapiens
gctgcagctcgccttccggcct

SEQ ID NO: 4064 - DNA, 22 bp, Homo sapiens
acatcatttgtctgtagctgaa

SEQ ID NO: 4065 - DNA, 22 bp, Homo sapiens
tggctcactgtagccttgacct

SEQ ID NO: 4066 - DNA, 22 bp, Homo sapiens
cacagggcttctcatggggtgc

SEQ ID NO: 4067 - DNA, 22 bp, Homo sapiens
cacgttaacagctaacagatga

SEQ ID NO: 4068 - DNA, 22 bp, Homo sapiens
gaaggtggcgagcggattgctg

SEQ ID NO: 4069 - DNA, 22 bp, Homo sapiens
gagaatgatgatttccaatttc

SEQ ID NO: 4070 - DNA, 22 bp, Homo sapiens
agagtccctcttcccaggaggc

SEQ ID NO: 4071 - DNA, 22 bp, Homo sapiens
cagggccagcgtctcgggctat

SEQ ID NO: 4072 - DNA, 21 bp, Homo sapiens
tccctgagcccaaggggctcc

SEQ ID NO: 4073 - DNA, 22 bp, Homo sapiens
tgattttctccattgtaaattc

SEQ ID NO: 4074 - DNA, 22 bp, Homo sapiens
cattgcaacttcaaactcctgg

SEQ ID NO: 4075 - DNA, 22 bp, Homo sapiens
acacagagccaaaccatatcac

SEQ ID NO: 4076 - DNA, 22 bp, Homo sapiens
gataccagacagggagggagaa

SEQ ID NO: 4077 - DNA, 22 bp, Homo sapiens
ttgttgtcattgtagaggattt

SEQ ID NO: 4078 - DNA, 22 bp, Homo sapiens
tctcaacagtgcaagctgctcc

SEQ ID NO: 4079 - DNA, 22 bp, Homo sapiens
gatggcggtcgtcgacggtcct

SEQ ID NO: 4080 - DNA, 22 bp, Homo sapiens
cactgcatggctgtgaggcagc

SEQ ID NO: 4081 - DNA, 22 bp, Homo sapiens
gaaggtgtctacgcgccttgag

SEQ ID NO: 4082 - DNA, 22 bp, Homo sapiens
actttatttcctattgcatcca

SEQ ID NO: 4083 - DNA, 22 bp, Homo sapiens
aagagaacagttgctgcccaag

SEQ ID NO: 4084 - DNA, 22 bp, Homo sapiens
tgagcacatttcacatgacagg

SEQ ID NO: 4085 - DNA, 22 bp, Homo sapiens
tcgcgctgtagccgcgcagagt

SEQ ID NO: 4086 - DNA, 22 bp, Homo sapiens
gatgcagtgcttaaatcatttg

SEQ ID NO: 4087 - DNA, 22 bp, Homo sapiens
agaatgggggctacaggccaca

SEQ ID NO: 4088 - DNA, 22 bp, Homo sapiens
gctgcagggagctggaaggctc

SEQ ID NO: 4089 - DNA, 22 bp, Homo sapiens
gacaatatagttgaatgagcaa

SEQ ID NO: 4090 - DNA, 22 bp, Homo sapiens
ccggcgtctcttccacttccta

SEQ ID NO: 4091 - DNA, 22 bp, Homo sapiens
agttgagggtgggagagaaatg

SEQ ID NO: 4092 - DNA, 22 bp, Homo sapiens
tagaggattttgcatttcatat

SEQ ID NO: 4093 - DNA, 22 bp, Homo sapiens
gcagatcaacactctctttcaa

SEQ ID NO: 4094 - DNA, 22 bp, Homo sapiens
aagagggaaattgttggctgct

SEQ ID NO: 4095 - DNA, 22 bp, Homo sapiens
gggtctcctaatggaggatgac

SEQ ID NO: 4096 - DNA, 22 bp, Homo sapiens
ctctggaggtggaggttgcagt

SEQ ID NO: 4097 - DNA, 22 bp, Homo sapiens
tttcataatactgtacatgaaa

SEQ ID NO: 4098 - DNA, 22 bp, Homo sapiens
gggaggttctgttcgcacttga

SEQ ID NO: 4099 - DNA, 22 bp, Homo sapiens
gcgtccacgctgccgctcagga

SEQ ID NO: 4100 - DNA, 22 bp, Homo sapiens
ataggtccaaggagaggtcttt

SEQ ID NO: 4101 - DNA, 22 bp, Homo sapiens
ccccatcatctttgaggtcatt

SEQ ID NO: 4102 - DNA, 22 bp, Homo sapiens
tgtctcctcggctgtccagcca

SEQ ID NO: 4103 - DNA, 22 bp, Homo sapiens
cagagcccctcgtctccaccac

SEQ ID NO: 4104 - DNA, 22 bp, Homo sapiens
ctcagattgtttgcctcgcagt

SEQ ID NO: 4105 - DNA, 22 bp, Homo sapiens
actgcaagaatggtaatatttg

SEQ ID NO: 4106 - DNA, 22 bp, Homo sapiens
gtggcatgaaagcatctgtgat

SEQ ID NO: 4107 - DNA, 22 bp, Homo sapiens
gcacctgcctgggactgaagat

SEQ ID NO: 4108 - DNA, 22 bp, Homo sapiens
agggacctcatgtaagtggatt

SEQ ID NO: 4109 - DNA, 22 bp, Homo sapiens
tgcccagagcctgagaggatta

SEQ ID NO: 4110 - DNA, 22 bp, Homo sapiens
gtgggtggacggtgcttttgtt

SEQ ID NO: 4111 - DNA, 22 bp, Homo sapiens
gaatttaagaggatgaatctgt

SEQ ID NO: 4112 - DNA, 22 bp, Homo sapiens
taatggttttttggagactgct

SEQ ID NO: 4113 - DNA, 22 bp, Homo sapiens
ggagcagggaattacagcgcag

SEQ ID NO: 4114 - DNA, 22 bp, Homo sapiens
acaggggattgattggaagtct

SEQ ID NO: 4115 - DNA, 22 bp, Homo sapiens
ctccgggtagctgaggccctgg

SEQ ID NO: 4116 - DNA, 22 bp, Homo sapiens
agcatttatcttttgtttgagt

SEQ ID NO: 4117 - DNA, 20 bp, Homo sapiens
gctgaggggtctatggcata

SEQ ID NO: 4118 - DNA, 22 bp, Homo sapiens
aggaaggactccatggtccgtc

SEQ ID NO: 4119 - DNA, 22 bp, Homo sapiens
tctccatggatttggaaatgat

SEQ ID NO: 4120 - DNA, 22 bp, Homo sapiens
ttctgggtttacatctgacttc

SEQ ID NO: 4121 - DNA, 22 bp, Homo sapiens
ccaagctacttaggagtctgag

SEQ ID NO: 4122 - DNA, 22 bp, Homo sapiens
tgccttgtggggaaggatttag

SEQ ID NO: 4123 - DNA, 22 bp, Homo sapiens
aataggtttaggaaagcgtttt

SEQ ID NO: 4124 - DNA, 22 bp, Homo sapiens
ccaggagttggaagctgccatg

SEQ ID NO: 4125 - DNA, 22 bp, Homo sapiens
ccaggcaggcgatggtgcagtg

SEQ ID NO: 4126 - DNA, 22 bp, Homo sapiens
tccagtcggataactagacggt

SEQ ID NO: 4127 - DNA, 18 bp, Homo sapiens
tggcgatggtcatttttc

SEQ ID NO: 4128 - DNA, 22 bp, Homo sapiens
gctgctttgtctgtaaaatgga

SEQ ID NO: 4129 - DNA, 22 bp, Homo sapiens
acttttaaatgagtttcagttg

SEQ ID NO: 4130 - DNA, 22 bp, Homo sapiens
tcaccagacgcgtgggtctgag

SEQ ID NO: 4131 - DNA, 19 bp, Homo sapiens
ttctggtctggaatcaagg

SEQ ID NO: 4132 - DNA, 22 bp, Homo sapiens
ggggccttggatctgtgccccg

SEQ ID NO: 4133 - DNA, 22 bp, Homo sapiens
ggggcgtcaccggggcacctgg

SEQ ID NO: 4134 - DNA, 22 bp, Homo sapiens
tcgctgaggctgcacggctgcc

SEQ ID NO: 4135 - DNA, 22 bp, Homo sapiens
tttttgagatggatttagctct

SEQ ID NO: 4136 - DNA, 22 bp, Homo sapiens
gcggggcccggacccagcctct

SEQ ID NO: 4137 - DNA, 22 bp, Homo sapiens
gagcaggaaggccagaagggtc

SEQ ID NO: 4138 - DNA, 22 bp, Homo sapiens
cgccgtcccctaggaaagagct

SEQ ID NO: 4139 - DNA, 22 bp, Homo sapiens
ttgctttgtttaaaagtggtat

SEQ ID NO: 4140 - DNA, 22 bp, Homo sapiens
gctgaaggcccggaggacaggg

SEQ ID NO: 4141 - DNA, 22 bp, Homo sapiens
tgtggaaggggccccatgacca

SEQ ID NO: 4142 - DNA, 22 bp, Homo sapiens
cagagatgtgatccagctgtct

SEQ ID NO: 4143 - DNA, 20 bp, Homo sapiens
aggccccaggtggacactag

SEQ ID NO: 4144 - DNA, 22 bp, Homo sapiens
gttgaagtaaggcagccacagg

SEQ ID NO: 4145 - DNA, 22 bp, Homo sapiens
ggtatactgcatgacattgggg

SEQ ID NO: 4146 - DNA, 22 bp, Homo sapiens
acctagaatttaaaacattgct

SEQ ID NO: 4147 - DNA, 22 bp, Homo sapiens
cagcaagtcatccaggatgatg

SEQ ID NO: 4148 - DNA, 22 bp, Homo sapiens
ttacactttaaatccagcttgt

SEQ ID NO: 4149 - DNA, 22 bp, Homo sapiens
tatactctgagaaacgtgtcac

SEQ ID NO: 4150 - DNA, 23 bp, Homo sapiens
cagagctggctcagagctgcctg

SEQ ID NO: 4151 - DNA, 22 bp, Homo sapiens
aggatgagccgcgcaagctgac

SEQ ID NO: 4152 - DNA, 22 bp, Homo sapiens
gagtaggttgtcagactccaaa

SEQ ID NO: 4153 - DNA, 23 bp, Homo sapiens
cagtgtgacaaaacttattactt

SEQ ID NO: 4154 - DNA, 22 bp, Homo sapiens
agtccctctgggagcaggactg

SEQ ID NO: 4155 - DNA, 22 bp, Homo sapiens
agcggcgccggagggaggtgcg

SEQ ID NO: 4156 - DNA, 22 bp, Homo sapiens
cagtggaggccttgggaccttt

SEQ ID NO: 4157 - DNA, 22 bp, Homo sapiens
gaagtttttgtagagacagggt

SEQ ID NO: 4158 - DNA, 22 bp, Homo sapiens
tttccagaaataccatttggtg

SEQ ID NO: 4159 - DNA, 22 bp, Homo sapiens
gcccagagtttgaagatacagt

SEQ ID NO: 4160 - DNA, 22 bp, Homo sapiens
ctcccctagcccgttgggaggt

SEQ ID NO: 4161 - DNA, 22 bp, Homo sapiens
ggtccccgtggaggctggagcg

SEQ ID NO: 4162 - DNA, 22 bp, Homo sapiens
gagctgaaggagaaagcagggg

SEQ ID NO: 4163 - DNA, 22 bp, Homo sapiens
tttgcatattaatatctgcgct

SEQ ID NO: 4164 - DNA, 22 bp, Homo sapiens
gtcccgcattgggcattcctgg

SEQ ID NO: 4165 - DNA, 22 bp, Homo sapiens
gagcaacagtggcagtggtggg

SEQ ID NO: 4166 - DNA, 22 bp, Homo sapiens
ggtgggaggactgtttgaggca

SEQ ID NO: 4167 - DNA, 22 bp, Homo sapiens
tggagttggccgcccggaccga

SEQ ID NO: 4168 - DNA, 22 bp, Homo sapiens
gcactgcaggtgggtggagagg

SEQ ID NO: 4169 - DNA, 22 bp, Homo sapiens
gtgacaatattagctcaggggc

SEQ ID NO: 4170 - DNA, 22 bp, Homo sapiens
attgcacatctgcactacagcc

SEQ ID NO: 4171 - DNA, 22 bp, Homo sapiens
attttttgttaactcaggatag

SEQ ID NO: 4172 - DNA, 22 bp, Homo sapiens
ttgggacagctgtggtagtgag

SEQ ID NO: 4173 - DNA, 17 bp, Homo sapiens
tcttggccagcttgctg

SEQ ID NO: 4174 - DNA, 20 bp, Homo sapiens
aggaaaaatggaaactggag

SEQ ID NO: 4175 - DNA, 22 bp, Homo sapiens
agtgtgttgtaggctcaaatgg

SEQ ID NO: 4176 - DNA, 22 bp, Homo sapiens
ataaaaactgacccatcctttg

SEQ ID NO: 4177 - DNA, 22 bp, Homo sapiens
aggagccgggcctgggccctgc

SEQ ID NO: 4178 - DNA, 17 bp, Homo sapiens
tgggttggggatttgga

SEQ ID NO: 4179 - DNA, 22 bp, Homo sapiens
gatatcattgagcccaggagtt

SEQ ID NO: 4180 - DNA, 22 bp, Homo sapiens
ggagtgaatcactagatgcaga

SEQ ID NO: 4181 - DNA, 22 bp, Homo sapiens
cactgcactccagcttgggtga

SEQ ID NO: 4182 - DNA, 21 bp, Homo sapiens
aggtgctggcgccccaggaga

SEQ ID NO: 4183 - DNA, 22 bp, Homo sapiens
ctgggcaaattgtgccagctat

SEQ ID NO: 4184 - DNA, 22 bp, Homo sapiens
ggcggctactcctcctggtgag

SEQ ID NO: 4185 - DNA, 22 bp, Homo sapiens
tggcacagactgggccaaggaa

SEQ ID NO: 4186 - DNA, 22 bp, Homo sapiens
cccgcagtcggaatttctcagt

SEQ ID NO: 4187 - DNA, 22 bp, Homo sapiens
acaggggcaagggctcacggcc

SEQ ID NO: 4188 - DNA, 22 bp, Homo sapiens
tgtggacgtcattaaagcagtg

SEQ ID NO: 4189 - DNA, 22 bp, Homo sapiens
catctctggcttggattatggt

SEQ ID NO: 4190 - DNA, 22 bp, Homo sapiens
gaggtgggtgtatcacaggtca

SEQ ID NO: 4191 - DNA, 22 bp, Homo sapiens
gcgtctcaaggcccccaggcca

SEQ ID NO: 4192 - DNA, 22 bp, Homo sapiens
tttacctttgtgggtctccctc

SEQ ID NO: 4193 - DNA, 22 bp, Homo sapiens
gagccagactgcctgaagctca

SEQ ID NO: 4194 - DNA, 22 bp, Homo sapiens
gtggactgcgcttgagggggcc

SEQ ID NO: 4195 - DNA, 22 bp, Homo sapiens
ctgcggctggggacagctgttg

SEQ ID NO: 4196 - DNA, 22 bp, Homo sapiens
aaaatatgtataactcttctgc

SEQ ID NO: 4197 - DNA, 21 bp, Homo sapiens
ctagcccctactccaagttga

SEQ ID NO: 4198 - DNA, 15 bp, Homo sapiens
gcaggcaggtcacct

SEQ ID NO: 4199 - DNA, 22 bp, Homo sapiens
gtgaagttggccagtttagttt

SEQ ID NO: 4200 - DNA, 22 bp, Homo sapiens
actagaccaaggaatcctggaa

SEQ ID NO: 4201 - DNA, 22 bp, Homo sapiens
gggcagccgcgtgacctgccag

SEQ ID NO: 4202 - DNA, 22 bp, Homo sapiens
gctggcaaggtgctggagggcc

SEQ ID NO: 4203 - DNA, 22 bp, Homo sapiens
tgtaccgcaaatgctgctgcct

SEQ ID NO: 4204 - DNA, 22 bp, Homo sapiens
catataaatacaacatgtgtta

SEQ ID NO: 4205 - DNA, 22 bp, Homo sapiens
aagtagcagggattacaggtgt

SEQ ID NO: 4206 - DNA, 22 bp, Homo sapiens
aatgagggagtggggcttgtcc

SEQ ID NO: 4207 - DNA, 22 bp, Homo sapiens
ttccaaaggctgcaccttgccc

SEQ ID NO: 4208 - DNA, 22 bp, Homo sapiens
accacctcatcaagctggattg

SEQ ID NO: 4209 - DNA, 22 bp, Homo sapiens
taactaggattacaagcgtgcg

SEQ ID NO: 4210 - DNA, 22 bp, Homo sapiens
aaattctgatttaataagtgta

SEQ ID NO: 4211 - DNA, 22 bp, Homo sapiens
gtatacatgcaggtcacagggg

SEQ ID NO: 4212 - DNA, 21 bp, Homo sapiens
ttgttcctatctgcctcctgc

SEQ ID NO: 4213 - DNA, 22 bp, Homo sapiens
ttcactggtcctttataggaac

SEQ ID NO: 4214 - DNA, 22 bp, Homo sapiens
ttgctttcccaaggcagaacat

SEQ ID NO: 4215 - DNA, 23 bp, Homo sapiens
gggggccgtcctggggattatag

SEQ ID NO: 4216 - DNA, 22 bp, Homo sapiens
tgtatagttgagtcaagtttca

SEQ ID NO: 4217 - DNA, 22 bp, Homo sapiens
cattgcactctagcctgggtga

SEQ ID NO: 4218 - DNA, 22 bp, Homo sapiens
cactgcactccagcctgggtga

SEQ ID NO: 4219 - DNA, 22 bp, Homo sapiens
tggagccagagcgcagcctggg

SEQ ID NO: 4220 - DNA, 22 bp, Homo sapiens
ctggtttgtcttgggaggatgt

SEQ ID NO: 4221 - DNA, 22 bp, Homo sapiens
caagatcttcctcaatagacct

SEQ ID NO: 4222 - DNA, 19 bp, Homo sapiens
atcctttcccacatacttt

SEQ ID NO: 4223 - DNA, 22 bp, Homo sapiens
acaaggcactttatgaagagga

SEQ ID NO: 4224 - DNA, 22 bp, Homo sapiens
aggtccaaggtagggcccagac

SEQ ID NO: 4225 - DNA, 18 bp, Homo sapiens
agcctgtcccttctcctg

SEQ ID NO: 4226 - DNA, 22 bp, Homo sapiens
cccaggatggggctgcagttat

SEQ ID NO: 4227 - DNA, 22 bp, Homo sapiens
tcacccaggctggagtgtagtg

SEQ ID NO: 4228 - DNA, 22 bp, Homo sapiens
actgcactccagcccgggtgac

SEQ ID NO: 4229 - DNA, 19 bp, Homo sapiens
ctgctgccggagactcgtc

SEQ ID NO: 4230 - DNA, 22 bp, Homo sapiens
cacctctcatttctacagattc

SEQ ID NO: 4231 - DNA, 22 bp, Homo sapiens
ggaatcgttaggtaagcaggga

SEQ ID NO: 4232 - DNA, 22 bp, Homo sapiens
aagttcctgacattgccatggc

SEQ ID NO: 4233 - DNA, 22 bp, Homo sapiens
aaaacctaagccagtagctccc

SEQ ID NO: 4234 - DNA, 18 bp, Homo sapiens
acggatccgcgggaccgc

SEQ ID NO: 4235 - DNA, 22 bp, Homo sapiens
gaggcagaggttgttgcagtga

SEQ ID NO: 4236 - DNA, 22 bp, Homo sapiens
ggctcactgcaacctccacctc

SEQ ID NO: 4237 - DNA, 22 bp, Homo sapiens
ctgtaatcccagctactcggga

SEQ ID NO: 4238 - DNA, 22 bp, Homo sapiens
caggcagggagctggaaaggat

SEQ ID NO: 4239 - DNA, 22 bp, Homo sapiens
taggattatttgttctatttct

SEQ ID NO: 4240 - DNA, 22 bp, Homo sapiens
tgtggctctcatgcactcccag

SEQ ID NO: 4241 - DNA, 22 bp, Homo sapiens
ctgttaggttaaggaatggcaa

SEQ ID NO: 4242 - DNA, 22 bp, Homo sapiens
gccatcatatcccctgtgacct

SEQ ID NO: 4243 - DNA, 16 bp, Homo sapiens
cttgtctgttgctcat

SEQ ID NO: 4244 - DNA, 22 bp, Homo sapiens
ggctgagttgagaggattactt

SEQ ID NO: 4245 - DNA, 21 bp, Homo sapiens
acgctgcaccacgttctgcgg

SEQ ID NO: 4246 - DNA, 22 bp, Homo sapiens
ccaggttggagttcagtggcgc

SEQ ID NO: 4247 - DNA, 22 bp, Homo sapiens
tggttaacttctgagcaggctg

SEQ ID NO: 4248 - DNA, 22 bp, Homo sapiens
tggcaatgttagcaaagcattt

SEQ ID NO: 4249 - DNA, 22 bp, Homo sapiens
agagttaagctttgcctaaaga

SEQ ID NO: 4250 - DNA, 22 bp, Homo sapiens
gtcacaaagcgcggtggtcggt

SEQ ID NO: 4251 - DNA, 22 bp, Homo sapiens
agaggaggctctgggatcgtcc

SEQ ID NO: 4252 - DNA, 22 bp, Homo sapiens
gccataggcagcgtggccagca

SEQ ID NO: 4253 - DNA, 22 bp, Homo sapiens
ggcatgcacccggtgaccatga

SEQ ID NO: 4254 - DNA, 22 bp, Homo sapiens
gttgaggagcaagcatgtgtct

SEQ ID NO: 4255 - DNA, 20 bp, Homo sapiens
ctgcgggctcggccgacccc

SEQ ID NO: 4256 - DNA, 22 bp, Homo sapiens
accagcacttccagaggtcagg

SEQ ID NO: 4257 - DNA, 22 bp, Homo sapiens
actgcatttgtctgtctcaatt

SEQ ID NO: 4258 - DNA, 22 bp, Homo sapiens
gctggctgacagatttggggtg

SEQ ID NO: 4259 - DNA, 22 bp, Homo sapiens
atggtcacttcacccatgagct

SEQ ID NO: 4260 - DNA, 22 bp, Homo sapiens
gtctccttgtggatctcaagga

SEQ ID NO: 4261 - DNA, 22 bp, Homo sapiens
gtcactcaggctggagttcagt

SEQ ID NO: 4262 - DNA, 23 bp, Homo sapiens
aattatctatttcaaatttagca

SEQ ID NO: 4263 - DNA, 22 bp, Homo sapiens
catccctgtcgtcaagtctctg

SEQ ID NO: 4264 - DNA, 22 bp, Homo sapiens
tggctaaaccctagtaaattaa

SEQ ID NO: 4265 - DNA, 22 bp, Homo sapiens
aaggagtggggcatatcacaga

SEQ ID NO: 4266 - DNA, 22 bp, Homo sapiens
agtccagaaagtgaacagtgtt

SEQ ID NO: 4267 - DNA, 22 bp, Homo sapiens
aggaattcaagaccagctgggc

SEQ ID NO: 4268 - DNA, 22 bp, Homo sapiens
caattgacaatgacagtgtcaa

SEQ ID NO: 4269 - DNA, 22 bp, Homo sapiens
tggttgcctctcagagattccg

SEQ ID NO: 4270 - DNA, 22 bp, Homo sapiens
tgaggcacaggcagtgcccccg

SEQ ID NO: 4271 - DNA, 22 bp, Homo sapiens
ttttcagctaagtcacacgctg

SEQ ID NO: 4272 - DNA, 22 bp, Homo sapiens
tcagcaatcctcccacaggtgg

SEQ ID NO: 4273 - DNA, 22 bp, Homo sapiens
tctgctcagccgatctgctccg

SEQ ID NO: 4274 - DNA, 22 bp, Homo sapiens
aaagcactgcacatatatttgc

SEQ ID NO: 4275 - DNA, 22 bp, Homo sapiens
gcggaggtggagcaccaagggc

SEQ ID NO: 4276 - DNA, 22 bp, Homo sapiens
aagtgtgtgagcctgtcaggct

SEQ ID NO: 4277 - DNA, 22 bp, Homo sapiens
gaagtccgggaggatcatgttc

SEQ ID NO: 4278 - DNA, 22 bp, Homo sapiens
gaaggagccgagctcttcccca

SEQ ID NO: 4279 - DNA, 22 bp, Homo sapiens
agagagctctgctgctgcccag

SEQ ID NO: 4280 - DNA, 22 bp, Homo sapiens
attcccagatttatattgatag

SEQ ID NO: 4281 - DNA, 17 bp, Homo sapiens
tcggtttgccaggcttc

SEQ ID NO: 4282 - DNA, 22 bp, Homo sapiens
gcagcagtgctttggaatcctg

SEQ ID NO: 4283 - DNA, 22 bp, Homo sapiens
gcgtctgagttgcgggggctca

SEQ ID NO: 4284 - DNA, 22 bp, Homo sapiens
ccatcacagtccccatcgtgat

SEQ ID NO: 4285 - DNA, 22 bp, Homo sapiens
gaggtagtttagttttggggaa

SEQ ID NO: 4286 - DNA, 22 bp, Homo sapiens
tggactaaagaggaagcaaata

SEQ ID NO: 4287 - DNA, 22 bp, Homo sapiens
gtacacaaagtgagacttgata

SEQ ID NO: 4288 - DNA, 22 bp, Homo sapiens
ccactggttttattctctttca

SEQ ID NO: 4289 - DNA, 22 bp, Homo sapiens
tcacccaggctggactgcagtg

SEQ ID NO: 4290 - DNA, 22 bp, Homo sapiens
ggaggtgggctaaggactctct

SEQ ID NO: 4291 - DNA, 22 bp, Homo sapiens
cagtcacaagcgtacctaattt

SEQ ID NO: 4292 - DNA, 22 bp, Homo sapiens
tagctgaatataggcacaacag

SEQ ID NO: 4293 - DNA, 22 bp, Homo sapiens
actgcaaagggaagccctttct

SEQ ID NO: 4294 - DNA, 22 bp, Homo sapiens
agcgccactgcactccagcctg

SEQ ID NO: 4295 - DNA, 21 bp, Homo sapiens
gctctgtgttacaagttgggg

SEQ ID NO: 4296 - DNA, 22 bp, Homo sapiens
aggcgaagggaccagacggtag

SEQ ID NO: 4297 - DNA, 17 bp, Homo sapiens
gcgtggagttggtgcgc

SEQ ID NO: 4298 - DNA, 22 bp, Homo sapiens
attgcactccagccctgctgac

SEQ ID NO: 4299 - DNA, 22 bp, Homo sapiens
cactgcactccagcctcggtga

SEQ ID NO: 4300 - DNA, 22 bp, Homo sapiens
gggctagcctcttccctgctcc

SEQ ID NO: 4301 - DNA, 22 bp, Homo sapiens
ttgcttgaacccaggaagtgga

SEQ ID NO: 4302 - DNA, 22 bp, Homo sapiens
cctgcgcgtctgggtctgtctc

SEQ ID NO: 4303 - DNA, 22 bp, Homo sapiens
ggcagagcttgcagtgagccga

SEQ ID NO: 4304 - DNA, 22 bp, Homo sapiens
cagggcctcctaaggcatctaa

SEQ ID NO: 4305 - DNA, 22 bp, Homo sapiens
gccaatgacagtctcagttctg

SEQ ID NO: 4306 - DNA, 22 bp, Homo sapiens
tgcgccatgtgctctcggccct

SEQ ID NO: 4307 - DNA, 22 bp, Homo sapiens
tagatgtgttgcctggagttgt

SEQ ID NO: 4308 - DNA, 22 bp, Homo sapiens
actccacaccacgggggccgcc

SEQ ID NO: 4309 - DNA, 22 bp, Homo sapiens
tgggctgtggagcacctttgca

SEQ ID NO: 4310 - DNA, 21 bp, Homo sapiens
tgggggtcttcacggtgttgt

SEQ ID NO: 4311 - DNA, 17 bp, Homo sapiens
tgttccatttgaccacc

SEQ ID NO: 4312 - DNA, 22 bp, Homo sapiens
ccaaagtgctgggattcaggca

SEQ ID NO: 4313 - DNA, 22 bp, Homo sapiens
actgcatttggtaaagtcaaga

SEQ ID NO: 4314 - DNA, 22 bp, Homo sapiens
gcttttacaagagccagagagg

SEQ ID NO: 4315 - DNA, 22 bp, Homo sapiens
ttacaaagtttaaggtggcact

SEQ ID NO: 4316 - DNA, 22 bp, Homo sapiens
ttgaggcaggtccgggtccttc

SEQ ID NO: 4317 - DNA, 22 bp, Homo sapiens
gctccaaagtacagtgacttac

SEQ ID NO: 4318 - DNA, 22 bp, Homo sapiens
cactgcactccagctgggtgac

SEQ ID NO: 4319 - DNA, 22 bp, Homo sapiens
cgtcccgggttcacgccattct

SEQ ID NO: 4320 - DNA, 22 bp, Homo sapiens
gaggtaggtgtaggaggcctgc

SEQ ID NO: 4321 - DNA, 22 bp, Homo sapiens
acctggccagtggggccgcgct

SEQ ID NO: 4322 - DNA, 22 bp, Homo sapiens
ttgatgtaggtttatctattgt

SEQ ID NO: 4323 - DNA, 22 bp, Homo sapiens
gggggggtcttcagacctcaga

SEQ ID NO: 4324 - DNA, 22 bp, Homo sapiens
ctctggagtgtctggccagggt

SEQ ID NO: 4325 - DNA, 22 bp, Homo sapiens
agtgaaccaggctgcgtccctg

SEQ ID NO: 4326 - DNA, 22 bp, Homo sapiens
attgcccttgtcaggcacgggt

SEQ ID NO: 4327 - DNA, 22 bp, Homo sapiens
gtatggcactatcctctctgat

SEQ ID NO: 4328 - DNA, 22 bp, Homo sapiens
aggactcatccctgcttgtcag

SEQ ID NO: 4329 - DNA, 22 bp, Homo sapiens
agcaggcctgccacctcggggt

SEQ ID NO: 4330 - DNA, 21 bp, Homo sapiens
ttgaccaagggtgcgtgctcc

SEQ ID NO: 4331 - DNA, 22 bp, Homo sapiens
catgggtaagactcttttgccc

SEQ ID NO: 4332 - DNA, 22 bp, Homo sapiens
tttctcatggaacatcgtttag

SEQ ID NO: 4333 - DNA, 22 bp, Homo sapiens
ttccactctacacactgctggc

SEQ ID NO: 4334 - DNA, 22 bp, Homo sapiens
gcctgtattcccagcactttgg

SEQ ID NO: 4335 - DNA, 22 bp, Homo sapiens
ggcggtctcagcaccctcttgg

SEQ ID NO: 4336 - DNA, 22 bp, Homo sapiens
cagcatgaatgtgttcgtaggg

SEQ ID NO: 4337 - DNA, 22 bp, Homo sapiens
tgcccaggctggagtacagtgg

SEQ ID NO: 4338 - DNA, 22 bp, Homo sapiens
tccagtgtttttcttcacaggt

SEQ ID NO: 4339 - DNA, 22 bp, Homo sapiens
tggcctctcctggctgagtttc

SEQ ID NO: 4340 - DNA, 22 bp, Homo sapiens
tctgtcacccagagtgcagtgg

SEQ ID NO: 4341 - DNA, 21 bp, Homo sapiens
gaccccagaccagcagacaca

SEQ ID NO: 4342 - DNA, 22 bp, Homo sapiens
aggctcccaagcactgacccca

SEQ ID NO: 4343 - DNA, 20 bp, Homo sapiens
gaaatgtacacattaccaca

SEQ ID NO: 4344 - DNA, 22 bp, Homo sapiens
atcagagtagttgttgcccaga

SEQ ID NO: 4345 - DNA, 22 bp, Homo sapiens
aatcggttgaacccaggaagtg

SEQ ID NO: 4346 - DNA, 22 bp, Homo sapiens
tccacagtggttgaactagtaa

SEQ ID NO: 4347 - DNA, 22 bp, Homo sapiens
taagcctgcatgaaccatgaga

SEQ ID NO: 4348 - DNA, 22 bp, Homo sapiens
gcagggttttatagatctcttc

SEQ ID NO: 4349 - DNA, 22 bp, Homo sapiens
taacctgttaagggctgaccca

SEQ ID NO: 4350 - DNA, 22 bp, Homo sapiens
gggcctgtgtgttcaggagcct

SEQ ID NO: 4351 - DNA, 22 bp, Homo sapiens
ctctgagtagatagggaacctg

SEQ ID NO: 4352 - DNA, 22 bp, Homo sapiens
actgcacttcagcctgggtgtc

SEQ ID NO: 4353 - DNA, 22 bp, Homo sapiens
attaatgaaactttggttaagc

SEQ ID NO: 4354 - DNA, 22 bp, Homo sapiens
tccacgtgagcttcgtgtgcag

SEQ ID NO: 4355 - DNA, 22 bp, Homo sapiens
agtgactggtgtgaagttaaat

SEQ ID NO: 4356 - DNA, 22 bp, Homo sapiens
tgaggcaggtggattacaaggt

SEQ ID NO: 4357 - DNA, 22 bp, Homo sapiens
gacctcgtgatccgccctcctt

SEQ ID NO: 4358 - DNA, 22 bp, Homo sapiens
atggcaccttccccagagctca

SEQ ID NO: 4359 - DNA, 22 bp, Homo sapiens
agagtggctctgctgggcacag

SEQ ID NO: 4360 - DNA, 22 bp, Homo sapiens
aagctgcagcacagagaggtgg

SEQ ID NO: 4361 - DNA, 22 bp, Homo sapiens
tagcttatcccacagtgcccag

SEQ ID NO: 4362 - DNA, 22 bp, Homo sapiens
tcatgcctggaatctcaccact

SEQ ID NO: 4363 - DNA, 20 bp, Homo sapiens
gggcagagccagccagtccc

SEQ ID NO: 4364 - DNA, 22 bp, Homo sapiens
taagtcaaggtggcatttgaga

SEQ ID NO: 4365 - DNA, 22 bp, Homo sapiens
gggctcttctggcatgctgctc

SEQ ID NO: 4366 - DNA, 22 bp, Homo sapiens
ggtgtgtctgccaggaactgca

SEQ ID NO: 4367 - DNA, 22 bp, Homo sapiens
gctcatgactgtaatcccagca

SEQ ID NO: 4368 - DNA, 22 bp, Homo sapiens
acagaagcctttggccatttga

SEQ ID NO: 4369 - DNA, 22 bp, Homo sapiens
gctgctctccaagcctccttga

SEQ ID NO: 4370 - DNA, 23 bp, Homo sapiens
ggagcctccggtgtgtgagaggc

SEQ ID NO: 4371 - DNA, 22 bp, Homo sapiens
gggtgtagaaagaaccctctgg

SEQ ID NO: 4372 - DNA, 21 bp, Homo sapiens
acacaagcactcgtacatacg

SEQ ID NO: 4373 - DNA, 22 bp, Homo sapiens
actgcactccaacctgggcaat

SEQ ID NO: 4374 - DNA, 22 bp, Homo sapiens
tcttgccgcgcaggcgcagttc

SEQ ID NO: 4375 - DNA, 22 bp, Homo sapiens
tgagtagatccaagactgtcct

SEQ ID NO: 4376 - DNA, 22 bp, Homo sapiens
tggcagtggcgggactcagggc

SEQ ID NO: 4377 - DNA, 21 bp, Homo sapiens
tcgtgcagcagctgaggcttg

SEQ ID NO: 4378 - DNA, 22 bp, Homo sapiens
aggcgcattgaggccctgttgc

SEQ ID NO: 4379 - DNA, 22 bp, Homo sapiens
tttctgtgataggctgcgacgc

SEQ ID NO: 4380 - DNA, 22 bp, Homo sapiens
gtttcaggttggacaacatgcc

SEQ ID NO: 4381 - DNA, 22 bp, Homo sapiens
agctttacctgccttggggcac

SEQ ID NO: 4382 - DNA, 22 bp, Homo sapiens
ctaaagtgccaggaatacaggt

SEQ ID NO: 4383 - DNA, 22 bp, Homo sapiens
gtatagaaacccagaaagatag

SEQ ID NO: 4384 - DNA, 22 bp, Homo sapiens
aggttatatgactgtcatgcct

SEQ ID NO: 4385 - DNA, 22 bp, Homo sapiens
cagtcaccttgaggactcagac

SEQ ID NO: 4386 - DNA, 22 bp, Homo sapiens
tcttgaatctaatgcagtttct

SEQ ID NO: 4387 - DNA, 22 bp, Homo sapiens
aaatgcaacgggctttccttat

SEQ ID NO: 4388 - DNA, 22 bp, Homo sapiens
ccctggaggttgaggctgcagt

SEQ ID NO: 4389 - DNA, 22 bp, Homo sapiens
agtattctggaattctatgtga

SEQ ID NO: 4390 - DNA, 22 bp, Homo sapiens
ttcagacaggcagctgggctgg

SEQ ID NO: 4391 - DNA, 22 bp, Homo sapiens
atggggaagcaattggatttcc

SEQ ID NO: 4392 - DNA, 22 bp, Homo sapiens
atgagaaagttaatcatcatga

SEQ ID NO: 4393 - DNA, 22 bp, Homo sapiens
tttaatcataagaaggaaaata

SEQ ID NO: 4394 - DNA, 22 bp, Homo sapiens
tgcagtcttccagctgcacaaa

SEQ ID NO: 4395 - DNA, 22 bp, Homo sapiens
gcccaggaggagaggctgcagt

SEQ ID NO: 4396 - DNA, 18 bp, Homo sapiens
tcaagtgattctcctgcc

SEQ ID NO: 4397 - DNA, 22 bp, Homo sapiens
gggtttcatggttctcacaatg

SEQ ID NO: 4398 - DNA, 22 bp, Homo sapiens
agccttcggccagagggtggcc

SEQ ID NO: 4399 - DNA, 22 bp, Homo sapiens
aagcttcctgcatgggactgct

SEQ ID NO: 4400 - DNA, 22 bp, Homo sapiens
ttactgtttgggtctgaggtca

SEQ ID NO: 4401 - DNA, 22 bp, Homo sapiens
cagcgtctcgttgtgggcctcg

SEQ ID NO: 4402 - DNA, 22 bp, Homo sapiens
gggaaagaccttcctggggtgt

SEQ ID NO: 4403 - DNA, 22 bp, Homo sapiens
accctcaagatggaagcagttt

SEQ ID NO: 4404 - DNA, 22 bp, Homo sapiens
atgaccagccgagataaacaga

SEQ ID NO: 4405 - DNA, 19 bp, Homo sapiens
agggagtttatatttgcac

SEQ ID NO: 4406 - DNA, 23 bp, Homo sapiens
gtgcgccaggacaacctgacgga

SEQ ID NO: 4407 - DNA, 22 bp, Homo sapiens
acaggcacctgccaccacatct

SEQ ID NO: 4408 - DNA, 22 bp, Homo sapiens
cagcagcagtgttctagaatct

SEQ ID NO: 4409 - DNA, 22 bp, Homo sapiens
gccctgtgcaggtgtgcagcag

SEQ ID NO: 4410 - DNA, 22 bp, Homo sapiens
gcatcccctgcattctgttttc

SEQ ID NO: 4411 - DNA, 22 bp, Homo sapiens
tgatatgcatgtaagggagaca

SEQ ID NO: 4412 - DNA, 22 bp, Homo sapiens
tggctagcactctacctttctc

SEQ ID NO: 4413 - DNA, 22 bp, Homo sapiens
ttgctctgactggagtgcagtg

SEQ ID NO: 4414 - DNA, 22 bp, Homo sapiens
ctgcgcagcaatcagagaggag

SEQ ID NO: 4415 - DNA, 22 bp, Homo sapiens
accactgcccatggtgaaaact

SEQ ID NO: 4416 - DNA, 22 bp, Homo sapiens
taaggctatcttttgagtgtgt

SEQ ID NO: 4417 - DNA, 22 bp, Homo sapiens
tttctcggcagagatgatgggc

SEQ ID NO: 4418 - DNA, 22 bp, Homo sapiens
tggcatttgagctggaaggatg

SEQ ID NO: 4419 - DNA, 22 bp, Homo sapiens
cagagggttgatgtgaggctta

SEQ ID NO: 4420 - DNA, 22 bp, Homo sapiens
aggggatgcctagtggagtctc

SEQ ID NO: 4421 - DNA, 22 bp, Homo sapiens
cttgaagtggagcttttgaaat

SEQ ID NO: 4422 - DNA, 22 bp, Homo sapiens
tcagccccacggggtcagccaa

SEQ ID NO: 4423 - DNA, 22 bp, Homo sapiens
ggcctgtggtgcgctatttcag

SEQ ID NO: 4424 - DNA, 22 bp, Homo sapiens
cttgctttcagtctcggcctca

SEQ ID NO: 4425 - DNA, 22 bp, Homo sapiens
tcaagcaaagtttagctggtta

SEQ ID NO: 4426 - DNA, 22 bp, Homo sapiens
cttctcttcctttgtcaactga

SEQ ID NO: 4427 - DNA, 22 bp, Homo sapiens
gggcaaaacctgggcatcatga

SEQ ID NO: 4428 - DNA, 21 bp, Homo sapiens
gaacccagcagcagtgctctg

SEQ ID NO: 4429 - DNA, 22 bp, Homo sapiens
gggcctcaggttctggagaagg

SEQ ID NO: 4430 - DNA, 22 bp, Homo sapiens
ctgtggctctttagttgagcac

SEQ ID NO: 4431 - DNA, 22 bp, Homo sapiens
tttctcttcactgtgtgcctca

SEQ ID NO: 4432 - DNA, 22 bp, Homo sapiens
ggcaagaacctcaattaccttt

SEQ ID NO: 4433 - DNA, 22 bp, Homo sapiens
cccaccagtacagatggtagat

SEQ ID NO: 4434 - DNA, 22 bp, Homo sapiens
aggtcaccatggcatgctccac

SEQ ID NO: 4435 - DNA, 22 bp, Homo sapiens
actgtacctcaaactctggaac

SEQ ID NO: 4436 - DNA, 22 bp, Homo sapiens
agaaacgcctgtgaaattatct

SEQ ID NO: 4437 - DNA, 22 bp, Homo sapiens
acattaaacttgcttggctgta

SEQ ID NO: 4438 - DNA, 22 bp, Homo sapiens
ttcaccttgaatatgtcttaaa

SEQ ID NO: 4439 - DNA, 23 bp, Homo sapiens
tcaaatcccagctctaccacttc

SEQ ID NO: 4440 - DNA, 22 bp, Homo sapiens
gatgaaggggctggtgccctct

SEQ ID NO: 4441 - DNA, 21 bp, Homo sapiens
gtgcggatgccgtcattgtca

SEQ ID NO: 4442 - DNA, 22 bp, Homo sapiens
gaggcagaggttgcagtgagct

SEQ ID NO: 4443 - DNA, 22 bp, Homo sapiens
agttctgcctatatagaaactc

SEQ ID NO: 4444 - DNA, 22 bp, Homo sapiens
ttcgcccagctccaggctggcc

SEQ ID NO: 4445 - DNA, 22 bp, Homo sapiens
tcactggaaagacagcactctt

SEQ ID NO: 4446 - DNA, 21 bp, Homo sapiens
tctctttctggaagcttccct

SEQ ID NO: 4447 - DNA, 22 bp, Homo sapiens
gaggacaagctgtgagtggggt

SEQ ID NO: 4448 - DNA, 22 bp, Homo sapiens
tcagcctccgaaagtgctggga

SEQ ID NO: 4449 - DNA, 22 bp, Homo sapiens
tagtttaggatccaatctaaga

SEQ ID NO: 4450 - DNA, 22 bp, Homo sapiens
gaaggaagtcattagtgcagac

SEQ ID NO: 4451 - DNA, 22 bp, Homo sapiens
acaggggacctaggaccctcgg

SEQ ID NO: 4452 - DNA, 22 bp, Homo sapiens
ctggccaagatggtgaaacccc

SEQ ID NO: 4453 - DNA, 23 bp, Homo sapiens
tcgttgaatagcaatagcacaac

SEQ ID NO: 4454 - DNA, 22 bp, Homo sapiens
atgtcgataggagtgccatcgg

SEQ ID NO: 4455 - DNA, 22 bp, Homo sapiens
ggtttattgttaataagtttga

SEQ ID NO: 4456 - DNA, 22 bp, Homo sapiens
tgggcggactcgggcatggaat

SEQ ID NO: 4457 - DNA, 22 bp, Homo sapiens
cctgcaccacaaggcttcagag

SEQ ID NO: 4458 - DNA, 22 bp, Homo sapiens
cgcatgagacctgccggccatc

SEQ ID NO: 4459 - DNA, 22 bp, Homo sapiens
atgcccctggcctggggaacat

SEQ ID NO: 4460 - DNA, 22 bp, Homo sapiens
aagtcgtcgaagatggaggttg

SEQ ID NO: 4461 - DNA, 22 bp, Homo sapiens
aaagtgctgggattacaggcct

SEQ ID NO: 4462 - DNA, 22 bp, Homo sapiens
tctcgctctgtcgcccaggctg

SEQ ID NO: 4463 - DNA, 22 bp, Homo sapiens
tagtgccctcccctttgggata

SEQ ID NO: 4464 - DNA, 18 bp, Homo sapiens
atggtctcatactgggag

SEQ ID NO: 4465 - DNA, 18 bp, Homo sapiens
tgagttcattagacttcc

SEQ ID NO: 4466 - DNA, 22 bp, Homo sapiens
taattataacatgctttctggc

SEQ ID NO: 4467 - DNA, 22 bp, Homo sapiens
tgagacttaagaggtcatgttg

SEQ ID NO: 4468 - DNA, 22 bp, Homo sapiens
agggctctgagtgggaaagagg

SEQ ID NO: 4469 - DNA, 18 bp, Homo sapiens
tcttcatctcctgagctg

SEQ ID NO: 4470 - DNA, 22 bp, Homo sapiens
ctgtcatggtttgaatgctcgc

SEQ ID NO: 4471 - DNA, 22 bp, Homo sapiens
cgtggggcgggtggacacttgc

SEQ ID NO: 4472 - DNA, 22 bp, Homo sapiens
ctgggggtcttgaaagggagag

SEQ ID NO: 4473 - DNA, 22 bp, Homo sapiens
cagacgttggaggaaatatacc

SEQ ID NO: 4474 - DNA, 22 bp, Homo sapiens
ggctcctgggggtgctcctgcc

SEQ ID NO: 4475 - DNA, 23 bp, Homo sapiens
tgagtgtgaaaatcctggagatg

SEQ ID NO: 4476 - DNA, 22 bp, Homo sapiens
tccttgtaacgttgggctgggg

SEQ ID NO: 4477 - DNA, 22 bp, Homo sapiens
gaagcctcaacatctctgcgtc

SEQ ID NO: 4478 - DNA, 22 bp, Homo sapiens
gcgccactgcactcccacctgg

SEQ ID NO: 4479 - DNA, 22 bp, Homo sapiens
aatggggtagtgggcagcctgg

SEQ ID NO: 4480 - DNA, 22 bp, Homo sapiens
aacccaggaggcggaggttgtg

SEQ ID NO: 4481 - DNA, 22 bp, Homo sapiens
ggctcactgcaacttccgcctc

SEQ ID NO: 4482 - DNA, 22 bp, Homo sapiens
cctgacgaaaggcgtgctggag

SEQ ID NO: 4483 - DNA, 22 bp, Homo sapiens
aaagtgcaaggattacaggcat

SEQ ID NO: 4484 - DNA, 22 bp, Homo sapiens
aagcgcaggactggctcacggc

SEQ ID NO: 4485 - DNA, 22 bp, Homo sapiens
tgaggcgtctccctgagctcac

SEQ ID NO: 4486 - DNA, 22 bp, Homo sapiens
tacatagctcctagtgatgcat

SEQ ID NO: 4487 - DNA, 22 bp, Homo sapiens
attgctaggaacaggttgcacc

SEQ ID NO: 4488 - DNA, 22 bp, Homo sapiens
cccggaggcagaggttgcagtg

SEQ ID NO: 4489 - DNA, 22 bp, Homo sapiens
gacctggtccttgtactttgaa

SEQ ID NO: 4490 - DNA, 22 bp, Homo sapiens
attttctctttgtatatgctag

SEQ ID NO: 4491 - DNA, 22 bp, Homo sapiens
tggctgtacattggaattatct

SEQ ID NO: 4492 - DNA, 22 bp, Homo sapiens
cgtgcgcctcagcctcgtgcgc

SEQ ID NO: 4493 - DNA, 22 bp, Homo sapiens
aatttgttataacttgggctga

SEQ ID NO: 4494 - DNA, 23 bp, Homo sapiens
ccactagcacctgttcaacttct

SEQ ID NO: 4495 - DNA, 22 bp, Homo sapiens
caggctggagtgcagtggggcg

SEQ ID NO: 4496 - DNA, 22 bp, Homo sapiens
actcccagaacatgctcttctt

SEQ ID NO: 4497 - DNA, 22 bp, Homo sapiens
tacgcctgtaatcccagcactt

SEQ ID NO: 4498 - DNA, 22 bp, Homo sapiens
tgccttagtgactaaagcacac

SEQ ID NO: 4499 - DNA, 18 bp, Homo sapiens
tgtccctgcaaataacat

SEQ ID NO: 4500 - DNA, 22 bp, Homo sapiens
gcgagcctctggagtcctctgg

SEQ ID NO: 4501 - DNA, 22 bp, Homo sapiens
attcacatttagcctctgacat

SEQ ID NO: 4502 - DNA, 21 bp, Homo sapiens
cttccccaggctggtctgtat

SEQ ID NO: 4503 - DNA, 22 bp, Homo sapiens
ccttggcaggcacgtcctgcgg

SEQ ID NO: 4504 - DNA, 22 bp, Homo sapiens
ggccttggagtcagccttgagc

SEQ ID NO: 4505 - DNA, 22 bp, Homo sapiens
ggcaggtcaggtccatgaccaa

SEQ ID NO: 4506 - DNA, 22 bp, Homo sapiens
catgttggtgtgctgcacccgt

SEQ ID NO: 4507 - DNA, 22 bp, Homo sapiens
aggctgtagtgcatgtgctatg

SEQ ID NO: 4508 - DNA, 22 bp, Homo sapiens
gggaaatctcgtcctctattta

SEQ ID NO: 4509 - DNA, 22 bp, Homo sapiens
actgcgctccagcctgggtgac

SEQ ID NO: 4510 - DNA, 22 bp, Homo sapiens
atgttatgtctgggaaggggta

SEQ ID NO: 4511 - DNA, 22 bp, Homo sapiens
ctcagcactgacccaggagatg

SEQ ID NO: 4512 - DNA, 22 bp, Homo sapiens
gcagaggacacaggagggcaag

SEQ ID NO: 4513 - DNA, 22 bp, Homo sapiens
agtccccctctgagcccaggga

SEQ ID NO: 4514 - DNA, 22 bp, Homo sapiens
caggtgtgccgggagcagtttg

SEQ ID NO: 4515 - DNA, 22 bp, Homo sapiens
tagcagtattccggaatacttt

SEQ ID NO: 4516 - DNA, 21 bp, Homo sapiens
atgcattcctcccctttcctc

SEQ ID NO: 4517 - DNA, 22 bp, Homo sapiens
cctttcctgtgtccttttaagg

SEQ ID NO: 4518 - DNA, 22 bp, Homo sapiens
gtgcatgtgtctttatagtagc

SEQ ID NO: 4519 - DNA, 22 bp, Homo sapiens
taggtataggattctaggttgg

SEQ ID NO: 4520 - DNA, 22 bp, Homo sapiens
caattcccagctgccgggctgc

SEQ ID NO: 4521 - DNA, 21 bp, Homo sapiens
acagtaagacagggcatttgc

SEQ ID NO: 4522 - DNA, 22 bp, Homo sapiens
agtgggtgacagttaacaggtt

SEQ ID NO: 4523 - DNA, 22 bp, Homo sapiens
cccaaagcagttgatgtaccag

SEQ ID NO: 4524 - DNA, 22 bp, Homo sapiens
ccggcgaccgctgtcggaggcg

SEQ ID NO: 4525 - DNA, 22 bp, Homo sapiens
ggcaaaaaccataattactttt

SEQ ID NO: 4526 - DNA, 22 bp, Homo sapiens
ttgtcacagcagcaaaggctct

SEQ ID NO: 4527 - DNA, 22 bp, Homo sapiens
gcttctggtgaggcctcaggaa

SEQ ID NO: 4528 - DNA, 22 bp, Homo sapiens
gactggaaagcctgtcctcaga

SEQ ID NO: 4529 - DNA, 17 bp, Homo sapiens
agtttttggacctgtgt

SEQ ID NO: 4530 - DNA, 22 bp, Homo sapiens
tgacacccatctgtgccagtcc

SEQ ID NO: 4531 - DNA, 22 bp, Homo sapiens
tgcatggacgtgacttggccaa

SEQ ID NO: 4532 - DNA, 23 bp, Homo sapiens
ccatcccttggaagctggtttta

SEQ ID NO: 4533 - DNA, 22 bp, Homo sapiens
cggccttggtcggcccacagct

SEQ ID NO: 4534 - DNA, 22 bp, Homo sapiens
gtgctgatgttgcttcccttgg

SEQ ID NO: 4535 - DNA, 22 bp, Homo sapiens
ctgcagtcatctgaagattttg

SEQ ID NO: 4536 - DNA, 22 bp, Homo sapiens
tgggcaggggccctgcttccgt

SEQ ID NO: 4537 - DNA, 22 bp, Homo sapiens
gagtcgagcagaaagccgtcgg

SEQ ID NO: 4538 - DNA, 23 bp, Homo sapiens
ttaaacactagttcgagtagcat

SEQ ID NO: 4539 - DNA, 22 bp, Homo sapiens
tcaactaactctattatttgaa

SEQ ID NO: 4540 - DNA, 18 bp, Homo sapiens
ggtgagggagctggaagc

SEQ ID NO: 4541 - DNA, 20 bp, Homo sapiens
atcctctcctgattaattca

SEQ ID NO: 4542 - DNA, 22 bp, Homo sapiens
ataatacatggttgatcttttc

SEQ ID NO: 4543 - DNA, 22 bp, Homo sapiens
gggaaatagagctggaaccttg

SEQ ID NO: 4544 - DNA, 21 bp, Homo sapiens
tggacttatggagtgtttctt

SEQ ID NO: 4545 - DNA, 21 bp, Homo sapiens
gtggttctagagaaacagaat

SEQ ID NO: 4546 - DNA, 17 bp, Homo sapiens
ggcctgcacctcctgct

SEQ ID NO: 4547 - DNA, 21 bp, Homo sapiens
agctgcctccacttctgaggc

SEQ ID NO: 4548 - DNA, 22 bp, Homo sapiens
gtgctccctccttcctcaagga

SEQ ID NO: 4549 - DNA, 22 bp, Homo sapiens
agccagactgtgatgtgattaa

SEQ ID NO: 4550 - DNA, 22 bp, Homo sapiens
tatcacagccttttggtgaggg

SEQ ID NO: 4551 - DNA, 22 bp, Homo sapiens
agtccggggtctggacacctgg

SEQ ID NO: 4552 - DNA, 22 bp, Homo sapiens
tgtccccacctaaatcttatct

SEQ ID NO: 4553 - DNA, 22 bp, Homo sapiens
ccaaagtgctaggattacaggt

SEQ ID NO: 4554 - DNA, 22 bp, Homo sapiens
tggattcacaccattctcctgc

SEQ ID NO: 4555 - DNA, 22 bp, Homo sapiens
aaatactcatcccaggaactgg

SEQ ID NO: 4556 - DNA, 22 bp, Homo sapiens
tattagttgcaaaacattgact

SEQ ID NO: 4557 - DNA, 22 bp, Homo sapiens
tgtagtagcattcacgaagtgt

SEQ ID NO: 4558 - DNA, 22 bp, Homo sapiens
aagtgctgggattacaggcatg

SEQ ID NO: 4559 - DNA, 22 bp, Homo sapiens
ttggggctcaggccgccgatgc

SEQ ID NO: 4560 - DNA, 22 bp, Homo sapiens
cagatcaaacaaaatgggttag

SEQ ID NO: 4561 - DNA, 22 bp, Homo sapiens
atggtactggggtcccggagtt

SEQ ID NO: 4562 - DNA, 22 bp, Homo sapiens
ccaaagtgctgggattacaggc

SEQ ID NO: 4563 - DNA, 22 bp, Homo sapiens
tgagcctgggtggtcgaggctg

SEQ ID NO: 4564 - DNA, 22 bp, Homo sapiens
gtgtgtcccttggaacctcagc

SEQ ID NO: 4565 - DNA, 22 bp, Homo sapiens
taaatacttagttttgtgtcta

SEQ ID NO: 4566 - DNA, 22 bp, Homo sapiens
gcctggactgttctaccatttt

SEQ ID NO: 4567 - DNA, 22 bp, Homo sapiens
ccctgggattcaatttcactct

SEQ ID NO: 4568 - DNA, 19 bp, Homo sapiens
gccgggcccgggttggccg

SEQ ID NO: 4569 - DNA, 22 bp, Homo sapiens
cccacagtgatcgcattcgtac

SEQ ID NO: 4570 - DNA, 22 bp, Homo sapiens
gcctgcagggcctgggcctacc

SEQ ID NO: 4571 - DNA, 22 bp, Homo sapiens
tttgaacagtagcttaggtgtg

SEQ ID NO: 4572 - DNA, 20 bp, Homo sapiens
cattggacttggcttcatgg

SEQ ID NO: 4573 - DNA, 21 bp, Homo sapiens
tcactagtgccttctgtcatt

SEQ ID NO: 4574 - DNA, 22 bp, Homo sapiens
tgtctggatagagcctaggccc

SEQ ID NO: 4575 - DNA, 22 bp, Homo sapiens
aagggggcggcagccagtggaa

SEQ ID NO: 4576 - DNA, 22 bp, Homo sapiens
ggttctctaactttgactggag

SEQ ID NO: 4577 - DNA, 22 bp, Homo sapiens
atacaatgattggttctcaccc

SEQ ID NO: 4578 - DNA, 23 bp, Homo sapiens
ttgcttagagacctcctcatcag

SEQ ID NO: 4579 - DNA, 22 bp, Homo sapiens
ggacgcttaccagtaacgactt

SEQ ID NO: 4580 - DNA, 22 bp, Homo sapiens
tgccagattgtggcatggcact

SEQ ID NO: 4581 - DNA, 22 bp, Homo sapiens
tgagaattacaaatgagtcaca

SEQ ID NO: 4582 - DNA, 22 bp, Homo sapiens
actgcactccatcctgggcaac

SEQ ID NO: 4583 - DNA, 22 bp, Homo sapiens
tcctagttctctgccagtcgct

SEQ ID NO: 4584 - DNA, 22 bp, Homo sapiens
ctggtgtggactccgcgcggag

SEQ ID NO: 4585 - DNA, 22 bp, Homo sapiens
atgattagttaccttgatttaa

SEQ ID NO: 4586 - DNA, 22 bp, Homo sapiens
aggaattgtgttgtagtggaga

SEQ ID NO: 4587 - DNA, 19 bp, Homo sapiens
ccttgtctggtgaaggact

SEQ ID NO: 4588 - DNA, 22 bp, Homo sapiens
acgtgcaggatctggttggcga

SEQ ID NO: 4589 - DNA, 22 bp, Homo sapiens
ccttctcagccccagctcccgc

SEQ ID NO: 4590 - DNA, 22 bp, Homo sapiens
gtctcccaaactctgatggtcc

SEQ ID NO: 4591 - DNA, 22 bp, Homo sapiens
ggtccccccatggtgagcactg

SEQ ID NO: 4592 - DNA, 22 bp, Homo sapiens
cctacggaggacaggttagcca

SEQ ID NO: 4593 - DNA, 22 bp, Homo sapiens
aaagtaattgcagtttctgcca

SEQ ID NO: 4594 - DNA, 22 bp, Homo sapiens
tgtgcacaatgtgcaggtttgt

SEQ ID NO: 4595 - DNA, 21 bp, Homo sapiens
tggttcagttcgttacgtgtg

SEQ ID NO: 4596 - DNA, 22 bp, Homo sapiens
cgggttcacgccattctcctgc

SEQ ID NO: 4597 - DNA, 23 bp, Homo sapiens
gacagagtgagaccttgtcttac

SEQ ID NO: 4598 - DNA, 22 bp, Homo sapiens
gccagggttcgaatccgtatgg

SEQ ID NO: 4599 - DNA, 22 bp, Homo sapiens
cgttctctcatgatcttcccga

SEQ ID NO: 4600 - DNA, 19 bp, Homo sapiens
gagcagtgaggaccaccag

SEQ ID NO: 4601 - DNA, 22 bp, Homo sapiens
agcgacaccgcctgcaggccat

SEQ ID NO: 4602 - DNA, 22 bp, Homo sapiens
tgtctggtgggttgacaggcag

SEQ ID NO: 4603 - DNA, 22 bp, Homo sapiens
gggttgaggcggatgtcggcgg

SEQ ID NO: 4604 - DNA, 23 bp, Homo sapiens
ccccactaccgtgatgtgcgagg

SEQ ID NO: 4605 - DNA, 22 bp, Homo sapiens
aactcctctctggtggttcgtc

SEQ ID NO: 4606 - DNA, 22 bp, Homo sapiens
tatccaattcaccattgatggg

SEQ ID NO: 4607 - DNA, 22 bp, Homo sapiens
gggaggaggaatgttttgtgta

SEQ ID NO: 4608 - DNA, 22 bp, Homo sapiens
gaacttggcctgtctgtctggc

SEQ ID NO: 4609 - DNA, 19 bp, Homo sapiens
ggggcccggggtctgcgag

SEQ ID NO: 4610 - DNA, 19 bp, Homo sapiens
ggggcctgtgatggtcaca

SEQ ID NO: 4611 - DNA, 22 bp, Homo sapiens
gtccgtagtggctgatgctttg

SEQ ID NO: 4612 - DNA, 22 bp, Homo sapiens
acccacgaagatgagcggcatg

SEQ ID NO: 4613 - DNA, 22 bp, Homo sapiens
agccacacttgccaggggaagg

SEQ ID NO: 4614 - DNA, 21 bp, Homo sapiens
tgggtcagagggaaagtgtat

SEQ ID NO: 4615 - DNA, 22 bp, Homo sapiens
aacgcccgtggttgccaaggta

SEQ ID NO: 4616 - DNA, 22 bp, Homo sapiens
tgttgcccaggttctctcctgc

SEQ ID NO: 4617 - DNA, 22 bp, Homo sapiens
tacagaggaggggattttaata

SEQ ID NO: 4618 - DNA, 22 bp, Homo sapiens
cattgcactccagtctgggcca

SEQ ID NO: 4619 - DNA, 22 bp, Homo sapiens
tgtgtgagtaaggctgagagag

SEQ ID NO: 4620 - DNA, 22 bp, Homo sapiens
ttaagtaacttgtccaaatgag

SEQ ID NO: 4621 - DNA, 22 bp, Homo sapiens
aaggagcgcttagggggcagaa

SEQ ID NO: 4622 - DNA, 22 bp, Homo sapiens
aacagactccattacctggctt

SEQ ID NO: 4623 - DNA, 22 bp, Homo sapiens
taactgattcctttttgaaaat

SEQ ID NO: 4624 - DNA, 22 bp, Homo sapiens
tacagctgctggtgctccatgc

SEQ ID NO: 4625 - DNA, 22 bp, Homo sapiens
gaggccaactttggagaacagg

SEQ ID NO: 4626 - DNA, 22 bp, Homo sapiens
caaagtgctaggattacaggcg

SEQ ID NO: 4627 - DNA, 22 bp, Homo sapiens
gccttgccgctcagcagtgggg

SEQ ID NO: 4628 - DNA, 20 bp, Homo sapiens
ggggaagtcactgcagtcag

SEQ ID NO: 4629 - DNA, 21 bp, Homo sapiens
tgtaagtttcatctgaattgg

SEQ ID NO: 4630 - DNA, 22 bp, Homo sapiens
ggacttcttgggcctgcaggga

SEQ ID NO: 4631 - DNA, 22 bp, Homo sapiens
cccatggcttaggagggagtgt

SEQ ID NO: 4632 - DNA, 22 bp, Homo sapiens
gtggggtagatctttctcagga

SEQ ID NO: 4633 - DNA, 22 bp, Homo sapiens
atgcttgcccatgtttctgaag

SEQ ID NO: 4634 - DNA, 22 bp, Homo sapiens
ttgggcctctcaaagtgctggg

SEQ ID NO: 4635 - DNA, 21 bp, Homo sapiens
tggtaggtactggcttcaggc

SEQ ID NO: 4636 - DNA, 22 bp, Homo sapiens
tttccctgtgaatatttaaaga

SEQ ID NO: 4637 - DNA, 22 bp, Homo sapiens
tggctgtgtccctgtccagagt

SEQ ID NO: 4638 - DNA, 22 bp, Homo sapiens
tgtctgcctgcgggccggcaca

SEQ ID NO: 4639 - DNA, 22 bp, Homo sapiens
ggcgccgcactcggtgcagccg

SEQ ID NO: 4640 - DNA, 22 bp, Homo sapiens
tgtaggagtccaatcaggagac

SEQ ID NO: 4641 - DNA, 22 bp, Homo sapiens
aagtgcttccatgtttgagtgt

SEQ ID NO: 4642 - DNA, 22 bp, Homo sapiens
tctacctggagtccgttgttaa

SEQ ID NO: 4643 - DNA, 22 bp, Homo sapiens
tttccatgtgtactggccagaa

SEQ ID NO: 4644 - DNA, 22 bp, Homo sapiens
gtcttgtcccagctctgccact

SEQ ID NO: 4645 - DNA, 22 bp, Homo sapiens
acgaggttggagagttgtttgg

SEQ ID NO: 4646 - DNA, 22 bp, Homo sapiens
ggggaccctcaggactgcgtct

SEQ ID NO: 4647 - DNA, 22 bp, Homo sapiens
agcactgtgagcaccagcacgc

SEQ ID NO: 4648 - DNA, 22 bp, Homo sapiens
tcttgagctgagtcagttcctg

SEQ ID NO: 4649 - DNA, 23 bp, Homo sapiens
gcctgggagttgcgatctgcccg

SEQ ID NO: 4650 - DNA, 22 bp, Homo sapiens
acccaagttttccatgcctgtt

SEQ ID NO: 4651 - DNA, 22 bp, Homo sapiens
attggccagacttatccttcag

SEQ ID NO: 4652 - DNA, 22 bp, Homo sapiens
cattgcactgcagcccgggcaa

SEQ ID NO: 4653 - DNA, 18 bp, Homo sapiens
agaggatgcatctaagag

SEQ ID NO: 4654 - DNA, 22 bp, Homo sapiens
tgtgaagaattaatgtgaatca

SEQ ID NO: 4655 - DNA, 22 bp, Homo sapiens
gtcactgtatccaggttccagc

SEQ ID NO: 4656 - DNA, 22 bp, Homo sapiens
ttctcccctttagggcctacgg

SEQ ID NO: 4657 - DNA, 22 bp, Homo sapiens
gccaggcgggtctcaaactcct

SEQ ID NO: 4658 - DNA, 18 bp, Homo sapiens
tctgccccagccgcactg

SEQ ID NO: 4659 - DNA, 22 bp, Homo sapiens
gaccaaggaagaggggagccag

SEQ ID NO: 4660 - DNA, 22 bp, Homo sapiens
ggactgggaatcagggagatgc

SEQ ID NO: 4661 - DNA, 22 bp, Homo sapiens
taggcgacagcttgatggtgcg

SEQ ID NO: 4662 - DNA, 22 bp, Homo sapiens
agtatacatagtgcttcctctt

SEQ ID NO: 4663 - DNA, 22 bp, Homo sapiens
ccatgtggtgggaaggagaatg

SEQ ID NO: 4664 - DNA, 22 bp, Homo sapiens
agacattttcgttggagaggtt

SEQ ID NO: 4665 - DNA, 22 bp, Homo sapiens
ctgatccctccatagggcacag

SEQ ID NO: 4666 - DNA, 22 bp, Homo sapiens
tgctatgtcgaaagggccatta

SEQ ID NO: 4667 - DNA, 22 bp, Homo sapiens
acccatccagtgtccctgctag

SEQ ID NO: 4668 - DNA, 22 bp, Homo sapiens
caggaggacatactggctcaca

SEQ ID NO: 4669 - DNA, 22 bp, Homo sapiens
tccacagtggttgaactagttt

SEQ ID NO: 4670 - DNA, 22 bp, Homo sapiens
tggtacacatgtccaaggtcag

SEQ ID NO: 4671 - DNA, 22 bp, Homo sapiens
cattgcactctagtctgggtga

SEQ ID NO: 4672 - DNA, 20 bp, Homo sapiens
aagacaccagtggcagcccc

SEQ ID NO: 4673 - DNA, 22 bp, Homo sapiens
ataatctttcttttccagatag

SEQ ID NO: 4674 - DNA, 20 bp, Homo sapiens
ctgggtggcaagcaaggggg

SEQ ID NO: 4675 - DNA, 22 bp, Homo sapiens
ggagtgagagagtttaaggtca

SEQ ID NO: 4676 - DNA, 22 bp, Homo sapiens
aagtaaatatctgtagtcttta

SEQ ID NO: 4677 - DNA, 19 bp, Homo sapiens
tggctctgtcgaaggcaca

SEQ ID NO: 4678 - DNA, 22 bp, Homo sapiens
tttcagatggaggtttaggaca

SEQ ID NO: 4679 - DNA, 22 bp, Homo sapiens
tggtagtcggcctcggtggctc

SEQ ID NO: 4680 - DNA, 22 bp, Homo sapiens
caggagtccatctggcctggtg

SEQ ID NO: 4681 - DNA, 22 bp, Homo sapiens
gatggcacacagacatccccgc

SEQ ID NO: 4682 - DNA, 22 bp, Homo sapiens
gctgtctgtcttcacatctcgc

SEQ ID NO: 4683 - DNA, 22 bp, Homo sapiens
agggatggagtgcggcccggac

SEQ ID NO: 4684 - DNA, 22 bp, Homo sapiens
ataaatgcatacatggttttga

SEQ ID NO: 4685 - DNA, 22 bp, Homo sapiens
aatattatacagtcaacctctt

SEQ ID NO: 4686 - DNA, 22 bp, Homo sapiens
ttttacctgaaccacacagtat

SEQ ID NO: 4687 - DNA, 22 bp, Homo sapiens
tactgcgccttcaccaagcggc

SEQ ID NO: 4688 - DNA, 22 bp, Homo sapiens
gttttgaatactactagaactt

SEQ ID NO: 4689 - DNA, 22 bp, Homo sapiens
ctggtagtttgcaaaatggtgt

SEQ ID NO: 4690 - DNA, 22 bp, Homo sapiens
actctccttttgatcttcagaa

SEQ ID NO: 4691 - DNA, 22 bp, Homo sapiens
tcacatcaaggactgtctggct

SEQ ID NO: 4692 - DNA, 22 bp, Homo sapiens
ggatcagggctggggatattct

SEQ ID NO: 4693 - DNA, 22 bp, Homo sapiens
agtgccaaatcgagggctctga

SEQ ID NO: 4694 - DNA, 22 bp, Homo sapiens
tggtacaatcacagctcactgt

SEQ ID NO: 4695 - DNA, 22 bp, Homo sapiens
gttgggttaaccaggatgtcaa

SEQ ID NO: 4696 - DNA, 22 bp, Homo sapiens
tcactgcaagctccgccttccg

SEQ ID NO: 4697 - DNA, 22 bp, Homo sapiens
gtggttgtttccaggtttgaaa

SEQ ID NO: 4698 - DNA, 22 bp, Homo sapiens
ttccatacgactgaggtctcgg

SEQ ID NO: 4699 - DNA, 22 bp, Homo sapiens
taaagattgctcaaaactgtga

SEQ ID NO: 4700 - DNA, 22 bp, Homo sapiens
agtgccttcagatttgccccag

SEQ ID NO: 4701 - DNA, 20 bp, Homo sapiens
aggctgttgacggctgcctc

SEQ ID NO: 4702 - DNA, 22 bp, Homo sapiens
tgcgggagggcaacgcggcatt

SEQ ID NO: 4703 - DNA, 22 bp, Homo sapiens
catagacagatggtaagaagct

SEQ ID NO: 4704 - DNA, 22 bp, Homo sapiens
ttagtgcttggcacacaataca

SEQ ID NO: 4705 - DNA, 22 bp, Homo sapiens
tgtgtcccttggaacctcagct

SEQ ID NO: 4706 - DNA, 22 bp, Homo sapiens
tattttgtgccatgcactgcct

SEQ ID NO: 4707 - DNA, 22 bp, Homo sapiens
cccaggaggcggaggttgcagt

SEQ ID NO: 4708 - DNA, 22 bp, Homo sapiens
acagaactgggaaatgcacata

SEQ ID NO: 4709 - DNA, 22 bp, Homo sapiens
tccgggcaactgaagggaggtt

SEQ ID NO: 4710 - DNA, 22 bp, Homo sapiens
atacaaaatatatactggagac

SEQ ID NO: 4711 - DNA, 22 bp, Homo sapiens
tcactgcactccagcctggtga

SEQ ID NO: 4712 - DNA, 22 bp, Homo sapiens
cccagcagtagagctcatatgg

SEQ ID NO: 4713 - DNA, 22 bp, Homo sapiens
tcatcttcctcatttctccagg

SEQ ID NO: 4714 - DNA, 22 bp, Homo sapiens
tggcacaggatctcagcggcca

SEQ ID NO: 4715 - DNA, 16 bp, Homo sapiens
tggggatggggaagag

SEQ ID NO: 4716 - DNA, 22 bp, Homo sapiens
cgtgagcaaaatggacactccc

SEQ ID NO: 4717 - DNA, 22 bp, Homo sapiens
ccccacaactcatgttgaaact

SEQ ID NO: 4718 - DNA, 22 bp, Homo sapiens
aaccaccattctctcctcttcc

SEQ ID NO: 4719 - DNA, 22 bp, Homo sapiens
aggtggagaagagatgggcagt

SEQ ID NO: 4720 - DNA, 22 bp, Homo sapiens
cctacctggggcaggcctcggg

SEQ ID NO: 4721 - DNA, 22 bp, Homo sapiens
tgtggactggcgggacgcaatg

SEQ ID NO: 4722 - DNA, 22 bp, Homo sapiens
ttccatttggagctcgcagcct

SEQ ID NO: 4723 - DNA, 22 bp, Homo sapiens
gggttgttggaggtgagtgtta

SEQ ID NO: 4724 - DNA, 21 bp, Homo sapiens
cctcaaagatgatggggtttc

SEQ ID NO: 4725 - DNA, 22 bp, Homo sapiens
ggacagaaaccatatgagtgta

SEQ ID NO: 4726 - DNA, 22 bp, Homo sapiens
aaggttcctctctccacccagc

SEQ ID NO: 4727 - DNA, 22 bp, Homo sapiens
ctcctgggaaaggctggacaca

SEQ ID NO: 4728 - DNA, 22 bp, Homo sapiens
actgcactccagcctgggcaca

SEQ ID NO: 4729 - DNA, 22 bp, Homo sapiens
aggtgcatctcgtagctcttct

SEQ ID NO: 4730 - DNA, 22 bp, Homo sapiens
aggaggaagggaagacaagtaa

SEQ ID NO: 4731 - DNA, 22 bp, Homo sapiens
gctgctgggatcctgggtctca

SEQ ID NO: 4732 - DNA, 22 bp, Homo sapiens
ttcaccctggaccagaaattgg

SEQ ID NO: 4733 - DNA, 22 bp, Homo sapiens
tttgagatggagtcttgctctg

SEQ ID NO: 4734 - DNA, 22 bp, Homo sapiens
tctgccttgtttgagctttgac

SEQ ID NO: 4735 - DNA, 22 bp, Homo sapiens
tggaggttgggatgcttgtgat

SEQ ID NO: 4736 - DNA, 22 bp, Homo sapiens
ctgccctttgaaagaacgtctt

SEQ ID NO: 4737 - DNA, 22 bp, Homo sapiens
gggcagccccagcgcgttggct

SEQ ID NO: 4738 - DNA, 22 bp, Homo sapiens
cactgcaatgtctacctcctgg

SEQ ID NO: 4739 - DNA, 22 bp, Homo sapiens
actgcacttcaccctgggtgac

SEQ ID NO: 4740 - DNA, 22 bp, Homo sapiens
tcccctctttctggaaacacaa

SEQ ID NO: 4741 - DNA, 21 bp, Homo sapiens
ggtgacacgtggccccgctct

SEQ ID NO: 4742 - DNA, 22 bp, Homo sapiens
tcactgcactccagcactcagg

SEQ ID NO: 4743 - DNA, 22 bp, Homo sapiens
aaaacgatgtttaaaagctctg

SEQ ID NO: 4744 - DNA, 22 bp, Homo sapiens
aaaagtaattgcggtttttgct

SEQ ID NO: 4745 - DNA, 22 bp, Homo sapiens
tcaccagctctgcctcgccagt

SEQ ID NO: 4746 - DNA, 22 bp, Homo sapiens
tgagcctgggagatggaggctg

SEQ ID NO: 4747 - DNA, 22 bp, Homo sapiens
gtaggtcagacataagaggaca

SEQ ID NO: 4748 - DNA, 22 bp, Homo sapiens
ccagctatggctattcaaggtc

SEQ ID NO: 4749 - DNA, 22 bp, Homo sapiens
gtccaggcctgcctctgaggag

SEQ ID NO: 4750 - DNA, 22 bp, Homo sapiens
gatgtagacacttggaggctta

SEQ ID NO: 4751 - DNA, 22 bp, Homo sapiens
actttaattaatgaactgtggc

SEQ ID NO: 4752 - DNA, 22 bp, Homo sapiens
atgatggttgtcctaggtgcat

SEQ ID NO: 4753 - DNA, 22 bp, Homo sapiens
gttgcctaggctggagtgcagt

SEQ ID NO: 4754 - DNA, 22 bp, Homo sapiens
caacccaaggttagttggtctt

SEQ ID NO: 4755 - DNA, 22 bp, Homo sapiens
ttgctgttgatgatgtgataca

SEQ ID NO: 4756 - DNA, 22 bp, Homo sapiens
cccaggaagtggaggttgcagt

SEQ ID NO: 4757 - DNA, 18 bp, Homo sapiens
ccctgccagctcccagca

SEQ ID NO: 4758 - DNA, 16 bp, Homo sapiens
ggcaggcgcggagccc

SEQ ID NO: 4759 - DNA, 22 bp, Homo sapiens
gagcaccgcctccacgatgccc

SEQ ID NO: 4760 - DNA, 22 bp, Homo sapiens
gaggcctcagcctgccctgaac

SEQ ID NO: 4761 - DNA, 22 bp, Homo sapiens
agccaccaccactgaaaggtta

SEQ ID NO: 4762 - DNA, 22 bp, Homo sapiens
atgtttgccatcatgagattgt

SEQ ID NO: 4763 - DNA, 22 bp, Homo sapiens
tcactgcaagctcagcctcccg

SEQ ID NO: 4764 - DNA, 22 bp, Homo sapiens
tccagcttataggtagatttaa

SEQ ID NO: 4765 - DNA, 22 bp, Homo sapiens
ctggagtagccggacgggtctg

SEQ ID NO: 4766 - DNA, 22 bp, Homo sapiens
tttcaacagatctgtcttcagg

SEQ ID NO: 4767 - DNA, 22 bp, Homo sapiens
ctgattctcctcaagactttcg

SEQ ID NO: 4768 - DNA, 23 bp, Homo sapiens
aacgacagctacaggcatcccac

SEQ ID NO: 4769 - DNA, 22 bp, Homo sapiens
ggagggcgacagggcgaccgcg

SEQ ID NO: 4770 - DNA, 22 bp, Homo sapiens
gcggctccgaagccaggccgcg

SEQ ID NO: 4771 - DNA, 22 bp, Homo sapiens
aatggcactttataaatgttaa

SEQ ID NO: 4772 - DNA, 22 bp, Homo sapiens
ttgctggaaggtggctggaatc

SEQ ID NO: 4773 - DNA, 22 bp, Homo sapiens
catgagatttgggaggggccag

SEQ ID NO: 4774 - DNA, 22 bp, Homo sapiens
aaaagcaattgcgggttttgcc

SEQ ID NO: 4775 - DNA, 22 bp, Homo sapiens
gaatgaacaaatgtggtggaga

SEQ ID NO: 4776 - DNA, 22 bp, Homo sapiens
cccactgtttccctgaggctct

SEQ ID NO: 4777 - DNA, 22 bp, Homo sapiens
gcacggctaatttttgtatttt

SEQ ID NO: 4778 - DNA, 22 bp, Homo sapiens
ctcggggatccatccacgtggc

SEQ ID NO: 4779 - DNA, 22 bp, Homo sapiens
ggccctgggccctctagcttgt

SEQ ID NO: 4780 - DNA, 22 bp, Homo sapiens
ggctttgggggtgtccaagaaa

SEQ ID NO: 4781 - DNA, 22 bp, Homo sapiens
atctggttttggctgtgtccct

SEQ ID NO: 4782 - DNA, 22 bp, Homo sapiens
gagctgagaagcagcgcttgat

SEQ ID NO: 4783 - DNA, 22 bp, Homo sapiens
cattcattacactcataaggtt

SEQ ID NO: 4784 - DNA, 22 bp, Homo sapiens
gtgcagttgtggacatgacaac

SEQ ID NO: 4785 - DNA, 20 bp, Homo sapiens
gtgcaatggctcagtctcag

SEQ ID NO: 4786 - DNA, 22 bp, Homo sapiens
gagcagtaggagaaccctgagc

SEQ ID NO: 4787 - DNA, 22 bp, Homo sapiens
tcaccggtgaccctcggctcgc

SEQ ID NO: 4788 - DNA, 22 bp, Homo sapiens
ctgagaacatcattcagatatt

SEQ ID NO: 4789 - DNA, 22 bp, Homo sapiens
gttatataagacaaatcagagt

SEQ ID NO: 4790 - DNA, 19 bp, Homo sapiens
ttcacattggaagaagtag

SEQ ID NO: 4791 - DNA, 22 bp, Homo sapiens
catcactgtccaaagttcagtt

SEQ ID NO: 4792 - DNA, 22 bp, Homo sapiens
ccgtgtgcacgcgccggtgctg

SEQ ID NO: 4793 - DNA, 22 bp, Homo sapiens
ggtgggagagctctgtctccag

SEQ ID NO: 4794 - DNA, 22 bp, Homo sapiens
gggacgtgagtgaagaaggtct

SEQ ID NO: 4795 - DNA, 22 bp, Homo sapiens
gcttctcgggcctgatgtcgtc

SEQ ID NO: 4796 - DNA, 22 bp, Homo sapiens
tggtagtgactcccccagggct

SEQ ID NO: 4797 - DNA, 22 bp, Homo sapiens
aaggggtgcaagttaatcagca

SEQ ID NO: 4798 - DNA, 22 bp, Homo sapiens
tattgtccaataggatgttcct

SEQ ID NO: 4799 - DNA, 22 bp, Homo sapiens
tcctcagaatcacctggcagct

SEQ ID NO: 4800 - DNA, 22 bp, Homo sapiens
accccaggaagtggaggtcatg

SEQ ID NO: 4801 - DNA, 22 bp, Homo sapiens
gggttcagtccctcttgctact

SEQ ID NO: 4802 - DNA, 20 bp, Homo sapiens
taagcatagttgtcagggtc

SEQ ID NO: 4803 - DNA, 22 bp, Homo sapiens
caacaacatgggattcatttct

SEQ ID NO: 4804 - DNA, 22 bp, Homo sapiens
agtggtgataaccgctatcata

SEQ ID NO: 4805 - DNA, 22 bp, Homo sapiens
ccgccaggatattgtggctttt

SEQ ID NO: 4806 - DNA, 22 bp, Homo sapiens
atgaagtaggactgaacttggg

SEQ ID NO: 4807 - DNA, 22 bp, Homo sapiens
gcgagaaactaagtgccctttg

SEQ ID NO: 4808 - DNA, 22 bp, Homo sapiens
gtaatctcagctacttgggagg

SEQ ID NO: 4809 - DNA, 22 bp, Homo sapiens
caaagtgctaggattacaggcc

SEQ ID NO: 4810 - DNA, 22 bp, Homo sapiens
tagtttcatctccaccctgccc

SEQ ID NO: 4811 - DNA, 22 bp, Homo sapiens
caccagcagcggtgtgagggtg

SEQ ID NO: 4812 - DNA, 22 bp, Homo sapiens
acatgagatttgggtggtgata

SEQ ID NO: 4813 - DNA, 22 bp, Homo sapiens
catgatctggtcctactgtggg

SEQ ID NO: 4814 - DNA, 22 bp, Homo sapiens
tccaggtgggctgcacccaggc

SEQ ID NO: 4815 - DNA, 22 bp, Homo sapiens
agcttactgccccatggaagga

SEQ ID NO: 4816 - DNA, 22 bp, Homo sapiens
tcaggtagttgacagaacttag

SEQ ID NO: 4817 - DNA, 22 bp, Homo sapiens
ggacattgaagctggaaaggga

SEQ ID NO: 4818 - DNA, 22 bp, Homo sapiens
tgggcaaggctggagcctgcag

SEQ ID NO: 4819 - DNA, 22 bp, Homo sapiens
agatggtagactatggaacgta

SEQ ID NO: 4820 - DNA, 22 bp, Homo sapiens
tgcaagtaattccagctactga

SEQ ID NO: 4821 - DNA, 22 bp, Homo sapiens
gggtggaaagtatttggggacc

SEQ ID NO: 4822 - DNA, 22 bp, Homo sapiens
cacgggagacgtgatcttggac

SEQ ID NO: 4823 - DNA, 22 bp, Homo sapiens
atggagcaacagacctatcaca

SEQ ID NO: 4824 - DNA, 22 bp, Homo sapiens
aggcggaagatggccccataga

SEQ ID NO: 4825 - DNA, 22 bp, Homo sapiens
cggccgctgacaaatagttccc

SEQ ID NO: 4826 - DNA, 22 bp, Homo sapiens
ggccttggttccaaagcaggca

SEQ ID NO: 4827 - DNA, 22 bp, Homo sapiens
cccaaaggttgaggctgcagtg

SEQ ID NO: 4828 - DNA, 22 bp, Homo sapiens
tcactgcacttcaggctttctc

SEQ ID NO: 4829 - DNA, 22 bp, Homo sapiens
ctccaccccgtgccggtgctgg

SEQ ID NO: 4830 - DNA, 22 bp, Homo sapiens
ataaagctattcctctcttttt

SEQ ID NO: 4831 - DNA, 22 bp, Homo sapiens
tgcccagggtggagtgcagtgg

SEQ ID NO: 4832 - DNA, 22 bp, Homo sapiens
gttggccttgaggtggtagagt

SEQ ID NO: 4833 - DNA, 22 bp, Homo sapiens
gggagcaagccggaggtactgt

SEQ ID NO: 4834 - DNA, 22 bp, Homo sapiens
aactcaggagtttaaggctgca

SEQ ID NO: 4835 - DNA, 16 bp, Homo sapiens
gtagccgtggccgctg

SEQ ID NO: 4836 - DNA, 22 bp, Homo sapiens
tataccatgtgtgcacactccc

SEQ ID NO: 4837 - DNA, 19 bp, Homo sapiens
gctggatggatcctggagt

SEQ ID NO: 4838 - DNA, 22 bp, Homo sapiens
tttcttggggctcctgcgccat

SEQ ID NO: 4839 - DNA, 22 bp, Homo sapiens
atgtatgtctaaaacggggagg

SEQ ID NO: 4840 - DNA, 21 bp, Homo sapiens
ctgtgatgttgccggggtagg

SEQ ID NO: 4841 - DNA, 19 bp, Homo sapiens
atcccaaggagctgggact

SEQ ID NO: 4842 - DNA, 22 bp, Homo sapiens
gtgttagtttgctaaggataat

SEQ ID NO: 4843 - DNA, 22 bp, Homo sapiens
ttgaccatagaacatgcgctat

SEQ ID NO: 4844 - DNA, 22 bp, Homo sapiens
cttctacacgtggctgtgccaa

SEQ ID NO: 4845 - DNA, 22 bp, Homo sapiens
ctcaggagttggaggctacagt

SEQ ID NO: 4846 - DNA, 22 bp, Homo sapiens
ggcgcacaatgtgcaggtttgt

SEQ ID NO: 4847 - DNA, 22 bp, Homo sapiens
tagatgcttgttcagaaatagg

SEQ ID NO: 4848 - DNA, 22 bp, Homo sapiens
gggctcgaagcgctggtggttg

SEQ ID NO: 4849 - DNA, 18 bp, Homo sapiens
ccaaggatgctgccggcc

SEQ ID NO: 4850 - DNA, 22 bp, Homo sapiens
cccagagcatgtgctgcctttg

SEQ ID NO: 4851 - DNA, 22 bp, Homo sapiens
ggacaagcctgtgagtgggttt

SEQ ID NO: 4852 - DNA, 22 bp, Homo sapiens
gtgagagattgattgtagcggc

SEQ ID NO: 4853 - DNA, 22 bp, Homo sapiens
tcatctaagagtcttacattta

SEQ ID NO: 4854 - DNA, 22 bp, Homo sapiens
agcaacctcatgagagtgaaat

SEQ ID NO: 4855 - DNA, 22 bp, Homo sapiens
agctgccgatgcccagctgcat

SEQ ID NO: 4856 - DNA, 22 bp, Homo sapiens
gggtaggccgtgggtcaccagg

SEQ ID NO: 4857 - DNA, 22 bp, Homo sapiens
tccctctacagggaagcgcttt

SEQ ID NO: 4858 - DNA, 22 bp, Homo sapiens
agaaatatgctgattagatgaa

SEQ ID NO: 4859 - DNA, 22 bp, Homo sapiens
gagcactcaggacactcatagg

SEQ ID NO: 4860 - DNA, 22 bp, Homo sapiens
gtttggggagttcctttaggcc

SEQ ID NO: 4861 - DNA, 22 bp, Homo sapiens
attcgacaaccttgttttgtac

SEQ ID NO: 4862 - DNA, 22 bp, Homo sapiens
tggactaaagaaacattccgtg

SEQ ID NO: 4863 - DNA, 22 bp, Homo sapiens
gactttgtgccaaacgccagaa

SEQ ID NO: 4864 - DNA, 22 bp, Homo sapiens
aaggaatttgaggctgcagtga

SEQ ID NO: 4865 - DNA, 22 bp, Homo sapiens
ctgtcctgtgctttttactgtc

SEQ ID NO: 4866 - DNA, 22 bp, Homo sapiens
taggaatggtgctcagcagaaa

SEQ ID NO: 4867 - DNA, 22 bp, Homo sapiens
ggaaacttggatgccagcactc

SEQ ID NO: 4868 - DNA, 22 bp, Homo sapiens
tatctcctgtcagggtggtggt

SEQ ID NO: 4869 - DNA, 22 bp, Homo sapiens
cctgcctactgagttttatatt

SEQ ID NO: 4870 - DNA, 22 bp, Homo sapiens
tgggggctgggatgtcactttc

SEQ ID NO: 4871 - DNA, 22 bp, Homo sapiens
taagtcatagattaatggccac

SEQ ID NO: 4872 - DNA, 22 bp, Homo sapiens
ctgaaggatgtgtggtgggagt

SEQ ID NO: 4873 - DNA, 21 bp, Homo sapiens
ctggccactgcacctcttcct

SEQ ID NO: 4874 - DNA, 23 bp, Homo sapiens
ctgttatatgggtgttatgtgct

SEQ ID NO: 4875 - DNA, 22 bp, Homo sapiens
tgtatgttgggtcaaagtacat

SEQ ID NO: 4876 - DNA, 21 bp, Homo sapiens
gggcactgaaagggaatagca

SEQ ID NO: 4877 - DNA, 22 bp, Homo sapiens
ttcagatgattagaatagtatt

SEQ ID NO: 4878 - DNA, 16 bp, Homo sapiens
aggtggagaagttcac

SEQ ID NO: 4879 - DNA, 22 bp, Homo sapiens
tacaagatgacaggtgcatgat

SEQ ID NO: 4880 - DNA, 20 bp, Homo sapiens
tgggatcgaatcaagtctgt

SEQ ID NO: 4881 - DNA, 22 bp, Homo sapiens
tctgcgcgctgctggtaccgaa

SEQ ID NO: 4882 - DNA, 22 bp, Homo sapiens
agttgcagacgcagagatgttg

SEQ ID NO: 4883 - DNA, 22 bp, Homo sapiens
ttgtgtgtactggttatgggca

SEQ ID NO: 4884 - DNA, 18 bp, Homo sapiens
tcactgtgtgtcttgggt

SEQ ID NO: 4885 - DNA, 22 bp, Homo sapiens
agcagcagtatccttccccggc

SEQ ID NO: 4886 - DNA, 23 bp, Homo sapiens
tgtcttcgactcctgcgtgcttc

SEQ ID NO: 4887 - DNA, 22 bp, Homo sapiens
gcagtggggcaatcatagctca

SEQ ID NO: 4888 - DNA, 22 bp, Homo sapiens
gtgcgcaccctcccggcatccc

SEQ ID NO: 4889 - DNA, 22 bp, Homo sapiens
ggcaggaggtgagtggcgggtg

SEQ ID NO: 4890 - DNA, 22 bp, Homo sapiens
ggggttaacagtattgctcatg

SEQ ID NO: 4891 - DNA, 22 bp, Homo sapiens
cttcagctgcagttatgtttag

SEQ ID NO: 4892 - DNA, 22 bp, Homo sapiens
ctgagtgaaagaagccagacat

SEQ ID NO: 4893 - DNA, 22 bp, Homo sapiens
cctcaggttctggagaagggcc

SEQ ID NO: 4894 - DNA, 22 bp, Homo sapiens
agcaacccgtccttgggggact

SEQ ID NO: 4895 - DNA, 22 bp, Homo sapiens
ccgggaggtggaggttgcagtg

SEQ ID NO: 4896 - DNA, 22 bp, Homo sapiens
ccaggaggtggaggttgcggtg

SEQ ID NO: 4897 - DNA, 22 bp, Homo sapiens
ttgagcatctgaggattttcct

SEQ ID NO: 4898 - DNA, 22 bp, Homo sapiens
gggatctgggacaacaggtggt

SEQ ID NO: 4899 - DNA, 22 bp, Homo sapiens
agaaactctggaagaactttta

SEQ ID NO: 4900 - DNA, 22 bp, Homo sapiens
ctcgcgttccagctgcgggccg

SEQ ID NO: 4901 - DNA, 22 bp, Homo sapiens
gggcatttcttgtcaatgtagg

SEQ ID NO: 4902 - DNA, 22 bp, Homo sapiens
gccatgcttggtatgctgtgag

SEQ ID NO: 4903 - DNA, 22 bp, Homo sapiens
catgcggctctttccaaaccgg

SEQ ID NO: 4904 - DNA, 22 bp, Homo sapiens
ttggatctcatctaagtgcgtg

SEQ ID NO: 4905 - DNA, 23 bp, Homo sapiens
tgcaatggcatgatttcagctca

SEQ ID NO: 4906 - DNA, 23 bp, Homo sapiens
tgaatgtttattctcggtgcaga

SEQ ID NO: 4907 - DNA, 22 bp, Homo sapiens
acctggacacctgctgtcatct

SEQ ID NO: 4908 - DNA, 22 bp, Homo sapiens
agctggtgtgccagttccagtt

SEQ ID NO: 4909 - DNA, 22 bp, Homo sapiens
ggcaaagccctgcctggttcaa

SEQ ID NO: 4910 - DNA, 22 bp, Homo sapiens
cccaggaggtggagcttgcagt

SEQ ID NO: 4911 - DNA, 22 bp, Homo sapiens
agccacacagcttaatgacaga

SEQ ID NO: 4912 - DNA, 22 bp, Homo sapiens
agtatgtcagagtgaaaatggt

SEQ ID NO: 4913 - DNA, 22 bp, Homo sapiens
cagagcttcctgctgggcttct

SEQ ID NO: 4914 - DNA, 21 bp, Homo sapiens
aaactgaccttgcctgagaca

SEQ ID NO: 4915 - DNA, 22 bp, Homo sapiens
aggctagaggcttctggcttca

SEQ ID NO: 4916 - DNA, 22 bp, Homo sapiens
aggcgagaggcttgggctagta

SEQ ID NO: 4917 - DNA, 22 bp, Homo sapiens
tcaaaaagttgaagagttgggg

SEQ ID NO: 4918 - DNA, 22 bp, Homo sapiens
tcagttatagatacttttacca

SEQ ID NO: 4919 - DNA, 22 bp, Homo sapiens
tactgcactccagcctgggtga

SEQ ID NO: 4920 - DNA, 22 bp, Homo sapiens
gtggcccaggctggagtgcagt

SEQ ID NO: 4921 - DNA, 22 bp, Homo sapiens
tcactcaggctggagtgcagtg

SEQ ID NO: 4922 - DNA, 22 bp, Homo sapiens
ggcaatcattggcattctctgg

SEQ ID NO: 4923 - DNA, 22 bp, Homo sapiens
gaaagacatagttgcaagatgg

SEQ ID NO: 4924 - DNA, 20 bp, Homo sapiens
agacagtgtggagattcctt

SEQ ID NO: 4925 - DNA, 22 bp, Homo sapiens
tgcttctgactaagctgcatga

SEQ ID NO: 4926 - DNA, 22 bp, Homo sapiens
tcacagagaaatgtggcacaaa

SEQ ID NO: 4927 - DNA, 22 bp, Homo sapiens
cactgcaacctccatcttctgg

SEQ ID NO: 4928 - DNA, 22 bp, Homo sapiens
taccttctaggtgatggttaca

SEQ ID NO: 4929 - DNA, 22 bp, Homo sapiens
taacaaagtattgtttgtgtat

SEQ ID NO: 4930 - DNA, 22 bp, Homo sapiens
cagaccagaaggaagccgacaa

SEQ ID NO: 4931 - DNA, 22 bp, Homo sapiens
cacactgtctttatgagctgta

SEQ ID NO: 4932 - DNA, 22 bp, Homo sapiens
taccaccatttgcctgctgtat

SEQ ID NO: 4933 - DNA, 22 bp, Homo sapiens
aagtgctgggattacaagcgtg

SEQ ID NO: 4934 - DNA, 22 bp, Homo sapiens
gccctccagcctgtggaaccgg

SEQ ID NO: 4935 - DNA, 22 bp, Homo sapiens
ctagttctagatccctgaggaa

SEQ ID NO: 4936 - DNA, 19 bp, Homo sapiens
gccttgaagcaactcttgt

SEQ ID NO: 4937 - DNA, 22 bp, Homo sapiens
agtggagacaggacagtcgata

SEQ ID NO: 4938 - DNA, 22 bp, Homo sapiens
cagcacatgctcatcagggaag

SEQ ID NO: 4939 - DNA, 20 bp, Homo sapiens
ttcaggaataagatagcagc

SEQ ID NO: 4940 - DNA, 22 bp, Homo sapiens
aggacttagaacattatgtact

SEQ ID NO: 4941 - DNA, 22 bp, Homo sapiens
tcctaggttttcaaaagaccac

SEQ ID NO: 4942 - DNA, 22 bp, Homo sapiens
gtataggtgagggacttgatca

SEQ ID NO: 4943 - DNA, 22 bp, Homo sapiens
tgtgggtttgtagttaagttct

SEQ ID NO: 4944 - DNA, 22 bp, Homo sapiens
ccaaagtgctgggattacaggt

SEQ ID NO: 4945 - DNA, 20 bp, Homo sapiens
agcggctggcggaggacacg

SEQ ID NO: 4946 - DNA, 22 bp, Homo sapiens
acggggctagagaaggtttctt

SEQ ID NO: 4947 - DNA, 22 bp, Homo sapiens
atccccctcttggatggcggca

SEQ ID NO: 4948 - DNA, 22 bp, Homo sapiens
gagtttgtgggaatggagtatt

SEQ ID NO: 4949 - DNA, 22 bp, Homo sapiens
ggcctgcctcacagtcagcacc

SEQ ID NO: 4950 - DNA, 22 bp, Homo sapiens
atgccactgcactccagcctgg

SEQ ID NO: 4951 - DNA, 22 bp, Homo sapiens
cctttgatttcccccgtctcag

SEQ ID NO: 4952 - DNA, 22 bp, Homo sapiens
agctgctgagccaggctgatgt

SEQ ID NO: 4953 - DNA, 22 bp, Homo sapiens
tcctggtgctgacacccatagc

SEQ ID NO: 4954 - DNA, 22 bp, Homo sapiens
ttaggcaattttgtcattgtgt

SEQ ID NO: 4955 - DNA, 22 bp, Homo sapiens
tggggagtgatgcctcggataa

SEQ ID NO: 4956 - DNA, 22 bp, Homo sapiens
ccgggcgggggctctcgtcacc

SEQ ID NO: 4957 - DNA, 22 bp, Homo sapiens
ctgctgggatagaagtatctca

SEQ ID NO: 4958 - DNA, 22 bp, Homo sapiens
gagcaggtgcctgtagctctct

SEQ ID NO: 4959 - DNA, 22 bp, Homo sapiens
aagagactgtaaaggcgtgagt

SEQ ID NO: 4960 - DNA, 22 bp, Homo sapiens
gagtgggaatgttctaagaatt

SEQ ID NO: 4961 - DNA, 22 bp, Homo sapiens
gcccatagtctctttctttctt

SEQ ID NO: 4962 - DNA, 22 bp, Homo sapiens
cactgcaccctcaaactcctgg

SEQ ID NO: 4963 - DNA, 22 bp, Homo sapiens
tgttgctgtatgaataggaagg

SEQ ID NO: 4964 - DNA, 22 bp, Homo sapiens
ggctgatgggcatgagctgtca

SEQ ID NO: 4965 - DNA, 22 bp, Homo sapiens
gggcctgctgcaggttcaggat

SEQ ID NO: 4966 - DNA, 22 bp, Homo sapiens
tcacttgaacctgggaggcaga

SEQ ID NO: 4967 - DNA, 22 bp, Homo sapiens
tctgtataaagtaccggtggca

SEQ ID NO: 4968 - DNA, 22 bp, Homo sapiens
gacctccgtgtacacctcccag

SEQ ID NO: 4969 - DNA, 22 bp, Homo sapiens
tggtattctttctgtagatcat

SEQ ID NO: 4970 - DNA, 22 bp, Homo sapiens
gaggtaacactgttcagtgggc

SEQ ID NO: 4971 - DNA, 19 bp, Homo sapiens
tggttctccttccacagtc

SEQ ID NO: 4972 - DNA, 22 bp, Homo sapiens
aattttctggtgtgtaatgaag

SEQ ID NO: 4973 - DNA, 22 bp, Homo sapiens
ggccaggcgatgacccctccac

SEQ ID NO: 4974 - DNA, 22 bp, Homo sapiens
gtgaataaaacacctgccaaga

SEQ ID NO: 4975 - DNA, 22 bp, Homo sapiens
cactgcactccagcctgggcga

SEQ ID NO: 4976 - DNA, 22 bp, Homo sapiens
cacacctcagccatgtggaggc

SEQ ID NO: 4977 - DNA, 22 bp, Homo sapiens
cagagagaatcttggcagctga

SEQ ID NO: 4978 - DNA, 22 bp, Homo sapiens
gatgctgctcgggtgcctggga

SEQ ID NO: 4979 - DNA, 18 bp, Homo sapiens
gatcgggggcgccccaag

SEQ ID NO: 4980 - DNA, 22 bp, Homo sapiens
cttggaggtggaagttgcagtg

SEQ ID NO: 4981 - DNA, 22 bp, Homo sapiens
ctgttcccggtggccgggccag

SEQ ID NO: 4982 - DNA, 23 bp, Homo sapiens
ggggtcttggaacaggtggccct

SEQ ID NO: 4983 - DNA, 23 bp, Homo sapiens
aaacttgctatggctgaaatcat

SEQ ID NO: 4984 - DNA, 22 bp, Homo sapiens
cagtggccaacttcctgcctct

SEQ ID NO: 4985 - DNA, 22 bp, Homo sapiens
tccaaacgggagccaaatgagc

SEQ ID NO: 4986 - DNA, 22 bp, Homo sapiens
gcttaattctggctcagtttcc

SEQ ID NO: 4987 - DNA, 22 bp, Homo sapiens
gaagaaagatcaaatagtttcc

SEQ ID NO: 4988 - DNA, 22 bp, Homo sapiens
ggaggcagaatagagtgtgggt

SEQ ID NO: 4989 - DNA, 22 bp, Homo sapiens
tgtgagttcttagaaagtcagt

SEQ ID NO: 4990 - DNA, 18 bp, Homo sapiens
gcctggcttcggagccgc

SEQ ID NO: 4991 - DNA, 22 bp, Homo sapiens
ttcaaagcagagggtcaataca

SEQ ID NO: 4992 - DNA, 22 bp, Homo sapiens
gccctgccctctcggcactcgc

SEQ ID NO: 4993 - DNA, 22 bp, Homo sapiens
tactgacaggattgacagtaaa

SEQ ID NO: 4994 - DNA, 22 bp, Homo sapiens
ctggctcgcattatattttggg

SEQ ID NO: 4995 - DNA, 22 bp, Homo sapiens
ttactcgtgacaatgtccttga

SEQ ID NO: 4996 - DNA, 22 bp, Homo sapiens
tgcgggtcccagggtcacaggc

SEQ ID NO: 4997 - DNA, 22 bp, Homo sapiens
cagtggctggttagggacagga

SEQ ID NO: 4998 - DNA, 22 bp, Homo sapiens
gagatgcagaaccctcaggagc

SEQ ID NO: 4999 - DNA, 20 bp, Homo sapiens
tttgcgaggccaaggcgggc

SEQ ID NO: 5000 - DNA, 22 bp, Homo sapiens
aagttgttgttgaggtgggtaa

SEQ ID NO: 5001 - DNA, 22 bp, Homo sapiens
agggaagcagcagccgcctgtc

SEQ ID NO: 5002 - DNA, 22 bp, Homo sapiens
gaggcaggcagattgcttgagg

SEQ ID NO: 5003 - DNA, 22 bp, Homo sapiens
ttaggctgttcttgtgttgtta

SEQ ID NO: 5004 - DNA, 22 bp, Homo sapiens
attaaagctatccagtcatgaa

SEQ ID NO: 5005 - DNA, 22 bp, Homo sapiens
agacgcgcagaaggaagcggcc

SEQ ID NO: 5006 - DNA, 22 bp, Homo sapiens
ggcttttgtttcagctctgcta

SEQ ID NO: 5007 - DNA, 22 bp, Homo sapiens
agtgttagattcttactcagtt

SEQ ID NO: 5008 - DNA, 22 bp, Homo sapiens
gtagtcttatcagaatttttaa

SEQ ID NO: 5009 - DNA, 22 bp, Homo sapiens
ctgtggttggagtgcagtgaga

SEQ ID NO: 5010 - DNA, 22 bp, Homo sapiens
gggcggatcacctgaggtcagg

SEQ ID NO: 5011 - DNA, 22 bp, Homo sapiens
taggtctgtttgggaaatgtga

SEQ ID NO: 5012 - DNA, 22 bp, Homo sapiens
cccagttgttgccggctctgga

SEQ ID NO: 5013 - DNA, 22 bp, Homo sapiens
tatagcagcatgatttatagtc

SEQ ID NO: 5014 - DNA, 22 bp, Homo sapiens
cgttaataggtgcaaggtaagg

SEQ ID NO: 5015 - DNA, 22 bp, Homo sapiens
cctgtatggctattccttggac

SEQ ID NO: 5016 - DNA, 22 bp, Homo sapiens
acactccagggagggagggaat

SEQ ID NO: 5017 - DNA, 22 bp, Homo sapiens
gtgcacatcgtgcaggtttgtt

SEQ ID NO: 5018 - DNA, 22 bp, Homo sapiens
cgctccttgagcgtgtcggcct

SEQ ID NO: 5019 - DNA, 22 bp, Homo sapiens
gactactcaaactttctctata

SEQ ID NO: 5020 - DNA, 22 bp, Homo sapiens
cctgcgggctgtgctgaagcct

SEQ ID NO: 5021 - DNA, 22 bp, Homo sapiens
tggatgctgtaggacacgctct

SEQ ID NO: 5022 - DNA, 22 bp, Homo sapiens
ctccccagccctggtattctga

SEQ ID NO: 5023 - DNA, 22 bp, Homo sapiens
ttgagggtctggatctgctgct

SEQ ID NO: 5024 - DNA, 22 bp, Homo sapiens
atttttctctttccactgagat

SEQ ID NO: 5025 - DNA, 22 bp, Homo sapiens
gagcactgatttatttttgtct

SEQ ID NO: 5026 - DNA, 22 bp, Homo sapiens
gagacacaggcacagaagaggc

SEQ ID NO: 5027 - DNA, 22 bp, Homo sapiens
ctaggtgatccactgctctctt

SEQ ID NO: 5028 - DNA, 22 bp, Homo sapiens
ggagaggcttccagagtcgtgc

SEQ ID NO: 5029 - DNA, 22 bp, Homo sapiens
ctcgggcttgaggctgtttacc

SEQ ID NO: 5030 - DNA, 22 bp, Homo sapiens
cattgcactccagcctgggtaa

SEQ ID NO: 5031 - DNA, 22 bp, Homo sapiens
gcgctgcgcctcctcttccgca

SEQ ID NO: 5032 - DNA, 22 bp, Homo sapiens
cttgccttcagtccatcagtca

SEQ ID NO: 5033 - DNA, 22 bp, Homo sapiens
agtgctgggctatctactgcta

SEQ ID NO: 5034 - DNA, 21 bp, Homo sapiens
accaccctgtttatccagagg

SEQ ID NO: 5035 - DNA, 22 bp, Homo sapiens
ggaaaagtgttaaggtgttgat

SEQ ID NO: 5036 - DNA, 22 bp, Homo sapiens
gctgcgagctcttgttctgaga

SEQ ID NO: 5037 - DNA, 22 bp, Homo sapiens
cacagacagtgtccctttgttg

SEQ ID NO: 5038 - DNA, 22 bp, Homo sapiens
tgtgactggttgtcccgctttc

SEQ ID NO: 5039 - DNA, 22 bp, Homo sapiens
caggaggagggcagccgcctcc

SEQ ID NO: 5040 - DNA, 22 bp, Homo sapiens
ctcattgcaacctccgcctccc

SEQ ID NO: 5041 - DNA, 22 bp, Homo sapiens
tcttcaggtagtgagtggggtg

SEQ ID NO: 5042 - DNA, 22 bp, Homo sapiens
aaaactacatttgacattttgt

SEQ ID NO: 5043 - DNA, 22 bp, Homo sapiens
cggaagagggacagcgccagcc

SEQ ID NO: 5044 - DNA, 22 bp, Homo sapiens
gtgcagagaggaccttggggag

SEQ ID NO: 5045 - DNA, 22 bp, Homo sapiens
agcaggagtttgatgcttttat

SEQ ID NO: 5046 - DNA, 22 bp, Homo sapiens
tggcaagaactgcaattgcttt

SEQ ID NO: 5047 - DNA, 22 bp, Homo sapiens
ggatgacccgagtctggggaac

SEQ ID NO: 5048 - DNA, 22 bp, Homo sapiens
acccaggctggagtgcagtgat

SEQ ID NO: 5049 - DNA, 22 bp, Homo sapiens
agatttggcagtataaattctg

SEQ ID NO: 5050 - DNA, 22 bp, Homo sapiens
cactgcactccagcttgggcaa

SEQ ID NO: 5051 - DNA, 22 bp, Homo sapiens
tgctaataaactccaggctgag

SEQ ID NO: 5052 - DNA, 23 bp, Homo sapiens
cagagctggcttcatgggtgtgc

SEQ ID NO: 5053 - DNA, 22 bp, Homo sapiens
atgcacctgaactccatcagct

SEQ ID NO: 5054 - DNA, 22 bp, Homo sapiens
tttttagtagaggtgggtttca

SEQ ID NO: 5055 - DNA, 22 bp, Homo sapiens
gtctatatattgcttgaataat

SEQ ID NO: 5056 - DNA, 23 bp, Homo sapiens
tgggaatactgaaacaaccttat

SEQ ID NO: 5057 - DNA, 22 bp, Homo sapiens
aaagtgctgggattccaggcgt

SEQ ID NO: 5058 - DNA, 22 bp, Homo sapiens
gcaggcaggcttccttgaactg

SEQ ID NO: 5059 - DNA, 17 bp, Homo sapiens
gaggccaaggcaggcgg

SEQ ID NO: 5060 - DNA, 22 bp, Homo sapiens
tgggttttgtcctgatccatca

SEQ ID NO: 5061 - DNA, 22 bp, Homo sapiens
attcactgaatttcatgattat

SEQ ID NO: 5062 - DNA, 22 bp, Homo sapiens
tcttcctgtcaatgagaattaa

SEQ ID NO: 5063 - DNA, 22 bp, Homo sapiens
gcaggcggaggttgcagtgagc

SEQ ID NO: 5064 - DNA, 22 bp, Homo sapiens
tctggagataagcagcaatgaa

SEQ ID NO: 5065 - DNA, 22 bp, Homo sapiens
cccacgtcgaacttgctccaga

SEQ ID NO: 5066 - DNA, 22 bp, Homo sapiens
ttccatttggcacttcactgag

SEQ ID NO: 5067 - DNA, 22 bp, Homo sapiens
gcccatgcactttctgtgatgg

SEQ ID NO: 5068 - DNA, 22 bp, Homo sapiens
gtcttttgctagccagagagct

SEQ ID NO: 5069 - DNA, 22 bp, Homo sapiens
tagtcagtgcacagacacttgt

SEQ ID NO: 5070 - DNA, 22 bp, Homo sapiens
attctcaaaacataacttcact

SEQ ID NO: 5071 - DNA, 22 bp, Homo sapiens
gcgactgtacagaattgcccct

SEQ ID NO: 5072 - DNA, 22 bp, Homo sapiens
gcacttcatgactttgtcaaat

SEQ ID NO: 5073 - DNA, 23 bp, Homo sapiens
ctatttctcatagttcaggtctt

SEQ ID NO: 5074 - DNA, 22 bp, Homo sapiens
atatatgcgcaggcacccagct

SEQ ID NO: 5075 - DNA, 22 bp, Homo sapiens
tgagtggacacctgcttcttta

SEQ ID NO: 5076 - DNA, 22 bp, Homo sapiens
cgtttagttgtcccttcttaaa

SEQ ID NO: 5077 - DNA, 22 bp, Homo sapiens
cactgcactccagcctgggcaa

SEQ ID NO: 5078 - DNA, 22 bp, Homo sapiens
gcccccgtagtagatgaggcgc

SEQ ID NO: 5079 - DNA, 22 bp, Homo sapiens
agagagcagtggatcacctagc

SEQ ID NO: 5080 - DNA, 22 bp, Homo sapiens
ggtcgctgtgtaggttcagcta

SEQ ID NO: 5081 - DNA, 22 bp, Homo sapiens
ttctgcaggctgtacaagaagc

SEQ ID NO: 5082 - DNA, 22 bp, Homo sapiens
aatggcaaggaaaccgttacca

SEQ ID NO: 5083 - DNA, 22 bp, Homo sapiens
agactcagccacacaagactac

SEQ ID NO: 5084 - DNA, 22 bp, Homo sapiens
ggatcctaaacttcggcatgcc

SEQ ID NO: 5085 - DNA, 23 bp, Homo sapiens
gctcatcaggcttagagtcaagg

SEQ ID NO: 5086 - DNA, 22 bp, Homo sapiens
tacataggtacagcctttttta

SEQ ID NO: 5087 - DNA, 22 bp, Homo sapiens
gatgctgagagattggagacta

SEQ ID NO: 5088 - DNA, 22 bp, Homo sapiens
tcaaatgttccctgtactggcc

SEQ ID NO: 5089 - DNA, 22 bp, Homo sapiens
tagggtacatgtgcacaacatg

SEQ ID NO: 5090 - DNA, 22 bp, Homo sapiens
tctggctctggagtccacctgc

SEQ ID NO: 5091 - DNA, 22 bp, Homo sapiens
tcagtgttaatcagtggtacct

SEQ ID NO: 5092 - DNA, 22 bp, Homo sapiens
gacagctccagctcctccaggc

SEQ ID NO: 5093 - DNA, 22 bp, Homo sapiens
agcctctctgttagtcactggg

SEQ ID NO: 5094 - DNA, 22 bp, Homo sapiens
cccaggccccagggcttgtcag

SEQ ID NO: 5095 - DNA, 22 bp, Homo sapiens
atatattttttgagacagagtc

SEQ ID NO: 5096 - DNA, 22 bp, Homo sapiens
tccagggagagccgctgctcca

SEQ ID NO: 5097 - DNA, 22 bp, Homo sapiens
cagctgctgttcagttttgttt

SEQ ID NO: 5098 - DNA, 22 bp, Homo sapiens
tgccgcactcggccaccagctg

SEQ ID NO: 5099 - DNA, 22 bp, Homo sapiens
tacgttttaaacacggagccag

SEQ ID NO: 5100 - DNA, 22 bp, Homo sapiens
agttatgtcctcagcaaatcaa

SEQ ID NO: 5101 - DNA, 22 bp, Homo sapiens
ggatgacagatgcaggctttga

SEQ ID NO: 5102 - DNA, 22 bp, Homo sapiens
tcactacaacctccgcctcctg

SEQ ID NO: 5103 - DNA, 22 bp, Homo sapiens
gcatgtgtctttatagcagcat

SEQ ID NO: 5104 - DNA, 22 bp, Homo sapiens
acccaggctggcgtgcagtggc

SEQ ID NO: 5105 - DNA, 22 bp, Homo sapiens
ctcggcaggtggaggttgtagt

SEQ ID NO: 5106 - DNA, 22 bp, Homo sapiens
gttccggaagtgactgatccgc

SEQ ID NO: 5107 - DNA, 23 bp, Homo sapiens
cggatttgactgaggtcctgcca

SEQ ID NO: 5108 - DNA, 22 bp, Homo sapiens
tcacttagatggggatcatcac

SEQ ID NO: 5109 - DNA, 22 bp, Homo sapiens
tgagctgacacccaatcatact

SEQ ID NO: 5110 - DNA, 22 bp, Homo sapiens
attgcactccagcctgggcaac

SEQ ID NO: 5111 - DNA, 23 bp, Homo sapiens
tcaagcaattctcctgcctcggc

SEQ ID NO: 5112 - DNA, 22 bp, Homo sapiens
aatgctgagtcctgtgagtctt

SEQ ID NO: 5113 - DNA, 22 bp, Homo sapiens
atatccagcagcaggtgagtat

SEQ ID NO: 5114 - DNA, 22 bp, Homo sapiens
tctcagggctcagagctcaggc

SEQ ID NO: 5115 - DNA, 21 bp, Homo sapiens
tcttttctcagctttgtggtt

SEQ ID NO: 5116 - DNA, 19 bp, Homo sapiens
tctcaattctccccactgc

SEQ ID NO: 5117 - DNA, 22 bp, Homo sapiens
agtcgctgttggtcgtggcact

SEQ ID NO: 5118 - DNA, 22 bp, Homo sapiens
atgtcttctctgtaggtaaatt

SEQ ID NO: 5119 - DNA, 19 bp, Homo sapiens
ggcttcgaggctggggaag

SEQ ID NO: 5120 - DNA, 22 bp, Homo sapiens
tcctgccttgcctgggacatca

SEQ ID NO: 5121 - DNA, 22 bp, Homo sapiens
gttgccatctgagaagagcagc

SEQ ID NO: 5122 - DNA, 22 bp, Homo sapiens
atgtaattattaacacctgtgc

SEQ ID NO: 5123 - DNA, 22 bp, Homo sapiens
gtgctcatagatgatgctcttt

SEQ ID NO: 5124 - DNA, 23 bp, Homo sapiens
aagttagtttcaataaagcaatt

SEQ ID NO: 5125 - DNA, 20 bp, Homo sapiens
tagcatgggtgagggtagag

SEQ ID NO: 5126 - DNA, 22 bp, Homo sapiens
ctgcaagctacccctagcatca

SEQ ID NO: 5127 - DNA, 22 bp, Homo sapiens
ttgttggaaatgagaggctagg

SEQ ID NO: 5128 - DNA, 22 bp, Homo sapiens
gtttgagaacaaaaggggacct

SEQ ID NO: 5129 - DNA, 22 bp, Homo sapiens
gcaggcattagcccccatggct

SEQ ID NO: 5130 - DNA, 22 bp, Homo sapiens
tccagaatcaatagcagttatc

SEQ ID NO: 5131 - DNA, 20 bp, Homo sapiens
tcacatcctctcccaacatg

SEQ ID NO: 5132 - DNA, 22 bp, Homo sapiens
ttggtccactgtgaaattggga

SEQ ID NO: 5133 - DNA, 21 bp, Homo sapiens
agcgtcaatatcgtcaacagg

SEQ ID NO: 5134 - DNA, 22 bp, Homo sapiens
ggctcagatggtttgttctaga

SEQ ID NO: 5135 - DNA, 22 bp, Homo sapiens
aagggctctgtgcttgtcccat

SEQ ID NO: 5136 - DNA, 22 bp, Homo sapiens
agttctttgcatagatttggct

SEQ ID NO: 5137 - DNA, 22 bp, Homo sapiens
gaatgctacttgactcagctca

SEQ ID NO: 5138 - DNA, 22 bp, Homo sapiens
acctcctccaaggagccatagg

SEQ ID NO: 5139 - DNA, 20 bp, Homo sapiens
gtctccactgggggttaacc

SEQ ID NO: 5140 - DNA, 22 bp, Homo sapiens
tgaagtatggaatgtagaagtg

SEQ ID NO: 5141 - DNA, 22 bp, Homo sapiens
agggttcagtccagggcctggg

SEQ ID NO: 5142 - DNA, 22 bp, Homo sapiens
cactgggagcagctccaacatt

SEQ ID NO: 5143 - DNA, 23 bp, Homo sapiens
gttttacaggtgagaaaatggag

SEQ ID NO: 5144 - DNA, 22 bp, Homo sapiens
atgtgggccgtgcgggtgtcct

SEQ ID NO: 5145 - DNA, 22 bp, Homo sapiens
ccagtgtgcaatctctggctta

SEQ ID NO: 5146 - DNA, 19 bp, Homo sapiens
ttccatctatcttcttact

SEQ ID NO: 5147 - DNA, 22 bp, Homo sapiens
actcttgattgatttagtcttt

SEQ ID NO: 5148 - DNA, 22 bp, Homo sapiens
ggagtgcagtggcgtgatctcg

SEQ ID NO: 5149 - DNA, 22 bp, Homo sapiens
tggttattaaggcctctttcag

SEQ ID NO: 5150 - DNA, 22 bp, Homo sapiens
tgagatgtaaggtatgcttact

SEQ ID NO: 5151 - DNA, 22 bp, Homo sapiens
ttggatttgtctaccagggaat

SEQ ID NO: 5152 - DNA, 22 bp, Homo sapiens
tgccacagacaggacagaacag

SEQ ID NO: 5153 - DNA, 22 bp, Homo sapiens
caatcactctgcaacattcctg

SEQ ID NO: 5154 - DNA, 22 bp, Homo sapiens
tgtgagaaatataggccgtgct

SEQ ID NO: 5155 - DNA, 22 bp, Homo sapiens
accatgtcatttattggccaaa

SEQ ID NO: 5156 - DNA, 22 bp, Homo sapiens
tgtgcggggaagggctcactca

SEQ ID NO: 5157 - DNA, 22 bp, Homo sapiens
caaagctggaaaaggaggctgg

SEQ ID NO: 5158 - DNA, 22 bp, Homo sapiens
gcatacttcttgctgctttcag

SEQ ID NO: 5159 - DNA, 22 bp, Homo sapiens
atataatttttggttagctcaa

SEQ ID NO: 5160 - DNA, 19 bp, Homo sapiens
tgccgctcgaggctctggg

SEQ ID NO: 5161 - DNA, 22 bp, Homo sapiens
actgagctccaagcctggaatc

SEQ ID NO: 5162 - DNA, 18 bp, Homo sapiens
gtcaggcatgaatctggg

SEQ ID NO: 5163 - DNA, 22 bp, Homo sapiens
tactaattgttcacacttgttt

SEQ ID NO: 5164 - DNA, 22 bp, Homo sapiens
ttcctccagccatgattgtaaa

SEQ ID NO: 5165 - DNA, 22 bp, Homo sapiens
gccaaggccctgtctgttttac

SEQ ID NO: 5166 - DNA, 22 bp, Homo sapiens
agcctgggccctgcctcttctc

SEQ ID NO: 5167 - DNA, 20 bp, Homo sapiens
gctgaggtggaggaaggaga

SEQ ID NO: 5168 - DNA, 22 bp, Homo sapiens
gccaaactacaagttaaatttt

SEQ ID NO: 5169 - DNA, 22 bp, Homo sapiens
agcatagagtcctgagggcagg

SEQ ID NO: 5170 - DNA, 22 bp, Homo sapiens
cagcctgccgtcagccaggtag

SEQ ID NO: 5171 - DNA, 22 bp, Homo sapiens
tggaatcattgctgtgttgctt

SEQ ID NO: 5172 - DNA, 22 bp, Homo sapiens
aggccacggcgggtggattact

SEQ ID NO: 5173 - DNA, 23 bp, Homo sapiens
tcatgcccaggctccagatgtca

SEQ ID NO: 5174 - DNA, 22 bp, Homo sapiens
ttgctttgcagtgcctatagga

SEQ ID NO: 5175 - DNA, 22 bp, Homo sapiens
aagatgattatgtagattggga

SEQ ID NO: 5176 - DNA, 22 bp, Homo sapiens
agccgcaagaagtacagcagca

SEQ ID NO: 5177 - DNA, 22 bp, Homo sapiens
ctaaatctcatcatgtacctcc

SEQ ID NO: 5178 - DNA, 22 bp, Homo sapiens
tggccactgctctcaagctcag

SEQ ID NO: 5179 - DNA, 22 bp, Homo sapiens
tggaggctggagtgcagtggcg

SEQ ID NO: 5180 - DNA, 22 bp, Homo sapiens
atcttctcatgtgtaatgaggt

SEQ ID NO: 5181 - DNA, 22 bp, Homo sapiens
aaggtggaggttgcagtgagct

SEQ ID NO: 5182 - DNA, 22 bp, Homo sapiens
gcagggtttagcacctgtagct

SEQ ID NO: 5183 - DNA, 22 bp, Homo sapiens
gtcagcgtgctcagcctattat

SEQ ID NO: 5184 - DNA, 22 bp, Homo sapiens
gcaggctgtctaaagttagagt

SEQ ID NO: 5185 - DNA, 22 bp, Homo sapiens
gcgctcctgagggttctgcatc

SEQ ID NO: 5186 - DNA, 22 bp, Homo sapiens
tatgatagttttttaaatgtcc

SEQ ID NO: 5187 - DNA, 23 bp, Homo sapiens
aatggcggaaagaacacagaggg

SEQ ID NO: 5188 - DNA, 22 bp, Homo sapiens
cagcagcccacgcgtgctgtcc

SEQ ID NO: 5189 - DNA, 20 bp, Homo sapiens
tgacatagctcttggggtgc

SEQ ID NO: 5190 - DNA, 22 bp, Homo sapiens
ggcctcgcggcttctggtggct

SEQ ID NO: 5191 - DNA, 22 bp, Homo sapiens
ttgaatctgggtacttgtaata

SEQ ID NO: 5192 - DNA, 22 bp, Homo sapiens
ctcgattgagtaggccagcact

SEQ ID NO: 5193 - DNA, 22 bp, Homo sapiens
tttgctggagatgagcgtgggt

SEQ ID NO: 5194 - DNA, 22 bp, Homo sapiens
gcgccccatctacagtactttt

SEQ ID NO: 5195 - DNA, 22 bp, Homo sapiens
gtcacctcgctgtcttcctgag

SEQ ID NO: 5196 - DNA, 17 bp, Homo sapiens
gagacccccactacacc

SEQ ID NO: 5197 - DNA, 22 bp, Homo sapiens
ttccctccatttcattttataa

SEQ ID NO: 5198 - DNA, 22 bp, Homo sapiens
tctgccttctatcttttgtctg

SEQ ID NO: 5199 - DNA, 22 bp, Homo sapiens
ctcatcagaaatacctgacaaa

SEQ ID NO: 5200 - DNA, 22 bp, Homo sapiens
tgagatgtcatagttcagttca

SEQ ID NO: 5201 - DNA, 22 bp, Homo sapiens
aggggatggagctggaaggcag

SEQ ID NO: 5202 - DNA, 16 bp, Homo sapiens
aggctcagaggctgga

SEQ ID NO: 5203 - DNA, 22 bp, Homo sapiens
gcgcaccacctccaggtggccg

SEQ ID NO: 5204 - DNA, 22 bp, Homo sapiens
ccttcccatgcagcctgtctga

SEQ ID NO: 5205 - DNA, 22 bp, Homo sapiens
agatgaatccacacatggcaaa

SEQ ID NO: 5206 - DNA, 22 bp, Homo sapiens
aagctgtagcttttcaaaacgt

SEQ ID NO: 5207 - DNA, 22 bp, Homo sapiens
tggccgggaagggacagtgtgg

SEQ ID NO: 5208 - DNA, 22 bp, Homo sapiens
tctcgacagcctggcacagtgg

SEQ ID NO: 5209 - DNA, 22 bp, Homo sapiens
gactacaggccggcatcagaga

SEQ ID NO: 5210 - DNA, 22 bp, Homo sapiens
gtgggtgtgggcttagcccaga

SEQ ID NO: 5211 - DNA, 22 bp, Homo sapiens
ttgacacagtcaacttgatttt

SEQ ID NO: 5212 - DNA, 23 bp, Homo sapiens
attttttgtctttgtaactagat

SEQ ID NO: 5213 - DNA, 21 bp, Homo sapiens
tttgtggaattctcactcttc

SEQ ID NO: 5214 - DNA, 22 bp, Homo sapiens
tatctgatacaacagaataaca

SEQ ID NO: 5215 - DNA, 22 bp, Homo sapiens
ttagatttgtagtgagttcaga

SEQ ID NO: 5216 - DNA, 22 bp, Homo sapiens
ccaaaaggaactttttgaaggt

SEQ ID NO: 5217 - DNA, 22 bp, Homo sapiens
ttttgcaatgagatgcttgtca

SEQ ID NO: 5218 - DNA, 22 bp, Homo sapiens
tcatgttgaattatcgttccca

SEQ ID NO: 5219 - DNA, 22 bp, Homo sapiens
agagctgtgtttagtagttacg

SEQ ID NO: 5220 - DNA, 22 bp, Homo sapiens
tggtgggctgagtctcatcgga

SEQ ID NO: 5221 - DNA, 22 bp, Homo sapiens
tcagggctgcagaagaggcagg

SEQ ID NO: 5222 - DNA, 22 bp, Homo sapiens
tcttggtatacgcatggcattg

SEQ ID NO: 5223 - DNA, 22 bp, Homo sapiens
aggaaggcttctttggtcttct

SEQ ID NO: 5224 - DNA, 22 bp, Homo sapiens
cctcagctcccatgagatctgc

SEQ ID NO: 5225 - DNA, 22 bp, Homo sapiens
agagggatcaccctgtttctgg

SEQ ID NO: 5226 - DNA, 21 bp, Homo sapiens
ctagaaagaatgttgtcgtct

SEQ ID NO: 5227 - DNA, 22 bp, Homo sapiens
agggactatttacccatctcac

SEQ ID NO: 5228 - DNA, 22 bp, Homo sapiens
aactgaggtatctgctgtgttt

SEQ ID NO: 5229 - DNA, 22 bp, Homo sapiens
cttggtgtcatgggtcagcagc

SEQ ID NO: 5230 - DNA, 22 bp, Homo sapiens
acgaggaagcgacccttgcccg

SEQ ID NO: 5231 - DNA, 22 bp, Homo sapiens
ctacccttaagtttctgtgggg

SEQ ID NO: 5232 - DNA, 22 bp, Homo sapiens
agggtgaatctcacaactctta

SEQ ID NO: 5233 - DNA, 22 bp, Homo sapiens
cttggtctataggagagattgt

SEQ ID NO: 5234 - DNA, 22 bp, Homo sapiens
ctgtggtcatgagtccttccat

SEQ ID NO: 5235 - DNA, 22 bp, Homo sapiens
tccgccaggactgagggcccat

SEQ ID NO: 5236 - DNA, 22 bp, Homo sapiens
tagagcattatgacaaccccat

SEQ ID NO: 5237 - DNA, 22 bp, Homo sapiens
ctcataaggagctcacaaccta

SEQ ID NO: 5238 - DNA, 22 bp, Homo sapiens
atggggagctcaccacctgttt

SEQ ID NO: 5239 - DNA, 22 bp, Homo sapiens
gtcctgacggctgattggcctg

SEQ ID NO: 5240 - DNA, 22 bp, Homo sapiens
tcctcgatgggcaggaagatct

SEQ ID NO: 5241 - DNA, 22 bp, Homo sapiens
tttgatccgttgctggtgagga

SEQ ID NO: 5242 - DNA, 22 bp, Homo sapiens
catgtgtgtctccaccagctgc

SEQ ID NO: 5243 - DNA, 22 bp, Homo sapiens
gcgtttgttttgctggcgccag

SEQ ID NO: 5244 - DNA, 22 bp, Homo sapiens
actggacagaggaaatatggag

SEQ ID NO: 5245 - DNA, 22 bp, Homo sapiens
ggcgcccccttcaaacagagca

SEQ ID NO: 5246 - DNA, 22 bp, Homo sapiens
acccagtgagcccgaccgatgg

SEQ ID NO: 5247 - DNA, 22 bp, Homo sapiens
tcccaatagcctaagagcctgg

SEQ ID NO: 5248 - DNA, 22 bp, Homo sapiens
gagaacagaagcattcctaatt

SEQ ID NO: 5249 - DNA, 22 bp, Homo sapiens
gcctggccaacgtggtgaaacc

SEQ ID NO: 5250 - DNA, 22 bp, Homo sapiens
acaaacagagttgaaaaatagg

SEQ ID NO: 5251 - DNA, 22 bp, Homo sapiens
tcagtggtgaagtggtgcacca

SEQ ID NO: 5252 - DNA, 22 bp, Homo sapiens
cactgcagcctcgctctcctga

SEQ ID NO: 5253 - DNA, 22 bp, Homo sapiens
cctagagctctgctttatctaa

SEQ ID NO: 5254 - DNA, 22 bp, Homo sapiens
gctcaagacccctctgtgactg

SEQ ID NO: 5255 - DNA, 22 bp, Homo sapiens
ctgaggaaggctgggggcatcc

SEQ ID NO: 5256 - DNA, 22 bp, Homo sapiens
gattgcgtctgtgtcaccttca

SEQ ID NO: 5257 - DNA, 22 bp, Homo sapiens
tcgccccgaggcagccctatgc

SEQ ID NO: 5258 - DNA, 22 bp, Homo sapiens
gcttttgaggtcctgctcagcc

SEQ ID NO: 5259 - DNA, 19 bp, Homo sapiens
agtgagtgtacagtagaat

SEQ ID NO: 5260 - DNA, 22 bp, Homo sapiens
gggcatgtcccgctgtgcaccg

SEQ ID NO: 5261 - DNA, 22 bp, Homo sapiens
tgggccacacacagaagaatca

SEQ ID NO: 5262 - DNA, 23 bp, Homo sapiens
aggatgtaggatgtatggcagag

SEQ ID NO: 5263 - DNA, 23 bp, Homo sapiens
ctgtggtgaggccctagaatctg

SEQ ID NO: 5264 - DNA, 22 bp, Homo sapiens
agctacagtcggaaggacagac

SEQ ID NO: 5265 - DNA, 20 bp, Homo sapiens
tctcgcactcggagcagccg

SEQ ID NO: 5266 - DNA, 23 bp, Homo sapiens
aaactacaacgccaggcactgag

SEQ ID NO: 5267 - DNA, 22 bp, Homo sapiens
ttgggctgaaccctgcagctga

SEQ ID NO: 5268 - DNA, 22 bp, Homo sapiens
ggaggtggaggttgcagtgagc

SEQ ID NO: 5269 - DNA, 22 bp, Homo sapiens
ggaggcggaggttgcagtgagt

SEQ ID NO: 5270 - DNA, 22 bp, Homo sapiens
ctgagcctcctgcttctatttc

SEQ ID NO: 5271 - DNA, 22 bp, Homo sapiens
ggagtgctttgaagccttcatt

SEQ ID NO: 5272 - DNA, 22 bp, Homo sapiens
ctcattgcagctgcattactgt

SEQ ID NO: 5273 - DNA, 22 bp, Homo sapiens
ggaggaggggtgactgaatgct

SEQ ID NO: 5274 - DNA, 20 bp, Homo sapiens
tttgagaccagtctgcccaa

SEQ ID NO: 5275 - DNA, 22 bp, Homo sapiens
ttcattcttttacatgtgaata

SEQ ID NO: 5276 - DNA, 22 bp, Homo sapiens
taaaggtagtgtgacatattgt

SEQ ID NO: 5277 - DNA, 22 bp, Homo sapiens
cactcagctgagccctcagccc

SEQ ID NO: 5278 - DNA, 22 bp, Homo sapiens
gggagccccacctcggtgcccg

SEQ ID NO: 5279 - DNA, 22 bp, Homo sapiens
ccacaagtttgttgattgaaac

SEQ ID NO: 5280 - DNA, 22 bp, Homo sapiens
ctggggtcagggatcagagagc

SEQ ID NO: 5281 - DNA, 22 bp, Homo sapiens
tccttgcagggtttgataaaga

SEQ ID NO: 5282 - DNA, 22 bp, Homo sapiens
cagggcgaacttggcggtgggc

SEQ ID NO: 5283 - DNA, 22 bp, Homo sapiens
catggcattgcataacggggct

SEQ ID NO: 5284 - DNA, 22 bp, Homo sapiens
ctccgcttgtgtatacctccaa

SEQ ID NO: 5285 - DNA, 22 bp, Homo sapiens
tgtcctgcccaaggtcacatac

SEQ ID NO: 5286 - DNA, 20 bp, Homo sapiens
tcccccactgtttctgctac

SEQ ID NO: 5287 - DNA, 23 bp, Homo sapiens
actgagccagggcctgggtcagc

SEQ ID NO: 5288 - DNA, 23 bp, Homo sapiens
ctcctggtgctgctatcaggggt

SEQ ID NO: 5289 - DNA, 22 bp, Homo sapiens
ccctcaggtgaaaggaaaaatt

SEQ ID NO: 5290 - DNA, 22 bp, Homo sapiens
atgctatgtaactggcagatag

SEQ ID NO: 5291 - DNA, 22 bp, Homo sapiens
ttagattctgttgttgctagtg

SEQ ID NO: 5292 - DNA, 22 bp, Homo sapiens
cagggaaagtcccaccccacac

SEQ ID NO: 5293 - DNA, 22 bp, Homo sapiens
acaggggaatttactgtcatta

SEQ ID NO: 5294 - DNA, 22 bp, Homo sapiens
agcccagaggctgggcgtgcat

SEQ ID NO: 5295 - DNA, 22 bp, Homo sapiens
cagtggatcctctgactccctc

SEQ ID NO: 5296 - DNA, 17 bp, Homo sapiens
tggtagaatgacaggcc

SEQ ID NO: 5297 - DNA, 22 bp, Homo sapiens
ccacctgagataagagagctca

SEQ ID NO: 5298 - DNA, 22 bp, Homo sapiens
ccaggaggcggaggttgcagtg

SEQ ID NO: 5299 - DNA, 22 bp, Homo sapiens
cctgtaatcccagctactcggg

SEQ ID NO: 5300 - DNA, 22 bp, Homo sapiens
caggctgtccaggctcctttgg

SEQ ID NO: 5301 - DNA, 22 bp, Homo sapiens
gactttctgatgtaaacattta

SEQ ID NO: 5302 - DNA, 22 bp, Homo sapiens
tcactgcaagctcctcctcctg

SEQ ID NO: 5303 - DNA, 22 bp, Homo sapiens
gtattgcttgagcccaggagtt

SEQ ID NO: 5304 - DNA, 22 bp, Homo sapiens
tccttaggaaaatgatgagggg

SEQ ID NO: 5305 - DNA, 22 bp, Homo sapiens
aggtaaacaggagaaaatgaga

SEQ ID NO: 5306 - DNA, 22 bp, Homo sapiens
ccccaggacgtggccctcatag

SEQ ID NO: 5307 - DNA, 22 bp, Homo sapiens
ccctggctgataccggaaaggc

SEQ ID NO: 5308 - DNA, 22 bp, Homo sapiens
ctcactgcaacctctgccccca

SEQ ID NO: 5309 - DNA, 22 bp, Homo sapiens
ttattttaccttcctctgagct

SEQ ID NO: 5310 - DNA, 22 bp, Homo sapiens
aaaccggggcctttccacaatg

SEQ ID NO: 5311 - DNA, 23 bp, Homo sapiens
caccactttctccttctccttgg

SEQ ID NO: 5312 - DNA, 22 bp, Homo sapiens
acaaagtgctgacattacaggc

SEQ ID NO: 5313 - DNA, 22 bp, Homo sapiens
gcacatgagaagctggcgatgc

SEQ ID NO: 5314 - DNA, 22 bp, Homo sapiens
ctgaggggatgtttttgacgga

SEQ ID NO: 5315 - DNA, 22 bp, Homo sapiens
aggaggggttctcgggtgctga

SEQ ID NO: 5316 - DNA, 22 bp, Homo sapiens
gtagaccatttatctggggagt

SEQ ID NO: 5317 - DNA, 22 bp, Homo sapiens
acaactttgacccttgttctta

SEQ ID NO: 5318 - DNA, 22 bp, Homo sapiens
tgagccagaggaggctgtgtgg

SEQ ID NO: 5319 - DNA, 21 bp, Homo sapiens
aagaggaagcattatggcata

SEQ ID NO: 5320 - DNA, 22 bp, Homo sapiens
cgtgattggcttctgcattgga

SEQ ID NO: 5321 - DNA, 22 bp, Homo sapiens
aaggtggcggctgccaggtcct

SEQ ID NO: 5322 - DNA, 22 bp, Homo sapiens
cttccccaggacctctgctaaa

SEQ ID NO: 5323 - DNA, 22 bp, Homo sapiens
aggtgaacccaggtgcttcacg

SEQ ID NO: 5324 - DNA, 22 bp, Homo sapiens
tcaggtccaagatggccatcca

SEQ ID NO: 5325 - DNA, 23 bp, Homo sapiens
cttcacaggttcaggggattaag

SEQ ID NO: 5326 - DNA, 22 bp, Homo sapiens
caagaggattattaataaataa

SEQ ID NO: 5327 - DNA, 22 bp, Homo sapiens
ggcggcttattcactctgggga

SEQ ID NO: 5328 - DNA, 22 bp, Homo sapiens
ttcagacatgcaggctgaggct

SEQ ID NO: 5329 - DNA, 22 bp, Homo sapiens
tgggttcgatgtatatgtagcc

SEQ ID NO: 5330 - DNA, 17 bp, Homo sapiens
cccgttctcttcgctgg

SEQ ID NO: 5331 - DNA, 22 bp, Homo sapiens
tagcacagagcttttaaacttc

SEQ ID NO: 5332 - DNA, 21 bp, Homo sapiens
tctgcaccccagcctgagtga

SEQ ID NO: 5333 - DNA, 22 bp, Homo sapiens
atagaataatggttgtcaggag

SEQ ID NO: 5334 - DNA, 22 bp, Homo sapiens
agagcacagggttttgtgccgg

SEQ ID NO: 5335 - DNA, 22 bp, Homo sapiens
gctcgcttagattttcctctga

SEQ ID NO: 5336 - DNA, 22 bp, Homo sapiens
aggttatcatcagttgagcact

SEQ ID NO: 5337 - DNA, 22 bp, Homo sapiens
tgaactgtacatccctaaccta

SEQ ID NO: 5338 - DNA, 22 bp, Homo sapiens
atgtatacgtgcaggtcacagg

SEQ ID NO: 5339 - DNA, 22 bp, Homo sapiens
aacggctagcaggggtgtcatg

SEQ ID NO: 5340 - DNA, 17 bp, Homo sapiens
ggcccggtgacgtcact

SEQ ID NO: 5341 - DNA, 22 bp, Homo sapiens
tctagctctgcttatcatggct

SEQ ID NO: 5342 - DNA, 23 bp, Homo sapiens
tcaagtaatactcccatcttggc

SEQ ID NO: 5343 - DNA, 22 bp, Homo sapiens
tagaacctccacaggacctcca

SEQ ID NO: 5344 - DNA, 22 bp, Homo sapiens
tcggagcgtcactggctggagg

SEQ ID NO: 5345 - DNA, 22 bp, Homo sapiens
aatggcaagagccacagaggcg

SEQ ID NO: 5346 - DNA, 22 bp, Homo sapiens
tgaggaaacttacaaggcagaa

SEQ ID NO: 5347 - DNA, 22 bp, Homo sapiens
agcctggtttaagcattttata

SEQ ID NO: 5348 - DNA, 22 bp, Homo sapiens
catccagtgggacagagaaacc

SEQ ID NO: 5349 - DNA, 22 bp, Homo sapiens
ctttggcaatgtcattttcaat

SEQ ID NO: 5350 - DNA, 22 bp, Homo sapiens
ctggctggagtgcaggtgagtg

SEQ ID NO: 5351 - DNA, 22 bp, Homo sapiens
tgacagtattgatggcaggatt

SEQ ID NO: 5352 - DNA, 22 bp, Homo sapiens
gatggcctcatggctgcaggcc

SEQ ID NO: 5353 - DNA, 22 bp, Homo sapiens
gaggccaaggtgggcagatcac

SEQ ID NO: 5354 - DNA, 22 bp, Homo sapiens
acggagcccgtgtcaggtggga

SEQ ID NO: 5355 - DNA, 22 bp, Homo sapiens
gtccttccacatggccaacttc

SEQ ID NO: 5356 - DNA, 22 bp, Homo sapiens
gctgtatgtgaggccacagtga

SEQ ID NO: 5357 - DNA, 22 bp, Homo sapiens
caggagttttaaatctagcatg

SEQ ID NO: 5358 - DNA, 22 bp, Homo sapiens
gccagttttctgaggattaagt

SEQ ID NO: 5359 - DNA, 22 bp, Homo sapiens
agatgctgctccacaggccagg

SEQ ID NO: 5360 - DNA, 22 bp, Homo sapiens
aaggcaaggcttccagctcccc

SEQ ID NO: 5361 - DNA, 22 bp, Homo sapiens
caatccatcaattacacaggct

SEQ ID NO: 5362 - DNA, 22 bp, Homo sapiens
ctgcgtgagcgtgcccgtcttg

SEQ ID NO: 5363 - DNA, 22 bp, Homo sapiens
caccgaggctggagtgcagtgg

SEQ ID NO: 5364 - DNA, 22 bp, Homo sapiens
gtgatatcttacaattctcttt

SEQ ID NO: 5365 - DNA, 22 bp, Homo sapiens
tgtctccaccatcatcttacca

SEQ ID NO: 5366 - DNA, 22 bp, Homo sapiens
actctgctctgtatttcactgt

SEQ ID NO: 5367 - DNA, 22 bp, Homo sapiens
ccacagtcctggcttctgtctg

SEQ ID NO: 5368 - DNA, 22 bp, Homo sapiens
agtgctgtctccttcccccggg

SEQ ID NO: 5369 - DNA, 22 bp, Homo sapiens
tgagatggagtctcactctgtt

SEQ ID NO: 5370 - DNA, 22 bp, Homo sapiens
ttttcctggagatggagttgtt

SEQ ID NO: 5371 - DNA, 22 bp, Homo sapiens
cactctgcagctgaagggctgg

SEQ ID NO: 5372 - DNA, 22 bp, Homo sapiens
agaggctgcacttgctcatgat

SEQ ID NO: 5373 - DNA, 22 bp, Homo sapiens
tgagaaacttgccaagcatctc

SEQ ID NO: 5374 - DNA, 22 bp, Homo sapiens
cttgtcttgcacacggttgcca

SEQ ID NO: 5375 - DNA, 22 bp, Homo sapiens
caagacttcaccgctctgtgct

SEQ ID NO: 5376 - DNA, 22 bp, Homo sapiens
acaccatactcatgttggttcc

SEQ ID NO: 5377 - DNA, 22 bp, Homo sapiens
gtatccatgggggattggttcc

SEQ ID NO: 5378 - DNA, 22 bp, Homo sapiens
cagtctctaaatcaatctgaat

SEQ ID NO: 5379 - DNA, 22 bp, Homo sapiens
tgaccaggctggagtgcagtgg

SEQ ID NO: 5380 - DNA, 22 bp, Homo sapiens
tagctttgtttatcaaggggca

SEQ ID NO: 5381 - DNA, 22 bp, Homo sapiens
aacccaggaggcagatgttgtg

SEQ ID NO: 5382 - DNA, 22 bp, Homo sapiens
tgttcctctgaacttcttccaa

SEQ ID NO: 5383 - DNA, 22 bp, Homo sapiens
gacttttgaataaggtaggata

SEQ ID NO: 5384 - DNA, 22 bp, Homo sapiens
gcctggagaaaggaaggtggga

SEQ ID NO: 5385 - DNA, 22 bp, Homo sapiens
ccctcccaggagtggccagaga

SEQ ID NO: 5386 - DNA, 22 bp, Homo sapiens
actgcacttcagcctgggtgac

SEQ ID NO: 5387 - DNA, 22 bp, Homo sapiens
tcttatacccctaaactgcagc

SEQ ID NO: 5388 - DNA, 22 bp, Homo sapiens
ccaattctgtagagttgattaa

SEQ ID NO: 5389 - DNA, 22 bp, Homo sapiens
cggcttctgcccattcagtcct

SEQ ID NO: 5390 - DNA, 19 bp, Homo sapiens
tcctgcccaccagccaggg

SEQ ID NO: 5391 - DNA, 22 bp, Homo sapiens
tgaagtcagggattccatgaag

SEQ ID NO: 5392 - DNA, 22 bp, Homo sapiens
tgggttagattccgcgaagcag

SEQ ID NO: 5393 - DNA, 22 bp, Homo sapiens
ctgcttaagcaagaaagcagca

SEQ ID NO: 5394 - DNA, 22 bp, Homo sapiens
ggtaacttagctcatggctgtg

SEQ ID NO: 5395 - DNA, 22 bp, Homo sapiens
attagggtaaggcttttcttag

SEQ ID NO: 5396 - DNA, 19 bp, Homo sapiens
cataatacagtggatctga

SEQ ID NO: 5397 - DNA, 22 bp, Homo sapiens
cactccagtctgggaacaaagc

SEQ ID NO: 5398 - DNA, 22 bp, Homo sapiens
gaccggttctgccgtggactgg

SEQ ID NO: 5399 - DNA, 22 bp, Homo sapiens
tttattctgtgctacatgaaga

SEQ ID NO: 5400 - DNA, 19 bp, Homo sapiens
tgaaggacagtgcacatca

SEQ ID NO: 5401 - DNA, 22 bp, Homo sapiens
aggcactgtgcagtcccaagca

SEQ ID NO: 5402 - DNA, 22 bp, Homo sapiens
gtccaagagtcaagaagggggc

SEQ ID NO: 5403 - DNA, 22 bp, Homo sapiens
cttcccaccaaagcccttgttg

SEQ ID NO: 5404 - DNA, 22 bp, Homo sapiens
tagtcccggaactccttcaggt

SEQ ID NO: 5405 - DNA, 22 bp, Homo sapiens
agaaggggcccaaggatgtcag

SEQ ID NO: 5406 - DNA, 22 bp, Homo sapiens
aagtgctgggattataggcatg

SEQ ID NO: 5407 - DNA, 22 bp, Homo sapiens
tgtcagggatttccaactcccc

SEQ ID NO: 5408 - DNA, 19 bp, Homo sapiens
ccctcttgcacaaagcaaa

SEQ ID NO: 5409 - DNA, 21 bp, Homo sapiens
aaggacgaggttttgattaca

SEQ ID NO: 5410 - DNA, 22 bp, Homo sapiens
gggccctgcgactcgcggcgga

SEQ ID NO: 5411 - DNA, 22 bp, Homo sapiens
tttcactcagctctcattgtct

SEQ ID NO: 5412 - DNA, 22 bp, Homo sapiens
tcgtgatctgtccacctcggcc

SEQ ID NO: 5413 - DNA, 22 bp, Homo sapiens
atgggtaaagcaggaagagagt

SEQ ID NO: 5414 - DNA, 22 bp, Homo sapiens
gcggcaggagtaaaggaggaag

SEQ ID NO: 5415 - DNA, 22 bp, Homo sapiens
ctctagctcccagggagcgtct

SEQ ID NO: 5416 - DNA, 22 bp, Homo sapiens
aggtcctcgtcgtgctgggcca

SEQ ID NO: 5417 - DNA, 22 bp, Homo sapiens
agatgtgtttctagttcctgca

SEQ ID NO: 5418 - DNA, 22 bp, Homo sapiens
ggctcactgcaagctccgcctc

SEQ ID NO: 5419 - DNA, 22 bp, Homo sapiens
aatgactaaatctgaagatagg

SEQ ID NO: 5420 - DNA, 22 bp, Homo sapiens
gtggttcacttgaggtcaggag

SEQ ID NO: 5421 - DNA, 22 bp, Homo sapiens
agtatgggtgtagattctgcaa

SEQ ID NO: 5422 - DNA, 21 bp, Homo sapiens
cccaaaagttctgagatggct

SEQ ID NO: 5423 - DNA, 22 bp, Homo sapiens
cgcggtggcggcctccagcgcc

SEQ ID NO: 5424 - DNA, 22 bp, Homo sapiens
tcctgggtccatggcagccgaa

SEQ ID NO: 5425 - DNA, 22 bp, Homo sapiens
tcaccttgtgatctccctgcct

SEQ ID NO: 5426 - DNA, 22 bp, Homo sapiens
cactgcaatatctgcatcctgg

SEQ ID NO: 5427 - DNA, 22 bp, Homo sapiens
cctgattcagtggtgcccagag

SEQ ID NO: 5428 - DNA, 22 bp, Homo sapiens
tcttgggggactttggcatgga

SEQ ID NO: 5429 - DNA, 22 bp, Homo sapiens
gttggggtgctataaaaatgat

SEQ ID NO: 5430 - DNA, 22 bp, Homo sapiens
cctgttgtttactgcagtgagt

SEQ ID NO: 5431 - DNA, 22 bp, Homo sapiens
ctggctttgatcagagtgacct

SEQ ID NO: 5432 - DNA, 22 bp, Homo sapiens
tgtctattcccccacctccgtt

SEQ ID NO: 5433 - DNA, 22 bp, Homo sapiens
ccacgacgagtcatcagggcga

SEQ ID NO: 5434 - DNA, 22 bp, Homo sapiens
ggcctggcagagcgcgcggctg

SEQ ID NO: 5435 - DNA, 21 bp, Homo sapiens
gcaattcgctatgatggtggc

SEQ ID NO: 5436 - DNA, 22 bp, Homo sapiens
gtggagaggaacccagctctgt

SEQ ID NO: 5437 - DNA, 20 bp, Homo sapiens
agtaggtgtccttcaggata

SEQ ID NO: 5438 - DNA, 22 bp, Homo sapiens
ctctcctattgtgtggtaagga

SEQ ID NO: 5439 - DNA, 22 bp, Homo sapiens
ggagctgaggacactacatttt

SEQ ID NO: 5440 - DNA, 22 bp, Homo sapiens
ccaggctggagtgcaatggcgt

SEQ ID NO: 5441 - DNA, 22 bp, Homo sapiens
aggggagccagggctgcgagtt

SEQ ID NO: 5442 - DNA, 22 bp, Homo sapiens
attgtactctagcctctgggca

SEQ ID NO: 5443 - DNA, 22 bp, Homo sapiens
cgcccaggctggagtgcagtgg

SEQ ID NO: 5444 - DNA, 22 bp, Homo sapiens
tggctcctcacgtcctcagagc

SEQ ID NO: 5445 - DNA, 22 bp, Homo sapiens
tggggtacacgtggggcaggat

SEQ ID NO: 5446 - DNA, 22 bp, Homo sapiens
tcctccagttccttggtttcag

SEQ ID NO: 5447 - DNA, 22 bp, Homo sapiens
agggcgacaatggagagcgttt

SEQ ID NO: 5448 - DNA, 22 bp, Homo sapiens
tggtggaattgtaaaatagtgt

SEQ ID NO: 5449 - DNA, 22 bp, Homo sapiens
tctgcatattgttaatggaatg

SEQ ID NO: 5450 - DNA, 22 bp, Homo sapiens
tggtggacgatgcccagctgga

SEQ ID NO: 5451 - DNA, 22 bp, Homo sapiens
cgcggctctgcgggccgctgag

SEQ ID NO: 5452 - DNA, 22 bp, Homo sapiens
tgagcttgcagtgccagccttg

SEQ ID NO: 5453 - DNA, 22 bp, Homo sapiens
ccctcaatgtctacagcagtcc

SEQ ID NO: 5454 - DNA, 22 bp, Homo sapiens
taacaactgctgaggtatttga

SEQ ID NO: 5455 - DNA, 22 bp, Homo sapiens
cacattccttacattcatagag

SEQ ID NO: 5456 - DNA, 22 bp, Homo sapiens
aaccagctaacatgtggaatga

SEQ ID NO: 5457 - DNA, 22 bp, Homo sapiens
ccacgcatccctccacagagag

SEQ ID NO: 5458 - DNA, 22 bp, Homo sapiens
cagccagtgtgaccgaggagga

SEQ ID NO: 5459 - DNA, 22 bp, Homo sapiens
ctttgctactgtgaatagtgcc

SEQ ID NO: 5460 - DNA, 22 bp, Homo sapiens
gttattgaggtggagtctcact

SEQ ID NO: 5461 - DNA, 19 bp, Homo sapiens
gggcttggggctgaagcct

SEQ ID NO: 5462 - DNA, 22 bp, Homo sapiens
gaccagtcattactcatgccct

SEQ ID NO: 5463 - DNA, 16 bp, Homo sapiens
cgagtgaagccttttc

SEQ ID NO: 5464 - DNA, 22 bp, Homo sapiens
ctcagcactttggaaggctgat

SEQ ID NO: 5465 - DNA, 22 bp, Homo sapiens
acccaggctggagtgcagtggg

SEQ ID NO: 5466 - DNA, 22 bp, Homo sapiens
attataggcttgagccaccgtg

SEQ ID NO: 5467 - DNA, 22 bp, Homo sapiens
gcaccgccttggaccgcccgct

SEQ ID NO: 5468 - DNA, 20 bp, Homo sapiens
cagagattttacttcctcac

SEQ ID NO: 5469 - DNA, 22 bp, Homo sapiens
tccgtggggcctgtggcttccg

SEQ ID NO: 5470 - DNA, 22 bp, Homo sapiens
ccacagtctatgcaacaaggtc

SEQ ID NO: 5471 - DNA, 22 bp, Homo sapiens
taaaggtctgaacacagtgagg

SEQ ID NO: 5472 - DNA, 22 bp, Homo sapiens
caacatggtaaaaccccgtctc

SEQ ID NO: 5473 - DNA, 22 bp, Homo sapiens
tccgcccgcacgtatggagtgg

SEQ ID NO: 5474 - DNA, 22 bp, Homo sapiens
gcataaactccaaaaggcaggg

SEQ ID NO: 5475 - DNA, 22 bp, Homo sapiens
tgtggactcgcatggctgaggc

SEQ ID NO: 5476 - DNA, 21 bp, Homo sapiens
aacaggtcccccacgggcttt

SEQ ID NO: 5477 - DNA, 16 bp, Homo sapiens
gaggagcccctctgcc

SEQ ID NO: 5478 - DNA, 19 bp, Homo sapiens
aatgtcagcatgttaattt

SEQ ID NO: 5479 - DNA, 22 bp, Homo sapiens
aagtcaggtgtctgatttgaac

SEQ ID NO: 5480 - DNA, 22 bp, Homo sapiens
tctcttgagctcagttctgatg

SEQ ID NO: 5481 - DNA, 22 bp, Homo sapiens
ttagcttttgagaatgatttct

SEQ ID NO: 5482 - DNA, 23 bp, Homo sapiens
ctcaaccctagtaagggagtagg

SEQ ID NO: 5483 - DNA, 22 bp, Homo sapiens
ggtagaaataatcttcaggctg

SEQ ID NO: 5484 - DNA, 22 bp, Homo sapiens
aatggaatacctaggtggccca

SEQ ID NO: 5485 - DNA, 22 bp, Homo sapiens
ggcatgattttggctcactgca

SEQ ID NO: 5486 - DNA, 21 bp, Homo sapiens
gacattgagcgtgtcgcagtg

SEQ ID NO: 5487 - DNA, 22 bp, Homo sapiens
atatatttgagaatattcatga

SEQ ID NO: 5488 - DNA, 23 bp, Homo sapiens
gcagccatgttcccgtctcagct

SEQ ID NO: 5489 - DNA, 22 bp, Homo sapiens
ttctgtccctctagagaaccat

SEQ ID NO: 5490 - DNA, 22 bp, Homo sapiens
aggctctcaccctctgaccaga

SEQ ID NO: 5491 - DNA, 22 bp, Homo sapiens
tggtcttagctggaaggaggga

SEQ ID NO: 5492 - DNA, 22 bp, Homo sapiens
ggtgttcaaatgaacacatgca

SEQ ID NO: 5493 - DNA, 22 bp, Homo sapiens
cacactgtctttcagaatggtt

SEQ ID NO: 5494 - DNA, 22 bp, Homo sapiens
agttttcattaccatgctgcaa

SEQ ID NO: 5495 - DNA, 19 bp, Homo sapiens
tctgccgagctagaccact

SEQ ID NO: 5496 - DNA, 22 bp, Homo sapiens
aaaggtcaaaatcgtgacattg

SEQ ID NO: 5497 - DNA, 22 bp, Homo sapiens
atcctccatctccatcggactg

SEQ ID NO: 5498 - DNA, 22 bp, Homo sapiens
agatacattgcacgatgcagat

SEQ ID NO: 5499 - DNA, 22 bp, Homo sapiens
aacccagggtggaggttgcagt

SEQ ID NO: 5500 - DNA, 22 bp, Homo sapiens
agttaagaatacacatcataat

SEQ ID NO: 5501 - DNA, 22 bp, Homo sapiens
ctcttcctagtgtgcagcgtgg

SEQ ID NO: 5502 - DNA, 22 bp, Homo sapiens
accagcctggccaacatggcaa

SEQ ID NO: 5503 - DNA, 22 bp, Homo sapiens
tcatggcttttattatgttgag

SEQ ID NO: 5504 - DNA, 22 bp, Homo sapiens
tctcatttacttccacaggctg

SEQ ID NO: 5505 - DNA, 22 bp, Homo sapiens
aactcaaagatgcatgacgctt

SEQ ID NO: 5506 - DNA, 22 bp, Homo sapiens
tcgagctctggagccaaggatg

SEQ ID NO: 5507 - DNA, 22 bp, Homo sapiens
gtagaagagattttattcctta

SEQ ID NO: 5508 - DNA, 22 bp, Homo sapiens
ccctctgcatacaggcgaggag

SEQ ID NO: 5509 - DNA, 22 bp, Homo sapiens
aagaagcaggtcacagacaggg

SEQ ID NO: 5510 - DNA, 22 bp, Homo sapiens
tcaatactaatcttgctggaag

SEQ ID NO: 5511 - DNA, 22 bp, Homo sapiens
gtgaggcgaaggtgctggcgcc

SEQ ID NO: 5512 - DNA, 21 bp, Homo sapiens
ctttagctctatgtcctgagg

SEQ ID NO: 5513 - DNA, 22 bp, Homo sapiens
actggggactctggccttttga

SEQ ID NO: 5514 - DNA, 22 bp, Homo sapiens
tgaccctgagagctgaatggct

SEQ ID NO: 5515 - DNA, 22 bp, Homo sapiens
taagggttcagaatgcagtggt

SEQ ID NO: 5516 - DNA, 22 bp, Homo sapiens
agctggtgctcggggagctggc

SEQ ID NO: 5517 - DNA, 22 bp, Homo sapiens
tttgaagactactgggagtgaa

SEQ ID NO: 5518 - DNA, 22 bp, Homo sapiens
agcatggccatctgggccgtcc

SEQ ID NO: 5519 - DNA, 22 bp, Homo sapiens
ctctagtagctgagattacagg

SEQ ID NO: 5520 - DNA, 21 bp, Homo sapiens
caaaagagactgattcttgga

SEQ ID NO: 5521 - DNA, 22 bp, Homo sapiens
atgcttccagattggtaggggt

SEQ ID NO: 5522 - DNA, 22 bp, Homo sapiens
gtgtttgttcgtgactccaaag

SEQ ID NO: 5523 - DNA, 22 bp, Homo sapiens
gcatatgatcacgtgtgtcggt

SEQ ID NO: 5524 - DNA, 22 bp, Homo sapiens
tttggcttctcctaccacctct

SEQ ID NO: 5525 - DNA, 22 bp, Homo sapiens
gcggcggagacagcaggaagcc

SEQ ID NO: 5526 - DNA, 22 bp, Homo sapiens
agctgcaccggctggaccactg

SEQ ID NO: 5527 - DNA, 22 bp, Homo sapiens
gtgagcagagatcgcgtgattg

SEQ ID NO: 5528 - DNA, 22 bp, Homo sapiens
tggcaatgtggaatggtccagg

SEQ ID NO: 5529 - DNA, 22 bp, Homo sapiens
aggcaacttttggggatgatgg

SEQ ID NO: 5530 - DNA, 22 bp, Homo sapiens
attaagtgttttacatacatta

SEQ ID NO: 5531 - DNA, 22 bp, Homo sapiens
tagactggtgaattagggggaa

SEQ ID NO: 5532 - DNA, 22 bp, Homo sapiens
tccagctgttccatcagctctt

SEQ ID NO: 5533 - DNA, 22 bp, Homo sapiens
ccccatttgaactccttcaact

SEQ ID NO: 5534 - DNA, 22 bp, Homo sapiens
gtgctaatgaattggagtgcct

SEQ ID NO: 5535 - DNA, 20 bp, Homo sapiens
ttcatgggagcaaagaggcc

SEQ ID NO: 5536 - DNA, 22 bp, Homo sapiens
ctgggagtggtgacagctctcg

SEQ ID NO: 5537 - DNA, 22 bp, Homo sapiens
tgtggcttaagaatgcctttaa

SEQ ID NO: 5538 - DNA, 22 bp, Homo sapiens
aagcacaatgaacatcttagat

SEQ ID NO: 5539 - DNA, 22 bp, Homo sapiens
gaccttgtgatccgcccgcctt

SEQ ID NO: 5540 - DNA, 22 bp, Homo sapiens
tgtgaaagatactaggcagagg

SEQ ID NO: 5541 - DNA, 22 bp, Homo sapiens
gagcgattgcgggggtcagagg

SEQ ID NO: 5542 - DNA, 22 bp, Homo sapiens
atgggtgcagcatggtgggaac

SEQ ID NO: 5543 - DNA, 22 bp, Homo sapiens
tcaggtgccttggctaattgtt

SEQ ID NO: 5544 - DNA, 22 bp, Homo sapiens
aaagcagaactgagagagctgg

SEQ ID NO: 5545 - DNA, 22 bp, Homo sapiens
cgtgaggggggtaaggcgtccg

SEQ ID NO: 5546 - DNA, 22 bp, Homo sapiens
aacccaggagttggaggctgtg

SEQ ID NO: 5547 - DNA, 22 bp, Homo sapiens
ttgcagttttgacagaccaaat

SEQ ID NO: 5548 - DNA, 22 bp, Homo sapiens
ggctcactacaacctccgcctt

SEQ ID NO: 5549 - DNA, 22 bp, Homo sapiens
tccaccaagccggggccacttc

SEQ ID NO: 5550 - DNA, 22 bp, Homo sapiens
catgctgtgtgttttagctcca

SEQ ID NO: 5551 - DNA, 22 bp, Homo sapiens
gttaaggctgagcaggacactg

SEQ ID NO: 5552 - DNA, 22 bp, Homo sapiens
gatcagagccagagatgataac

SEQ ID NO: 5553 - DNA, 22 bp, Homo sapiens
aagggcctgccagctcttcatg

SEQ ID NO: 5554 - DNA, 22 bp, Homo sapiens
gctttggacaataactgctttt

SEQ ID NO: 5555 - DNA, 22 bp, Homo sapiens
aggccctattcaatggggccca

SEQ ID NO: 5556 - DNA, 22 bp, Homo sapiens
atgaggtgggagaatcacttga

SEQ ID NO: 5557 - DNA, 22 bp, Homo sapiens
tctgtcttagccatctcaggct

SEQ ID NO: 5558 - DNA, 22 bp, Homo sapiens
ctcactgcaagctcagcctccc

SEQ ID NO: 5559 - DNA, 18 bp, Homo sapiens
cccaggttggcctacaga

SEQ ID NO: 5560 - DNA, 22 bp, Homo sapiens
ccgcgaggtggaggttgcagtg

SEQ ID NO: 5561 - DNA, 22 bp, Homo sapiens
acagcagagcctggtacttact

SEQ ID NO: 5562 - DNA, 22 bp, Homo sapiens
tgcaccactgcattccagcctg

SEQ ID NO: 5563 - DNA, 22 bp, Homo sapiens
agccggggtaattaacacgggg

SEQ ID NO: 5564 - DNA, 22 bp, Homo sapiens
gtggtgagattgctggatcaaa

SEQ ID NO: 5565 - DNA, 22 bp, Homo sapiens
tccctcatctcacatgtgtgtg

SEQ ID NO: 5566 - DNA, 22 bp, Homo sapiens
ctgctcttcacactacacccgt

SEQ ID NO: 5567 - DNA, 22 bp, Homo sapiens
taagtgagggagctgggacttg

SEQ ID NO: 5568 - DNA, 22 bp, Homo sapiens
aacatacgagcagtttatagag

SEQ ID NO: 5569 - DNA, 22 bp, Homo sapiens
agccccttgtgggcgcacagca

SEQ ID NO: 5570 - DNA, 22 bp, Homo sapiens
ggatgtttgctagcattcctgg

SEQ ID NO: 5571 - DNA, 22 bp, Homo sapiens
gtgttaaccagctaaactttgc

SEQ ID NO: 5572 - DNA, 20 bp, Homo sapiens
atggatgaccttggccaggg

SEQ ID NO: 5573 - DNA, 22 bp, Homo sapiens
gcccagccacagtcactttcat

SEQ ID NO: 5574 - DNA, 22 bp, Homo sapiens
taatgtaaacacagagacagaa

SEQ ID NO: 5575 - DNA, 22 bp, Homo sapiens
ggacctgaacataaaacgaggc

SEQ ID NO: 5576 - DNA, 22 bp, Homo sapiens
ctgccaggattctgtgaacccc

SEQ ID NO: 5577 - DNA, 22 bp, Homo sapiens
ttttcctttgattcccagatgt

SEQ ID NO: 5578 - DNA, 22 bp, Homo sapiens
tggcactgaagctggaaagcct

SEQ ID NO: 5579 - DNA, 22 bp, Homo sapiens
tcagtggagagcttccaggatt

SEQ ID NO: 5580 - DNA, 22 bp, Homo sapiens
ttccagtcacaaaacatattaa

SEQ ID NO: 5581 - DNA, 22 bp, Homo sapiens
taactctgaatcctcacagcag

SEQ ID NO: 5582 - DNA, 22 bp, Homo sapiens
gtacatccccaaagccacgccc

SEQ ID NO: 5583 - DNA, 17 bp, Homo sapiens
cttcccaccatctcctg

SEQ ID NO: 5584 - DNA, 17 bp, Homo sapiens
gacctcaggtgatctgc

SEQ ID NO: 5585 - DNA, 22 bp, Homo sapiens
ttatagcagcatgatttataat

SEQ ID NO: 5586 - DNA, 22 bp, Homo sapiens
cctggagagctcgggccaggca

SEQ ID NO: 5587 - DNA, 22 bp, Homo sapiens
cctcaccttcccagagacgatc

SEQ ID NO: 5588 - DNA, 22 bp, Homo sapiens
ttattgaaggaactgaaataaa

SEQ ID NO: 5589 - DNA, 22 bp, Homo sapiens
atgttcatatccccattctgat

SEQ ID NO: 5590 - DNA, 20 bp, Homo sapiens
ggtcactgtggctgcaggat

SEQ ID NO: 5591 - DNA, 21 bp, Homo sapiens
tactgtagccttgcactgtag

SEQ ID NO: 5592 - DNA, 22 bp, Homo sapiens
tgagctcaagcaattcacccgc

SEQ ID NO: 5593 - DNA, 22 bp, Homo sapiens
tctttgctccacactctagaga

SEQ ID NO: 5594 - DNA, 22 bp, Homo sapiens
gttcatcactcagagacctccc

SEQ ID NO: 5595 - DNA, 22 bp, Homo sapiens
aggtgggcggattcatgaggtc

SEQ ID NO: 5596 - DNA, 22 bp, Homo sapiens
catgtaaagaatttcacacaag

SEQ ID NO: 5597 - DNA, 19 bp, Homo sapiens
tgttgtctaccatgaagtc

SEQ ID NO: 5598 - DNA, 22 bp, Homo sapiens
atctccgaaagtcttgtcaccc

SEQ ID NO: 5599 - DNA, 22 bp, Homo sapiens
ttatttaaaagtggtaagattc

SEQ ID NO: 5600 - DNA, 16 bp, Homo sapiens
cattgcactctagcct

SEQ ID NO: 5601 - DNA, 22 bp, Homo sapiens
acagtatagggcttatattgta

SEQ ID NO: 5602 - DNA, 22 bp, Homo sapiens
gtgcaaccatcaccactgactc

SEQ ID NO: 5603 - DNA, 22 bp, Homo sapiens
aagataagagggaggtgcctca

SEQ ID NO: 5604 - DNA, 21 bp, Homo sapiens
gccatttcacacagacatttg

SEQ ID NO: 5605 - DNA, 22 bp, Homo sapiens
tctggcttcgcagctcccagcc

SEQ ID NO: 5606 - DNA, 22 bp, Homo sapiens
gtagtcccagctaccccggagg

SEQ ID NO: 5607 - DNA, 22 bp, Homo sapiens
cctgtcatatacatacctcctc

SEQ ID NO: 5608 - DNA, 22 bp, Homo sapiens
tgtgaacttactgtccccacag

SEQ ID NO: 5609 - DNA, 22 bp, Homo sapiens
tccctgaggatggttgtattta

SEQ ID NO: 5610 - DNA, 22 bp, Homo sapiens
ggttggacactaggtaggagcg

SEQ ID NO: 5611 - DNA, 22 bp, Homo sapiens
ggcagacctctccagccccaca

SEQ ID NO: 5612 - DNA, 22 bp, Homo sapiens
tctctcaggctggagtgcagtg

SEQ ID NO: 5613 - DNA, 22 bp, Homo sapiens
agcatgcgcttgatcagctcca

SEQ ID NO: 5614 - DNA, 22 bp, Homo sapiens
tagctaccattattgagcacct

SEQ ID NO: 5615 - DNA, 22 bp, Homo sapiens
gtttacttgtgccttggcttaa

SEQ ID NO: 5616 - DNA, 22 bp, Homo sapiens
agttcgagatctgctgatgaga

SEQ ID NO: 5617 - DNA, 20 bp, Homo sapiens
aactcctagcctcaagtgat

SEQ ID NO: 5618 - DNA, 22 bp, Homo sapiens
atgatactctaggtgatttaca

SEQ ID NO: 5619 - DNA, 22 bp, Homo sapiens
gaaaaggcctggggcaaagtgt

SEQ ID NO: 5620 - DNA, 22 bp, Homo sapiens
aagccctggcgggtggagggcc

SEQ ID NO: 5621 - DNA, 22 bp, Homo sapiens
tttgccctttctgagcctcatc

SEQ ID NO: 5622 - DNA, 22 bp, Homo sapiens
agcgccgcccctgctggtgttg

SEQ ID NO: 5623 - DNA, 22 bp, Homo sapiens
ggagaacatatctcccacattg

SEQ ID NO: 5624 - DNA, 22 bp, Homo sapiens
ctaggctcaggtgactccaagc

SEQ ID NO: 5625 - DNA, 22 bp, Homo sapiens
aagtcacactagacaactgagg

SEQ ID NO: 5626 - DNA, 22 bp, Homo sapiens
tcagtgccatgggcagacaggc

SEQ ID NO: 5627 - DNA, 22 bp, Homo sapiens
gctcgaccgccagaaacttcct

SEQ ID NO: 5628 - DNA, 22 bp, Homo sapiens
gacggagctggttgctgcggct

SEQ ID NO: 5629 - DNA, 22 bp, Homo sapiens
gtaaaaggtcaaggccaagtct

SEQ ID NO: 5630 - DNA, 22 bp, Homo sapiens
tgcatattatgtgtatctgtct

SEQ ID NO: 5631 - DNA, 22 bp, Homo sapiens
gaagttctttatagcagtgtga

SEQ ID NO: 5632 - DNA, 18 bp, Homo sapiens
acctgattggcgcagccc

SEQ ID NO: 5633 - DNA, 22 bp, Homo sapiens
tccagggccatctccatgaggc

SEQ ID NO: 5634 - DNA, 22 bp, Homo sapiens
attgaggtcccagaaaggactg

SEQ ID NO: 5635 - DNA, 22 bp, Homo sapiens
aatatgcactctgatttagcag

SEQ ID NO: 5636 - DNA, 22 bp, Homo sapiens
tcagtcttgaacagccccctgt

SEQ ID NO: 5637 - DNA, 22 bp, Homo sapiens
ttgcttgagacttaagaggtca

SEQ ID NO: 5638 - DNA, 22 bp, Homo sapiens
tatctcattttattgcaaatgt

SEQ ID NO: 5639 - DNA, 22 bp, Homo sapiens
actgcaacctccacctcctggg

SEQ ID NO: 5640 - DNA, 22 bp, Homo sapiens
gggagtgggtttggcctaggcc

SEQ ID NO: 5641 - DNA, 22 bp, Homo sapiens
catcaggcagaggaaaggactg

SEQ ID NO: 5642 - DNA, 22 bp, Homo sapiens
caggaagctgtgaaggagacgg

SEQ ID NO: 5643 - DNA, 22 bp, Homo sapiens
agttgggtttgtgtcagttgca

SEQ ID NO: 5644 - DNA, 22 bp, Homo sapiens
aggtggaaatggctttcctagg

SEQ ID NO: 5645 - DNA, 22 bp, Homo sapiens
actgcgtggggagctgtgacta

SEQ ID NO: 5646 - DNA, 22 bp, Homo sapiens
agtggtgataaccactatcata

SEQ ID NO: 5647 - DNA, 22 bp, Homo sapiens
ttgtgaatagtgccacaataaa

SEQ ID NO: 5648 - DNA, 22 bp, Homo sapiens
ttgtgagtagtgccgcaataaa

SEQ ID NO: 5649 - DNA, 22 bp, Homo sapiens
tcatctgaagattgctgttcaa

SEQ ID NO: 5650 - DNA, 19 bp, Homo sapiens
ctatctcaaatcttttccc

SEQ ID NO: 5651 - DNA, 21 bp, Homo sapiens
taaacataaccttgtatggct

SEQ ID NO: 5652 - DNA, 20 bp, Homo sapiens
gggactgtcccatcctcatc

SEQ ID NO: 5653 - DNA, 22 bp, Homo sapiens
catgatggggaatgttaaggga

SEQ ID NO: 5654 - DNA, 22 bp, Homo sapiens
gcgcggcctcacccctcggtga

SEQ ID NO: 5655 - DNA, 23 bp, Homo sapiens
gtatacgtgcaagtcacagggga

SEQ ID NO: 5656 - DNA, 22 bp, Homo sapiens
tgaaggacagcagtggctccaa

SEQ ID NO: 5657 - DNA, 22 bp, Homo sapiens
tagtaacccacacaacagtaga

SEQ ID NO: 5658 - DNA, 22 bp, Homo sapiens
tagcataggaaagtactgggaa

SEQ ID NO: 5659 - DNA, 22 bp, Homo sapiens
ggtcgagtcacttgttgccttt

SEQ ID NO: 5660 - DNA, 23 bp, Homo sapiens
agaaagtcatggccaggtttgat

SEQ ID NO: 5661 - DNA, 22 bp, Homo sapiens
tgtttgagttctagcgcattta

SEQ ID NO: 5662 - DNA, 22 bp, Homo sapiens
gcgctaggcaagtcctttcaac

SEQ ID NO: 5663 - DNA, 22 bp, Homo sapiens
agaatccctgcttgtcttcaaa

SEQ ID NO: 5664 - DNA, 22 bp, Homo sapiens
acgtagcactgagagatgcagg

SEQ ID NO: 5665 - DNA, 22 bp, Homo sapiens
ggctcactgcaacctctgcctc

SEQ ID NO: 5666 - DNA, 22 bp, Homo sapiens
gaatgcttggaacctgaagttc

SEQ ID NO: 5667 - DNA, 22 bp, Homo sapiens
accaggggatggttggcactgt

SEQ ID NO: 5668 - DNA, 22 bp, Homo sapiens
cgggttttccacaggagtcttt

SEQ ID NO: 5669 - DNA, 22 bp, Homo sapiens
agaacgtggaatgtggctcctt

SEQ ID NO: 5670 - DNA, 22 bp, Homo sapiens
tgccgaggctggagtgcagtgg

SEQ ID NO: 5671 - DNA, 22 bp, Homo sapiens
tgctttggacccagggagcgga

SEQ ID NO: 5672 - DNA, 22 bp, Homo sapiens
tctcagaacctcagtttgctct

SEQ ID NO: 5673 - DNA, 22 bp, Homo sapiens
tggcactgagcagccgcggcag

SEQ ID NO: 5674 - DNA, 22 bp, Homo sapiens
ggcaaaaagttcccatcagtgt

SEQ ID NO: 5675 - DNA, 22 bp, Homo sapiens
tgaacgcaggtccacatggctc

SEQ ID NO: 5676 - DNA, 22 bp, Homo sapiens
ttacctaaaatagctcaattta

SEQ ID NO: 5677 - DNA, 22 bp, Homo sapiens
agattctaccagagctagtttg

SEQ ID NO: 5678 - DNA, 22 bp, Homo sapiens
ccgggttgaggttcccatagat

SEQ ID NO: 5679 - DNA, 22 bp, Homo sapiens
tccttgccctaaatgtctgtgt

SEQ ID NO: 5680 - DNA, 22 bp, Homo sapiens
tcctggtcttcaggttgcaaaa

SEQ ID NO: 5681 - DNA, 22 bp, Homo sapiens
atggtcacaccactgtactcca

SEQ ID NO: 5682 - DNA, 22 bp, Homo sapiens
gcctgcaactggcacagcttgt

SEQ ID NO: 5683 - DNA, 22 bp, Homo sapiens
gaaaggatttggtgccaagcgt

SEQ ID NO: 5684 - DNA, 22 bp, Homo sapiens
caccctccagctcccgggggct

SEQ ID NO: 5685 - DNA, 22 bp, Homo sapiens
aggatgtggatggagtatttat

SEQ ID NO: 5686 - DNA, 22 bp, Homo sapiens
gttaaggatcttgagatgagga

SEQ ID NO: 5687 - DNA, 22 bp, Homo sapiens
tgtttctgtatgatcaatattg

SEQ ID NO: 5688 - DNA, 22 bp, Homo sapiens
tgacagtaccactgaaagtctg

SEQ ID NO: 5689 - DNA, 22 bp, Homo sapiens
gggaagagggagctggaatgat

SEQ ID NO: 5690 - DNA, 22 bp, Homo sapiens
aggattgtgcctccagtcagaa

SEQ ID NO: 5691 - DNA, 22 bp, Homo sapiens
acggcctggtgcagcaggtcgc

SEQ ID NO: 5692 - DNA, 22 bp, Homo sapiens
ttacgcagctgctccaggaagc

SEQ ID NO: 5693 - DNA, 22 bp, Homo sapiens
gtcttagatttcaccgataatg

SEQ ID NO: 5694 - DNA, 22 bp, Homo sapiens
ctctaatcctttgtccctgggt

SEQ ID NO: 5695 - DNA, 22 bp, Homo sapiens
aacattgaacttggcacaccca

SEQ ID NO: 5696 - DNA, 22 bp, Homo sapiens
aactcagatgtttggctacctt

SEQ ID NO: 5697 - DNA, 22 bp, Homo sapiens
tcagattgttggagccaaacag

SEQ ID NO: 5698 - DNA, 22 bp, Homo sapiens
aaggtttcgggagcgggtctgg

SEQ ID NO: 5699 - DNA, 22 bp, Homo sapiens
cattgcactccagcctgggcaa

SEQ ID NO: 5700 - DNA, 22 bp, Homo sapiens
cggtcaggtgcagcgttggcac

SEQ ID NO: 5701 - DNA, 22 bp, Homo sapiens
gaccttgtgctccgaggcgggc

SEQ ID NO: 5702 - DNA, 22 bp, Homo sapiens
ttagcacaggagtctctgttat

SEQ ID NO: 5703 - DNA, 22 bp, Homo sapiens
cacttcattgggaccagggctg

SEQ ID NO: 5704 - DNA, 22 bp, Homo sapiens
ggtcttcctatggcggggccct

SEQ ID NO: 5705 - DNA, 22 bp, Homo sapiens
gggagcttaagacagttccaat

SEQ ID NO: 5706 - DNA, 22 bp, Homo sapiens
tcatcataatatggaatcttgt

SEQ ID NO: 5707 - DNA, 22 bp, Homo sapiens
ggtgaggggctcctctgcccgg

SEQ ID NO: 5708 - DNA, 22 bp, Homo sapiens
tgagggcctcatacctgattct

SEQ ID NO: 5709 - DNA, 22 bp, Homo sapiens
agtcggaagctgtgcgtaaatc

SEQ ID NO: 5710 - DNA, 21 bp, Homo sapiens
gccaattccagctgagttagc

SEQ ID NO: 5711 - DNA, 22 bp, Homo sapiens
gcccggcagtcacacacccagg

SEQ ID NO: 5712 - DNA, 22 bp, Homo sapiens
tctgccgtgcgaggtcccacca

SEQ ID NO: 5713 - DNA, 22 bp, Homo sapiens
tatcacagtaaatctgggtgca

SEQ ID NO: 5714 - DNA, 22 bp, Homo sapiens
tgtctgatcatgaggcagggct

SEQ ID NO: 5715 - DNA, 17 bp, Homo sapiens
gcccgcggcccggggtg

SEQ ID NO: 5716 - DNA, 22 bp, Homo sapiens
actgggctcaagtgattgtcct

SEQ ID NO: 5717 - DNA, 22 bp, Homo sapiens
ttctccacccactcttttgttg

SEQ ID NO: 5718 - DNA, 22 bp, Homo sapiens
acccgcgagtctcactgccgct

SEQ ID NO: 5719 - DNA, 22 bp, Homo sapiens
agccagggtctctcgctctgtt

SEQ ID NO: 5720 - DNA, 22 bp, Homo sapiens
ctcactgcaagctccgcctccc

SEQ ID NO: 5721 - DNA, 22 bp, Homo sapiens
ctgcggctctgcgggcagctgg

SEQ ID NO: 5722 - DNA, 22 bp, Homo sapiens
cacggccagggctgtgggtgcg

SEQ ID NO: 5723 - DNA, 22 bp, Homo sapiens
ctggaaggagcccgggcggatc

SEQ ID NO: 5724 - DNA, 22 bp, Homo sapiens
tacagatgaggaaactgaggca

SEQ ID NO: 5725 - DNA, 22 bp, Homo sapiens
gcgcgggcaggccttccgagtg

SEQ ID NO: 5726 - DNA, 22 bp, Homo sapiens
tcagccagccagctacaggctt

SEQ ID NO: 5727 - DNA, 20 bp, Homo sapiens
accccagtgtgtgcctcaag

SEQ ID NO: 5728 - DNA, 22 bp, Homo sapiens
gaggtggctgcttgctgggaaa

SEQ ID NO: 5729 - DNA, 22 bp, Homo sapiens
gaggggctgccctggtgtcagg

SEQ ID NO: 5730 - DNA, 22 bp, Homo sapiens
gtgtcaataaatagcggtgtgg

SEQ ID NO: 5731 - DNA, 22 bp, Homo sapiens
gctatgggatgtgctgtggatg

SEQ ID NO: 5732 - DNA, 22 bp, Homo sapiens
aaaaaattatcatagttcctga

SEQ ID NO: 5733 - DNA, 22 bp, Homo sapiens
aacatgatttcatgcatttaga

SEQ ID NO: 5734 - DNA, 22 bp, Homo sapiens
gaatgatttagtgttcaaggaa

SEQ ID NO: 5735 - DNA, 22 bp, Homo sapiens
tgtattctaaatacatcttacc

SEQ ID NO: 5736 - DNA, 22 bp, Homo sapiens
atgtgccaacgtgcaggtttgt

SEQ ID NO: 5737 - DNA, 22 bp, Homo sapiens
gtgttgatgacattttagaaac

SEQ ID NO: 5738 - DNA, 22 bp, Homo sapiens
ctggcaggtggaggttgcagtg

SEQ ID NO: 5739 - DNA, 22 bp, Homo sapiens
tgcctccctggcaagtctctcc

SEQ ID NO: 5740 - DNA, 22 bp, Homo sapiens
tgggaatgcaaggaaagctgtt

SEQ ID NO: 5741 - DNA, 23 bp, Homo sapiens
gggtccagccaattccaaggaaa

SEQ ID NO: 5742 - DNA, 22 bp, Homo sapiens
cagcccgccctgaactttcggg

SEQ ID NO: 5743 - DNA, 22 bp, Homo sapiens
agcccttagtacatttctcaag

SEQ ID NO: 5744 - DNA, 22 bp, Homo sapiens
cgcagggccgcgagcgggacca

SEQ ID NO: 5745 - DNA, 22 bp, Homo sapiens
cttcctcctccatctcgaaggc

SEQ ID NO: 5746 - DNA, 22 bp, Homo sapiens
ctgtgctccctctggcgccccg

SEQ ID NO: 5747 - DNA, 22 bp, Homo sapiens
gcagtatctatgtgatgggttg

SEQ ID NO: 5748 - DNA, 22 bp, Homo sapiens
acatgattgtctggcttggcca

SEQ ID NO: 5749 - DNA, 22 bp, Homo sapiens
gttgacagtgaccctgaaagca

SEQ ID NO: 5750 - DNA, 22 bp, Homo sapiens
actatagatgctggcgaggctg

SEQ ID NO: 5751 - DNA, 22 bp, Homo sapiens
tggctcatttctaaacccagct

SEQ ID NO: 5752 - DNA, 22 bp, Homo sapiens
aaggagaaatggtagatgtgca

SEQ ID NO: 5753 - DNA, 22 bp, Homo sapiens
tcaacgcatgctccaagaaaga

SEQ ID NO: 5754 - DNA, 22 bp, Homo sapiens
gcaggcagaggtggaggagaca

SEQ ID NO: 5755 - DNA, 22 bp, Homo sapiens
accgggaagtcctgcactgggc

SEQ ID NO: 5756 - DNA, 22 bp, Homo sapiens
caaagtgctgggattataggca

SEQ ID NO: 5757 - DNA, 22 bp, Homo sapiens
cagtcactggaatagctgagga

SEQ ID NO: 5758 - DNA, 19 bp, Homo sapiens
gcccagcgaaggggatgac

SEQ ID NO: 5759 - DNA, 22 bp, Homo sapiens
ggacagccgagtggccttctcc

SEQ ID NO: 5760 - DNA, 22 bp, Homo sapiens
ggagtgcaatggcgtgatctca

SEQ ID NO: 5761 - DNA, 22 bp, Homo sapiens
tttgaggttagctagcagatca

SEQ ID NO: 5762 - DNA, 22 bp, Homo sapiens
tagggaccttagaattgtatgt

SEQ ID NO: 5763 - DNA, 22 bp, Homo sapiens
ccctgcatccaaaggcctcctc

SEQ ID NO: 5764 - DNA, 22 bp, Homo sapiens
actgcaacctccgcctgccagg

SEQ ID NO: 5765 - DNA, 22 bp, Homo sapiens
atgctaaggcccaggagaaaat

SEQ ID NO: 5766 - DNA, 22 bp, Homo sapiens
aaggatacttttagagcctgag

SEQ ID NO: 5767 - DNA, 22 bp, Homo sapiens
ttggcataccttagtggtggag

SEQ ID NO: 5768 - DNA, 22 bp, Homo sapiens
gtccacttctgcctttctggat

SEQ ID NO: 5769 - DNA, 22 bp, Homo sapiens
ggctcaggcctgtaatcctagc

SEQ ID NO: 5770 - DNA, 22 bp, Homo sapiens
gatctgtgtgattggatgcatt

SEQ ID NO: 5771 - DNA, 22 bp, Homo sapiens
ctttttcctcgtagagcctaat

SEQ ID NO: 5772 - DNA, 16 bp, Homo sapiens
ttgccgcacaggtcgc

SEQ ID NO: 5773 - DNA, 22 bp, Homo sapiens
gtggcagagccaaggctggagc

SEQ ID NO: 5774 - DNA, 22 bp, Homo sapiens
cacatttttactgccaacttaa

SEQ ID NO: 5775 - DNA, 22 bp, Homo sapiens
gcaggtggatcacctgaggtca

SEQ ID NO: 5776 - DNA, 22 bp, Homo sapiens
ctcagccccagcccagatagca

SEQ ID NO: 5777 - DNA, 22 bp, Homo sapiens
ggccctggcagccacgaaagcc

SEQ ID NO: 5778 - DNA, 22 bp, Homo sapiens
gtggcatgtgcctgtaatctca

SEQ ID NO: 5779 - DNA, 22 bp, Homo sapiens
tggaacgtcgtaatgttggtta

SEQ ID NO: 5780 - DNA, 22 bp, Homo sapiens
catctgtctgcatgctctgggt

SEQ ID NO: 5781 - DNA, 22 bp, Homo sapiens
atcatcctagaaggaagctagg

SEQ ID NO: 5782 - DNA, 22 bp, Homo sapiens
gctcccaggatgaggagccagg

SEQ ID NO: 5783 - DNA, 22 bp, Homo sapiens
gccactgtggtcctcccatgat

SEQ ID NO: 5784 - DNA, 22 bp, Homo sapiens
cctgctcaacgaatatggcgat

SEQ ID NO: 5785 - DNA, 22 bp, Homo sapiens
ggaaatctcagatctcccagat

SEQ ID NO: 5786 - DNA, 20 bp, Homo sapiens
ttgcaactgtaagaagcagg

SEQ ID NO: 5787 - DNA, 22 bp, Homo sapiens
tcagtgactccttcttcctgct

SEQ ID NO: 5788 - DNA, 22 bp, Homo sapiens
tacctcaagttccaggaaagcg

SEQ ID NO: 5789 - DNA, 22 bp, Homo sapiens
ccctcccggcgtgctgggctcg

SEQ ID NO: 5790 - DNA, 22 bp, Homo sapiens
atcagaatgttttggtgtgctc

SEQ ID NO: 5791 - DNA, 22 bp, Homo sapiens
aggtggtgtttggttacatgag

SEQ ID NO: 5792 - DNA, 22 bp, Homo sapiens
cgaggcctcctcgccgccaccg

SEQ ID NO: 5793 - DNA, 22 bp, Homo sapiens
tggtggctcacacctgtaatcc

SEQ ID NO: 5794 - DNA, 22 bp, Homo sapiens
ccagcttgaagatgtgctggtt

SEQ ID NO: 5795 - DNA, 22 bp, Homo sapiens
ttgatacccaagtgttatgggt

SEQ ID NO: 5796 - DNA, 22 bp, Homo sapiens
agaagtatcaggaagattctca

SEQ ID NO: 5797 - DNA, 22 bp, Homo sapiens
ttgagcccaggaggcctgggtg

SEQ ID NO: 5798 - DNA, 22 bp, Homo sapiens
ggctgggctccgggagcatgcg

SEQ ID NO: 5799 - DNA, 22 bp, Homo sapiens
cagctggtgtcaggcactgcag

SEQ ID NO: 5800 - DNA, 22 bp, Homo sapiens
gcaggaggttgagccaggactg

SEQ ID NO: 5801 - DNA, 22 bp, Homo sapiens
ttgagatggagcctcagtcttg

SEQ ID NO: 5802 - DNA, 22 bp, Homo sapiens
gggagagtagctggaaggttct

SEQ ID NO: 5803 - DNA, 22 bp, Homo sapiens
atgcagtggcttcagtgtcagt

SEQ ID NO: 5804 - DNA, 22 bp, Homo sapiens
cttgccttctctggggtggcag

SEQ ID NO: 5805 - DNA, 22 bp, Homo sapiens
ctccatgtctgtaacacatgac

SEQ ID NO: 5806 - DNA, 22 bp, Homo sapiens
gctcactgcaagctccgcctcc

SEQ ID NO: 5807 - DNA, 22 bp, Homo sapiens
gaggctggacgtgcatttctac

SEQ ID NO: 5808 - DNA, 22 bp, Homo sapiens
ggtgtagctctgtgtcccactg

SEQ ID NO: 5809 - DNA, 22 bp, Homo sapiens
tccgatgcttccagggccacct

SEQ ID NO: 5810 - DNA, 22 bp, Homo sapiens
agggctggagccacagctggga

SEQ ID NO: 5811 - DNA, 22 bp, Homo sapiens
ggcgtttcaccatgttgaccag

SEQ ID NO: 5812 - DNA, 22 bp, Homo sapiens
cagtgcacgggccagtcctgcc

SEQ ID NO: 5813 - DNA, 22 bp, Homo sapiens
gtcaggactctgacccgtcccg

SEQ ID NO: 5814 - DNA, 22 bp, Homo sapiens
tcctggcaaagatgttggtgtt

SEQ ID NO: 5815 - DNA, 22 bp, Homo sapiens
accacatcgggcggacactggg

SEQ ID NO: 5816 - DNA, 22 bp, Homo sapiens
agcctctttttcaaggtccaca

SEQ ID NO: 5817 - DNA, 22 bp, Homo sapiens
gagcactgagctggaattggag

SEQ ID NO: 5818 - DNA, 22 bp, Homo sapiens
atcctccagctcctgcttctgc

SEQ ID NO: 5819 - DNA, 22 bp, Homo sapiens
ggcttggcaggtgccctgcgca

SEQ ID NO: 5820 - DNA, 19 bp, Homo sapiens
gctgaaggaggtgcctgca

SEQ ID NO: 5821 - DNA, 22 bp, Homo sapiens
tgcagcggtagttctcgtggaa

SEQ ID NO: 5822 - DNA, 22 bp, Homo sapiens
tgtggccattcttgaggtcgac

SEQ ID NO: 5823 - DNA, 22 bp, Homo sapiens
attccagaggggattcccggcc

SEQ ID NO: 5824 - DNA, 22 bp, Homo sapiens
ggtgacgaatccatagcatcga

SEQ ID NO: 5825 - DNA, 22 bp, Homo sapiens
ctgaggcctctcccactccagc

SEQ ID NO: 5826 - DNA, 22 bp, Homo sapiens
catcaagtggttctccaggttg

SEQ ID NO: 5827 - DNA, 22 bp, Homo sapiens
atgccactgcacttcagcctgg

SEQ ID NO: 5828 - DNA, 22 bp, Homo sapiens
gaggtggatgttgcagtgagct

SEQ ID NO: 5829 - DNA, 22 bp, Homo sapiens
gtgttggacagcttctactgtg

SEQ ID NO: 5830 - DNA, 22 bp, Homo sapiens
cattgcactccagcctaggcaa

SEQ ID NO: 5831 - DNA, 22 bp, Homo sapiens
cgttcagcgggctggccgtgga

SEQ ID NO: 5832 - DNA, 22 bp, Homo sapiens
agcgaggtgagtcctccagctc

SEQ ID NO: 5833 - DNA, 22 bp, Homo sapiens
tcagcctggcaggatggcctgg

SEQ ID NO: 5834 - DNA, 22 bp, Homo sapiens
agccctcttccagccagcacag

SEQ ID NO: 5835 - DNA, 22 bp, Homo sapiens
gtgtgtctcccaagaaggccca

SEQ ID NO: 5836 - DNA, 22 bp, Homo sapiens
caagctgaacactgtcttcaag

SEQ ID NO: 5837 - DNA, 22 bp, Homo sapiens
taggggactgacaagcggggac

SEQ ID NO: 5838 - DNA, 22 bp, Homo sapiens
ctccccccacagtgttcttgcc

SEQ ID NO: 5839 - DNA, 22 bp, Homo sapiens
ggaactgaggaacgaactggga

SEQ ID NO: 5840 - DNA, 18 bp, Homo sapiens
tcctttctccctcatctt

SEQ ID NO: 5841 - DNA, 20 bp, Homo sapiens
cgcccagtgcggttctgacc

SEQ ID NO: 5842 - DNA, 22 bp, Homo sapiens
aggtgggtgcctatgtatgtat

SEQ ID NO: 5843 - DNA, 22 bp, Homo sapiens
aactctatttaccctactaaac

SEQ ID NO: 5844 - DNA, 22 bp, Homo sapiens
gttgtgattgtagctaaactag

SEQ ID NO: 5845 - DNA, 22 bp, Homo sapiens
ggcccaggctggagtgcagtgg

SEQ ID NO: 5846 - DNA, 22 bp, Homo sapiens
tcgcaccattgcactccagcca

SEQ ID NO: 5847 - DNA, 22 bp, Homo sapiens
gtcgtggagctcacagtgtgcc

SEQ ID NO: 5848 - DNA, 22 bp, Homo sapiens
ttgcctaggctggagtgcagtg

SEQ ID NO: 5849 - DNA, 22 bp, Homo sapiens
ctcgcaagtcgctccggttact

SEQ ID NO: 5850 - DNA, 22 bp, Homo sapiens
agattcttgagtagctgtgctt

SEQ ID NO: 5851 - DNA, 17 bp, Homo sapiens
cttgttgagctcgttcc

SEQ ID NO: 5852 - DNA, 22 bp, Homo sapiens
aacttagtgagccactcttgca

SEQ ID NO: 5853 - DNA, 21 bp, Homo sapiens
gcccacagtgaggaggatccc

SEQ ID NO: 5854 - DNA, 22 bp, Homo sapiens
gctccctggtagccatgctctc

SEQ ID NO: 5855 - DNA, 22 bp, Homo sapiens
ttctatattcgcttcccaaggc

SEQ ID NO: 5856 - DNA, 23 bp, Homo sapiens
tgttccagatacgccttttcctc

SEQ ID NO: 5857 - DNA, 22 bp, Homo sapiens
attgcaggctctgacaccaggc

SEQ ID NO: 5858 - DNA, 22 bp, Homo sapiens
ggcccagacccaagagtggtgg

SEQ ID NO: 5859 - DNA, 22 bp, Homo sapiens
tagctgggactactggccctgc

SEQ ID NO: 5860 - DNA, 20 bp, Homo sapiens
tgtttactctagagggtaga

SEQ ID NO: 5861 - DNA, 22 bp, Homo sapiens
gggagaagaatgtgtcaattgt

SEQ ID NO: 5862 - DNA, 22 bp, Homo sapiens
gctgatagactgaatgttggga

SEQ ID NO: 5863 - DNA, 22 bp, Homo sapiens
ggggtctcactatgttacccag

SEQ ID NO: 5864 - DNA, 18 bp, Homo sapiens
catgggtgacaggtggat

SEQ ID NO: 5865 - DNA, 23 bp, Homo sapiens
gtgtggccccagggcctcctcgc

SEQ ID NO: 5866 - DNA, 22 bp, Homo sapiens
aaagattaaatcaaattggtca

SEQ ID NO: 5867 - DNA, 22 bp, Homo sapiens
ttccgctgtttagttgaagttt

SEQ ID NO: 5868 - DNA, 22 bp, Homo sapiens
gagaaatatggctcagttccac

SEQ ID NO: 5869 - DNA, 22 bp, Homo sapiens
ttcgttgctttaagccactacg

SEQ ID NO: 5870 - DNA, 20 bp, Homo sapiens
tatctcagtttgtcctaaac

SEQ ID NO: 5871 - DNA, 22 bp, Homo sapiens
ctcactgcaagctccacctctt

SEQ ID NO: 5872 - DNA, 22 bp, Homo sapiens
agaggccgggtgcctgctcaga

SEQ ID NO: 5873 - DNA, 22 bp, Homo sapiens
catcttgtctttttgggcctga

SEQ ID NO: 5874 - DNA, 22 bp, Homo sapiens
aatataacacagatggcctgtt

SEQ ID NO: 5875 - DNA, 22 bp, Homo sapiens
aggcaggaaaatcgcttgaacc

SEQ ID NO: 5876 - DNA, 22 bp, Homo sapiens
accagctagggtagcacatctc

SEQ ID NO: 5877 - DNA, 22 bp, Homo sapiens
tcaccttgtgatccgcccacct

SEQ ID NO: 5878 - DNA, 22 bp, Homo sapiens
actgtgtgccaggcgctggtct

SEQ ID NO: 5879 - DNA, 22 bp, Homo sapiens
ctccaggccatggctgcggagg

SEQ ID NO: 5880 - DNA, 22 bp, Homo sapiens
ttgacccgagtccttcttgggg

SEQ ID NO: 5881 - DNA, 22 bp, Homo sapiens
ggctggtgttgagtgcctgtag

SEQ ID NO: 5882 - DNA, 22 bp, Homo sapiens
agagcgagtctggggctcggat

SEQ ID NO: 5883 - DNA, 22 bp, Homo sapiens
actgcactccagcctgggtaac

SEQ ID NO: 5884 - DNA, 22 bp, Homo sapiens
actgcactccaacctgggtgac

SEQ ID NO: 5885 - DNA, 22 bp, Homo sapiens
ttcctggtctatttagaattgc

SEQ ID NO: 5886 - DNA, 22 bp, Homo sapiens
cccgtgggagagacacgcaccc

SEQ ID NO: 5887 - DNA, 22 bp, Homo sapiens
acagtcttcagaagggattggg

SEQ ID NO: 5888 - DNA, 22 bp, Homo sapiens
ctcgtgatccgcccacctcagc

SEQ ID NO: 5889 - DNA, 22 bp, Homo sapiens
gccagaagcacatgagaggtga

SEQ ID NO: 5890 - DNA, 22 bp, Homo sapiens
ataaaagatcccttctgagctc

SEQ ID NO: 5891 - DNA, 22 bp, Homo sapiens
cactgcactccagcctgcgcaa

SEQ ID NO: 5892 - DNA, 23 bp, Homo sapiens
ggagtgcaatggcgccatctcgg

SEQ ID NO: 5893 - DNA, 23 bp, Homo sapiens
agagtacagtggcgccatctcag

SEQ ID NO: 5894 - DNA, 22 bp, Homo sapiens
tcaaagatcagatggttgtagg

SEQ ID NO: 5895 - DNA, 22 bp, Homo sapiens
ttctgggcacacaggccctggt

SEQ ID NO: 5896 - DNA, 22 bp, Homo sapiens
acaatgctccctgtagtcagga

SEQ ID NO: 5897 - DNA, 22 bp, Homo sapiens
aggctcgcatgccctgcaccac

SEQ ID NO: 5898 - DNA, 22 bp, Homo sapiens
cttgtcagccaattgtggattt

SEQ ID NO: 5899 - DNA, 22 bp, Homo sapiens
ttagtactgatagggtcaatca

SEQ ID NO: 5900 - DNA, 17 bp, Homo sapiens
aggaggccctggcgttt

SEQ ID NO: 5901 - DNA, 22 bp, Homo sapiens
tgtgttcagaatttgctgcttt

SEQ ID NO: 5902 - DNA, 22 bp, Homo sapiens
accagtaggagttggagaggaa

SEQ ID NO: 5903 - DNA, 22 bp, Homo sapiens
tttgagtgcccatgtttcccag

SEQ ID NO: 5904 - DNA, 22 bp, Homo sapiens
acgatgatgaaagagaacattc

SEQ ID NO: 5905 - DNA, 22 bp, Homo sapiens
cacgcctggacggcggagggtg

SEQ ID NO: 5906 - DNA, 19 bp, Homo sapiens
actgcactccagcctgggt

SEQ ID NO: 5907 - DNA, 22 bp, Homo sapiens
ctcacagtctgcctttcccttg

SEQ ID NO: 5908 - DNA, 22 bp, Homo sapiens
atggtcaccttgggagcctgct

SEQ ID NO: 5909 - DNA, 22 bp, Homo sapiens
gggcaacagagcgagggcctgt

SEQ ID NO: 5910 - DNA, 22 bp, Homo sapiens
ggcctgttttatcagtttttaa

SEQ ID NO: 5911 - DNA, 22 bp, Homo sapiens
atgaagtggttctattggtttt

SEQ ID NO: 5912 - DNA, 22 bp, Homo sapiens
tctctcttttttgaacccgctc

SEQ ID NO: 5913 - DNA, 22 bp, Homo sapiens
ggtcagccttggatttggtagc

SEQ ID NO: 5914 - DNA, 22 bp, Homo sapiens
ctcgagagatcctcttgccacc

SEQ ID NO: 5915 - DNA, 22 bp, Homo sapiens
aaatgtggggctggaggcagga

SEQ ID NO: 5916 - DNA, 22 bp, Homo sapiens
caagccattctcctgcctcagc

SEQ ID NO: 5917 - DNA, 22 bp, Homo sapiens
ccactgtggaaagcagttcaga

SEQ ID NO: 5918 - DNA, 22 bp, Homo sapiens
tccagcccaggctggagtgtag

SEQ ID NO: 5919 - DNA, 22 bp, Homo sapiens
attcactgtgggtcctttggat

SEQ ID NO: 5920 - DNA, 22 bp, Homo sapiens
agcaagattgaggcttcctcag

SEQ ID NO: 5921 - DNA, 22 bp, Homo sapiens
gagaaagcttctttcccacagg

SEQ ID NO: 5922 - DNA, 22 bp, Homo sapiens
ttatgatttgccacagattggt

SEQ ID NO: 5923 - DNA, 22 bp, Homo sapiens
atgagagctgatgactttacaa

SEQ ID NO: 5924 - DNA, 22 bp, Homo sapiens
gggtggtggccagcagtgggca

SEQ ID NO: 5925 - DNA, 22 bp, Homo sapiens
ctcagctcattgtggatccggt

SEQ ID NO: 5926 - DNA, 22 bp, Homo sapiens
aggacaaaggaccagatctgga

SEQ ID NO: 5927 - DNA, 22 bp, Homo sapiens
agacacttcatgtaagtggaat

SEQ ID NO: 5928 - DNA, 22 bp, Homo sapiens
cctgccctgctcactgtcggta

SEQ ID NO: 5929 - DNA, 18 bp, Homo sapiens
ggctggataccttaggaa

SEQ ID NO: 5930 - DNA, 22 bp, Homo sapiens
tcttttgtgattcttcagttac

SEQ ID NO: 5931 - DNA, 22 bp, Homo sapiens
acgtcttcgttggcagagattt

SEQ ID NO: 5932 - DNA, 22 bp, Homo sapiens
ctctaccaggagtctccaccgt

SEQ ID NO: 5933 - DNA, 22 bp, Homo sapiens
acagacaagtagttcagacaag

SEQ ID NO: 5934 - DNA, 22 bp, Homo sapiens
tggtaatggttctcttgctata

SEQ ID NO: 5935 - DNA, 22 bp, Homo sapiens
cgtggcctctatggctcccgcc

SEQ ID NO: 5936 - DNA, 22 bp, Homo sapiens
tttacttcatttccagtgagga

SEQ ID NO: 5937 - DNA, 22 bp, Homo sapiens
tgcaccactgcactccagcctg

SEQ ID NO: 5938 - DNA, 22 bp, Homo sapiens
ggccctggtcctaggggtggaa

SEQ ID NO: 5939 - DNA, 22 bp, Homo sapiens
ctgtggccagagcgccgttgac

SEQ ID NO: 5940 - DNA, 22 bp, Homo sapiens
tgtccagctcgagacactatct

SEQ ID NO: 5941 - DNA, 22 bp, Homo sapiens
tagagagtcgggaacttacctg

SEQ ID NO: 5942 - DNA, 22 bp, Homo sapiens
tcagagagcagaacttttttac

SEQ ID NO: 5943 - DNA, 22 bp, Homo sapiens
cacgcctgtaatcccagcactt

SEQ ID NO: 5944 - DNA, 22 bp, Homo sapiens
tctgaaaactccatgagctcgt

SEQ ID NO: 5945 - DNA, 22 bp, Homo sapiens
attcaccttgataaggggatca

SEQ ID NO: 5946 - DNA, 22 bp, Homo sapiens
tttgttttcaatgtgtcattca

SEQ ID NO: 5947 - DNA, 22 bp, Homo sapiens
tcactgcatcctccgcctcctg

SEQ ID NO: 5948 - DNA, 22 bp, Homo sapiens
tcgcccaggctggagtgcagtg

SEQ ID NO: 5949 - DNA, 22 bp, Homo sapiens
cttttgtgattcctcagttact

SEQ ID NO: 5950 - DNA, 19 bp, Homo sapiens
ccacagcctgctgtcttcc

SEQ ID NO: 5951 - DNA, 22 bp, Homo sapiens
tgggagcagttgcatctccagt

SEQ ID NO: 5952 - DNA, 22 bp, Homo sapiens
tcaggcagtagaattgcttgaa

SEQ ID NO: 5953 - DNA, 22 bp, Homo sapiens
agcgggtctgcaagccttccct

SEQ ID NO: 5954 - DNA, 22 bp, Homo sapiens
gtggcccatcacgtttcgcctt

SEQ ID NO: 5955 - DNA, 22 bp, Homo sapiens
gcagctggaagtgacactctgt

SEQ ID NO: 5956 - DNA, 22 bp, Homo sapiens
caagtgatcctcccatcttggc

SEQ ID NO: 5957 - DNA, 22 bp, Homo sapiens
acatggcgggagtttcagatac

SEQ ID NO: 5958 - DNA, 22 bp, Homo sapiens
tcggtgcgcgaggcgcggtccc

SEQ ID NO: 5959 - DNA, 22 bp, Homo sapiens
tctcacagcctctggaggtagt

SEQ ID NO: 5960 - DNA, 22 bp, Homo sapiens
tgacaggaaacatgcagtgatt

SEQ ID NO: 5961 - DNA, 22 bp, Homo sapiens
tgctgggctggggcctcagacc

SEQ ID NO: 5962 - DNA, 22 bp, Homo sapiens
cagtagatttggtaaactagga

SEQ ID NO: 5963 - DNA, 22 bp, Homo sapiens
atgctctctgtcctgctcagag

SEQ ID NO: 5964 - DNA, 21 bp, Homo sapiens
tctgatggtagatgagatgtg

SEQ ID NO: 5965 - DNA, 22 bp, Homo sapiens
tcccagaaccctgccaggtcct

SEQ ID NO: 5966 - DNA, 22 bp, Homo sapiens
ccaattttattcttctgcaagt

SEQ ID NO: 5967 - DNA, 20 bp, Homo sapiens
gggtgtgtgcagggcctggt

SEQ ID NO: 5968 - DNA, 22 bp, Homo sapiens
tgttttaagctctagaagggga

SEQ ID NO: 5969 - DNA, 22 bp, Homo sapiens
tcacagcctggacagttgcctg

SEQ ID NO: 5970 - DNA, 22 bp, Homo sapiens
gagaggtggaggttgcagtgag

SEQ ID NO: 5971 - DNA, 22 bp, Homo sapiens
gagccaagattgtgtccctgca

SEQ ID NO: 5972 - DNA, 22 bp, Homo sapiens
tccgtgcccctggcactaggtc

SEQ ID NO: 5973 - DNA, 22 bp, Homo sapiens
tttcccagcctcagctcagcag

SEQ ID NO: 5974 - DNA, 22 bp, Homo sapiens
cactgcagcctctgcctctcag

SEQ ID NO: 5975 - DNA, 22 bp, Homo sapiens
attgtgaatagtgctgcaataa

SEQ ID NO: 5976 - DNA, 22 bp, Homo sapiens
gggtaattggggccttgcagtg

SEQ ID NO: 5977 - DNA, 22 bp, Homo sapiens
gaggtgtcatcaggcagctctg

SEQ ID NO: 5978 - DNA, 22 bp, Homo sapiens
aaactgctttccacagtggcta

SEQ ID NO: 5979 - DNA, 22 bp, Homo sapiens
cactgcactccagcctgggtca

SEQ ID NO: 5980 - DNA, 22 bp, Homo sapiens
gttggtgagtttctgatcacaa

SEQ ID NO: 5981 - DNA, 19 bp, Homo sapiens
cattaggattagagacaag

SEQ ID NO: 5982 - DNA, 22 bp, Homo sapiens
cgtcagggttgagcaggtagat

SEQ ID NO: 5983 - DNA, 22 bp, Homo sapiens
tttgcttcacaagtatggttct

SEQ ID NO: 5984 - DNA, 22 bp, Homo sapiens
tcaccggcagacgtggcctgat

SEQ ID NO: 5985 - DNA, 22 bp, Homo sapiens
aaagtgctgaaattacaggtgt

SEQ ID NO: 5986 - DNA, 19 bp, Homo sapiens
ggcatggggtccggggacc

SEQ ID NO: 5987 - DNA, 22 bp, Homo sapiens
caagtggaatgctcttcctccc

SEQ ID NO: 5988 - DNA, 22 bp, Homo sapiens
ctgatcccaggcactgtcgcaa

SEQ ID NO: 5989 - DNA, 22 bp, Homo sapiens
gaccaagatacagcatcataga

SEQ ID NO: 5990 - DNA, 22 bp, Homo sapiens
aagtcattggtagcttgatagg

SEQ ID NO: 5991 - DNA, 22 bp, Homo sapiens
tgtcctcatcctccagtctgtc

SEQ ID NO: 5992 - DNA, 22 bp, Homo sapiens
gacctggttgactgtgagcagg

SEQ ID NO: 5993 - DNA, 22 bp, Homo sapiens
gtgggggcaggcagtgctagga

SEQ ID NO: 5994 - DNA, 22 bp, Homo sapiens
gtgaaatatttaacgtccaggt

SEQ ID NO: 5995 - DNA, 20 bp, Homo sapiens
gtttctgattcagtaggtct

SEQ ID NO: 5996 - DNA, 22 bp, Homo sapiens
gtcatcttgctgttttagatct

SEQ ID NO: 5997 - DNA, 22 bp, Homo sapiens
ttctttgaatagatgttcccag

SEQ ID NO: 5998 - DNA, 22 bp, Homo sapiens
cgcccaggctggagagcagtgg

SEQ ID NO: 5999 - DNA, 22 bp, Homo sapiens
gggctgagacgatggggtcttc

SEQ ID NO: 6000 - DNA, 22 bp, Homo sapiens
tgcagcctggcttcgcgcctcc

SEQ ID NO: 6001 - DNA, 22 bp, Homo sapiens
acatcccatgcgcatctggcaa

SEQ ID NO: 6002 - DNA, 22 bp, Homo sapiens
ctgctcatcagccgagcagggc

SEQ ID NO: 6003 - DNA, 20 bp, Homo sapiens
ccccgtgtttagcatatcat

SEQ ID NO: 6004 - DNA, 22 bp, Homo sapiens
ggtttgacagcttggggctgtc

SEQ ID NO: 6005 - DNA, 22 bp, Homo sapiens
gtgtgaaagcttgtcctctgta

SEQ ID NO: 6006 - DNA, 22 bp, Homo sapiens
tgtgaagatagctgttacatct

SEQ ID NO: 6007 - DNA, 23 bp, Homo sapiens
atcattactttgataccttttct

SEQ ID NO: 6008 - DNA, 22 bp, Homo sapiens
tgacatctgtcataaaatgtat

SEQ ID NO: 6009 - DNA, 22 bp, Homo sapiens
ggtgtgattatgacatgtgact

SEQ ID NO: 6010 - DNA, 22 bp, Homo sapiens
gtggaggagaggcgccttgcgg

SEQ ID NO: 6011 - DNA, 22 bp, Homo sapiens
gaggagggagctggaagctctt

SEQ ID NO: 6012 - DNA, 22 bp, Homo sapiens
gcccttctgctgttaggtagcc

SEQ ID NO: 6013 - DNA, 19 bp, Homo sapiens
gagaaagcaggcacagcac

SEQ ID NO: 6014 - DNA, 22 bp, Homo sapiens
agtcccaacagcttacaaggaa

SEQ ID NO: 6015 - DNA, 22 bp, Homo sapiens
aaaagttattgatgcaggacaa

SEQ ID NO: 6016 - DNA, 19 bp, Homo sapiens
gcagacaggtccagagagg

SEQ ID NO: 6017 - DNA, 17 bp, Homo sapiens
tccttcagtgcctctgc

SEQ ID NO: 6018 - DNA, 22 bp, Homo sapiens
gccgcggcactggcctggctcc

SEQ ID NO: 6019 - DNA, 22 bp, Homo sapiens
cctagagccgcacctcctccac

SEQ ID NO: 6020 - DNA, 22 bp, Homo sapiens
acacttggagcaacacttatgg

SEQ ID NO: 6021 - DNA, 22 bp, Homo sapiens
tctcacatgcaaacagtccaca

SEQ ID NO: 6022 - DNA, 22 bp, Homo sapiens
gaggggtccaggaggcacttac

SEQ ID NO: 6023 - DNA, 22 bp, Homo sapiens
aatcacttagaacccaggaagt

SEQ ID NO: 6024 - DNA, 22 bp, Homo sapiens
cacagtggtccccgaagcccct

SEQ ID NO: 6025 - DNA, 22 bp, Homo sapiens
ggattgcaacaagctagtttag

SEQ ID NO: 6026 - DNA, 22 bp, Homo sapiens
gctcgttgaacctgtccccgag

SEQ ID NO: 6027 - DNA, 22 bp, Homo sapiens
aaagaaggtagggctggtgact

SEQ ID NO: 6028 - DNA, 22 bp, Homo sapiens
gcctccccaagcagcagggatt

SEQ ID NO: 6029 - DNA, 21 bp, Homo sapiens
gacactgcttactctgaccta

SEQ ID NO: 6030 - DNA, 22 bp, Homo sapiens
ttgcatagtgctgaggttcggg

SEQ ID NO: 6031 - DNA, 23 bp, Homo sapiens
cggcagcgtccggctacgggagg

SEQ ID NO: 6032 - DNA, 22 bp, Homo sapiens
gacaattgcttttgccgaataa

SEQ ID NO: 6033 - DNA, 22 bp, Homo sapiens
gtctctcaaaactagaagagaa

SEQ ID NO: 6034 - DNA, 22 bp, Homo sapiens
agaaagtgcttccctttggtga

SEQ ID NO: 6035 - DNA, 22 bp, Homo sapiens
tcgaaggcctcttgctcctcga

SEQ ID NO: 6036 - DNA, 22 bp, Homo sapiens
ttgtgaatagtgctgcaataaa

SEQ ID NO: 6037 - DNA, 22 bp, Homo sapiens
ctgaggtgtgaaatggtggcaa

SEQ ID NO: 6038 - DNA, 22 bp, Homo sapiens
gccaggctgaggctctggaaga

SEQ ID NO: 6039 - DNA, 22 bp, Homo sapiens
gtatttggaaaccaccagtgcc

SEQ ID NO: 6040 - DNA, 22 bp, Homo sapiens
aggtcaagagtaaatttgggta

SEQ ID NO: 6041 - DNA, 22 bp, Homo sapiens
ttgcccaggctggagtgcagta

SEQ ID NO: 6042 - DNA, 18 bp, Homo sapiens
actctgcggaggccccag

SEQ ID NO: 6043 - DNA, 22 bp, Homo sapiens
gggtcgctgccgctgctggacc

SEQ ID NO: 6044 - DNA, 22 bp, Homo sapiens
ggtgggagccaacacccttctg

SEQ ID NO: 6045 - DNA, 22 bp, Homo sapiens
atgaaaacggaccagagctatt

SEQ ID NO: 6046 - DNA, 22 bp, Homo sapiens
ctgtccctgagcaactcctgtt

SEQ ID NO: 6047 - DNA, 22 bp, Homo sapiens
gtccccaaaattacaagacaca

SEQ ID NO: 6048 - DNA, 22 bp, Homo sapiens
gtcagactgcactcaaggacag

SEQ ID NO: 6049 - DNA, 22 bp, Homo sapiens
gttgattccggggccatttcaa

SEQ ID NO: 6050 - DNA, 22 bp, Homo sapiens
actcccttggtggagaatgcaa

SEQ ID NO: 6051 - DNA, 22 bp, Homo sapiens
gctgggctgcgtcggggaagcc

SEQ ID NO: 6052 - DNA, 22 bp, Homo sapiens
agctcagggccaggcgcgtttc

SEQ ID NO: 6053 - DNA, 22 bp, Homo sapiens
ttggaatgttttaatataaatt

SEQ ID NO: 6054 - DNA, 22 bp, Homo sapiens
gagggtggtggcttaaggtgct

SEQ ID NO: 6055 - DNA, 22 bp, Homo sapiens
aagcgccatggttcctgcgcag

SEQ ID NO: 6056 - DNA, 22 bp, Homo sapiens
ttaaacatttatggaggcagca

SEQ ID NO: 6057 - DNA, 22 bp, Homo sapiens
tgtgacctcatcttaactggaa

SEQ ID NO: 6058 - DNA, 22 bp, Homo sapiens
tttctttatcatagcatctttg

SEQ ID NO: 6059 - DNA, 22 bp, Homo sapiens
agggaagtggtctgggaacttg

SEQ ID NO: 6060 - DNA, 22 bp, Homo sapiens
tgcagattcaaatgaaatgcaa

SEQ ID NO: 6061 - DNA, 22 bp, Homo sapiens
ccaaccagctatggaatcttgt

SEQ ID NO: 6062 - DNA, 22 bp, Homo sapiens
tggcaaattccaaagttaattc

SEQ ID NO: 6063 - DNA, 22 bp, Homo sapiens
tcctgaagaaggcagatatttg

SEQ ID NO: 6064 - DNA, 22 bp, Homo sapiens
actattagcatatcatgaatgg

SEQ ID NO: 6065 - DNA, 22 bp, Homo sapiens
cataaaaggtagcagtttgaaa

SEQ ID NO: 6066 - DNA, 22 bp, Homo sapiens
tagcaaaggatgactatgtacc

SEQ ID NO: 6067 - DNA, 22 bp, Homo sapiens
ctgaggcaggcagatcacttga

SEQ ID NO: 6068 - DNA, 22 bp, Homo sapiens
actgcaacacctcctgggttca

SEQ ID NO: 6069 - DNA, 21 bp, Homo sapiens
agaacccagcagcactgttct

SEQ ID NO: 6070 - DNA, 22 bp, Homo sapiens
gtggcccaggttggagtgcagt

SEQ ID NO: 6071 - DNA, 22 bp, Homo sapiens
ccgcccacactaaatatgagcg

SEQ ID NO: 6072 - DNA, 22 bp, Homo sapiens
ttagtctctttgcattgccata

SEQ ID NO: 6073 - DNA, 22 bp, Homo sapiens
ccaggattggaggctgtggtga

SEQ ID NO: 6074 - DNA, 22 bp, Homo sapiens
tggttcagttgcacaggctgtt

SEQ ID NO: 6075 - DNA, 22 bp, Homo sapiens
gaccttgtgatctgcccacctt

SEQ ID NO: 6076 - DNA, 22 bp, Homo sapiens
tgtttcctttctggtgagcata

SEQ ID NO: 6077 - DNA, 22 bp, Homo sapiens
agttgctttggatataacttct

SEQ ID NO: 6078 - DNA, 22 bp, Homo sapiens
tgccatcagctgactccaaggt

SEQ ID NO: 6079 - DNA, 23 bp, Homo sapiens
ttggcaaagcctatgaagtcctc

SEQ ID NO: 6080 - DNA, 22 bp, Homo sapiens
gaatcccaatctgttattgaca

SEQ ID NO: 6081 - DNA, 22 bp, Homo sapiens
tagatgaccttgtgttaggcaa

SEQ ID NO: 6082 - DNA, 22 bp, Homo sapiens
ggagatatttgtattctgtctc

SEQ ID NO: 6083 - DNA, 22 bp, Homo sapiens
cattaaacaaccttgaatcaat

SEQ ID NO: 6084 - DNA, 22 bp, Homo sapiens
tgccgctccaggtctcgcggtg

SEQ ID NO: 6085 - DNA, 22 bp, Homo sapiens
tcaaaccagccttgcatcccag

SEQ ID NO: 6086 - DNA, 22 bp, Homo sapiens
cgggcagtgcccagcggggcag

SEQ ID NO: 6087 - DNA, 22 bp, Homo sapiens
aaccaccaccgtaatttaccca

SEQ ID NO: 6088 - DNA, 22 bp, Homo sapiens
agatgcagtggttaacaataca

SEQ ID NO: 6089 - DNA, 22 bp, Homo sapiens
ctgtctgaatcctaagcttcct

SEQ ID NO: 6090 - DNA, 17 bp, Homo sapiens
catccgtgagctcggca

SEQ ID NO: 6091 - DNA, 18 bp, Homo sapiens
gcctgagggtcaagtgtg

SEQ ID NO: 6092 - DNA, 22 bp, Homo sapiens
gtgatctgccagcctcagcctc

SEQ ID NO: 6093 - DNA, 22 bp, Homo sapiens
cacggccactgcagcaccccag

SEQ ID NO: 6094 - DNA, 22 bp, Homo sapiens
taaatgttgtaagtacatctaa

SEQ ID NO: 6095 - DNA, 22 bp, Homo sapiens
agagagcccgggccagggcaca

SEQ ID NO: 6096 - DNA, 22 bp, Homo sapiens
tttacagcagcatgatttataa

SEQ ID NO: 6097 - DNA, 22 bp, Homo sapiens
agacagggtgatcgcttgagcc

SEQ ID NO: 6098 - DNA, 22 bp, Homo sapiens
cgattgtcatattctgttggat

SEQ ID NO: 6099 - DNA, 19 bp, Homo sapiens
atctgccttagtgctgctg

SEQ ID NO: 6100 - DNA, 22 bp, Homo sapiens
tcactacaaccgctacctgaca

SEQ ID NO: 6101 - DNA, 22 bp, Homo sapiens
aggtggcagatgggggtgctcg

SEQ ID NO: 6102 - DNA, 22 bp, Homo sapiens
ctcccagccttcgccagtctga

SEQ ID NO: 6103 - DNA, 22 bp, Homo sapiens
atggcctcagcatggagcttcg

SEQ ID NO: 6104 - DNA, 22 bp, Homo sapiens
tgtgtaggatttcctggagcct

SEQ ID NO: 6105 - DNA, 22 bp, Homo sapiens
cccaggaggtcaaggctgcagt

SEQ ID NO: 6106 - DNA, 22 bp, Homo sapiens
cttcttatcaagtggcaaatct

SEQ ID NO: 6107 - DNA, 22 bp, Homo sapiens
cggtctcccgtgtgtgtgcgct

SEQ ID NO: 6108 - DNA, 22 bp, Homo sapiens
gaagaggttcaacgtggtcatc

SEQ ID NO: 6109 - DNA, 22 bp, Homo sapiens
caagaatcaacattatttagtg

SEQ ID NO: 6110 - DNA, 22 bp, Homo sapiens
agcggggtgttttgggtggcct

SEQ ID NO: 6111 - DNA, 22 bp, Homo sapiens
actcatgtaagcggaatgtagt

SEQ ID NO: 6112 - DNA, 22 bp, Homo sapiens
gagcctcagggttttgttgaca

SEQ ID NO: 6113 - DNA, 22 bp, Homo sapiens
tgtcaatatgtaataactgaat

SEQ ID NO: 6114 - DNA, 22 bp, Homo sapiens
taggattccagaacagtgctgc

SEQ ID NO: 6115 - DNA, 22 bp, Homo sapiens
ttgtacttgccatagaacaaca

SEQ ID NO: 6116 - DNA, 22 bp, Homo sapiens
cgcggaggaggtcaggaggtga

SEQ ID NO: 6117 - DNA, 22 bp, Homo sapiens
atcttggggaatcctctgtgta

SEQ ID NO: 6118 - DNA, 22 bp, Homo sapiens
tgaaggtggctgtttgtgcata

SEQ ID NO: 6119 - DNA, 22 bp, Homo sapiens
actgggaagtcagagagaggct

SEQ ID NO: 6120 - DNA, 22 bp, Homo sapiens
gtctcctccctttcattcacct

SEQ ID NO: 6121 - DNA, 22 bp, Homo sapiens
cttctcaaagttgtgaatcagg

SEQ ID NO: 6122 - DNA, 22 bp, Homo sapiens
tcagttacttgcttgtttgaaa

SEQ ID NO: 6123 - DNA, 22 bp, Homo sapiens
gtgggcatcaccagggcctcca

SEQ ID NO: 6124 - DNA, 22 bp, Homo sapiens
aagtggcagttcaggaagcaga

SEQ ID NO: 6125 - DNA, 22 bp, Homo sapiens
catagcggtattccacgtggtt

SEQ ID NO: 6126 - DNA, 22 bp, Homo sapiens
gaaccctagcatgtcctttagg

SEQ ID NO: 6127 - DNA, 22 bp, Homo sapiens
tttatagtagcatgatttataa

SEQ ID NO: 6128 - DNA, 22 bp, Homo sapiens
caagcaccatgtgctccatgtt

SEQ ID NO: 6129 - DNA, 22 bp, Homo sapiens
gagagaagggggatatgagcct

SEQ ID NO: 6130 - DNA, 22 bp, Homo sapiens
tttgtagattttctctccagta

SEQ ID NO: 6131 - DNA, 22 bp, Homo sapiens
tccagtatcaaagtcctagtcc

SEQ ID NO: 6132 - DNA, 22 bp, Homo sapiens
gcttggctttactagggggaca

SEQ ID NO: 6133 - DNA, 22 bp, Homo sapiens
catgaaattgtattggcctcaa

SEQ ID NO: 6134 - DNA, 22 bp, Homo sapiens
tagttagagaagccacagtgga

SEQ ID NO: 6135 - DNA, 23 bp, Homo sapiens
caaaatgctatgtgcccaatgca

SEQ ID NO: 6136 - DNA, 22 bp, Homo sapiens
gcagtggcatgatgtgggctca

SEQ ID NO: 6137 - DNA, 22 bp, Homo sapiens
aaatcccatcggagaggaggat

SEQ ID NO: 6138 - DNA, 22 bp, Homo sapiens
tgcctccaacagcccatcctag

SEQ ID NO: 6139 - DNA, 22 bp, Homo sapiens
tcaccaggctagagtgcagtgg

SEQ ID NO: 6140 - DNA, 22 bp, Homo sapiens
cccactgctgcgccgggcgccg

SEQ ID NO: 6141 - DNA, 22 bp, Homo sapiens
aggctgagataggtggatcatt

SEQ ID NO: 6142 - DNA, 22 bp, Homo sapiens
attcacctttccccaaaatgag

SEQ ID NO: 6143 - DNA, 22 bp, Homo sapiens
cagctcacccatcacgtctgct

SEQ ID NO: 6144 - DNA, 22 bp, Homo sapiens
agtgctgtcagttttatagata

SEQ ID NO: 6145 - DNA, 22 bp, Homo sapiens
ttgcgcgcggctaggtctcggt

SEQ ID NO: 6146 - DNA, 22 bp, Homo sapiens
cttcctttgctgttcggaggtt

SEQ ID NO: 6147 - DNA, 22 bp, Homo sapiens
cagcttggaggaggatctaaga

SEQ ID NO: 6148 - DNA, 22 bp, Homo sapiens
tcacatctaattccatttctgc

SEQ ID NO: 6149 - DNA, 22 bp, Homo sapiens
gaattcttttctttctgaaagt

SEQ ID NO: 6150 - DNA, 22 bp, Homo sapiens
tacagctgcaagggtttctggg

SEQ ID NO: 6151 - DNA, 22 bp, Homo sapiens
gtgacacccgcatgccactgtg

SEQ ID NO: 6152 - DNA, 22 bp, Homo sapiens
agaagcagaaactgggcttgtg

SEQ ID NO: 6153 - DNA, 19 bp, Homo sapiens
ttcagcattatattctagc

SEQ ID NO: 6154 - DNA, 22 bp, Homo sapiens
gcttggccaacatggtgaaacc

SEQ ID NO: 6155 - DNA, 22 bp, Homo sapiens
gcgaggaggggtgctgggcccc

SEQ ID NO: 6156 - DNA, 22 bp, Homo sapiens
tttggactgcatgatgatctgg

SEQ ID NO: 6157 - DNA, 22 bp, Homo sapiens
cgccgtaaatgcaagcctgtag

SEQ ID NO: 6158 - DNA, 22 bp, Homo sapiens
aacagaatgcaggggatgctgc

SEQ ID NO: 6159 - DNA, 22 bp, Homo sapiens
tagtgaatgggggttatgagac

SEQ ID NO: 6160 - DNA, 22 bp, Homo sapiens
gaagatgttatggagagctcag

SEQ ID NO: 6161 - DNA, 22 bp, Homo sapiens
ttgcactccagtctgggaacaa

SEQ ID NO: 6162 - DNA, 22 bp, Homo sapiens
aggctggagtgcagtggtgtga

SEQ ID NO: 6163 - DNA, 22 bp, Homo sapiens
ctgatcctcctttaagtagctg

SEQ ID NO: 6164 - DNA, 22 bp, Homo sapiens
ccagagctgattcctgggactt

SEQ ID NO: 6165 - DNA, 22 bp, Homo sapiens
agacactgttctcacatgcttg

SEQ ID NO: 6166 - DNA, 19 bp, Homo sapiens
ctcgtgcacccatcacctg

SEQ ID NO: 6167 - DNA, 22 bp, Homo sapiens
cagtcctgaatactggacggtg

SEQ ID NO: 6168 - DNA, 22 bp, Homo sapiens
aacatagccagaatgtctcctg

SEQ ID NO: 6169 - DNA, 22 bp, Homo sapiens
gtcctcgcggcgcgaagccagt

SEQ ID NO: 6170 - DNA, 22 bp, Homo sapiens
aatactgcctgtgaggtaactc

SEQ ID NO: 6171 - DNA, 21 bp, Homo sapiens
gttcttgcaggatttccttcc

SEQ ID NO: 6172 - DNA, 22 bp, Homo sapiens
cttatcagattatctgggctgt

SEQ ID NO: 6173 - DNA, 22 bp, Homo sapiens
tctggcaatctgattctgcatc

SEQ ID NO: 6174 - DNA, 22 bp, Homo sapiens
tacaaagtcttgggttctaggc

SEQ ID NO: 6175 - DNA, 22 bp, Homo sapiens
tcgtacagcagactgaagtcct

SEQ ID NO: 6176 - DNA, 22 bp, Homo sapiens
taccagggaacagggatattaa

SEQ ID NO: 6177 - DNA, 22 bp, Homo sapiens
gctcactgcaagctctgcctcc

SEQ ID NO: 6178 - DNA, 22 bp, Homo sapiens
acatagtgttttgagagacagc

SEQ ID NO: 6179 - DNA, 22 bp, Homo sapiens
atcccaagctctacaagtgatt

SEQ ID NO: 6180 - DNA, 22 bp, Homo sapiens
tggctgttggagctggaagatg

SEQ ID NO: 6181 - DNA, 22 bp, Homo sapiens
gggaaggaaagttattagcaga

SEQ ID NO: 6182 - DNA, 22 bp, Homo sapiens
tgcaggcctggactgatgtggt

SEQ ID NO: 6183 - DNA, 22 bp, Homo sapiens
atagcagggatgtcagcaagta

SEQ ID NO: 6184 - DNA, 22 bp, Homo sapiens
gttcccaccatgctgcacccat

SEQ ID NO: 6185 - DNA, 22 bp, Homo sapiens
gtgagttcccggatctgttcca

SEQ ID NO: 6186 - DNA, 18 bp, Homo sapiens
ttcacaagggcttggttt

SEQ ID NO: 6187 - DNA, 22 bp, Homo sapiens
catggtgggtgtagtttccgcc

SEQ ID NO: 6188 - DNA, 22 bp, Homo sapiens
tctcttggagagtccatcatca

SEQ ID NO: 6189 - DNA, 23 bp, Homo sapiens
gcctgccgcctggctgagaactg

SEQ ID NO: 6190 - DNA, 22 bp, Homo sapiens
cgtgtggacatgactagctgcc

SEQ ID NO: 6191 - DNA, 21 bp, Homo sapiens
aggcttggatctagacaggcc

SEQ ID NO: 6192 - DNA, 22 bp, Homo sapiens
tccgaggccaaagctgtgaata

SEQ ID NO: 6193 - DNA, 22 bp, Homo sapiens
tgtgttccagagcatccaggtc

SEQ ID NO: 6194 - DNA, 22 bp, Homo sapiens
ataataacaatgccagatgcct

SEQ ID NO: 6195 - DNA, 22 bp, Homo sapiens
ttcttcatgggttcttttagga

SEQ ID NO: 6196 - DNA, 22 bp, Homo sapiens
ctgagccaaggggacagtgaca

SEQ ID NO: 6197 - DNA, 22 bp, Homo sapiens
tgctagtgtgtgagatgttcaa

SEQ ID NO: 6198 - DNA, 22 bp, Homo sapiens
tcttgagctttatccagtttct

SEQ ID NO: 6199 - DNA, 22 bp, Homo sapiens
gtagaggtagacttccttgtct

SEQ ID NO: 6200 - DNA, 22 bp, Homo sapiens
gccagtggtcactgaggaagaa

SEQ ID NO: 6201 - DNA, 22 bp, Homo sapiens
acccggaggcgggggatgcagt

SEQ ID NO: 6202 - DNA, 22 bp, Homo sapiens
acccgggcaaggattctgagag

SEQ ID NO: 6203 - DNA, 22 bp, Homo sapiens
ctgggaggcggaggttgtagtg

SEQ ID NO: 6204 - DNA, 22 bp, Homo sapiens
tctatgcttgagacagatgggg

SEQ ID NO: 6205 - DNA, 22 bp, Homo sapiens
aaagaaatagatggcatttaaa

SEQ ID NO: 6206 - DNA, 22 bp, Homo sapiens
tataaagagtctcaaagaagtt

SEQ ID NO: 6207 - DNA, 22 bp, Homo sapiens
aaagtgctgagattacaagcgt

SEQ ID NO: 6208 - DNA, 22 bp, Homo sapiens
aaagtgctgggattacaggcgt

SEQ ID NO: 6209 - DNA, 22 bp, Homo sapiens
tgggcttggtttctaggtaggt

SEQ ID NO: 6210 - DNA, 22 bp, Homo sapiens
actgccaatggtagtttgatgg

SEQ ID NO: 6211 - DNA, 22 bp, Homo sapiens
ggattgaaggcccttaactgat

SEQ ID NO: 6212 - DNA, 22 bp, Homo sapiens
agctgtcaccaggagccggacc

SEQ ID NO: 6213 - DNA, 22 bp, Homo sapiens
atgacttgctgtgcttgggagc

SEQ ID NO: 6214 - DNA, 22 bp, Homo sapiens
ccgtggggggccgtcgtccctg

SEQ ID NO: 6215 - DNA, 22 bp, Homo sapiens
gctcccaccttaaccttcacat

SEQ ID NO: 6216 - DNA, 22 bp, Homo sapiens
ccaggggggcgtagatgctggg

SEQ ID NO: 6217 - DNA, 22 bp, Homo sapiens
ctgcaccctcaaactcctgggc

SEQ ID NO: 6218 - DNA, 21 bp, Homo sapiens
ccagagcctgagaggattatg

SEQ ID NO: 6219 - DNA, 22 bp, Homo sapiens
aaaatggtctcagctggcacca

SEQ ID NO: 6220 - DNA, 22 bp, Homo sapiens
ctactggccatctgatctacaa

SEQ ID NO: 6221 - DNA, 22 bp, Homo sapiens
ttgaggtcatctgaagtactag

SEQ ID NO: 6222 - DNA, 22 bp, Homo sapiens
gccgtggggagagagggtgcgt

SEQ ID NO: 6223 - DNA, 22 bp, Homo sapiens
tgcctagttctgtatttacagt

SEQ ID NO: 6224 - DNA, 22 bp, Homo sapiens
aagtaggtaccgcgcagcaggg

SEQ ID NO: 6225 - DNA, 22 bp, Homo sapiens
gtcggccacgcaggtgcggtag

SEQ ID NO: 6226 - DNA, 22 bp, Homo sapiens
cgttgtttgagattttcagaat

SEQ ID NO: 6227 - DNA, 22 bp, Homo sapiens
agtgaccgaggcacttggcaac

SEQ ID NO: 6228 - DNA, 22 bp, Homo sapiens
agtggcacaactgtttagctac

SEQ ID NO: 6229 - DNA, 22 bp, Homo sapiens
taattcttcaggccttttgtct

SEQ ID NO: 6230 - DNA, 22 bp, Homo sapiens
tacccagtgccaccctctgagg

SEQ ID NO: 6231 - DNA, 22 bp, Homo sapiens
ttcataaacaaattaaggcctg

SEQ ID NO: 6232 - DNA, 22 bp, Homo sapiens
tgaatagagctgcagtggacat

SEQ ID NO: 6233 - DNA, 22 bp, Homo sapiens
ttaccacagtgcctgtctaatg

SEQ ID NO: 6234 - DNA, 22 bp, Homo sapiens
tcgaaggaggcactcagacatg

SEQ ID NO: 6235 - DNA, 22 bp, Homo sapiens
gcgcttccaccgaaggcagctc

SEQ ID NO: 6236 - DNA, 22 bp, Homo sapiens
atgatgtaaaataagttgtgag

SEQ ID NO: 6237 - DNA, 22 bp, Homo sapiens
tgaatttcacaaggtgaggata

SEQ ID NO: 6238 - DNA, 23 bp, Homo sapiens
ggacttcatgcattaacagcatc

SEQ ID NO: 6239 - DNA, 22 bp, Homo sapiens
ccgagctgtggtctcttttacg

SEQ ID NO: 6240 - DNA, 22 bp, Homo sapiens
ctggctgggagcgagctgctca

SEQ ID NO: 6241 - DNA, 22 bp, Homo sapiens
gccagagttgaggcagtttatt

SEQ ID NO: 6242 - DNA, 22 bp, Homo sapiens
caaaatgcatctgagaccaggc

SEQ ID NO: 6243 - DNA, 22 bp, Homo sapiens
gagaaagctaaataagttgatt

SEQ ID NO: 6244 - DNA, 22 bp, Homo sapiens
agcccaggagtttgaggctgtg

SEQ ID NO: 6245 - DNA, 22 bp, Homo sapiens
cactgcaagctctgccacctgg

SEQ ID NO: 6246 - DNA, 22 bp, Homo sapiens
tagtggatgggtaaagtatttt

SEQ ID NO: 6247 - DNA, 22 bp, Homo sapiens
atcaagggcgcgtggttcggcg

SEQ ID NO: 6248 - DNA, 22 bp, Homo sapiens
agcctagggttctgatgtcact

SEQ ID NO: 6249 - DNA, 22 bp, Homo sapiens
actcaagtcataggcttctttc

SEQ ID NO: 6250 - DNA, 23 bp, Homo sapiens
tcggtgggcgtggaggccgaggc

SEQ ID NO: 6251 - DNA, 22 bp, Homo sapiens
ttcgactctgtgcctgaagagc

SEQ ID NO: 6252 - DNA, 22 bp, Homo sapiens
tgcactccaggctgggtgacag

SEQ ID NO: 6253 - DNA, 22 bp, Homo sapiens
ggctccccaggtccaggagctg

SEQ ID NO: 6254 - DNA, 22 bp, Homo sapiens
tagcccctgcctttgaacctgg

SEQ ID NO: 6255 - DNA, 23 bp, Homo sapiens
catgatgttaactttgttatgct

SEQ ID NO: 6256 - DNA, 22 bp, Homo sapiens
aagtggactaatacaaggacta

SEQ ID NO: 6257 - DNA, 22 bp, Homo sapiens
tttaggttttttcacgtggcta

SEQ ID NO: 6258 - DNA, 22 bp, Homo sapiens
atggcagcggagctggaaatga

SEQ ID NO: 6259 - DNA, 22 bp, Homo sapiens
cacttcaacctctgagtcctgg

SEQ ID NO: 6260 - DNA, 22 bp, Homo sapiens
gtcgtgcagacctcacagcatt

SEQ ID NO: 6261 - DNA, 22 bp, Homo sapiens
taattataacagttacatctta

SEQ ID NO: 6262 - DNA, 22 bp, Homo sapiens
tctaggcctggcttgggcccag

SEQ ID NO: 6263 - DNA, 22 bp, Homo sapiens
gtcagaggggcagctgccaggc

SEQ ID NO: 6264 - DNA, 22 bp, Homo sapiens
cttccgtgtcagttccaggtgg

SEQ ID NO: 6265 - DNA, 22 bp, Homo sapiens
gtacagtgggtgtagggaccag

SEQ ID NO: 6266 - DNA, 22 bp, Homo sapiens
tttcctcttctggcaggcaggg

SEQ ID NO: 6267 - DNA, 22 bp, Homo sapiens
atctgagtcaaatatttcattt

SEQ ID NO: 6268 - DNA, 22 bp, Homo sapiens
cttttgattgagcagtttcaaa

SEQ ID NO: 6269 - DNA, 22 bp, Homo sapiens
tgaccgttttggcacccatgct

SEQ ID NO: 6270 - DNA, 18 bp, Homo sapiens
tgagaggctattttttgc

SEQ ID NO: 6271 - DNA, 22 bp, Homo sapiens
cactgcacttcagcctgggcga

SEQ ID NO: 6272 - DNA, 22 bp, Homo sapiens
cccaggaggtggaggctgcagt

SEQ ID NO: 6273 - DNA, 22 bp, Homo sapiens
tccataaattttatgaacatat

SEQ ID NO: 6274 - DNA, 22 bp, Homo sapiens
ctgcatccatgttgctgcaaag

SEQ ID NO: 6275 - DNA, 22 bp, Homo sapiens
ttcctcaggctgctttcacata

SEQ ID NO: 6276 - DNA, 19 bp, Homo sapiens
cttgaaactactgttgaga

SEQ ID NO: 6277 - DNA, 22 bp, Homo sapiens
atagtatttaatagttagctca

SEQ ID NO: 6278 - DNA, 22 bp, Homo sapiens
tcagtgatttctggggtgaggg

SEQ ID NO: 6279 - DNA, 22 bp, Homo sapiens
aaagagactggtggcattttgc

SEQ ID NO: 6280 - DNA, 20 bp, Homo sapiens
ggggcccaagccctcttgcc

SEQ ID NO: 6281 - DNA, 22 bp, Homo sapiens
tttgctcagtttgataatttga

SEQ ID NO: 6282 - DNA, 22 bp, Homo sapiens
aagcagcacagcaatgactcta

SEQ ID NO: 6283 - DNA, 22 bp, Homo sapiens
tttgtcttatccaatctctcag

SEQ ID NO: 6284 - DNA, 22 bp, Homo sapiens
gcggcgcctgggacccgccagc

SEQ ID NO: 6285 - DNA, 19 bp, Homo sapiens
atcaggcttctattttctc

SEQ ID NO: 6286 - DNA, 22 bp, Homo sapiens
tagcacagcttcttgatgtcac

SEQ ID NO: 6287 - DNA, 22 bp, Homo sapiens
tgctcttcacagtttcagcatc

SEQ ID NO: 6288 - DNA, 22 bp, Homo sapiens
aatggtttctgaagttaggcag

SEQ ID NO: 6289 - DNA, 22 bp, Homo sapiens
tcccagctactctagaggctga

SEQ ID NO: 6290 - DNA, 22 bp, Homo sapiens
tggaggcgagagcgcgcgggct

SEQ ID NO: 6291 - DNA, 22 bp, Homo sapiens
ccagcagccaccttctcgaaat

SEQ ID NO: 6292 - DNA, 22 bp, Homo sapiens
ggtgcagtgcagggtaattata

SEQ ID NO: 6293 - DNA, 22 bp, Homo sapiens
ttgtgaaacattcatggatttg

SEQ ID NO: 6294 - DNA, 23 bp, Homo sapiens
agctctgctcgggcatgccctgc

SEQ ID NO: 6295 - DNA, 17 bp, Homo sapiens
tgcatgtcctttgttcc

SEQ ID NO: 6296 - DNA, 22 bp, Homo sapiens
ctaaactgctctggggttctaa

SEQ ID NO: 6297 - DNA, 17 bp, Homo sapiens
agttggcagccgttgct

SEQ ID NO: 6298 - DNA, 22 bp, Homo sapiens
agattcaggcatgtcttcattt

SEQ ID NO: 6299 - DNA, 22 bp, Homo sapiens
ctcagcttttcccggataggtg

SEQ ID NO: 6300 - DNA, 22 bp, Homo sapiens
actaggggctcaggcccaggga

SEQ ID NO: 6301 - DNA, 22 bp, Homo sapiens
tttacacagaggacactgggct

SEQ ID NO: 6302 - DNA, 22 bp, Homo sapiens
tggacacaaagatcaaatattg

SEQ ID NO: 6303 - DNA, 22 bp, Homo sapiens
ctgagatggagtttcgctcttc

SEQ ID NO: 6304 - DNA, 22 bp, Homo sapiens
ggggcattgtgtctgggttcct

SEQ ID NO: 6305 - DNA, 22 bp, Homo sapiens
aggggagagttaatgtgaatgt

SEQ ID NO: 6306 - DNA, 22 bp, Homo sapiens
taggctaggctgaaggttttgg

SEQ ID NO: 6307 - DNA, 22 bp, Homo sapiens
atgctgtttgcttttagtctgc

SEQ ID NO: 6308 - DNA, 22 bp, Homo sapiens
gacgtgaaggcagcggggctcg

SEQ ID NO: 6309 - DNA, 22 bp, Homo sapiens
ttgagactgccttgtcgtctgc

SEQ ID NO: 6310 - DNA, 22 bp, Homo sapiens
tacagtcacattctgaggtctt

SEQ ID NO: 6311 - DNA, 21 bp, Homo sapiens
gttctacagttttagaattcc

SEQ ID NO: 6312 - DNA, 22 bp, Homo sapiens
tgaggccggagacaagagactt

SEQ ID NO: 6313 - DNA, 22 bp, Homo sapiens
cagcaggaggtgagtagcaggt

SEQ ID NO: 6314 - DNA, 22 bp, Homo sapiens
gctggcagacttcctctggaac

SEQ ID NO: 6315 - DNA, 22 bp, Homo sapiens
tggggttttaacatgttgccag

SEQ ID NO: 6316 - DNA, 22 bp, Homo sapiens
gactgtgacttctgaagcaata

SEQ ID NO: 6317 - DNA, 22 bp, Homo sapiens
cctccaaccataggtccagggg

SEQ ID NO: 6318 - DNA, 22 bp, Homo sapiens
agcctgagaaaggagtttggag

SEQ ID NO: 6319 - DNA, 22 bp, Homo sapiens
gatttagtggcccttggtacac

SEQ ID NO: 6320 - DNA, 22 bp, Homo sapiens
agccccaaacaccaggattact

SEQ ID NO: 6321 - DNA, 22 bp, Homo sapiens
agtctcaaactcctaggctcga

SEQ ID NO: 6322 - DNA, 22 bp, Homo sapiens
ccacccttgggttcggaggccg

SEQ ID NO: 6323 - DNA, 22 bp, Homo sapiens
gttcagatttgactggtttctc

SEQ ID NO: 6324 - DNA, 21 bp, Homo sapiens
ccgccgctgatagctctgggc

SEQ ID NO: 6325 - DNA, 22 bp, Homo sapiens
tccggactcacctgacaatggc

SEQ ID NO: 6326 - DNA, 22 bp, Homo sapiens
gacccacctcaccaagcatgtg

SEQ ID NO: 6327 - DNA, 22 bp, Homo sapiens
aggggctcctttgtgctgcgtc

SEQ ID NO: 6328 - DNA, 23 bp, Homo sapiens
ggttccaggaacacagcctgatg

SEQ ID NO: 6329 - DNA, 22 bp, Homo sapiens
atttgtgggactataatgcagg

SEQ ID NO: 6330 - DNA, 22 bp, Homo sapiens
agtacctggtatatgattatga

SEQ ID NO: 6331 - DNA, 22 bp, Homo sapiens
tcttcacgccaagtgcccctca

SEQ ID NO: 6332 - DNA, 18 bp, Homo sapiens
gaggtagataagattttc

SEQ ID NO: 6333 - DNA, 22 bp, Homo sapiens
aatgttgtgcatgtattttgta

SEQ ID NO: 6334 - DNA, 22 bp, Homo sapiens
tcactgccattagttggttaat

SEQ ID NO: 6335 - DNA, 22 bp, Homo sapiens
tgctgagcttccactgcttctg

SEQ ID NO: 6336 - DNA, 23 bp, Homo sapiens
ggcctcagtgatgatgggttaaa

SEQ ID NO: 6337 - DNA, 22 bp, Homo sapiens
aaaatcttgtgacttaggaagg

SEQ ID NO: 6338 - DNA, 22 bp, Homo sapiens
cctactctgagcgcctccgcat

SEQ ID NO: 6339 - DNA, 22 bp, Homo sapiens
aaggctcggcaatgtgcggctc

SEQ ID NO: 6340 - DNA, 22 bp, Homo sapiens
atattgcttgaggccaggaggt

SEQ ID NO: 6341 - DNA, 22 bp, Homo sapiens
tttccctttagcctgagaatcc

SEQ ID NO: 6342 - DNA, 22 bp, Homo sapiens
caaagtgctaggattataggtg

SEQ ID NO: 6343 - DNA, 22 bp, Homo sapiens
aggccttaccatagctgtagca

SEQ ID NO: 6344 - DNA, 22 bp, Homo sapiens
gaggcaggaggattgcttgagc

SEQ ID NO: 6345 - DNA, 22 bp, Homo sapiens
cggccaggcacagtggcccacg

SEQ ID NO: 6346 - DNA, 22 bp, Homo sapiens
agaatagaattctcatagaatt

SEQ ID NO: 6347 - DNA, 22 bp, Homo sapiens
ggcttggaaactagagtgtgca

SEQ ID NO: 6348 - DNA, 22 bp, Homo sapiens
tagaggttgacagtgactgtga

SEQ ID NO: 6349 - DNA, 19 bp, Homo sapiens
tcattgtgctgagcaaggt

SEQ ID NO: 6350 - DNA, 22 bp, Homo sapiens
ttggaaacgtcaccttttcctt

SEQ ID NO: 6351 - DNA, 22 bp, Homo sapiens
attgcactccatcctgggcaat

SEQ ID NO: 6352 - DNA, 22 bp, Homo sapiens
ttgtttccataattaagtgtga

SEQ ID NO: 6353 - DNA, 22 bp, Homo sapiens
caccaaagtcgcttctgtcgtc

SEQ ID NO: 6354 - DNA, 22 bp, Homo sapiens
caggaaggggctcactctggcc

SEQ ID NO: 6355 - DNA, 22 bp, Homo sapiens
ttctgcagtgttaacaatgtca

SEQ ID NO: 6356 - DNA, 22 bp, Homo sapiens
gaggcagtgaacaattcctgtg

SEQ ID NO: 6357 - DNA, 21 bp, Homo sapiens
ctctgaatcctgcttctcagt

SEQ ID NO: 6358 - DNA, 22 bp, Homo sapiens
tgccagtcagttggtgtgggac

SEQ ID NO: 6359 - DNA, 22 bp, Homo sapiens
ccctctacagggaagcgctttc

SEQ ID NO: 6360 - DNA, 22 bp, Homo sapiens
tgacagaactcattctcaccaa

SEQ ID NO: 6361 - DNA, 22 bp, Homo sapiens
tccgggtgcccacgtgccccta

SEQ ID NO: 6362 - DNA, 22 bp, Homo sapiens
gtgcttccatctagagggtcac

SEQ ID NO: 6363 - DNA, 22 bp, Homo sapiens
aattgaaaatattgtagaccat

SEQ ID NO: 6364 - DNA, 22 bp, Homo sapiens
gaggctgaggcggatggatcac

SEQ ID NO: 6365 - DNA, 19 bp, Homo sapiens
tgtgatattgttagtaata

SEQ ID NO: 6366 - DNA, 22 bp, Homo sapiens
accacccagccagcttctccct

SEQ ID NO: 6367 - DNA, 22 bp, Homo sapiens
ggaagtcctcatacctgattct

SEQ ID NO: 6368 - DNA, 22 bp, Homo sapiens
cttaatctcacctgcaaagtcc

SEQ ID NO: 6369 - DNA, 22 bp, Homo sapiens
agaggcaggaggttgacttgag

SEQ ID NO: 6370 - DNA, 22 bp, Homo sapiens
gacaattagatcattcctttga

SEQ ID NO: 6371 - DNA, 22 bp, Homo sapiens
tacagtgcttggtatctagtaa

SEQ ID NO: 6372 - DNA, 22 bp, Homo sapiens
gggttcttatagtatcagagct

SEQ ID NO: 6373 - DNA, 22 bp, Homo sapiens
gggccatgagaggttcatcaac

SEQ ID NO: 6374 - DNA, 22 bp, Homo sapiens
ggctcttccgccaccagccaca

SEQ ID NO: 6375 - DNA, 22 bp, Homo sapiens
agtcaaggtggaccagaaaaat

SEQ ID NO: 6376 - DNA, 22 bp, Homo sapiens
cccccaaagtttgcacggataa

SEQ ID NO: 6377 - DNA, 22 bp, Homo sapiens
ccaggtgtgctctgcagtggat

SEQ ID NO: 6378 - DNA, 22 bp, Homo sapiens
gggcccggaccttcctctctga

SEQ ID NO: 6379 - DNA, 22 bp, Homo sapiens
ccagtgacttgccaggtggatc

SEQ ID NO: 6380 - DNA, 22 bp, Homo sapiens
tgttttcgatcatttcacagta

SEQ ID NO: 6381 - DNA, 22 bp, Homo sapiens
acattcagaatcttgtagcagt

SEQ ID NO: 6382 - DNA, 22 bp, Homo sapiens
gcagcctcaaactccccagctc

SEQ ID NO: 6383 - DNA, 21 bp, Homo sapiens
acacaggcagtgtcccgaggt

SEQ ID NO: 6384 - DNA, 22 bp, Homo sapiens
aaggtcagagtgagctgtggcc

SEQ ID NO: 6385 - DNA, 22 bp, Homo sapiens
gttccgtttatatgctggatta

SEQ ID NO: 6386 - DNA, 22 bp, Homo sapiens
tgcagcattgcactccagcctg

SEQ ID NO: 6387 - DNA, 22 bp, Homo sapiens
gcaggtctatcaggctgcaggt

SEQ ID NO: 6388 - DNA, 22 bp, Homo sapiens
agatgtgagaatcaagtgacca

SEQ ID NO: 6389 - DNA, 22 bp, Homo sapiens
atgtcactgttgttattgttat

SEQ ID NO: 6390 - DNA, 22 bp, Homo sapiens
atggtttattagctgcacaggc

SEQ ID NO: 6391 - DNA, 22 bp, Homo sapiens
taatggtgtttttctgtaattt

SEQ ID NO: 6392 - DNA, 22 bp, Homo sapiens
aatattatcaaaagctttttca

SEQ ID NO: 6393 - DNA, 22 bp, Homo sapiens
atgcaggcagacactgtgggca

SEQ ID NO: 6394 - DNA, 22 bp, Homo sapiens
tcaccgtcgggggtcgctgtct

SEQ ID NO: 6395 - DNA, 22 bp, Homo sapiens
tctctagtctcctttaacctga

SEQ ID NO: 6396 - DNA, 22 bp, Homo sapiens
gcaaagaatgcagatttgcctc

SEQ ID NO: 6397 - DNA, 22 bp, Homo sapiens
tactagttcccagctaaaagta

SEQ ID NO: 6398 - DNA, 22 bp, Homo sapiens
tgcctgataccctctgtctctc

SEQ ID NO: 6399 - DNA, 22 bp, Homo sapiens
tgatgcctaatatacttcaatt

SEQ ID NO: 6400 - DNA, 22 bp, Homo sapiens
ttgccttgttattctctcagaa

SEQ ID NO: 6401 - DNA, 17 bp, Homo sapiens
gaacttgttcactgtga

SEQ ID NO: 6402 - DNA, 22 bp, Homo sapiens
cctgtatttaaaaatattctaa

SEQ ID NO: 6403 - DNA, 19 bp, Homo sapiens
agaaccactgctctcttca

SEQ ID NO: 6404 - DNA, 22 bp, Homo sapiens
atacagttatagtcagggctaa

SEQ ID NO: 6405 - DNA, 23 bp, Homo sapiens
actgcagtcttgatctcctgggc

SEQ ID NO: 6406 - DNA, 22 bp, Homo sapiens
tctcagctcatggcagccttga

SEQ ID NO: 6407 - DNA, 22 bp, Homo sapiens
attgttgggtctcactcctaga

SEQ ID NO: 6408 - DNA, 22 bp, Homo sapiens
actgtgtgtttgtctagcacag

SEQ ID NO: 6409 - DNA, 22 bp, Homo sapiens
atggatggaactctgctgtggt

SEQ ID NO: 6410 - DNA, 22 bp, Homo sapiens
tacatttataaggcttctctgt

SEQ ID NO: 6411 - DNA, 22 bp, Homo sapiens
ttccagagagttattcccctgg

SEQ ID NO: 6412 - DNA, 22 bp, Homo sapiens
cctcgtccacaatccttgcaca

SEQ ID NO: 6413 - DNA, 22 bp, Homo sapiens
tggtcgaccagttggaaagtaa

SEQ ID NO: 6414 - DNA, 22 bp, Homo sapiens
agcctggcggtcgtcggtcagg

SEQ ID NO: 6415 - DNA, 22 bp, Homo sapiens
acatctagactcttgccctctt

SEQ ID NO: 6416 - DNA, 22 bp, Homo sapiens
ctggtctgccacccacacccct

SEQ ID NO: 6417 - DNA, 22 bp, Homo sapiens
ctgaatccacacaaggtgatgg

SEQ ID NO: 6418 - DNA, 22 bp, Homo sapiens
ttgcaaatcagaagtatagatt

SEQ ID NO: 6419 - DNA, 22 bp, Homo sapiens
aaggccttgccgaaggatgcca

SEQ ID NO: 6420 - DNA, 22 bp, Homo sapiens
tcgcgcccccaagcgtcattgg

SEQ ID NO: 6421 - DNA, 23 bp, Homo sapiens
agcagccagagatcctcggccct

SEQ ID NO: 6422 - DNA, 21 bp, Homo sapiens
tgaaggggtggcagtgtgctt

SEQ ID NO: 6423 - DNA, 22 bp, Homo sapiens
atggtggctcatgcatgcaatc

SEQ ID NO: 6424 - DNA, 22 bp, Homo sapiens
agtctacaaagggaagcccttt

SEQ ID NO: 6425 - DNA, 22 bp, Homo sapiens
tccctagtcgcatctgtggaga

SEQ ID NO: 6426 - DNA, 23 bp, Homo sapiens
tgtgtcatggggaaagactcacc

SEQ ID NO: 6427 - DNA, 22 bp, Homo sapiens
tgacagagtgacactcttgtct

SEQ ID NO: 6428 - DNA, 22 bp, Homo sapiens
atttagaactttgtttgccaat

SEQ ID NO: 6429 - DNA, 18 bp, Homo sapiens
ccctcttgcacaaagcaa

SEQ ID NO: 6430 - DNA, 22 bp, Homo sapiens
taaagttggacctgattttatt

SEQ ID NO: 6431 - DNA, 22 bp, Homo sapiens
ttcaacagacccttctttcttt

SEQ ID NO: 6432 - DNA, 22 bp, Homo sapiens
agatgtttataactcatgagtg

SEQ ID NO: 6433 - DNA, 22 bp, Homo sapiens
ttggaagacaatgctgattctc

SEQ ID NO: 6434 - DNA, 22 bp, Homo sapiens
gggtacagttcttccagtgtca

SEQ ID NO: 6435 - DNA, 22 bp, Homo sapiens
ggaactgaatgtctcggtataa

SEQ ID NO: 6436 - DNA, 22 bp, Homo sapiens
tgtgcatgtttgttttcagggt

SEQ ID NO: 6437 - DNA, 22 bp, Homo sapiens
aacccaggaggtggaggttgtg

SEQ ID NO: 6438 - DNA, 21 bp, Homo sapiens
ttagaagctaatgcagctggt

SEQ ID NO: 6439 - DNA, 16 bp, Homo sapiens
cttggtgttggcagag

SEQ ID NO: 6440 - DNA, 22 bp, Homo sapiens
atccatcctgccatctgagtag

SEQ ID NO: 6441 - DNA, 22 bp, Homo sapiens
ttagaggaaagactgggactaa

SEQ ID NO: 6442 - DNA, 19 bp, Homo sapiens
ggcttgtctcggcagccgc

SEQ ID NO: 6443 - DNA, 22 bp, Homo sapiens
ctgagtttccagataagacctt

SEQ ID NO: 6444 - DNA, 22 bp, Homo sapiens
gttcccattggggatcttgggc

SEQ ID NO: 6445 - DNA, 22 bp, Homo sapiens
ccggctactcgggaggctgacg

SEQ ID NO: 6446 - DNA, 22 bp, Homo sapiens
atggatttgcttatacacatgt

SEQ ID NO: 6447 - DNA, 22 bp, Homo sapiens
ttggagatatcacaccttcaca

SEQ ID NO: 6448 - DNA, 22 bp, Homo sapiens
atctggggtgaataggttatgt

SEQ ID NO: 6449 - DNA, 22 bp, Homo sapiens
ctgccctggggggcctccttgc

SEQ ID NO: 6450 - DNA, 22 bp, Homo sapiens
gacctcatgatccacctgcctt

SEQ ID NO: 6451 - DNA, 19 bp, Homo sapiens
aggattccagaacagtgtt

SEQ ID NO: 6452 - DNA, 22 bp, Homo sapiens
tgtcatctgcgggtggcactgc

SEQ ID NO: 6453 - DNA, 22 bp, Homo sapiens
gaggcagaagttgcagtgagca

SEQ ID NO: 6454 - DNA, 22 bp, Homo sapiens
catgtgaattccaaagctaggt

SEQ ID NO: 6455 - DNA, 22 bp, Homo sapiens
tggcacgacaattggcaccaat

SEQ ID NO: 6456 - DNA, 22 bp, Homo sapiens
taatttcagtgcaagctcacgg

SEQ ID NO: 6457 - DNA, 22 bp, Homo sapiens
tgggttttatatgtggtggaca

SEQ ID NO: 6458 - DNA, 22 bp, Homo sapiens
tgggtagtttcccctgccctgc

SEQ ID NO: 6459 - DNA, 22 bp, Homo sapiens
catgctgggtaaaggtggtgaa

SEQ ID NO: 6460 - DNA, 22 bp, Homo sapiens
ttgtcccaggacttgcatagat

SEQ ID NO: 6461 - DNA, 22 bp, Homo sapiens
tctcaagcttgttggtatgttt

SEQ ID NO: 6462 - DNA, 22 bp, Homo sapiens
tgaacatgctgttgatggcctg

SEQ ID NO: 6463 - DNA, 22 bp, Homo sapiens
tgttatctgagcaacgtcgacg

SEQ ID NO: 6464 - DNA, 22 bp, Homo sapiens
tggcagttcaggttggactctt

SEQ ID NO: 6465 - DNA, 22 bp, Homo sapiens
tggcatgcatctgttgtcctag

SEQ ID NO: 6466 - DNA, 22 bp, Homo sapiens
gcctacatttcccagttgaatg

SEQ ID NO: 6467 - DNA, 23 bp, Homo sapiens
aaaacagcttcctccagtggctc

SEQ ID NO: 6468 - DNA, 22 bp, Homo sapiens
tttttgggtccaggctgtatct

SEQ ID NO: 6469 - DNA, 22 bp, Homo sapiens
aggggcgtgctcttccccgacg

SEQ ID NO: 6470 - DNA, 22 bp, Homo sapiens
agggtagtacagagagtgtcct

SEQ ID NO: 6471 - DNA, 22 bp, Homo sapiens
gtggtggtcaccaaattgaggg

SEQ ID NO: 6472 - DNA, 22 bp, Homo sapiens
tgtgacagcaataactacttaa

SEQ ID NO: 6473 - DNA, 22 bp, Homo sapiens
tttctgagaaattaaacacttt

SEQ ID NO: 6474 - DNA, 22 bp, Homo sapiens
ggtgccagaaaacttgaagagt

SEQ ID NO: 6475 - DNA, 22 bp, Homo sapiens
tgagccatgggactccaaggga

SEQ ID NO: 6476 - DNA, 22 bp, Homo sapiens
gcggggttccgtgccccagagt

SEQ ID NO: 6477 - DNA, 22 bp, Homo sapiens
gagccaagctcttctccatgag

SEQ ID NO: 6478 - DNA, 22 bp, Homo sapiens
ggaaatgacttggtgcttcgtt

SEQ ID NO: 6479 - DNA, 22 bp, Homo sapiens
gcatctaaataaacgtgggagt

SEQ ID NO: 6480 - DNA, 22 bp, Homo sapiens
tggggtcagcaggcctggcctg

SEQ ID NO: 6481 - DNA, 22 bp, Homo sapiens
ccttttgctctcccatccagaa

SEQ ID NO: 6482 - DNA, 22 bp, Homo sapiens
gctgcactttgactgctggggt

SEQ ID NO: 6483 - DNA, 22 bp, Homo sapiens
atagaatatgacttttagatcc

SEQ ID NO: 6484 - DNA, 18 bp, Homo sapiens
tccatgcacatagccccc

SEQ ID NO: 6485 - DNA, 22 bp, Homo sapiens
ttgcccaggctggagtgcagtg

SEQ ID NO: 6486 - DNA, 22 bp, Homo sapiens
gtgacatggtttgccgtccctg

SEQ ID NO: 6487 - DNA, 22 bp, Homo sapiens
gcaggtggatcaccacgtcagg

SEQ ID NO: 6488 - DNA, 22 bp, Homo sapiens
tctgagtggactgtcctgcagg

SEQ ID NO: 6489 - DNA, 22 bp, Homo sapiens
accattgcactctagcctgggc

SEQ ID NO: 6490 - DNA, 22 bp, Homo sapiens
cgagagttagctaggagtcaca

SEQ ID NO: 6491 - DNA, 22 bp, Homo sapiens
ctagagtgcaggtgtatggtta

SEQ ID NO: 6492 - DNA, 22 bp, Homo sapiens
caggagatgacagggaagaacc

SEQ ID NO: 6493 - DNA, 22 bp, Homo sapiens
tttggggatgtctgagttgttg

SEQ ID NO: 6494 - DNA, 22 bp, Homo sapiens
ttctgtgaatcttttttcccac

SEQ ID NO: 6495 - DNA, 22 bp, Homo sapiens
ttccagtgggctgggagtaagg

SEQ ID NO: 6496 - DNA, 22 bp, Homo sapiens
acaaagtgaattgcatcgagtt

SEQ ID NO: 6497 - DNA, 21 bp, Homo sapiens
attctttgatgtgcaataagt

SEQ ID NO: 6498 - DNA, 22 bp, Homo sapiens
gctgatcacatttccaaaaccc

SEQ ID NO: 6499 - DNA, 22 bp, Homo sapiens
atagttttaaaacctcaggaag

SEQ ID NO: 6500 - DNA, 22 bp, Homo sapiens
ttgatcaaatcagctactgagg

SEQ ID NO: 6501 - DNA, 22 bp, Homo sapiens
ggcctacgccagtatccccagg

SEQ ID NO: 6502 - DNA, 22 bp, Homo sapiens
gccttgatctgctgtgtttgag

SEQ ID NO: 6503 - DNA, 19 bp, Homo sapiens
ctgtccttggctgcactgt

SEQ ID NO: 6504 - DNA, 22 bp, Homo sapiens
aagatgcggttgaccatggtgt

SEQ ID NO: 6505 - DNA, 22 bp, Homo sapiens
tgcgggttggtggcatatgcag

SEQ ID NO: 6506 - DNA, 22 bp, Homo sapiens
atttgattgtgtctgagacgat

SEQ ID NO: 6507 - DNA, 22 bp, Homo sapiens
agccactttagataccatctta

SEQ ID NO: 6508 - DNA, 22 bp, Homo sapiens
ggaggcggaggctgcagtgagc

SEQ ID NO: 6509 - DNA, 22 bp, Homo sapiens
agcttgtagaaggccacgagca

SEQ ID NO: 6510 - DNA, 18 bp, Homo sapiens
cccggctaatttttggta

SEQ ID NO: 6511 - DNA, 22 bp, Homo sapiens
aagcctaggcctactctggttt

SEQ ID NO: 6512 - DNA, 22 bp, Homo sapiens
gctgaggtggaggaaggagacc

SEQ ID NO: 6513 - DNA, 22 bp, Homo sapiens
aattcacatccgaccaggtcaa

SEQ ID NO: 6514 - DNA, 22 bp, Homo sapiens
ggcgccagcactgcagcgcctc

SEQ ID NO: 6515 - DNA, 22 bp, Homo sapiens
agggaaattaatgtgagcaatg

SEQ ID NO: 6516 - DNA, 22 bp, Homo sapiens
tgtctttgttattgtggacagg

SEQ ID NO: 6517 - DNA, 22 bp, Homo sapiens
gccgggtgcagcgggcccgcca

SEQ ID NO: 6518 - DNA, 22 bp, Homo sapiens
tcagtctttccctccctcagtt

SEQ ID NO: 6519 - DNA, 22 bp, Homo sapiens
gcgcacgtcagaaaggctttta

SEQ ID NO: 6520 - DNA, 22 bp, Homo sapiens
ccaggcagcctgctccattctg

SEQ ID NO: 6521 - DNA, 22 bp, Homo sapiens
agctcattgcaacctccgcctc

SEQ ID NO: 6522 - DNA, 18 bp, Homo sapiens
ggcgggtgttttattcac

SEQ ID NO: 6523 - DNA, 22 bp, Homo sapiens
gggatgcagactacagggctta

SEQ ID NO: 6524 - DNA, 22 bp, Homo sapiens
ctacaaaagtaattgtggtttt

SEQ ID NO: 6525 - DNA, 22 bp, Homo sapiens
actgcactcctgcctgggtaac

SEQ ID NO: 6526 - DNA, 22 bp, Homo sapiens
acacttggctctgagtcactac

SEQ ID NO: 6527 - DNA, 23 bp, Homo sapiens
ttacagcttcagcagctaacccc

SEQ ID NO: 6528 - DNA, 22 bp, Homo sapiens
tcgcgggttgcacatggccatc

SEQ ID NO: 6529 - DNA, 22 bp, Homo sapiens
agtgtggagcatcgagggcaga

SEQ ID NO: 6530 - DNA, 22 bp, Homo sapiens
tcatctccatacggtctcgcag

SEQ ID NO: 6531 - DNA, 22 bp, Homo sapiens
tcacagacccttgctgagctct

SEQ ID NO: 6532 - DNA, 22 bp, Homo sapiens
tggaagacaatttgaaaacatt

SEQ ID NO: 6533 - DNA, 22 bp, Homo sapiens
cctgcacagccggacccctgct

SEQ ID NO: 6534 - DNA, 22 bp, Homo sapiens
caggtagaggctgccatcagct

SEQ ID NO: 6535 - DNA, 22 bp, Homo sapiens
caagattaccaaggaccagcgg

SEQ ID NO: 6536 - DNA, 22 bp, Homo sapiens
tgagggctgtctgaagcttggg

SEQ ID NO: 6537 - DNA, 22 bp, Homo sapiens
cactccagcctcagtgacagag

SEQ ID NO: 6538 - DNA, 22 bp, Homo sapiens
aactgctgacaagtgaccagtg

SEQ ID NO: 6539 - DNA, 22 bp, Homo sapiens
cctccccacagcccaggagact

SEQ ID NO: 6540 - DNA, 22 bp, Homo sapiens
aatccctccccaggcaagtcct

SEQ ID NO: 6541 - DNA, 22 bp, Homo sapiens
caccctcaagcagtggcacgtg

SEQ ID NO: 6542 - DNA, 22 bp, Homo sapiens
gggccgtagaccacgtccgggc

SEQ ID NO: 6543 - DNA, 22 bp, Homo sapiens
attgcactccagcctgggcgac

SEQ ID NO: 6544 - DNA, 22 bp, Homo sapiens
tgttcagaacaaaggtaaatga

SEQ ID NO: 6545 - DNA, 22 bp, Homo sapiens
tgattgcacacctgcactcaag

SEQ ID NO: 6546 - DNA, 22 bp, Homo sapiens
ttagacatgatggtgcagagag

SEQ ID NO: 6547 - DNA, 22 bp, Homo sapiens
aacccaggagccggaggttgtg

SEQ ID NO: 6548 - DNA, 22 bp, Homo sapiens
tagctaaaccagtatgtgaagg

SEQ ID NO: 6549 - DNA, 22 bp, Homo sapiens
gtggccccagggccctgtctgg

SEQ ID NO: 6550 - DNA, 22 bp, Homo sapiens
aactcactttgtggcttctgaa

SEQ ID NO: 6551 - DNA, 22 bp, Homo sapiens
tcccaagtagatgggaatacag

SEQ ID NO: 6552 - DNA, 22 bp, Homo sapiens
ggtgttgcagttgaagactggt

SEQ ID NO: 6553 - DNA, 22 bp, Homo sapiens
gggcagatcacctgaggtcagg

SEQ ID NO: 6554 - DNA, 22 bp, Homo sapiens
tgggaaagtctttatttctctt

SEQ ID NO: 6555 - DNA, 22 bp, Homo sapiens
aggggtcagcccttttgtcagc

SEQ ID NO: 6556 - DNA, 22 bp, Homo sapiens
tcgttaatcagcaccagaattc

SEQ ID NO: 6557 - DNA, 22 bp, Homo sapiens
gtccccgccgtcgctcaggctg

SEQ ID NO: 6558 - DNA, 22 bp, Homo sapiens
catttctgggagacatgctaga

SEQ ID NO: 6559 - DNA, 22 bp, Homo sapiens
gtcccataagtagtgcaacttg

SEQ ID NO: 6560 - DNA, 22 bp, Homo sapiens
gttttagataaagctgtccttg

SEQ ID NO: 6561 - DNA, 17 bp, Homo sapiens
aatctgtttacagtcag

SEQ ID NO: 6562 - DNA, 22 bp, Homo sapiens
tatgtgtttgacaccctgcaag

SEQ ID NO: 6563 - DNA, 23 bp, Homo sapiens
ggcccccggaacgctctgtgacc

SEQ ID NO: 6564 - DNA, 22 bp, Homo sapiens
ttgtctaatgagctccacttca

SEQ ID NO: 6565 - DNA, 22 bp, Homo sapiens
aaaagtcttggggaaggccagg

SEQ ID NO: 6566 - DNA, 21 bp, Homo sapiens
ggaatagcctccttgaactca

SEQ ID NO: 6567 - DNA, 22 bp, Homo sapiens
tgcgggatgacagtggccaaca

SEQ ID NO: 6568 - DNA, 23 bp, Homo sapiens
aggatatgacttgtctgccaacc

SEQ ID NO: 6569 - DNA, 22 bp, Homo sapiens
ttcctgggattattgtcaagca

SEQ ID NO: 6570 - DNA, 22 bp, Homo sapiens
cacatacccggctattgctgct

SEQ ID NO: 6571 - DNA, 22 bp, Homo sapiens
ggccgctctccggtgtggatct

SEQ ID NO: 6572 - DNA, 22 bp, Homo sapiens
agcccttggtattttccgatcc

SEQ ID NO: 6573 - DNA, 22 bp, Homo sapiens
caagtctgacctctgggtgaag

SEQ ID NO: 6574 - DNA, 22 bp, Homo sapiens
ctaaatgccccttctggcacag

SEQ ID NO: 6575 - DNA, 22 bp, Homo sapiens
ctgtgcgtaagtagccaaaata

SEQ ID NO: 6576 - DNA, 22 bp, Homo sapiens
tcactgcaacctctgcctgcca

SEQ ID NO: 6577 - DNA, 22 bp, Homo sapiens
tctgtgagaaccagtgccaggg

SEQ ID NO: 6578 - DNA, 22 bp, Homo sapiens
tctgcgtgaaactagatggcag

SEQ ID NO: 6579 - DNA, 22 bp, Homo sapiens
atgtaaactactgactacacta

SEQ ID NO: 6580 - DNA, 22 bp, Homo sapiens
ttctctgcctcacaggtctaag

SEQ ID NO: 6581 - DNA, 22 bp, Homo sapiens
tcctcattcttggtgcatcaaa

SEQ ID NO: 6582 - DNA, 22 bp, Homo sapiens
cccgacctcgcaaagcgcactc

SEQ ID NO: 6583 - DNA, 22 bp, Homo sapiens
cctgcagacacttgtccagcaa

SEQ ID NO: 6584 - DNA, 22 bp, Homo sapiens
tcttgaattgtactcccataag

SEQ ID NO: 6585 - DNA, 22 bp, Homo sapiens
aaattagtgcaccaggttgaag

SEQ ID NO: 6586 - DNA, 23 bp, Homo sapiens
tcaactgctctgggaaggtcccc

SEQ ID NO: 6587 - DNA, 22 bp, Homo sapiens
gagtttcttcatggtgcagagg

SEQ ID NO: 6588 - DNA, 22 bp, Homo sapiens
tagactagaggatcagcaaggg

SEQ ID NO: 6589 - DNA, 22 bp, Homo sapiens
taatactgtatactgcaaattt

SEQ ID NO: 6590 - DNA, 22 bp, Homo sapiens
cctaacatatgtaaaggtcttt

SEQ ID NO: 6591 - DNA, 22 bp, Homo sapiens
attcacagggggagaagggtat

SEQ ID NO: 6592 - DNA, 22 bp, Homo sapiens
cttctcggccgtgtggatgcgc

SEQ ID NO: 6593 - DNA, 22 bp, Homo sapiens
ccggtgttcaaagtctggtatg

SEQ ID NO: 6594 - DNA, 22 bp, Homo sapiens
tgtcttggttcttctgaaacac

SEQ ID NO: 6595 - DNA, 22 bp, Homo sapiens
cacccaggctggagtgcagtga

SEQ ID NO: 6596 - DNA, 22 bp, Homo sapiens
cacccaggctggaatgcagtgg

SEQ ID NO: 6597 - DNA, 22 bp, Homo sapiens
gcactttgcccctcctttggca

SEQ ID NO: 6598 - DNA, 22 bp, Homo sapiens
gggagctgaaggagccggcggg

SEQ ID NO: 6599 - DNA, 22 bp, Homo sapiens
ggttcagggctaccagtgggtg

SEQ ID NO: 6600 - DNA, 22 bp, Homo sapiens
ggacaccggtcctattggatga

SEQ ID NO: 6601 - DNA, 22 bp, Homo sapiens
agggaagaggaccagagtctct

SEQ ID NO: 6602 - DNA, 22 bp, Homo sapiens
gctccggcttggtgtgcagggt

SEQ ID NO: 6603 - DNA, 22 bp, Homo sapiens
tgcgcatgcgtggctctccggc

SEQ ID NO: 6604 - DNA, 22 bp, Homo sapiens
attggccatttgcatgtattat

SEQ ID NO: 6605 - DNA, 22 bp, Homo sapiens
attaagtatgcaatggtgcagt

SEQ ID NO: 6606 - DNA, 22 bp, Homo sapiens
atgagctcatccgagtcacact

SEQ ID NO: 6607 - DNA, 22 bp, Homo sapiens
aggatcagggtggtggaagtca

SEQ ID NO: 6608 - DNA, 22 bp, Homo sapiens
ttttcatttttgtagatgcaag

SEQ ID NO: 6609 - DNA, 22 bp, Homo sapiens
cctggtgcaggtgtgttgccag

SEQ ID NO: 6610 - DNA, 22 bp, Homo sapiens
gcaaggtctttcagaaaggaaa

SEQ ID NO: 6611 - DNA, 22 bp, Homo sapiens
ttgtacatttgttcagttctga

SEQ ID NO: 6612 - DNA, 22 bp, Homo sapiens
atttagtagagaaattaagaaa

SEQ ID NO: 6613 - DNA, 22 bp, Homo sapiens
gggcactcctctggtccagccc

SEQ ID NO: 6614 - DNA, 19 bp, Homo sapiens
ctgggatgtctcctcccag

SEQ ID NO: 6615 - DNA, 22 bp, Homo sapiens
tttgaaatatgtgtcttttgaa

SEQ ID NO: 6616 - DNA, 22 bp, Homo sapiens
ccaagcaaataatcacccacta

SEQ ID NO: 6617 - DNA, 22 bp, Homo sapiens
ttgagatggagcttcactcttg

SEQ ID NO: 6618 - DNA, 22 bp, Homo sapiens
gccagaattttgagactacttg

SEQ ID NO: 6619 - DNA, 22 bp, Homo sapiens
tccagcagtccatgtgagacac

SEQ ID NO: 6620 - DNA, 22 bp, Homo sapiens
gctcgcgccgcaccggtccacc

SEQ ID NO: 6621 - DNA, 22 bp, Homo sapiens
tgccagctgcttgtcccccaca

SEQ ID NO: 6622 - DNA, 22 bp, Homo sapiens
ttgagatggagtctcgcactgt

SEQ ID NO: 6623 - DNA, 22 bp, Homo sapiens
atcatgttttaattagcaaact

SEQ ID NO: 6624 - DNA, 23 bp, Homo sapiens
ttgcttgagcccaggaagtggag

SEQ ID NO: 6625 - DNA, 22 bp, Homo sapiens
agaacagaggccttatgtttca

SEQ ID NO: 6626 - DNA, 22 bp, Homo sapiens
gggctctcccacaacgtgccag

SEQ ID NO: 6627 - DNA, 22 bp, Homo sapiens
ttccaactttgtcatatattat

SEQ ID NO: 6628 - DNA, 22 bp, Homo sapiens
actgcactccagcctgggtgat

SEQ ID NO: 6629 - DNA, 22 bp, Homo sapiens
aggaagatgtgcaaagttggaa

SEQ ID NO: 6630 - DNA, 22 bp, Homo sapiens
tcatcagggatattggcctgaa

SEQ ID NO: 6631 - DNA, 22 bp, Homo sapiens
acaagaagggtgattaggggca

SEQ ID NO: 6632 - DNA, 22 bp, Homo sapiens
gggaggcagtgctggaggctgg

SEQ ID NO: 6633 - DNA, 22 bp, Homo sapiens
ccagttccagtgctcacatcca

SEQ ID NO: 6634 - DNA, 22 bp, Homo sapiens
cttatcttacttccccttcatg

SEQ ID NO: 6635 - DNA, 22 bp, Homo sapiens
agtccgcgctccatgggagtcc

SEQ ID NO: 6636 - DNA, 22 bp, Homo sapiens
ttgaggactgtggtccccaaag

SEQ ID NO: 6637 - DNA, 22 bp, Homo sapiens
tagcgaggtgtttctaggactg

SEQ ID NO: 6638 - DNA, 22 bp, Homo sapiens
cactgttttacatgttatttaa

SEQ ID NO: 6639 - DNA, 22 bp, Homo sapiens
gggcggggtggctcatgcctgt

SEQ ID NO: 6640 - DNA, 22 bp, Homo sapiens
aaccaggtgactcatggtgagc

SEQ ID NO: 6641 - DNA, 22 bp, Homo sapiens
tgagatcattgacttgttcctg

SEQ ID NO: 6642 - DNA, 22 bp, Homo sapiens
cggggccctggggctgaaggtc

SEQ ID NO: 6643 - DNA, 22 bp, Homo sapiens
ccagtgtatttttgggacctgc

SEQ ID NO: 6644 - DNA, 23 bp, Homo sapiens
gacattggctgtctgatgcaggg

SEQ ID NO: 6645 - DNA, 22 bp, Homo sapiens
ttggatgagagggtgtggtaca

SEQ ID NO: 6646 - DNA, 19 bp, Homo sapiens
gataggcagccatgagccc

SEQ ID NO: 6647 - DNA, 22 bp, Homo sapiens
ggccagaagttggaaaagagcc

SEQ ID NO: 6648 - DNA, 22 bp, Homo sapiens
tctggacaggggcgctttgggg

SEQ ID NO: 6649 - DNA, 22 bp, Homo sapiens
ataattcgtataaggggaaaag

SEQ ID NO: 6650 - DNA, 22 bp, Homo sapiens
ggtgcagaggagccagctgggg

SEQ ID NO: 6651 - DNA, 22 bp, Homo sapiens
attggtagttttgtatttctct

SEQ ID NO: 6652 - DNA, 22 bp, Homo sapiens
tggctcatgcctgtaatcttag

SEQ ID NO: 6653 - DNA, 22 bp, Homo sapiens
gttggagtgcagcttgtgcgat

SEQ ID NO: 6654 - DNA, 22 bp, Homo sapiens
ctggcaagaaatatatatctta

SEQ ID NO: 6655 - DNA, 19 bp, Homo sapiens
gggtcccaaaagatgtgct

SEQ ID NO: 6656 - DNA, 20 bp, Homo sapiens
attagagctacatggctaca

SEQ ID NO: 6657 - DNA, 20 bp, Homo sapiens
gccgactgccttgtgagcct

SEQ ID NO: 6658 - DNA, 22 bp, Homo sapiens
gctccagtgaccatcgttttag

SEQ ID NO: 6659 - DNA, 22 bp, Homo sapiens
gccttattacctgcactttgaa

SEQ ID NO: 6660 - DNA, 22 bp, Homo sapiens
tttgtggcaggagcggagaccg

SEQ ID NO: 6661 - DNA, 22 bp, Homo sapiens
aagaactgtttacaattttcac

SEQ ID NO: 6662 - DNA, 22 bp, Homo sapiens
cccaggggttctgagcagcagc

SEQ ID NO: 6663 - DNA, 22 bp, Homo sapiens
cttcctctgtggccagagtgta

SEQ ID NO: 6664 - DNA, 22 bp, Homo sapiens
ggagaagttggacagtttggga

SEQ ID NO: 6665 - DNA, 22 bp, Homo sapiens
gcccaggagttcaagtctagtg

SEQ ID NO: 6666 - DNA, 22 bp, Homo sapiens
tgacagaggagctggaatgatt

SEQ ID NO: 6667 - DNA, 22 bp, Homo sapiens
ttcttgggaatttttccaacac

SEQ ID NO: 6668 - DNA, 22 bp, Homo sapiens
actagaaagaagttttttgaga

SEQ ID NO: 6669 - DNA, 22 bp, Homo sapiens
tcaggggcttgaggtgcatgtc

SEQ ID NO: 6670 - DNA, 22 bp, Homo sapiens
cttgcagtttaggtcctctgtg

SEQ ID NO: 6671 - DNA, 22 bp, Homo sapiens
tcagtgcagggtgggagagaga

SEQ ID NO: 6672 - DNA, 22 bp, Homo sapiens
gtgtaagtatctttgtatcttt

SEQ ID NO: 6673 - DNA, 22 bp, Homo sapiens
cccaggaggttgaggctgcagt

SEQ ID NO: 6674 - DNA, 22 bp, Homo sapiens
gctgagtacatatgatgcatca

SEQ ID NO: 6675 - DNA, 22 bp, Homo sapiens
aacctcaaactcttgggcttaa

SEQ ID NO: 6676 - DNA, 22 bp, Homo sapiens
gatcccaggtgatcttatttgt

SEQ ID NO: 6677 - DNA, 22 bp, Homo sapiens
ggcatctggatctgcttctccc

SEQ ID NO: 6678 - DNA, 22 bp, Homo sapiens
atttcagcagcccatgtttgga

SEQ ID NO: 6679 - DNA, 22 bp, Homo sapiens
cccccggttcctgtttgcagag

SEQ ID NO: 6680 - DNA, 22 bp, Homo sapiens
ctgctcctgtccagcagggcca

SEQ ID NO: 6681 - DNA, 22 bp, Homo sapiens
ggtgtctatgattcagtttatg

SEQ ID NO: 6682 - DNA, 22 bp, Homo sapiens
gtgtgacctcatcttaactgga

SEQ ID NO: 6683 - DNA, 22 bp, Homo sapiens
cgcccaggctggagtgcagtga

SEQ ID NO: 6684 - DNA, 22 bp, Homo sapiens
acgcctctgcagctgccgggcc

SEQ ID NO: 6685 - DNA, 22 bp, Homo sapiens
tgtgtctaatgactatttcttc

SEQ ID NO: 6686 - DNA, 18 bp, Homo sapiens
ggagactaaactgttgac

SEQ ID NO: 6687 - DNA, 22 bp, Homo sapiens
agagtggagagaaacaactctg

SEQ ID NO: 6688 - DNA, 22 bp, Homo sapiens
ctcccggctgctccggctcccg

SEQ ID NO: 6689 - DNA, 22 bp, Homo sapiens
gagtggctattgatccgtgatg

SEQ ID NO: 6690 - DNA, 22 bp, Homo sapiens
ctgctaaacctctctgagagct

SEQ ID NO: 6691 - DNA, 22 bp, Homo sapiens
gttactcctggttgagcttggt

SEQ ID NO: 6692 - DNA, 21 bp, Homo sapiens
aataagatggtatttggaggt

SEQ ID NO: 6693 - DNA, 22 bp, Homo sapiens
gacaggaggcagagctcaggtg

SEQ ID NO: 6694 - DNA, 22 bp, Homo sapiens
gcctccagcccacgcaggcctg

SEQ ID NO: 6695 - DNA, 22 bp, Homo sapiens
actttaaaactgatcatcagag

SEQ ID NO: 6696 - DNA, 22 bp, Homo sapiens
tgaatgtttatattggccaaaa

SEQ ID NO: 6697 - DNA, 22 bp, Homo sapiens
aagtgctgggattacaggcgtc

SEQ ID NO: 6698 - DNA, 22 bp, Homo sapiens
accgagttagccaggatggtct

SEQ ID NO: 6699 - DNA, 22 bp, Homo sapiens
tgcaagctgacatccagagaga

SEQ ID NO: 6700 - DNA, 22 bp, Homo sapiens
agggctgcccagtgtgagagct

SEQ ID NO: 6701 - DNA, 22 bp, Homo sapiens
agagtgcaaccgaaacaagcag

SEQ ID NO: 6702 - DNA, 22 bp, Homo sapiens
aagaaatgtgaatattgaatag

SEQ ID NO: 6703 - DNA, 22 bp, Homo sapiens
agtccaggcattccagccattc

SEQ ID NO: 6704 - DNA, 22 bp, Homo sapiens
cacccaggttggagtgcagtgg

SEQ ID NO: 6705 - DNA, 22 bp, Homo sapiens
gcttcggggtccaagcgcgtgt

SEQ ID NO: 6706 - DNA, 22 bp, Homo sapiens
caatttgattaataccatactt

SEQ ID NO: 6707 - DNA, 22 bp, Homo sapiens
tcagaacctcctagcagtgttc

SEQ ID NO: 6708 - DNA, 21 bp, Homo sapiens
accctgctttatgccgtcctc

SEQ ID NO: 6709 - DNA, 22 bp, Homo sapiens
aaagatcacgtcccaggactcg

SEQ ID NO: 6710 - DNA, 22 bp, Homo sapiens
ttgcaatcagcagtgttttcac

SEQ ID NO: 6711 - DNA, 22 bp, Homo sapiens
cttcttgttgttagggtcctgt

SEQ ID NO: 6712 - DNA, 22 bp, Homo sapiens
catcccctgatgctcttgagta

SEQ ID NO: 6713 - DNA, 22 bp, Homo sapiens
tatgtaagttgcaaatgaagga

SEQ ID NO: 6714 - DNA, 22 bp, Homo sapiens
attgacctgattgttcctggaa

SEQ ID NO: 6715 - DNA, 22 bp, Homo sapiens
actctggccatcttggaccttg

SEQ ID NO: 6716 - DNA, 22 bp, Homo sapiens
tgtgacagcacggttcaactgc

SEQ ID NO: 6717 - DNA, 22 bp, Homo sapiens
ctccagtgcttctagaaaatac

SEQ ID NO: 6718 - DNA, 23 bp, Homo sapiens
aggcgagctcttctccagcacgt

SEQ ID NO: 6719 - DNA, 22 bp, Homo sapiens
acctggtgggagataattgaat

SEQ ID NO: 6720 - DNA, 22 bp, Homo sapiens
ctcaggacggccgggggagcct

SEQ ID NO: 6721 - DNA, 22 bp, Homo sapiens
tgtgactgaggctccaagctag

SEQ ID NO: 6722 - DNA, 22 bp, Homo sapiens
tgagctgtctgaatggtgagga

SEQ ID NO: 6723 - DNA, 22 bp, Homo sapiens
atcagagtgggttttaaaagtg

SEQ ID NO: 6724 - DNA, 22 bp, Homo sapiens
cgggcagcggcgtggccatggt

SEQ ID NO: 6725 - DNA, 22 bp, Homo sapiens
actgtctagttctcttttctaa

SEQ ID NO: 6726 - DNA, 22 bp, Homo sapiens
tctgtggcccaagtgatggctg

SEQ ID NO: 6727 - DNA, 22 bp, Homo sapiens
tgggatgccctgaccctctgga

SEQ ID NO: 6728 - DNA, 22 bp, Homo sapiens
tgtgcctgttcccactttgcct

SEQ ID NO: 6729 - DNA, 20 bp, Homo sapiens
ccagagctgatggctgcccg

SEQ ID NO: 6730 - DNA, 22 bp, Homo sapiens
gggtattaaaatgaaggagaaa

SEQ ID NO: 6731 - DNA, 22 bp, Homo sapiens
tggaagctcaaggcagggtgag

SEQ ID NO: 6732 - DNA, 22 bp, Homo sapiens
ttggtggacctcatcagaaccg

SEQ ID NO: 6733 - DNA, 22 bp, Homo sapiens
tctgctacaaatacgctgggag

SEQ ID NO: 6734 - DNA, 22 bp, Homo sapiens
tatttaataaaactatggcatg

SEQ ID NO: 6735 - DNA, 22 bp, Homo sapiens
gcccagctgcaccctggtgggt

SEQ ID NO: 6736 - DNA, 22 bp, Homo sapiens
ctcactgcaacctccgcctcct

SEQ ID NO: 6737 - DNA, 22 bp, Homo sapiens
ttgtagtctaggatagattttt

SEQ ID NO: 6738 - DNA, 22 bp, Homo sapiens
tgctgctgaggctaaagtatag

SEQ ID NO: 6739 - DNA, 22 bp, Homo sapiens
aggctccctgaatcgcccgttc

SEQ ID NO: 6740 - DNA, 22 bp, Homo sapiens
gccgtgcgtgcgcaggtgctgt

SEQ ID NO: 6741 - DNA, 22 bp, Homo sapiens
ctctgcctcccaggttcaagcg

SEQ ID NO: 6742 - DNA, 22 bp, Homo sapiens
tgtctgggagactgatcacccg

SEQ ID NO: 6743 - DNA, 22 bp, Homo sapiens
gccggggctggggagagacatg

SEQ ID NO: 6744 - DNA, 22 bp, Homo sapiens
gcttcaaactgagcttcaagtg

SEQ ID NO: 6745 - DNA, 23 bp, Homo sapiens
ccaagactgttaggagtggggag

SEQ ID NO: 6746 - DNA, 22 bp, Homo sapiens
tcttgaagtgggagacatcgtg

SEQ ID NO: 6747 - DNA, 22 bp, Homo sapiens
agtgaggggcagctgagtgggc

SEQ ID NO: 6748 - DNA, 22 bp, Homo sapiens
attgtcgtcaatggacacatag

SEQ ID NO: 6749 - DNA, 22 bp, Homo sapiens
gctagtgtttgccagcgtagcc

SEQ ID NO: 6750 - DNA, 22 bp, Homo sapiens
tatttcacatctatgaagtgag

SEQ ID NO: 6751 - DNA, 22 bp, Homo sapiens
acttcccttgctttacgatgtt

SEQ ID NO: 6752 - DNA, 22 bp, Homo sapiens
ttctgtggttgaaaggagagat

SEQ ID NO: 6753 - DNA, 23 bp, Homo sapiens
tttctgatgagggatgtggtatg

SEQ ID NO: 6754 - DNA, 22 bp, Homo sapiens
ggagttccagaccagactggcc

SEQ ID NO: 6755 - DNA, 22 bp, Homo sapiens
tggggtcccaactctgattgat

SEQ ID NO: 6756 - DNA, 22 bp, Homo sapiens
gcttttcatgacaactcagcga

SEQ ID NO: 6757 - DNA, 22 bp, Homo sapiens
tgcctgcctaggaagctgtgaa

SEQ ID NO: 6758 - DNA, 22 bp, Homo sapiens
aaatgcctcattttctctcact

SEQ ID NO: 6759 - DNA, 19 bp, Homo sapiens
gttggcactgaaaatggct

SEQ ID NO: 6760 - DNA, 22 bp, Homo sapiens
ggttggtaactccctgtgcagt

SEQ ID NO: 6761 - DNA, 22 bp, Homo sapiens
cagcgtgggatttggaaaccag

SEQ ID NO: 6762 - DNA, 22 bp, Homo sapiens
gagtgctttgtcttgtaattct

SEQ ID NO: 6763 - DNA, 22 bp, Homo sapiens
attgcactccggcctgggtgac

SEQ ID NO: 6764 - DNA, 22 bp, Homo sapiens
gttgagtgttgtgcatgcacca

SEQ ID NO: 6765 - DNA, 22 bp, Homo sapiens
acacccaggctggcgtgcagtg

SEQ ID NO: 6766 - DNA, 22 bp, Homo sapiens
gcagatggatgtggacggcgcc

SEQ ID NO: 6767 - DNA, 22 bp, Homo sapiens
tatctatgtgctctgacctctc

SEQ ID NO: 6768 - DNA, 22 bp, Homo sapiens
ctgattgctaacctgttagaat

SEQ ID NO: 6769 - DNA, 22 bp, Homo sapiens
aacagaatattttgcctttctc

SEQ ID NO: 6770 - DNA, 22 bp, Homo sapiens
ctgctttgcatagctgccagag

SEQ ID NO: 6771 - DNA, 22 bp, Homo sapiens
acagcgccgattctccggggct

SEQ ID NO: 6772 - DNA, 22 bp, Homo sapiens
atcttgttaaaaagcagattct

SEQ ID NO: 6773 - DNA, 22 bp, Homo sapiens
gatgggcgtggcgcgtttggtg

SEQ ID NO: 6774 - DNA, 22 bp, Homo sapiens
ggtagactgtcaaacactagcc

SEQ ID NO: 6775 - DNA, 22 bp, Homo sapiens
ggcaggactgatcagtgggatg

SEQ ID NO: 6776 - DNA, 22 bp, Homo sapiens
cagaggatatactatctggaaa

SEQ ID NO: 6777 - DNA, 22 bp, Homo sapiens
gggtaaatctcttttcatggct

SEQ ID NO: 6778 - DNA, 22 bp, Homo sapiens
ctgtccttccagccgaaatcta

SEQ ID NO: 6779 - DNA, 22 bp, Homo sapiens
caggagtgttgattgctcagga

SEQ ID NO: 6780 - DNA, 22 bp, Homo sapiens
gcatggcttcggggtgctgcct

SEQ ID NO: 6781 - DNA, 22 bp, Homo sapiens
cactctgcgctgggcgccagcg

SEQ ID NO: 6782 - DNA, 22 bp, Homo sapiens
ttctaggcctggcttgggccca

SEQ ID NO: 6783 - DNA, 22 bp, Homo sapiens
agcaacctgccagtcactcagt

SEQ ID NO: 6784 - DNA, 22 bp, Homo sapiens
cgccggcttgaggcaggcggca

SEQ ID NO: 6785 - DNA, 22 bp, Homo sapiens
gtacactgggtaagggactcct

SEQ ID NO: 6786 - DNA, 23 bp, Homo sapiens
tcctgtcaagtgcttgttcctgc

SEQ ID NO: 6787 - DNA, 22 bp, Homo sapiens
ttgggttagaacggtaacatac

SEQ ID NO: 6788 - DNA, 22 bp, Homo sapiens
tgaggcactccaggatgctgtt

SEQ ID NO: 6789 - DNA, 22 bp, Homo sapiens
ccttgtttctctcccagataag

SEQ ID NO: 6790 - DNA, 22 bp, Homo sapiens
gcccagcgagcagaggtggacg

SEQ ID NO: 6791 - DNA, 22 bp, Homo sapiens
ggtgacagtggttaaaatttgt

SEQ ID NO: 6792 - DNA, 22 bp, Homo sapiens
tgggtgtccagaccctgcacat

SEQ ID NO: 6793 - DNA, 22 bp, Homo sapiens
tgagatgagggctgcactcaaa

SEQ ID NO: 6794 - DNA, 22 bp, Homo sapiens
cctgtcataatgtccgatgtca

SEQ ID NO: 6795 - DNA, 19 bp, Homo sapiens
taggaccctggtggccccc

SEQ ID NO: 6796 - DNA, 22 bp, Homo sapiens
ctgtggctctcagaggctgctg

SEQ ID NO: 6797 - DNA, 22 bp, Homo sapiens
tgctggatttgaccaagttgga

SEQ ID NO: 6798 - DNA, 22 bp, Homo sapiens
aaaagggacgacaacaggccac

SEQ ID NO: 6799 - DNA, 22 bp, Homo sapiens
cccagctcttcaagtcaccccc

SEQ ID NO: 6800 - DNA, 22 bp, Homo sapiens
aagacttgaccaggttgaaggc

SEQ ID NO: 6801 - DNA, 22 bp, Homo sapiens
tgatccattaaaatccaagagt

SEQ ID NO: 6802 - DNA, 22 bp, Homo sapiens
attgattttcagactatgcgag

SEQ ID NO: 6803 - DNA, 22 bp, Homo sapiens
tctccaatgcttaggaaagttt

SEQ ID NO: 6804 - DNA, 22 bp, Homo sapiens
aatctgagggaacttgaactcc

SEQ ID NO: 6805 - DNA, 22 bp, Homo sapiens
actgcactccagcctgggacac

SEQ ID NO: 6806 - DNA, 22 bp, Homo sapiens
tgtacaatgctgaggtttgggg

SEQ ID NO: 6807 - DNA, 17 bp, Homo sapiens
gctactggttacctcta

SEQ ID NO: 6808 - DNA, 22 bp, Homo sapiens
atcaagtgaagggctcttgaag

SEQ ID NO: 6809 - DNA, 22 bp, Homo sapiens
ctggggtccttgccatgtgtca

SEQ ID NO: 6810 - DNA, 22 bp, Homo sapiens
agagcactttcgagagccggag

SEQ ID NO: 6811 - DNA, 22 bp, Homo sapiens
ttgtgaatggtgccgcaataaa

SEQ ID NO: 6812 - DNA, 22 bp, Homo sapiens
atattagtttggagactacaat

SEQ ID NO: 6813 - DNA, 22 bp, Homo sapiens
taatgtataacaaatactcatc

SEQ ID NO: 6814 - DNA, 22 bp, Homo sapiens
ggggccgccagagagagccttg

SEQ ID NO: 6815 - DNA, 22 bp, Homo sapiens
tgctccagcaccaagagctcca

SEQ ID NO: 6816 - DNA, 21 bp, Homo sapiens
ccgccacctctaagctgggtc

SEQ ID NO: 6817 - DNA, 22 bp, Homo sapiens
ctcagcagtatactctgaagat

SEQ ID NO: 6818 - DNA, 22 bp, Homo sapiens
gccatgggcaaatgcagagctg

SEQ ID NO: 6819 - DNA, 22 bp, Homo sapiens
gaccttgtgatccccctgcctt

SEQ ID NO: 6820 - DNA, 22 bp, Homo sapiens
tgaccacattgatttctcatcc

SEQ ID NO: 6821 - DNA, 22 bp, Homo sapiens
ctctgtagactccacctttgag

SEQ ID NO: 6822 - DNA, 22 bp, Homo sapiens
tgaactcctgacctcatgatcc

SEQ ID NO: 6823 - DNA, 22 bp, Homo sapiens
ttctgattgctgatgaggccca

SEQ ID NO: 6824 - DNA, 22 bp, Homo sapiens
ttctcttacattttctcagcct

SEQ ID NO: 6825 - DNA, 22 bp, Homo sapiens
aacccgggaggcagaggttgtg

SEQ ID NO: 6826 - DNA, 22 bp, Homo sapiens
ccagtggctacaggggggttga

SEQ ID NO: 6827 - DNA, 22 bp, Homo sapiens
cctgtgatattgttcataatat

SEQ ID NO: 6828 - DNA, 22 bp, Homo sapiens
ttgtctgcatgattctaggcag

SEQ ID NO: 6829 - DNA, 22 bp, Homo sapiens
gaccatcctggccaacgtggta

SEQ ID NO: 6830 - DNA, 22 bp, Homo sapiens
agtgggaattttctcccaggga

SEQ ID NO: 6831 - DNA, 22 bp, Homo sapiens
gcccatgaggtggaggctgcag

SEQ ID NO: 6832 - DNA, 17 bp, Homo sapiens
ttaaggtggatcagcac

SEQ ID NO: 6833 - DNA, 22 bp, Homo sapiens
gagcccgagcgcgtacccggcg

SEQ ID NO: 6834 - DNA, 22 bp, Homo sapiens
ccactgccctgcaaaagctgga

SEQ ID NO: 6835 - DNA, 22 bp, Homo sapiens
atccccagaaagaccgatgtac

SEQ ID NO: 6836 - DNA, 22 bp, Homo sapiens
tgggaacagaggacttgactgt

SEQ ID NO: 6837 - DNA, 22 bp, Homo sapiens
atcaaatacaaagggcataagg

SEQ ID NO: 6838 - DNA, 22 bp, Homo sapiens
tgtccttatctccaaacaatca

SEQ ID NO: 6839 - DNA, 22 bp, Homo sapiens
taccatgctctgcatctcacaa

SEQ ID NO: 6840 - DNA, 22 bp, Homo sapiens
aagatacagacagagccaaaat

SEQ ID NO: 6841 - DNA, 22 bp, Homo sapiens
ctcggagggcaacagaagtgct

SEQ ID NO: 6842 - DNA, 15 bp, Homo sapiens
tctagttttgaagac

SEQ ID NO: 6843 - DNA, 22 bp, Homo sapiens
ggctgagctccaagtattccat

SEQ ID NO: 6844 - DNA, 19 bp, Homo sapiens
actggcacacaggggctgc

SEQ ID NO: 6845 - DNA, 22 bp, Homo sapiens
tgaggctccttgtagagagtgg

SEQ ID NO: 6846 - DNA, 22 bp, Homo sapiens
gtttgagatgggttattgctct

SEQ ID NO: 6847 - DNA, 22 bp, Homo sapiens
cccaggcttttctcttgcccca

SEQ ID NO: 6848 - DNA, 22 bp, Homo sapiens
tcactttaagcgggaggcagag

SEQ ID NO: 6849 - DNA, 22 bp, Homo sapiens
gctgccaatccagctgtgggag

SEQ ID NO: 6850 - DNA, 22 bp, Homo sapiens
catgcacttacctgaaattcaa

SEQ ID NO: 6851 - DNA, 22 bp, Homo sapiens
ttcttcagcctaccttgacctc

SEQ ID NO: 6852 - DNA, 17 bp, Homo sapiens
acctattgatctgtcac

SEQ ID NO: 6853 - DNA, 22 bp, Homo sapiens
ctcagatctttcccattttccc

SEQ ID NO: 6854 - DNA, 22 bp, Homo sapiens
ctgctttggacaactattcttg

SEQ ID NO: 6855 - DNA, 22 bp, Homo sapiens
cgggcgcactccgggcagctgt

SEQ ID NO: 6856 - DNA, 22 bp, Homo sapiens
cggagccagaggctggagaggc

SEQ ID NO: 6857 - DNA, 20 bp, Homo sapiens
gtgtgacctcctgtggatgc

SEQ ID NO: 6858 - DNA, 22 bp, Homo sapiens
aacctgggcttgaacagtgcct

SEQ ID NO: 6859 - DNA, 22 bp, Homo sapiens
caatgctaaaaattctgtacat

SEQ ID NO: 6860 - DNA, 22 bp, Homo sapiens
agtggcaggatctcggttcact

SEQ ID NO: 6861 - DNA, 22 bp, Homo sapiens
cgatgaatatttaacgctgtga

SEQ ID NO: 6862 - DNA, 22 bp, Homo sapiens
gctcttgtcaaaaattagttga

SEQ ID NO: 6863 - DNA, 22 bp, Homo sapiens
ttgaaattttaggccttgcaat

SEQ ID NO: 6864 - DNA, 22 bp, Homo sapiens
caagcgtggctgctctgatgga

SEQ ID NO: 6865 - DNA, 23 bp, Homo sapiens
tgagctgggcctgcaggggtctc

SEQ ID NO: 6866 - DNA, 22 bp, Homo sapiens
tggcaccatcaaggctgagaac

SEQ ID NO: 6867 - DNA, 22 bp, Homo sapiens
tcacttcgtaaacccctcccat

SEQ ID NO: 6868 - DNA, 22 bp, Homo sapiens
ccaaggccttgaaggcgcgggg

SEQ ID NO: 6869 - DNA, 22 bp, Homo sapiens
aacccaggagacaggttgcagt

SEQ ID NO: 6870 - DNA, 22 bp, Homo sapiens
ctgcagtctacctggattttta

SEQ ID NO: 6871 - DNA, 22 bp, Homo sapiens
tgatcaaaacattactccacca

SEQ ID NO: 6872 - DNA, 22 bp, Homo sapiens
ggtgcccaaggaaggttgccgt

SEQ ID NO: 6873 - DNA, 22 bp, Homo sapiens
gcgggccaccttggagagcgct

SEQ ID NO: 6874 - DNA, 22 bp, Homo sapiens
tggggacttgccttgttgctca

SEQ ID NO: 6875 - DNA, 22 bp, Homo sapiens
ggcagcttgtcctggaggatgg

SEQ ID NO: 6876 - DNA, 22 bp, Homo sapiens
tccagaaggccacccggggatg

SEQ ID NO: 6877 - DNA, 18 bp, Homo sapiens
agagtatacagacaacaa

SEQ ID NO: 6878 - DNA, 22 bp, Homo sapiens
atgccactgacatggacaattt

SEQ ID NO: 6879 - DNA, 22 bp, Homo sapiens
agtccgcctgctgccgtggcag

SEQ ID NO: 6880 - DNA, 22 bp, Homo sapiens
acccgatgttggtgctctagta

SEQ ID NO: 6881 - DNA, 22 bp, Homo sapiens
ggtgagaaagggattcctgttc

SEQ ID NO: 6882 - DNA, 22 bp, Homo sapiens
tcagacattattttcaagataa

SEQ ID NO: 6883 - DNA, 22 bp, Homo sapiens
ttttcagaattagcataccatt

SEQ ID NO: 6884 - DNA, 19 bp, Homo sapiens
tccacagtggttgaactag

SEQ ID NO: 6885 - DNA, 22 bp, Homo sapiens
tgggtactcctattagttcagt

SEQ ID NO: 6886 - DNA, 22 bp, Homo sapiens
catgagatctgcagggatgggc

SEQ ID NO: 6887 - DNA, 22 bp, Homo sapiens
cggaggttgaggctgcagtgag

SEQ ID NO: 6888 - DNA, 22 bp, Homo sapiens
gggctgcatcagcaggacccgg

SEQ ID NO: 6889 - DNA, 22 bp, Homo sapiens
aaattagtcatgttgtattact

SEQ ID NO: 6890 - DNA, 22 bp, Homo sapiens
tcccacaggtggagcttgcagt

SEQ ID NO: 6891 - DNA, 22 bp, Homo sapiens
tgttgactcaacactgtgggca

SEQ ID NO: 6892 - DNA, 23 bp, Homo sapiens
gtgcatgtgtctttacagtagca

SEQ ID NO: 6893 - DNA, 22 bp, Homo sapiens
cctgggtttggagcctgcagaa

SEQ ID NO: 6894 - DNA, 22 bp, Homo sapiens
agccagtgcagctggaaattca

SEQ ID NO: 6895 - DNA, 22 bp, Homo sapiens
agaaatcctgatggagtctgaa

SEQ ID NO: 6896 - DNA, 22 bp, Homo sapiens
ttgcatcttctggttgagcccc

SEQ ID NO: 6897 - DNA, 22 bp, Homo sapiens
tctgagaaatttctttgtgatg

SEQ ID NO: 6898 - DNA, 22 bp, Homo sapiens
ctggaaggcggaggttgtagtg

SEQ ID NO: 6899 - DNA, 22 bp, Homo sapiens
ctgcgtgcatgtctgcgtgcat

SEQ ID NO: 6900 - DNA, 22 bp, Homo sapiens
gccctagcgccagctcagcacc

SEQ ID NO: 6901 - DNA, 22 bp, Homo sapiens
cgtgcggcctcggggcccggct

SEQ ID NO: 6902 - DNA, 22 bp, Homo sapiens
ggctctgcagcttggggtcctg

SEQ ID NO: 6903 - DNA, 22 bp, Homo sapiens
tcgttatagaacattcttgggt

SEQ ID NO: 6904 - DNA, 22 bp, Homo sapiens
attaggtcatggggaggcccta

SEQ ID NO: 6905 - DNA, 22 bp, Homo sapiens
gagagagctctgtgcctgggat

SEQ ID NO: 6906 - DNA, 22 bp, Homo sapiens
ggggagatgcttaggtccgggg

SEQ ID NO: 6907 - DNA, 22 bp, Homo sapiens
gtatacgtgcaggtcacagggg

SEQ ID NO: 6908 - DNA, 22 bp, Homo sapiens
tggaaatgtttcttgagctcag

SEQ ID NO: 6909 - DNA, 23 bp, Homo sapiens
ctcctcgtaactctgtggtgggt

SEQ ID NO: 6910 - DNA, 22 bp, Homo sapiens
ttctcagtgaagtttagaacat

SEQ ID NO: 6911 - DNA, 22 bp, Homo sapiens
aggaccatcctaaggtaggcaa

SEQ ID NO: 6912 - DNA, 22 bp, Homo sapiens
agcccggcttccccggttgcta

SEQ ID NO: 6913 - DNA, 22 bp, Homo sapiens
tgtgcctttcttcccaagtaga

SEQ ID NO: 6914 - DNA, 22 bp, Homo sapiens
gagctcattcattcattgcctg

SEQ ID NO: 6915 - DNA, 22 bp, Homo sapiens
tggtctttgtccctccttgatc

SEQ ID NO: 6916 - DNA, 22 bp, Homo sapiens
gccagtgcctcgccgcgctcct

SEQ ID NO: 6917 - DNA, 22 bp, Homo sapiens
agtgcaatggcgtgatcttggc

SEQ ID NO: 6918 - DNA, 22 bp, Homo sapiens
ttagccaggggagcagcttgtc

SEQ ID NO: 6919 - DNA, 22 bp, Homo sapiens
atgccactgcgctccagcctgg

SEQ ID NO: 6920 - DNA, 22 bp, Homo sapiens
agtccgtggccagactcaagag

SEQ ID NO: 6921 - DNA, 22 bp, Homo sapiens
agccggccatgtggtcttgtgc

SEQ ID NO: 6922 - DNA, 22 bp, Homo sapiens
atgtgtcaggtacactcattag

SEQ ID NO: 6923 - DNA, 18 bp, Homo sapiens
gtgactgccccaaaaggc

SEQ ID NO: 6924 - DNA, 20 bp, Homo sapiens
gccactgggcaccagcaggg

SEQ ID NO: 6925 - DNA, 22 bp, Homo sapiens
tttcttcctgctttgtcccatg

SEQ ID NO: 6926 - DNA, 22 bp, Homo sapiens
ctctcgccagcggggctgcgct

SEQ ID NO: 6927 - DNA, 22 bp, Homo sapiens
tgctggaagggtcggcgtgggc

SEQ ID NO: 6928 - DNA, 22 bp, Homo sapiens
cttgaaagtcagcagagtggat

SEQ ID NO: 6929 - DNA, 22 bp, Homo sapiens
acagtctgtcccccaggtgcta

SEQ ID NO: 6930 - DNA, 22 bp, Homo sapiens
tgacctattagatttccttgcc

SEQ ID NO: 6931 - DNA, 22 bp, Homo sapiens
tatgtttggcctggcaatttca

SEQ ID NO: 6932 - DNA, 22 bp, Homo sapiens
aagcagagaatctgggagcgag

SEQ ID NO: 6933 - DNA, 22 bp, Homo sapiens
ttctaattaaatctacgctagg

SEQ ID NO: 6934 - DNA, 22 bp, Homo sapiens
ccctggaggcggagcttgcagt

SEQ ID NO: 6935 - DNA, 22 bp, Homo sapiens
attgtctctgaattttcagctg

SEQ ID NO: 6936 - DNA, 22 bp, Homo sapiens
aatctcatttacaacatgagga

SEQ ID NO: 6937 - DNA, 22 bp, Homo sapiens
accctaataatcacagactagt

SEQ ID NO: 6938 - DNA, 22 bp, Homo sapiens
ctggcagatagtaagtgatcaa

SEQ ID NO: 6939 - DNA, 22 bp, Homo sapiens
aggctcagatccttgtgtcctg

SEQ ID NO: 6940 - DNA, 23 bp, Homo sapiens
acagcaagaggaccagatgtgag

SEQ ID NO: 6941 - DNA, 22 bp, Homo sapiens
ccatccttgtcatcttcatgtt

SEQ ID NO: 6942 - DNA, 22 bp, Homo sapiens
ctgaagagaaagggagctcttc

SEQ ID NO: 6943 - DNA, 22 bp, Homo sapiens
ccaccagctgcatatgcacgta

SEQ ID NO: 6944 - DNA, 22 bp, Homo sapiens
tgagatgaataactcctgctaa

SEQ ID NO: 6945 - DNA, 22 bp, Homo sapiens
gaaatgctcaggggttttccag

SEQ ID NO: 6946 - DNA, 22 bp, Homo sapiens
tcctgccaccgggggtggcgat

SEQ ID NO: 6947 - DNA, 21 bp, Homo sapiens
tccttcagtctagatgattgt

SEQ ID NO: 6948 - DNA, 22 bp, Homo sapiens
tgaatgtgatgctaaacatatg

SEQ ID NO: 6949 - DNA, 22 bp, Homo sapiens
gtgtccccacccaaatctcatc

SEQ ID NO: 6950 - DNA, 22 bp, Homo sapiens
gtccctgataagagccatcgat

SEQ ID NO: 6951 - DNA, 22 bp, Homo sapiens
gagagcaggaggcagcgggacg

SEQ ID NO: 6952 - DNA, 22 bp, Homo sapiens
tgtagggcctaggggtatggat

SEQ ID NO: 6953 - DNA, 22 bp, Homo sapiens
ggaaaggcctgggtgtcctggg

SEQ ID NO: 6954 - DNA, 22 bp, Homo sapiens
aaggaggcctggcagatgaaga

SEQ ID NO: 6955 - DNA, 22 bp, Homo sapiens
tggtattacttctagacacaag

SEQ ID NO: 6956 - DNA, 22 bp, Homo sapiens
gggcggatcatttgaggtcagg

SEQ ID NO: 6957 - DNA, 22 bp, Homo sapiens
agagttgaagtataatagggat

SEQ ID NO: 6958 - DNA, 22 bp, Homo sapiens
cctgggctctgtcagaattggg

SEQ ID NO: 6959 - DNA, 22 bp, Homo sapiens
cgtctaggccgtgccctgaggt

SEQ ID NO: 6960 - DNA, 22 bp, Homo sapiens
ttctcacagaagcacgaagcct

SEQ ID NO: 6961 - DNA, 22 bp, Homo sapiens
tgctgctcatcagattttaaaa

SEQ ID NO: 6962 - DNA, 22 bp, Homo sapiens
actgtactccagcctcggtgac

SEQ ID NO: 6963 - DNA, 22 bp, Homo sapiens
gacccttagaatgtgatcttat

SEQ ID NO: 6964 - DNA, 22 bp, Homo sapiens
gctggtgagcaaaggagaagga

SEQ ID NO: 6965 - DNA, 22 bp, Homo sapiens
atgcgagtgatgcagagtggct

SEQ ID NO: 6966 - DNA, 22 bp, Homo sapiens
gaggtggccaagcgaggaaggg

SEQ ID NO: 6967 - DNA, 22 bp, Homo sapiens
accctggaggtggaggtgcagt

SEQ ID NO: 6968 - DNA, 22 bp, Homo sapiens
agcctgattttgataattatat

SEQ ID NO: 6969 - DNA, 22 bp, Homo sapiens
gtgattttcatgccctgctagg

SEQ ID NO: 6970 - DNA, 22 bp, Homo sapiens
ctagggtgtgcagattttgcct

SEQ ID NO: 6971 - DNA, 22 bp, Homo sapiens
gtgggccactgggaggcaaggg

SEQ ID NO: 6972 - DNA, 22 bp, Homo sapiens
caggtgagaggcggtcctgcat

SEQ ID NO: 6973 - DNA, 22 bp, Homo sapiens
gataatccactctgctgacttt

SEQ ID NO: 6974 - DNA, 22 bp, Homo sapiens
tgtgtttctgagaatcccacct

SEQ ID NO: 6975 - DNA, 22 bp, Homo sapiens
gcctgtaatcccagcactttgg

SEQ ID NO: 6976 - DNA, 22 bp, Homo sapiens
ctcctgagctctgaggaagctt

SEQ ID NO: 6977 - DNA, 22 bp, Homo sapiens
ttctagtgtccttggacttgct

SEQ ID NO: 6978 - DNA, 22 bp, Homo sapiens
tttgcttgattaggatatggaa

SEQ ID NO: 6979 - DNA, 22 bp, Homo sapiens
ctgaaattctttggagttttct

SEQ ID NO: 6980 - DNA, 22 bp, Homo sapiens
gtgtcaggccctgcattatgtg

SEQ ID NO: 6981 - DNA, 20 bp, Homo sapiens
tgtcttccagcaggtgttta

SEQ ID NO: 6982 - DNA, 22 bp, Homo sapiens
gtgagtaaaggttcattgaatt

SEQ ID NO: 6983 - DNA, 22 bp, Homo sapiens
catggcactgagcaggtatgca

SEQ ID NO: 6984 - DNA, 22 bp, Homo sapiens
ctgagggtcaacttgattgtat

SEQ ID NO: 6985 - DNA, 22 bp, Homo sapiens
aaagtgctgtgattacaggcat

SEQ ID NO: 6986 - DNA, 22 bp, Homo sapiens
tgtgaccctctccgatgggcag

SEQ ID NO: 6987 - DNA, 22 bp, Homo sapiens
gtgagaaatgacaaatgtgtcg

SEQ ID NO: 6988 - DNA, 22 bp, Homo sapiens
tcacagctcactgtagcctcga

SEQ ID NO: 6989 - DNA, 22 bp, Homo sapiens
acgggccttctcttcaggcgag

SEQ ID NO: 6990 - DNA, 22 bp, Homo sapiens
taagggaacagcttcaaactca

SEQ ID NO: 6991 - DNA, 22 bp, Homo sapiens
agggttgcaccatgttggtcag

SEQ ID NO: 6992 - DNA, 22 bp, Homo sapiens
aaaagagcttggttgattttgc

SEQ ID NO: 6993 - DNA, 22 bp, Homo sapiens
tgccaccccggaccccgaagtg

SEQ ID NO: 6994 - DNA, 22 bp, Homo sapiens
cactgcaacctccgcctcctgg

SEQ ID NO: 6995 - DNA, 22 bp, Homo sapiens
ggaggctctgaccatttaccca

SEQ ID NO: 6996 - DNA, 18 bp, Homo sapiens
ttgcttcttttctctagg

SEQ ID NO: 6997 - DNA, 22 bp, Homo sapiens
gatctcagacaggtggacaggg

SEQ ID NO: 6998 - DNA, 22 bp, Homo sapiens
tgcgatggcgtagacaaatccc

SEQ ID NO: 6999 - DNA, 22 bp, Homo sapiens
ttcccacagtgactccagagaa

SEQ ID NO: 7000 - DNA, 22 bp, Homo sapiens
ctggcaggttatagagctgccc

SEQ ID NO: 7001 - DNA, 22 bp, Homo sapiens
aaaggggtaatctaaggaattc

SEQ ID NO: 7002 - DNA, 23 bp, Homo sapiens
ggactgcaatggcgccgtctcag

SEQ ID NO: 7003 - DNA, 22 bp, Homo sapiens
aagtgattgttccgttgagtgt

SEQ ID NO: 7004 - DNA, 22 bp, Homo sapiens
tccggccgaaagatctgaccga

SEQ ID NO: 7005 - DNA, 22 bp, Homo sapiens
tataaactcctcttgcattcct

SEQ ID NO: 7006 - DNA, 22 bp, Homo sapiens
gctgtcttgctcactcttgcag

SEQ ID NO: 7007 - DNA, 22 bp, Homo sapiens
tgcctgatgcaggagtatcaga

SEQ ID NO: 7008 - DNA, 22 bp, Homo sapiens
ctcatgatccaccgatgtcagc

SEQ ID NO: 7009 - DNA, 22 bp, Homo sapiens
atcacccaagctggagtgcagt

SEQ ID NO: 7010 - DNA, 22 bp, Homo sapiens
ggtcagaggtcccagaagaagc

SEQ ID NO: 7011 - DNA, 22 bp, Homo sapiens
gggttggatcctggtggctgcc

SEQ ID NO: 7012 - DNA, 22 bp, Homo sapiens
cagaggctggcggccgccccga

SEQ ID NO: 7013 - DNA, 21 bp, Homo sapiens
atatcaatacagcaggacttc

SEQ ID NO: 7014 - DNA, 22 bp, Homo sapiens
taaatcttctacatcatcataa

SEQ ID NO: 7015 - DNA, 22 bp, Homo sapiens
acagagacacggaagctaaaga

SEQ ID NO: 7016 - DNA, 22 bp, Homo sapiens
ccttttgtcctgcttggtttcg

SEQ ID NO: 7017 - DNA, 22 bp, Homo sapiens
tggtgcttgtggagctggtgct

SEQ ID NO: 7018 - DNA, 22 bp, Homo sapiens
acagatgttgcttgtcattctc

SEQ ID NO: 7019 - DNA, 22 bp, Homo sapiens
tgtcttcgctacaatgaaaagg

SEQ ID NO: 7020 - DNA, 22 bp, Homo sapiens
aagaaggcggaccagaagggag

SEQ ID NO: 7021 - DNA, 22 bp, Homo sapiens
aacagcttgctgcaccttaata

SEQ ID NO: 7022 - DNA, 22 bp, Homo sapiens
ggtagggctgcaatggtagtga

SEQ ID NO: 7023 - DNA, 22 bp, Homo sapiens
aggtctgtttaacaaagtcagg

SEQ ID NO: 7024 - DNA, 17 bp, Homo sapiens
gcgtgtccccgcgtctc

SEQ ID NO: 7025 - DNA, 20 bp, Homo sapiens
cagcctgcatcatctgcagc

SEQ ID NO: 7026 - DNA, 22 bp, Homo sapiens
gtgtgcacagagctccagtgtt

SEQ ID NO: 7027 - DNA, 22 bp, Homo sapiens
tggatttcaccatgttggtcag

SEQ ID NO: 7028 - DNA, 22 bp, Homo sapiens
agacggctggcagtgagcggct

SEQ ID NO: 7029 - DNA, 22 bp, Homo sapiens
tgagtcatgtaataatgctgct

SEQ ID NO: 7030 - DNA, 22 bp, Homo sapiens
gactatctgccaggtcccaggg

SEQ ID NO: 7031 - DNA, 20 bp, Homo sapiens
ctttaactggaaggctgctt

SEQ ID NO: 7032 - DNA, 21 bp, Homo sapiens
ctcccagggtgactgttcaac

SEQ ID NO: 7033 - DNA, 22 bp, Homo sapiens
caaaccacactcagcgtatcgg

SEQ ID NO: 7034 - DNA, 22 bp, Homo sapiens
tcgaagattctttttgttagta

SEQ ID NO: 7035 - DNA, 22 bp, Homo sapiens
tcactgcaatctcagcctcctg

SEQ ID NO: 7036 - DNA, 22 bp, Homo sapiens
ttcaaatgatggcagtcctggc

SEQ ID NO: 7037 - DNA, 22 bp, Homo sapiens
attcatcagctaatggacattt

SEQ ID NO: 7038 - DNA, 22 bp, Homo sapiens
agtgcactggcaccatctcagc

SEQ ID NO: 7039 - DNA, 22 bp, Homo sapiens
gtggcttgagcaggggcagagg

SEQ ID NO: 7040 - DNA, 22 bp, Homo sapiens
gctgcgccggatcccacgttcc

SEQ ID NO: 7041 - DNA, 22 bp, Homo sapiens
cctcaaagctcaaatgaggctt

SEQ ID NO: 7042 - DNA, 22 bp, Homo sapiens
actctgcctgcggtgggcggga

SEQ ID NO: 7043 - DNA, 22 bp, Homo sapiens
atggtggacgggagacaggact

SEQ ID NO: 7044 - DNA, 22 bp, Homo sapiens
taggtgcagtggctcatgcctg

SEQ ID NO: 7045 - DNA, 22 bp, Homo sapiens
taggcatgcaaataaatgtgca

SEQ ID NO: 7046 - DNA, 22 bp, Homo sapiens
ctgagataggactctgctggct

SEQ ID NO: 7047 - DNA, 22 bp, Homo sapiens
gtacactccccctgtgaagttg

SEQ ID NO: 7048 - DNA, 22 bp, Homo sapiens
ccaggaggcggaggttgcagcg

SEQ ID NO: 7049 - DNA, 22 bp, Homo sapiens
gccccgtcgtggggccagggat

SEQ ID NO: 7050 - DNA, 22 bp, Homo sapiens
atcatcatgcccacttgagact

SEQ ID NO: 7051 - DNA, 22 bp, Homo sapiens
gttgagtgggttaggatgctga

SEQ ID NO: 7052 - DNA, 22 bp, Homo sapiens
acacatggtctacttcttctca

SEQ ID NO: 7053 - DNA, 22 bp, Homo sapiens
atggctagcaccgcgttgctgg

SEQ ID NO: 7054 - DNA, 22 bp, Homo sapiens
cggaggcctcagctcatggttt

SEQ ID NO: 7055 - DNA, 22 bp, Homo sapiens
gccattgcactccagcctaggc

SEQ ID NO: 7056 - DNA, 22 bp, Homo sapiens
cttcagctcttggtaaatgttt

SEQ ID NO: 7057 - DNA, 22 bp, Homo sapiens
gtttctggcgccggggcaggcc

SEQ ID NO: 7058 - DNA, 22 bp, Homo sapiens
aaactcttggtcaacatgagga

SEQ ID NO: 7059 - DNA, 22 bp, Homo sapiens
cattctggaccaagctgggtgc

SEQ ID NO: 7060 - DNA, 22 bp, Homo sapiens
ggaactcctgctccaagcagct

SEQ ID NO: 7061 - DNA, 22 bp, Homo sapiens
tacaaaggaggtgcatagaaca

SEQ ID NO: 7062 - DNA, 22 bp, Homo sapiens
tgcctgtgtcagcaggtggaag

SEQ ID NO: 7063 - DNA, 22 bp, Homo sapiens
ttccacatgttagctggttaaa

SEQ ID NO: 7064 - DNA, 22 bp, Homo sapiens
ccctgttgggaagagagatggc

SEQ ID NO: 7065 - DNA, 22 bp, Homo sapiens
cccagtttcaactttccagtgg

SEQ ID NO: 7066 - DNA, 22 bp, Homo sapiens
gactgtggggaagcagatgcca

SEQ ID NO: 7067 - DNA, 22 bp, Homo sapiens
accagaagctggagcacaagga

SEQ ID NO: 7068 - DNA, 19 bp, Homo sapiens
tgtccgtggccttctggat

SEQ ID NO: 7069 - DNA, 21 bp, Homo sapiens
tttcttaggctctaaaatgac

SEQ ID NO: 7070 - DNA, 22 bp, Homo sapiens
actgcattccagcctgggcaac

SEQ ID NO: 7071 - DNA, 22 bp, Homo sapiens
atgctaaggcactaccttctca

SEQ ID NO: 7072 - DNA, 22 bp, Homo sapiens
gctgcaagtgcatgttgcaact

SEQ ID NO: 7073 - DNA, 22 bp, Homo sapiens
cattctgaccctatgatttaag

SEQ ID NO: 7074 - DNA, 22 bp, Homo sapiens
gtggcattgccttctgcaggaa

SEQ ID NO: 7075 - DNA, 22 bp, Homo sapiens
ttcacagcttaataaggctcag

SEQ ID NO: 7076 - DNA, 22 bp, Homo sapiens
tgctatgtgtgccagggactgt

SEQ ID NO: 7077 - DNA, 22 bp, Homo sapiens
tatgcttattgtctcatccact

SEQ ID NO: 7078 - DNA, 22 bp, Homo sapiens
tatactacgcaccaaacaaagg

SEQ ID NO: 7079 - DNA, 22 bp, Homo sapiens
aggctaggaacagcccggccct

SEQ ID NO: 7080 - DNA, 22 bp, Homo sapiens
cactgcaagctccgcctctggg

SEQ ID NO: 7081 - DNA, 18 bp, Homo sapiens
tttgaccctcagtgccat

SEQ ID NO: 7082 - DNA, 22 bp, Homo sapiens
tagatttgtttccttctctcca

SEQ ID NO: 7083 - DNA, 22 bp, Homo sapiens
cttgggaggcagaggttgcagt

SEQ ID NO: 7084 - DNA, 22 bp, Homo sapiens
aaggccctggcaggaagcagga

SEQ ID NO: 7085 - DNA, 22 bp, Homo sapiens
tccacaaggcagctcctccagg

SEQ ID NO: 7086 - DNA, 22 bp, Homo sapiens
ggtggcctgttttcaggtttgc

SEQ ID NO: 7087 - DNA, 22 bp, Homo sapiens
ttacaattacttgatctcagct

SEQ ID NO: 7088 - DNA, 22 bp, Homo sapiens
aaacttttttaggttcataggc

SEQ ID NO: 7089 - DNA, 22 bp, Homo sapiens
agctcttacatttaggtctatg

SEQ ID NO: 7090 - DNA, 22 bp, Homo sapiens
gctcccaccgccgctatgggta

SEQ ID NO: 7091 - DNA, 22 bp, Homo sapiens
gctcaggtagatggggttgtcc

SEQ ID NO: 7092 - DNA, 22 bp, Homo sapiens
ccgcgccacccattcccactga

SEQ ID NO: 7093 - DNA, 22 bp, Homo sapiens
ccagttgttccctgtcagagat

SEQ ID NO: 7094 - DNA, 22 bp, Homo sapiens
tcacccttgacttggaaaaacc

SEQ ID NO: 7095 - DNA, 22 bp, Homo sapiens
tcttgcacttcatgaatatgtt

SEQ ID NO: 7096 - DNA, 22 bp, Homo sapiens
tgaggcaggaggattgcaggat

SEQ ID NO: 7097 - DNA, 22 bp, Homo sapiens
gcaccctgtcaaaatggaccaa

SEQ ID NO: 7098 - DNA, 22 bp, Homo sapiens
aaggtcatggcaaattactttt

SEQ ID NO: 7099 - DNA, 22 bp, Homo sapiens
tctgcaggaagctggcggctga

SEQ ID NO: 7100 - DNA, 22 bp, Homo sapiens
ggagtgactcacagctgggaca

SEQ ID NO: 7101 - DNA, 22 bp, Homo sapiens
cattacagaatatgtaatgatc

SEQ ID NO: 7102 - DNA, 22 bp, Homo sapiens
caccagagtgggtgagggtgat

SEQ ID NO: 7103 - DNA, 22 bp, Homo sapiens
ggcatggacgtctctgaggcca

SEQ ID NO: 7104 - DNA, 22 bp, Homo sapiens
ttcctttctctggactgcagcc

SEQ ID NO: 7105 - DNA, 22 bp, Homo sapiens
tatctgttaaaacaagctttaa

SEQ ID NO: 7106 - DNA, 22 bp, Homo sapiens
ttctcttttcaccagttgctaa

SEQ ID NO: 7107 - DNA, 19 bp, Homo sapiens
gttttgcaggcagagggga

SEQ ID NO: 7108 - DNA, 21 bp, Homo sapiens
gctcctggtgctgcgtggcgc

SEQ ID NO: 7109 - DNA, 21 bp, Homo sapiens
cccgtgccttcagcagtcctg

SEQ ID NO: 7110 - DNA, 22 bp, Homo sapiens
ggctagcaaggtagcagaatgc

SEQ ID NO: 7111 - DNA, 22 bp, Homo sapiens
ggttccacctggcgaggggtat

SEQ ID NO: 7112 - DNA, 22 bp, Homo sapiens
gagaccttaggaacagcctcaa

SEQ ID NO: 7113 - DNA, 22 bp, Homo sapiens
tggagggcatgctgtccatggg

SEQ ID NO: 7114 - DNA, 22 bp, Homo sapiens
ctcgcatgccctgcctcatcca

SEQ ID NO: 7115 - DNA, 22 bp, Homo sapiens
ggccggggcctgctcgcctgtg

SEQ ID NO: 7116 - DNA, 22 bp, Homo sapiens
gtcttgatctcctgaccttgtg

SEQ ID NO: 7117 - DNA, 22 bp, Homo sapiens
actgagggtcaaccatttgctc

SEQ ID NO: 7118 - DNA, 22 bp, Homo sapiens
tagatctgatacaattcatctg

SEQ ID NO: 7119 - DNA, 22 bp, Homo sapiens
ggtcaggagcccttggccccct

SEQ ID NO: 7120 - DNA, 22 bp, Homo sapiens
gagtcacatactatgtaataga

SEQ ID NO: 7121 - DNA, 22 bp, Homo sapiens
cccagacccagagggaggcagg

SEQ ID NO: 7122 - DNA, 20 bp, Homo sapiens
tgtggtttttgccagttgaa

SEQ ID NO: 7123 - DNA, 22 bp, Homo sapiens
agtcacagggggcccctgcaac

SEQ ID NO: 7124 - DNA, 22 bp, Homo sapiens
gcttacaggtgaggcagcaaga

SEQ ID NO: 7125 - DNA, 22 bp, Homo sapiens
actaaagctcacagagttgaac

SEQ ID NO: 7126 - DNA, 22 bp, Homo sapiens
ggttcagagcctgcccagtata

SEQ ID NO: 7127 - DNA, 22 bp, Homo sapiens
gatcgggtgggttctgccatca

SEQ ID NO: 7128 - DNA, 22 bp, Homo sapiens
gtctatgatattttgttatagc

SEQ ID NO: 7129 - DNA, 22 bp, Homo sapiens
acaagaagtaaaggtcggatgc

SEQ ID NO: 7130 - DNA, 22 bp, Homo sapiens
ccgttggaaagctccgagttga

SEQ ID NO: 7131 - DNA, 22 bp, Homo sapiens
gcctgatcaggtcctcggcata

SEQ ID NO: 7132 - DNA, 22 bp, Homo sapiens
taagtcccccacttgccacagg

SEQ ID NO: 7133 - DNA, 22 bp, Homo sapiens
tgaccactgtagccacttaaga

SEQ ID NO: 7134 - DNA, 22 bp, Homo sapiens
tctccattagtgggtggcagtg

SEQ ID NO: 7135 - DNA, 22 bp, Homo sapiens
cattggccttttatcctagagg

SEQ ID NO: 7136 - DNA, 22 bp, Homo sapiens
accgtgtctgacactttgggcg

SEQ ID NO: 7137 - DNA, 22 bp, Homo sapiens
atgccccagtgtgtgcttcctt

SEQ ID NO: 7138 - DNA, 22 bp, Homo sapiens
tgccagaatttgcttccaatgt

SEQ ID NO: 7139 - DNA, 22 bp, Homo sapiens
ttatcacttatgagctttttgc

SEQ ID NO: 7140 - DNA, 22 bp, Homo sapiens
ggtcaatgccaagtgtggctta

SEQ ID NO: 7141 - DNA, 22 bp, Homo sapiens
tcattgccatggcatttgcaga

SEQ ID NO: 7142 - DNA, 22 bp, Homo sapiens
gtcagatgtttgcgtagggtat

SEQ ID NO: 7143 - DNA, 18 bp, Homo sapiens
ccatcaccctaactagtg

SEQ ID NO: 7144 - DNA, 22 bp, Homo sapiens
cgtgtacagtctatcttttttc

SEQ ID NO: 7145 - DNA, 22 bp, Homo sapiens
gtgctggggagataggaagaga

SEQ ID NO: 7146 - DNA, 18 bp, Homo sapiens
cagcctctgattggttgc

SEQ ID NO: 7147 - DNA, 22 bp, Homo sapiens
gcagccagagggggtgtgatca

SEQ ID NO: 7148 - DNA, 22 bp, Homo sapiens
cacttgttggtggtgaaatcac

SEQ ID NO: 7149 - DNA, 18 bp, Homo sapiens
ctgccagtgtgctctccg

SEQ ID NO: 7150 - DNA, 18 bp, Homo sapiens
ctgtacttcagcctgggt

SEQ ID NO: 7151 - DNA, 22 bp, Homo sapiens
aggagccagtggagttcctgcc

SEQ ID NO: 7152 - DNA, 22 bp, Homo sapiens
atgaagctactgaatatttggt

SEQ ID NO: 7153 - DNA, 22 bp, Homo sapiens
tcagcttcgcctgaggtatggg

SEQ ID NO: 7154 - DNA, 19 bp, Homo sapiens
gccgaccgttggggtgccc

SEQ ID NO: 7155 - DNA, 22 bp, Homo sapiens
ccaaagtgctggggttacaggc

SEQ ID NO: 7156 - DNA, 22 bp, Homo sapiens
cgtgtggtcccggcaaggcaag

SEQ ID NO: 7157 - DNA, 22 bp, Homo sapiens
ccaccgccatggcgttgtacag

SEQ ID NO: 7158 - DNA, 22 bp, Homo sapiens
gagcccaggaagtggaggctga

SEQ ID NO: 7159 - DNA, 22 bp, Homo sapiens
ctcaccttccggctgctccctg

SEQ ID NO: 7160 - DNA, 22 bp, Homo sapiens
cacagcctcctctggctcacgg

SEQ ID NO: 7161 - DNA, 22 bp, Homo sapiens
agagcggggatagttaatattc

SEQ ID NO: 7162 - DNA, 22 bp, Homo sapiens
ccgaggtcctggacttggccct

SEQ ID NO: 7163 - DNA, 22 bp, Homo sapiens
ccttcctaacattgccatgaca

SEQ ID NO: 7164 - DNA, 22 bp, Homo sapiens
gaaatcatattctcagtccttc

SEQ ID NO: 7165 - DNA, 22 bp, Homo sapiens
gcagagtgctgtcgtacgcccc

SEQ ID NO: 7166 - DNA, 22 bp, Homo sapiens
tgaaatgattatatggtgtttg

SEQ ID NO: 7167 - DNA, 22 bp, Homo sapiens
tagagctggccgggacagctgg

SEQ ID NO: 7168 - DNA, 22 bp, Homo sapiens
ttataagactgtagtgagtatt

SEQ ID NO: 7169 - DNA, 20 bp, Homo sapiens
ctgtaactgtcccttttgcc

SEQ ID NO: 7170 - DNA, 22 bp, Homo sapiens
tgacagtgaacaggttaccact

SEQ ID NO: 7171 - DNA, 22 bp, Homo sapiens
tcactgcaacctccacctcctg

SEQ ID NO: 7172 - DNA, 22 bp, Homo sapiens
ctccatatgttcagttatgcag

SEQ ID NO: 7173 - DNA, 22 bp, Homo sapiens
tacttttagcctatttgattct

SEQ ID NO: 7174 - DNA, 22 bp, Homo sapiens
ctgtccagcgactaggggatgg

SEQ ID NO: 7175 - DNA, 22 bp, Homo sapiens
cacaaccatgcacagctaattt

SEQ ID NO: 7176 - DNA, 22 bp, Homo sapiens
agaccaaagaaaacacatctgg

SEQ ID NO: 7177 - DNA, 22 bp, Homo sapiens
tgccatggcctagacctgtgat

SEQ ID NO: 7178 - DNA, 22 bp, Homo sapiens
acccagggctcaagcgtaggca

SEQ ID NO: 7179 - DNA, 22 bp, Homo sapiens
tctcctggagcccagatgctgg

SEQ ID NO: 7180 - DNA, 22 bp, Homo sapiens
ctctggcaattgctgctgactc

SEQ ID NO: 7181 - DNA, 22 bp, Homo sapiens
tcggactcggcaaggctatgca

SEQ ID NO: 7182 - DNA, 22 bp, Homo sapiens
agaggaagtaatcaggacctgc

SEQ ID NO: 7183 - DNA, 22 bp, Homo sapiens
tccagtgcaatggctcattcat

SEQ ID NO: 7184 - DNA, 22 bp, Homo sapiens
cgatcaccgtggccactttgag

SEQ ID NO: 7185 - DNA, 22 bp, Homo sapiens
ttgacctatgtttcttcatctg

SEQ ID NO: 7186 - DNA, 22 bp, Homo sapiens
ttgagaaccactgagttagata

SEQ ID NO: 7187 - DNA, 22 bp, Homo sapiens
tttcaggacacctttaaaaacg

SEQ ID NO: 7188 - DNA, 23 bp, Homo sapiens
ggttctgccgcttactgctgtgc

SEQ ID NO: 7189 - DNA, 22 bp, Homo sapiens
aaagtgctggtattacaggtgt

SEQ ID NO: 7190 - DNA, 22 bp, Homo sapiens
gatggaggagatggcagggtgc

SEQ ID NO: 7191 - DNA, 21 bp, Homo sapiens
gttcatgtcagcattaaggga

SEQ ID NO: 7192 - DNA, 22 bp, Homo sapiens
ctccagttggccccagttggtt

SEQ ID NO: 7193 - DNA, 22 bp, Homo sapiens
attgagcacatactgtgggcca

SEQ ID NO: 7194 - DNA, 22 bp, Homo sapiens
gcagtgccgaaggtagtggttg

SEQ ID NO: 7195 - DNA, 22 bp, Homo sapiens
gtctgctcgctgctcagccctg

SEQ ID NO: 7196 - DNA, 22 bp, Homo sapiens
ctcgcggcgcccgaagcccttg

SEQ ID NO: 7197 - DNA, 22 bp, Homo sapiens
ttgaaggtcaccccgtagccat

SEQ ID NO: 7198 - DNA, 22 bp, Homo sapiens
atggggctgttctctgccctgc

SEQ ID NO: 7199 - DNA, 22 bp, Homo sapiens
tgtagatattaattattccttt

SEQ ID NO: 7200 - DNA, 22 bp, Homo sapiens
tcctcagtcacggtagcacatt

SEQ ID NO: 7201 - DNA, 22 bp, Homo sapiens
ctggtaggggtgactgttatcg

SEQ ID NO: 7202 - DNA, 22 bp, Homo sapiens
tctcgatctcctgaccttgtga

SEQ ID NO: 7203 - DNA, 20 bp, Homo sapiens
tgtccccacccaaatctcat

SEQ ID NO: 7204 - DNA, 22 bp, Homo sapiens
tccacgctgtgtgaccttgggc

SEQ ID NO: 7205 - DNA, 22 bp, Homo sapiens
tgatggggaattaattaatggg

SEQ ID NO: 7206 - DNA, 22 bp, Homo sapiens
gggttaaagagcccaatgtatg

SEQ ID NO: 7207 - DNA, 22 bp, Homo sapiens
caccatgcccggctaattttgg

SEQ ID NO: 7208 - DNA, 22 bp, Homo sapiens
aaagtgctaggattacaagcgt

SEQ ID NO: 7209 - DNA, 22 bp, Homo sapiens
tttaatcaggcaaagcataata

SEQ ID NO: 7210 - DNA, 22 bp, Homo sapiens
aaaagtaattgtggtttttgct

SEQ ID NO: 7211 - DNA, 23 bp, Homo sapiens
cgcccagcctcagtgacctgggc

SEQ ID NO: 7212 - DNA, 22 bp, Homo sapiens
cagctggcgactctcctcgatg

SEQ ID NO: 7213 - DNA, 22 bp, Homo sapiens
tcaaaattaaaccaacgtccag

SEQ ID NO: 7214 - DNA, 22 bp, Homo sapiens
tctgagctccatgcaggaggct

SEQ ID NO: 7215 - DNA, 22 bp, Homo sapiens
ttccctaatgtctaacgctatt

SEQ ID NO: 7216 - DNA, 22 bp, Homo sapiens
gcacttcaccactgtcctggtt

SEQ ID NO: 7217 - DNA, 22 bp, Homo sapiens
gcggcggcggtcattgagcatg

SEQ ID NO: 7218 - DNA, 22 bp, Homo sapiens
tctgagctgggtcttgacagct

SEQ ID NO: 7219 - DNA, 22 bp, Homo sapiens
tgttcattacccatcccaggtc

SEQ ID NO: 7220 - DNA, 22 bp, Homo sapiens
ggggcagagaataaaaacctaa

SEQ ID NO: 7221 - DNA, 22 bp, Homo sapiens
tcatcagcaccctatgtccttt

SEQ ID NO: 7222 - DNA, 22 bp, Homo sapiens
ctcccgcaggagcagctcgcag

SEQ ID NO: 7223 - DNA, 20 bp, Homo sapiens
tttctccggtcttgagatcc

SEQ ID NO: 7224 - DNA, 22 bp, Homo sapiens
agcagtgtgggctgcacgctgg

SEQ ID NO: 7225 - DNA, 21 bp, Homo sapiens
tagcccttctccacctcgccc

SEQ ID NO: 7226 - DNA, 22 bp, Homo sapiens
gtgtgggctgcagaggcacagc

SEQ ID NO: 7227 - DNA, 22 bp, Homo sapiens
gctgaggctcctcgggaggaca

SEQ ID NO: 7228 - DNA, 22 bp, Homo sapiens
agatttccagaccaatttctca

SEQ ID NO: 7229 - DNA, 22 bp, Homo sapiens
tagagctctccttcctctgtgg

SEQ ID NO: 7230 - DNA, 22 bp, Homo sapiens
aaggtccttttgcagtgtgatc

SEQ ID NO: 7231 - DNA, 22 bp, Homo sapiens
gtcttaggcacccggatgtggt

SEQ ID NO: 7232 - DNA, 22 bp, Homo sapiens
cctgtgcttggccagagaggtt

SEQ ID NO: 7233 - DNA, 22 bp, Homo sapiens
tgcacgtgtgagcattcacatg

SEQ ID NO: 7234 - DNA, 22 bp, Homo sapiens
ttggcagattctgaacaaagcc

SEQ ID NO: 7235 - DNA, 22 bp, Homo sapiens
acaggcttacaggctgcaagta

SEQ ID NO: 7236 - DNA, 22 bp, Homo sapiens
catgcctgtaatcccagcactt

SEQ ID NO: 7237 - DNA, 22 bp, Homo sapiens
gccccgcgcctggctccaggtg

SEQ ID NO: 7238 - DNA, 22 bp, Homo sapiens
agaacactgatagctgagggga

SEQ ID NO: 7239 - DNA, 22 bp, Homo sapiens
cattctctctacttgttttcaa

SEQ ID NO: 7240 - DNA, 22 bp, Homo sapiens
catctaagatactctctgtcac

SEQ ID NO: 7241 - DNA, 22 bp, Homo sapiens
gtgggccttcaaccctgtctgg

SEQ ID NO: 7242 - DNA, 22 bp, Homo sapiens
gtggttttattcgttcctctgt

SEQ ID NO: 7243 - DNA, 22 bp, Homo sapiens
cctgggcctctcaaagtgctgg

SEQ ID NO: 7244 - DNA, 22 bp, Homo sapiens
gactacaggtgtgtgccaccat

SEQ ID NO: 7245 - DNA, 22 bp, Homo sapiens
tcgtggatcaccgcgtctgtgt

SEQ ID NO: 7246 - DNA, 22 bp, Homo sapiens
tgagaactgcctgtatttatct

SEQ ID NO: 7247 - DNA, 22 bp, Homo sapiens
ggccatttgctttattcacttc

SEQ ID NO: 7248 - DNA, 22 bp, Homo sapiens
gaccctgtttctacaaataatt

SEQ ID NO: 7249 - DNA, 22 bp, Homo sapiens
tatttccttgagacggagtctc

SEQ ID NO: 7250 - DNA, 22 bp, Homo sapiens
gtccccgacgtttggcttgatg

SEQ ID NO: 7251 - DNA, 22 bp, Homo sapiens
ctgcactgacttccccggctgc

SEQ ID NO: 7252 - DNA, 22 bp, Homo sapiens
ccggcgccttcacggggcttag

SEQ ID NO: 7253 - DNA, 22 bp, Homo sapiens
gagcccaggcagaggttgcagt

SEQ ID NO: 7254 - DNA, 22 bp, Homo sapiens
ccctagtccacaggttcctgga

SEQ ID NO: 7255 - DNA, 22 bp, Homo sapiens
ggcctcacccatcggtgccttt

SEQ ID NO: 7256 - DNA, 22 bp, Homo sapiens
atctcctggtccacccgggcgg

SEQ ID NO: 7257 - DNA, 22 bp, Homo sapiens
tcgcttgaacccaggaagtgga

SEQ ID NO: 7258 - DNA, 22 bp, Homo sapiens
caattttcaattccttcagata

SEQ ID NO: 7259 - DNA, 22 bp, Homo sapiens
tcctgggatcaagtgatcctcc

SEQ ID NO: 7260 - DNA, 22 bp, Homo sapiens
aggtaaagacagtgaaagaggg

SEQ ID NO: 7261 - DNA, 22 bp, Homo sapiens
tcagtatcaatagcgtcacaat

SEQ ID NO: 7262 - DNA, 22 bp, Homo sapiens
gcaagacatgtctaaggtttaa

SEQ ID NO: 7263 - DNA, 22 bp, Homo sapiens
gcagttaaaaataaaccttcat

SEQ ID NO: 7264 - DNA, 22 bp, Homo sapiens
ttgcagatgaagaaactgaagc

SEQ ID NO: 7265 - DNA, 22 bp, Homo sapiens
tgttgatttgtgggctgcaaaa

SEQ ID NO: 7266 - DNA, 22 bp, Homo sapiens
ttcatatttctttaaggacttt

SEQ ID NO: 7267 - DNA, 22 bp, Homo sapiens
ggaagaaaggtggacaacaggt

SEQ ID NO: 7268 - DNA, 22 bp, Homo sapiens
atgagtatatgatatggtttgg

SEQ ID NO: 7269 - DNA, 22 bp, Homo sapiens
atcattatcctcctatttgcct

SEQ ID NO: 7270 - DNA, 22 bp, Homo sapiens
ttgatgtgtttccaggatttgt

SEQ ID NO: 7271 - DNA, 22 bp, Homo sapiens
ggtcccatgactgacacagcag

SEQ ID NO: 7272 - DNA, 22 bp, Homo sapiens
atgttatcatgtttgttatacg

SEQ ID NO: 7273 - DNA, 22 bp, Homo sapiens
aggaagttagtaaattatgtgc

SEQ ID NO: 7274 - DNA, 22 bp, Homo sapiens
tttgctttgtttaaaagtggta

SEQ ID NO: 7275 - DNA, 22 bp, Homo sapiens
atagggctgccatcacagaaga

SEQ ID NO: 7276 - DNA, 23 bp, Homo sapiens
tctgtgtctccacccaaatctca

SEQ ID NO: 7277 - DNA, 22 bp, Homo sapiens
gcagcaacgcggccctactgct

SEQ ID NO: 7278 - DNA, 22 bp, Homo sapiens
aggaggtctcactatgttgccc

SEQ ID NO: 7279 - DNA, 22 bp, Homo sapiens
tatcactacacctggctaatta

SEQ ID NO: 7280 - DNA, 23 bp, Homo sapiens
tactatggttattatccctctcc

SEQ ID NO: 7281 - DNA, 22 bp, Homo sapiens
gttgcagatgtggaactcgtgc

SEQ ID NO: 7282 - DNA, 22 bp, Homo sapiens
tcgcagaccgcggtgcacgtgg

SEQ ID NO: 7283 - DNA, 22 bp, Homo sapiens
gaaaggagagggttaaggagct

SEQ ID NO: 7284 - DNA, 22 bp, Homo sapiens
atctggctcccttggaatccgt

SEQ ID NO: 7285 - DNA, 22 bp, Homo sapiens
agctcactgcaacctccgcctc

SEQ ID NO: 7286 - DNA, 22 bp, Homo sapiens
gagcctcgtggcggccactgcg

SEQ ID NO: 7287 - DNA, 20 bp, Homo sapiens
cagcagtggatgagagtttt

SEQ ID NO: 7288 - DNA, 18 bp, Homo sapiens
tggttccttgaaggggca

SEQ ID NO: 7289 - DNA, 22 bp, Homo sapiens
agttattgagtgcagagcaggg

SEQ ID NO: 7290 - DNA, 20 bp, Homo sapiens
gggcaaggaaacagccccca

SEQ ID NO: 7291 - DNA, 22 bp, Homo sapiens
taggctgggaagaaagattctc

SEQ ID NO: 7292 - DNA, 22 bp, Homo sapiens
ttcctgcaggccatagagcctg

SEQ ID NO: 7293 - DNA, 22 bp, Homo sapiens
gtgctgtttgggagaaggttct

SEQ ID NO: 7294 - DNA, 22 bp, Homo sapiens
caggcactgtgctgagctctgc

SEQ ID NO: 7295 - DNA, 22 bp, Homo sapiens
agctggaagtgcatttctcact

SEQ ID NO: 7296 - DNA, 22 bp, Homo sapiens
tgaagtgtcatttacatttcta

SEQ ID NO: 7297 - DNA, 22 bp, Homo sapiens
caataagtgcttttgtttagca

SEQ ID NO: 7298 - DNA, 22 bp, Homo sapiens
agactgttgtgtgaagtagggt

SEQ ID NO: 7299 - DNA, 22 bp, Homo sapiens
gtgaaagcactgaacaaagtaa

SEQ ID NO: 7300 - DNA, 22 bp, Homo sapiens
tgtgtggattcatctcaaagag

SEQ ID NO: 7301 - DNA, 22 bp, Homo sapiens
attgggtacgattattttatgg

SEQ ID NO: 7302 - DNA, 22 bp, Homo sapiens
ggggcccctcggacacgtgcgg

SEQ ID NO: 7303 - DNA, 22 bp, Homo sapiens
ttgccaggctggagtgcagtgg

SEQ ID NO: 7304 - DNA, 22 bp, Homo sapiens
gaagaaggtggcccaggggtag

SEQ ID NO: 7305 - DNA, 22 bp, Homo sapiens
gtggattacaagacagttgaga

SEQ ID NO: 7306 - DNA, 23 bp, Homo sapiens
ccagtgattgcctggaaggaggt

SEQ ID NO: 7307 - DNA, 20 bp, Homo sapiens
ttgagcttttagtacagaca

SEQ ID NO: 7308 - DNA, 22 bp, Homo sapiens
ttgaagactaatttagataatg

SEQ ID NO: 7309 - DNA, 22 bp, Homo sapiens
gtactagagatgtgtgcgggta

SEQ ID NO: 7310 - DNA, 22 bp, Homo sapiens
ggctctgtgtctccacccaaat

SEQ ID NO: 7311 - DNA, 22 bp, Homo sapiens
agcctctcagagtgctgggatt

SEQ ID NO: 7312 - DNA, 22 bp, Homo sapiens
tcactgcaacctctgcctcccg

SEQ ID NO: 7313 - DNA, 22 bp, Homo sapiens
gatttggttgcaggaagtaatt

SEQ ID NO: 7314 - DNA, 22 bp, Homo sapiens
tggcatctttgtcccagaagct

SEQ ID NO: 7315 - DNA, 22 bp, Homo sapiens
atgtctgtttgctgagcccggc

SEQ ID NO: 7316 - DNA, 22 bp, Homo sapiens
ctgtgaagggacggatgctgct

SEQ ID NO: 7317 - DNA, 22 bp, Homo sapiens
cggctggtgtcgggcacagcaa

SEQ ID NO: 7318 - DNA, 22 bp, Homo sapiens
aagagggctcgatttggcaaaa

SEQ ID NO: 7319 - DNA, 22 bp, Homo sapiens
gcactccagcctgggtaacagc

SEQ ID NO: 7320 - DNA, 22 bp, Homo sapiens
caactccctgtggggtactggg

SEQ ID NO: 7321 - DNA, 22 bp, Homo sapiens
gttccagtatgattccacccat

SEQ ID NO: 7322 - DNA, 17 bp, Homo sapiens
ctggagcagacaaaagg

SEQ ID NO: 7323 - DNA, 22 bp, Homo sapiens
gtgtggctgaaatcaaggcagg

SEQ ID NO: 7324 - DNA, 22 bp, Homo sapiens
tgggggctttatgtaatgcaca

SEQ ID NO: 7325 - DNA, 22 bp, Homo sapiens
taaattgagattattagggtaa

SEQ ID NO: 7326 - DNA, 22 bp, Homo sapiens
gtcttgggacccgcactgtggg

SEQ ID NO: 7327 - DNA, 22 bp, Homo sapiens
ctcactgcaacctctgcctccc

SEQ ID NO: 7328 - DNA, 22 bp, Homo sapiens
tagaggctttcagcggtaggtc

SEQ ID NO: 7329 - DNA, 22 bp, Homo sapiens
aagccggctgggccgaggctgc

SEQ ID NO: 7330 - DNA, 19 bp, Homo sapiens
gactccaactttaagcatg

SEQ ID NO: 7331 - DNA, 22 bp, Homo sapiens
cgggaaggtggaggttgcagtg

SEQ ID NO: 7332 - DNA, 22 bp, Homo sapiens
tattgtgaatagtgccgcaata

SEQ ID NO: 7333 - DNA, 22 bp, Homo sapiens
ttgaagtgagaggggctggggt

SEQ ID NO: 7334 - DNA, 22 bp, Homo sapiens
tcgttagcctcgagatctttgt

SEQ ID NO: 7335 - DNA, 22 bp, Homo sapiens
gttccaggtggtcacagagctc

SEQ ID NO: 7336 - DNA, 22 bp, Homo sapiens
ttgagatggagtcttgctctct

SEQ ID NO: 7337 - DNA, 22 bp, Homo sapiens
ggcaatagttgtgggttcttta

SEQ ID NO: 7338 - DNA, 22 bp, Homo sapiens
gagacgtggcctttgcctgagc

SEQ ID NO: 7339 - DNA, 22 bp, Homo sapiens
tgtgcctagttctgtatttaca

SEQ ID NO: 7340 - DNA, 22 bp, Homo sapiens
tctgcgttgctcacgctgggag

SEQ ID NO: 7341 - DNA, 22 bp, Homo sapiens
ggttttcacctccagaatgtgc

SEQ ID NO: 7342 - DNA, 22 bp, Homo sapiens
gatgtgtttgtttctggaggag

SEQ ID NO: 7343 - DNA, 22 bp, Homo sapiens
atttaagggatttggagaccaa

SEQ ID NO: 7344 - DNA, 22 bp, Homo sapiens
tggtggcactgacatcagacac

SEQ ID NO: 7345 - DNA, 22 bp, Homo sapiens
gcaggtctgttgattacagtca

SEQ ID NO: 7346 - DNA, 22 bp, Homo sapiens
ttgactagaattatttaatcga

SEQ ID NO: 7347 - DNA, 22 bp, Homo sapiens
cgcagacactgagggtccgggg

SEQ ID NO: 7348 - DNA, 17 bp, Homo sapiens
gtaaggcttgcagatgc

SEQ ID NO: 7349 - DNA, 22 bp, Homo sapiens
accctggacatcttgtcatagc

SEQ ID NO: 7350 - DNA, 22 bp, Homo sapiens
aagaaatgctgatgttggatgg

SEQ ID NO: 7351 - DNA, 22 bp, Homo sapiens
gattgctaatgtggggatttgg

SEQ ID NO: 7352 - DNA, 22 bp, Homo sapiens
gctgcacagacttgctcattta

SEQ ID NO: 7353 - DNA, 22 bp, Homo sapiens
gaggtgctgctgtacttcttgc

SEQ ID NO: 7354 - DNA, 22 bp, Homo sapiens
gaagattgaaggctgggaatta

SEQ ID NO: 7355 - DNA, 22 bp, Homo sapiens
gaggcacagagtaggtgcacac

SEQ ID NO: 7356 - DNA, 22 bp, Homo sapiens
aaatcggttggttcaaggtaat

SEQ ID NO: 7357 - DNA, 22 bp, Homo sapiens
aggcttcaggtttgctttgcag

SEQ ID NO: 7358 - DNA, 22 bp, Homo sapiens
aatctcagctcatgcaattcca

SEQ ID NO: 7359 - DNA, 22 bp, Homo sapiens
tgctgggggtagctctgcgtag

SEQ ID NO: 7360 - DNA, 18 bp, Homo sapiens
tttctcagactctctttc

SEQ ID NO: 7361 - DNA, 22 bp, Homo sapiens
ggttcacagtaaggtttgtgct

SEQ ID NO: 7362 - DNA, 22 bp, Homo sapiens
ttattaggaactcaggattttt

SEQ ID NO: 7363 - DNA, 23 bp, Homo sapiens
ttggacaaggccagagccagcac

SEQ ID NO: 7364 - DNA, 22 bp, Homo sapiens
tgttaaggcagcaacggatgaa

SEQ ID NO: 7365 - DNA, 22 bp, Homo sapiens
cctagatgggatggcggccggg

SEQ ID NO: 7366 - DNA, 22 bp, Homo sapiens
tctcccctggtctcgcgcgctg

SEQ ID NO: 7367 - DNA, 22 bp, Homo sapiens
aaacatctactgtaggctggag

SEQ ID NO: 7368 - DNA, 23 bp, Homo sapiens
tagatgtattaagtgcattttca

SEQ ID NO: 7369 - DNA, 22 bp, Homo sapiens
agagcgcactgtctgcaggcaa

SEQ ID NO: 7370 - DNA, 22 bp, Homo sapiens
cactgcaacctccacctcctgg

SEQ ID NO: 7371 - DNA, 22 bp, Homo sapiens
ctggtagctcctgaatatccct

SEQ ID NO: 7372 - DNA, 22 bp, Homo sapiens
ttattgcttatgattaggtgtt

SEQ ID NO: 7373 - DNA, 22 bp, Homo sapiens
tcttccagatggttctttagct

SEQ ID NO: 7374 - DNA, 22 bp, Homo sapiens
tggccggccacctccagggttg

SEQ ID NO: 7375 - DNA, 22 bp, Homo sapiens
tgatctggtcctactgtgggca

SEQ ID NO: 7376 - DNA, 22 bp, Homo sapiens
tggagataggctgaggcagggc

SEQ ID NO: 7377 - DNA, 22 bp, Homo sapiens
ggcaaggggtcaggctgagaca

SEQ ID NO: 7378 - DNA, 22 bp, Homo sapiens
atgcctgtaatcccagcacttt

SEQ ID NO: 7379 - DNA, 22 bp, Homo sapiens
ggcatcttgttgctcaaatcta

SEQ ID NO: 7380 - DNA, 22 bp, Homo sapiens
gatcctggagctccatcactat

SEQ ID NO: 7381 - DNA, 22 bp, Homo sapiens
aggaatgacaggcctcccgcag

SEQ ID NO: 7382 - DNA, 22 bp, Homo sapiens
tcattgagttgcacttttacta

SEQ ID NO: 7383 - DNA, 22 bp, Homo sapiens
ttatggttcaggtgagggtgta

SEQ ID NO: 7384 - DNA, 22 bp, Homo sapiens
cagaagatctcttagtggaggg

SEQ ID NO: 7385 - DNA, 22 bp, Homo sapiens
ccaagtagttgagactacaggt

SEQ ID NO: 7386 - DNA, 22 bp, Homo sapiens
tcttgggcaatttctctagagg

SEQ ID NO: 7387 - DNA, 22 bp, Homo sapiens
tctgactcccatattccacttc

SEQ ID NO: 7388 - DNA, 22 bp, Homo sapiens
gtgtggtcgaagttctcccgga

SEQ ID NO: 7389 - DNA, 22 bp, Homo sapiens
caaatcctcacctcatcatgaa

SEQ ID NO: 7390 - DNA, 22 bp, Homo sapiens
attgataaattgcaatggggct

SEQ ID NO: 7391 - DNA, 22 bp, Homo sapiens
ccagaagcagagcctgaggcag

SEQ ID NO: 7392 - DNA, 22 bp, Homo sapiens
cccggacagaggggcagagtgt

SEQ ID NO: 7393 - DNA, 22 bp, Homo sapiens
taacaatacccattctaattac

SEQ ID NO: 7394 - DNA, 22 bp, Homo sapiens
ctcactgcaagttccacctacc

SEQ ID NO: 7395 - DNA, 22 bp, Homo sapiens
gattcactcatattttacgttt

SEQ ID NO: 7396 - DNA, 22 bp, Homo sapiens
aaaggacacacaggaggtgtct

SEQ ID NO: 7397 - DNA, 22 bp, Homo sapiens
ctggcccaggtggtcgttgagg

SEQ ID NO: 7398 - DNA, 22 bp, Homo sapiens
gtcctgtgagattcatgctcaa

SEQ ID NO: 7399 - DNA, 18 bp, Homo sapiens
gctttctatgcgacagta

SEQ ID NO: 7400 - DNA, 22 bp, Homo sapiens
tgtaggacatgtacttgtaaca

SEQ ID NO: 7401 - DNA, 20 bp, Homo sapiens
agcaactctcacctggctgc

SEQ ID NO: 7402 - DNA, 22 bp, Homo sapiens
catgcctgcctggtgggcgtgg

SEQ ID NO: 7403 - DNA, 22 bp, Homo sapiens
gcaaatgctaaagtgtagagac

SEQ ID NO: 7404 - DNA, 22 bp, Homo sapiens
cggccaagccggggccccgaag

SEQ ID NO: 7405 - DNA, 22 bp, Homo sapiens
acctggccaatttttgtatttt

SEQ ID NO: 7406 - DNA, 22 bp, Homo sapiens
catcatcaaaagtgacagagaa

SEQ ID NO: 7407 - DNA, 22 bp, Homo sapiens
caaagcccagaggcctcacttt

SEQ ID NO: 7408 - DNA, 22 bp, Homo sapiens
gaagctgagctgaggcatgttg

SEQ ID NO: 7409 - DNA, 22 bp, Homo sapiens
tgtgagcagagacatgaaaagc

SEQ ID NO: 7410 - DNA, 22 bp, Homo sapiens
agcctattccaggatgagctca

SEQ ID NO: 7411 - DNA, 22 bp, Homo sapiens
aagacactcattatcactggtt

SEQ ID NO: 7412 - DNA, 22 bp, Homo sapiens
tctgttttgcataatgttcttt

SEQ ID NO: 7413 - DNA, 22 bp, Homo sapiens
tgcagtggtacaatttcggctc

SEQ ID NO: 7414 - DNA, 22 bp, Homo sapiens
agacggaatttcatcatgttag

SEQ ID NO: 7415 - DNA, 22 bp, Homo sapiens
tgccctctttctgtacagctcc

SEQ ID NO: 7416 - DNA, 20 bp, Homo sapiens
ataaaataactgccacaaga

SEQ ID NO: 7417 - DNA, 22 bp, Homo sapiens
cctggcaggtggcgccctcggc

SEQ ID NO: 7418 - DNA, 22 bp, Homo sapiens
tcagaacatgtttgagtaagac

SEQ ID NO: 7419 - DNA, 22 bp, Homo sapiens
aaaccgcaattacttttgcgtc

SEQ ID NO: 7420 - DNA, 22 bp, Homo sapiens
ataatggaggaagctatgtgga

SEQ ID NO: 7421 - DNA, 22 bp, Homo sapiens
tggttttagggaatcaatctat

SEQ ID NO: 7422 - DNA, 22 bp, Homo sapiens
tggcaacttgcaacctcattct

SEQ ID NO: 7423 - DNA, 22 bp, Homo sapiens
gtgattttctcctcctagaagt

SEQ ID NO: 7424 - DNA, 20 bp, Homo sapiens
tgcctataaagggccaggta

SEQ ID NO: 7425 - DNA, 22 bp, Homo sapiens
tgtggcacatacacaggagggc

SEQ ID NO: 7426 - DNA, 23 bp, Homo sapiens
actcgtggaattctctgcgatcg

SEQ ID NO: 7427 - DNA, 22 bp, Homo sapiens
ttcccagtcaaacgaaggactt

SEQ ID NO: 7428 - DNA, 22 bp, Homo sapiens
ttgttgagatgtgtctctcaat

SEQ ID NO: 7429 - DNA, 22 bp, Homo sapiens
cagggggctcaaaggagagtgc

SEQ ID NO: 7430 - DNA, 22 bp, Homo sapiens
cttggattcctcatatgcacag

SEQ ID NO: 7431 - DNA, 22 bp, Homo sapiens
agccatttcaacaaccggctgc

SEQ ID NO: 7432 - DNA, 22 bp, Homo sapiens
gaggcagtccagtgggtaagaa

SEQ ID NO: 7433 - DNA, 22 bp, Homo sapiens
ggaacttaataagttttgtaat

SEQ ID NO: 7434 - DNA, 23 bp, Homo sapiens
agcttttaggtggaaatggcact

SEQ ID NO: 7435 - DNA, 22 bp, Homo sapiens
ctctgtagaaagagcccaggtg

SEQ ID NO: 7436 - DNA, 22 bp, Homo sapiens
ttgatcatttttctggtaaaat

SEQ ID NO: 7437 - DNA, 22 bp, Homo sapiens
tctcattcttcagtggctttgt

SEQ ID NO: 7438 - DNA, 22 bp, Homo sapiens
tccggcggccggcctgagcccg

SEQ ID NO: 7439 - DNA, 17 bp, Homo sapiens
ttcttttctgagccttg

SEQ ID NO: 7440 - DNA, 22 bp, Homo sapiens
agatttctgggcttcaccacct

SEQ ID NO: 7441 - DNA, 22 bp, Homo sapiens
cctacagttatattcttgattg

SEQ ID NO: 7442 - DNA, 22 bp, Homo sapiens
gacgagagactccatccaccac

SEQ ID NO: 7443 - DNA, 22 bp, Homo sapiens
ttgagatggagtctcactctgt

SEQ ID NO: 7444 - DNA, 22 bp, Homo sapiens
ggcggaggttgcagtaagccga

SEQ ID NO: 7445 - DNA, 19 bp, Homo sapiens
taaaacgtgcatggcagca

SEQ ID NO: 7446 - DNA, 22 bp, Homo sapiens
ggcccacggcggcccgggcgtc

SEQ ID NO: 7447 - DNA, 22 bp, Homo sapiens
ctggaggtgcttcgctggccac

SEQ ID NO: 7448 - DNA, 17 bp, Homo sapiens
gcccgtgggctacggta

SEQ ID NO: 7449 - DNA, 22 bp, Homo sapiens
ttaggcctttgattggggtgct

SEQ ID NO: 7450 - DNA, 22 bp, Homo sapiens
ttcccttaaattatggcatcta

SEQ ID NO: 7451 - DNA, 22 bp, Homo sapiens
agtttgggtggaacagagtcgt

SEQ ID NO: 7452 - DNA, 22 bp, Homo sapiens
tgataggtcctcgggcactgga

SEQ ID NO: 7453 - DNA, 22 bp, Homo sapiens
cccatttcttgagttcagctct

SEQ ID NO: 7454 - DNA, 22 bp, Homo sapiens
gaggggagcccccatcctccag

SEQ ID NO: 7455 - DNA, 22 bp, Homo sapiens
ttctccctgtcctatcaagact

SEQ ID NO: 7456 - DNA, 22 bp, Homo sapiens
attaattagagaggtgcctgtt

SEQ ID NO: 7457 - DNA, 22 bp, Homo sapiens
tgaaatgttaaacaagtggctc

SEQ ID NO: 7458 - DNA, 19 bp, Homo sapiens
gggcaaagtgatcgtcctg

SEQ ID NO: 7459 - DNA, 22 bp, Homo sapiens
tcattccctcattgttcactgg

SEQ ID NO: 7460 - DNA, 22 bp, Homo sapiens
aagtgctgggattacaggtgtc

SEQ ID NO: 7461 - DNA, 22 bp, Homo sapiens
ctgaccaacatggtgaaacctt

SEQ ID NO: 7462 - DNA, 22 bp, Homo sapiens
aggaatgacatagaaaggggag

SEQ ID NO: 7463 - DNA, 22 bp, Homo sapiens
gggggcttggcccggtctggtt

SEQ ID NO: 7464 - DNA, 22 bp, Homo sapiens
aggggtgaaagagggccctcaa

SEQ ID NO: 7465 - DNA, 22 bp, Homo sapiens
atggactgggaggtcatcttct

SEQ ID NO: 7466 - DNA, 22 bp, Homo sapiens
taaagctctgggtttctagatc

SEQ ID NO: 7467 - DNA, 22 bp, Homo sapiens
ggagaccagaaggaagcttcga

SEQ ID NO: 7468 - DNA, 22 bp, Homo sapiens
agtgtattctgcatgggagact

SEQ ID NO: 7469 - DNA, 22 bp, Homo sapiens
catacccatttgtttcaggagc

SEQ ID NO: 7470 - DNA, 21 bp, Homo sapiens
cagggccaatcctgacctcta

SEQ ID NO: 7471 - DNA, 22 bp, Homo sapiens
gagctcatccccatggtccgtc

SEQ ID NO: 7472 - DNA, 22 bp, Homo sapiens
cacagctgtgagaagggagcct

SEQ ID NO: 7473 - DNA, 22 bp, Homo sapiens
cctgagtagctggaattaaagg

SEQ ID NO: 7474 - DNA, 22 bp, Homo sapiens
aatgaattgcagtactgacttg

SEQ ID NO: 7475 - DNA, 23 bp, Homo sapiens
ctgaatgcgacatttctctccac

SEQ ID NO: 7476 - DNA, 22 bp, Homo sapiens
ggtgccaggctgtagtcagggt

SEQ ID NO: 7477 - DNA, 19 bp, Homo sapiens
aaggctgtttctccctcag

SEQ ID NO: 7478 - DNA, 22 bp, Homo sapiens
tgcaaagttgaggaaggcatgg

SEQ ID NO: 7479 - DNA, 22 bp, Homo sapiens
gcagatgtgtcctggagggagg

SEQ ID NO: 7480 - DNA, 22 bp, Homo sapiens
gcctggattccttgtttctcag

SEQ ID NO: 7481 - DNA, 22 bp, Homo sapiens
gcgagtccactggggggcgcag

SEQ ID NO: 7482 - DNA, 22 bp, Homo sapiens
aaaacctcagttctgctcttaa

SEQ ID NO: 7483 - DNA, 22 bp, Homo sapiens
tgggaagaggggtataaagaag

SEQ ID NO: 7484 - DNA, 19 bp, Homo sapiens
acccagcccaggagtggca

SEQ ID NO: 7485 - DNA, 22 bp, Homo sapiens
ggagagcttggagtgcgatttt

SEQ ID NO: 7486 - DNA, 22 bp, Homo sapiens
tttggcggggcaattctgaagc

SEQ ID NO: 7487 - DNA, 22 bp, Homo sapiens
tttgtcctaacagtggtaaagg

SEQ ID NO: 7488 - DNA, 22 bp, Homo sapiens
tctgatctgtcagtcatgaagg

SEQ ID NO: 7489 - DNA, 22 bp, Homo sapiens
cttatagtatgatgttgagaat

SEQ ID NO: 7490 - DNA, 22 bp, Homo sapiens
gtgtatgttctacttaatatta

SEQ ID NO: 7491 - DNA, 22 bp, Homo sapiens
ttccacattccttacattcata

SEQ ID NO: 7492 - DNA, 22 bp, Homo sapiens
ggatgttctggggttctcttgt

SEQ ID NO: 7493 - DNA, 22 bp, Homo sapiens
gagaatgtttctgtctgccctt

SEQ ID NO: 7494 - DNA, 22 bp, Homo sapiens
gtgaggtggtacaatattaact

SEQ ID NO: 7495 - DNA, 22 bp, Homo sapiens
catctcccacttccttgggggt

SEQ ID NO: 7496 - DNA, 22 bp, Homo sapiens
caggatatttacgttctgctac

SEQ ID NO: 7497 - DNA, 22 bp, Homo sapiens
tgagatcatgtgtggaccccag

SEQ ID NO: 7498 - DNA, 22 bp, Homo sapiens
gggggtttctgggctgagcaga

SEQ ID NO: 7499 - DNA, 22 bp, Homo sapiens
ttgtgctcctatgagaatctaa

SEQ ID NO: 7500 - DNA, 22 bp, Homo sapiens
ctcctgaattgtccctcacagc

SEQ ID NO: 7501 - DNA, 22 bp, Homo sapiens
aagggaatgttgtggttggttt

SEQ ID NO: 7502 - DNA, 22 bp, Homo sapiens
acaggtgcatgctaccatgtct

SEQ ID NO: 7503 - DNA, 22 bp, Homo sapiens
aatggccagacagatggctgct

SEQ ID NO: 7504 - DNA, 22 bp, Homo sapiens
tgcaatgatattgtcaaagcat

SEQ ID NO: 7505 - DNA, 22 bp, Homo sapiens
ctgctcttgagggactgcggtc

SEQ ID NO: 7506 - DNA, 22 bp, Homo sapiens
cattgctttgtgcatatttaaa

SEQ ID NO: 7507 - DNA, 22 bp, Homo sapiens
aatgtattcttcaaccttgcta

SEQ ID NO: 7508 - DNA, 22 bp, Homo sapiens
aaggctccagtgaatgctggca

SEQ ID NO: 7509 - DNA, 22 bp, Homo sapiens
gtagtctgaacagtaattttgt

SEQ ID NO: 7510 - DNA, 22 bp, Homo sapiens
caaagtgctgggattacaggtg

SEQ ID NO: 7511 - DNA, 22 bp, Homo sapiens
ggcgccaggcttcactttaaag

SEQ ID NO: 7512 - DNA, 22 bp, Homo sapiens
gaacttgcagctgtgatttgtg

SEQ ID NO: 7513 - DNA, 19 bp, Homo sapiens
catggtgaaaccccgtctc

SEQ ID NO: 7514 - DNA, 22 bp, Homo sapiens
gatgaatgatggcttgtttctg

SEQ ID NO: 7515 - DNA, 22 bp, Homo sapiens
tcccttatctggtattttttag

SEQ ID NO: 7516 - DNA, 22 bp, Homo sapiens
ggcaagaaccacaattactttt

SEQ ID NO: 7517 - DNA, 22 bp, Homo sapiens
agctttggcatctgactagccg

SEQ ID NO: 7518 - DNA, 20 bp, Homo sapiens
aggggcacctgcgacggggc

SEQ ID NO: 7519 - DNA, 20 bp, Homo sapiens
acgcacacgcgggggcgtgc

SEQ ID NO: 7520 - DNA, 22 bp, Homo sapiens
ttgtatgtggcaaatgggggag

SEQ ID NO: 7521 - DNA, 22 bp, Homo sapiens
catccaggctggagtacagtgg

SEQ ID NO: 7522 - DNA, 22 bp, Homo sapiens
acagagcaataacagggagagg

SEQ ID NO: 7523 - DNA, 22 bp, Homo sapiens
ttggccatctaagcccagccac

SEQ ID NO: 7524 - DNA, 21 bp, Homo sapiens
ggccgccgccttgtgctctgc

SEQ ID NO: 7525 - DNA, 22 bp, Homo sapiens
tgctgagcgcatccggcggccg

SEQ ID NO: 7526 - DNA, 22 bp, Homo sapiens
cgggagcctctgggtcacactg

SEQ ID NO: 7527 - DNA, 22 bp, Homo sapiens
agtgtttgagtttgcggcattg

SEQ ID NO: 7528 - DNA, 22 bp, Homo sapiens
ggcttcagtggccagagatgat

SEQ ID NO: 7529 - DNA, 22 bp, Homo sapiens
gacgccgtgtcccggcactctt

SEQ ID NO: 7530 - DNA, 22 bp, Homo sapiens
tcactgtagcctcaactcttgg

SEQ ID NO: 7531 - DNA, 22 bp, Homo sapiens
ccactgtgcccagcctcatggg

SEQ ID NO: 7532 - DNA, 22 bp, Homo sapiens
tgcagcactgttcacaatagcc

SEQ ID NO: 7533 - DNA, 22 bp, Homo sapiens
agagattcctttggggaaagca

SEQ ID NO: 7534 - DNA, 22 bp, Homo sapiens
gcggcctgcgctgctcccgacg

SEQ ID NO: 7535 - DNA, 22 bp, Homo sapiens
ctccggccgcggtgcccagcgc

SEQ ID NO: 7536 - DNA, 22 bp, Homo sapiens
cccaggaggcagagatagcagt

SEQ ID NO: 7537 - DNA, 22 bp, Homo sapiens
ttacatgtggtgtgaagaagag

SEQ ID NO: 7538 - DNA, 22 bp, Homo sapiens
aggagatggagctcagtgggca

SEQ ID NO: 7539 - DNA, 22 bp, Homo sapiens
atgaatgccacgatttcatcct

SEQ ID NO: 7540 - DNA, 20 bp, Homo sapiens
ggccggggagctctccaggg

SEQ ID NO: 7541 - DNA, 22 bp, Homo sapiens
acaagtattggtgaggatgtag

SEQ ID NO: 7542 - DNA, 22 bp, Homo sapiens
gaagatacaaatttcttagatg

SEQ ID NO: 7543 - DNA, 22 bp, Homo sapiens
gcgtggcttagagtggggtacc

SEQ ID NO: 7544 - DNA, 21 bp, Homo sapiens
tgaaggtgttcatgatgcggt

SEQ ID NO: 7545 - DNA, 22 bp, Homo sapiens
ggactgctgtttacctggcttt

SEQ ID NO: 7546 - DNA, 22 bp, Homo sapiens
ctccacagctgtaaatataggg

SEQ ID NO: 7547 - DNA, 22 bp, Homo sapiens
ggatattaatctgtgtcatttc

SEQ ID NO: 7548 - DNA, 22 bp, Homo sapiens
atcttgccagtctccaaatcaa

SEQ ID NO: 7549 - DNA, 22 bp, Homo sapiens
gctcactgcctgggcaacaaga

SEQ ID NO: 7550 - DNA, 22 bp, Homo sapiens
gggctgactcctattggatgaa

SEQ ID NO: 7551 - DNA, 17 bp, Homo sapiens
gggcagggactcctggg

SEQ ID NO: 7552 - DNA, 22 bp, Homo sapiens
cgcaccactgaattccagcctg

SEQ ID NO: 7553 - DNA, 22 bp, Homo sapiens
tctctttgcctgctgccatcca

SEQ ID NO: 7554 - DNA, 22 bp, Homo sapiens
gctctagtaggaatgtccctct

SEQ ID NO: 7555 - DNA, 22 bp, Homo sapiens
aacagcgacgtcctccccaaca

SEQ ID NO: 7556 - DNA, 22 bp, Homo sapiens
gtctgctcatgctaccgcgggc

SEQ ID NO: 7557 - DNA, 22 bp, Homo sapiens
agctcaatgcaacctccgcctc

SEQ ID NO: 7558 - DNA, 22 bp, Homo sapiens
ctgcatgtttacatttttgaga

SEQ ID NO: 7559 - DNA, 22 bp, Homo sapiens
aaattgattaaagtccgtgctt

SEQ ID NO: 7560 - DNA, 22 bp, Homo sapiens
tgtggtgccgagagtctggacg

SEQ ID NO: 7561 - DNA, 22 bp, Homo sapiens
tttgctattgtgaatagtgcca

SEQ ID NO: 7562 - DNA, 22 bp, Homo sapiens
tggattccacgcctgctcctgt

SEQ ID NO: 7563 - DNA, 22 bp, Homo sapiens
cgacgggctcggtccgcttcct

SEQ ID NO: 7564 - DNA, 21 bp, Homo sapiens
cctggttcaagtgatgcccct

SEQ ID NO: 7565 - DNA, 22 bp, Homo sapiens
tatgggcatataaagaagtatg

SEQ ID NO: 7566 - DNA, 22 bp, Homo sapiens
cacctgtacagggccgggctgg

SEQ ID NO: 7567 - DNA, 22 bp, Homo sapiens
cgccgcctgctgcagcagctgt

SEQ ID NO: 7568 - DNA, 22 bp, Homo sapiens
ttgcttctcagggcctgatgca

SEQ ID NO: 7569 - DNA, 22 bp, Homo sapiens
tgggagcggcccgggccacacg

SEQ ID NO: 7570 - DNA, 22 bp, Homo sapiens
gagtccctgctgtcaggtgctg

SEQ ID NO: 7571 - DNA, 19 bp, Homo sapiens
caccaagatggctctagtc

SEQ ID NO: 7572 - DNA, 22 bp, Homo sapiens
acatttttcacatttgtagggt

SEQ ID NO: 7573 - DNA, 22 bp, Homo sapiens
tccaaggtcagcgagagtcact

SEQ ID NO: 7574 - DNA, 22 bp, Homo sapiens
ttgtgctgtgagaatgctcatt

SEQ ID NO: 7575 - DNA, 22 bp, Homo sapiens
cccgggaggcggaggttgcagt

SEQ ID NO: 7576 - DNA, 22 bp, Homo sapiens
actgggcagcagctcgagccgc

SEQ ID NO: 7577 - DNA, 23 bp, Homo sapiens
atgtttgcagtaacccatcctgg

SEQ ID NO: 7578 - DNA, 22 bp, Homo sapiens
tgaggcaggagaatcacatgaa

SEQ ID NO: 7579 - DNA, 22 bp, Homo sapiens
gctggccacagatccccaggga

SEQ ID NO: 7580 - DNA, 22 bp, Homo sapiens
ttcttctcagggtcccacatgg

SEQ ID NO: 7581 - DNA, 22 bp, Homo sapiens
gctggggaggcagcagagaaca

SEQ ID NO: 7582 - DNA, 22 bp, Homo sapiens
cccgttgccttctgggagttgt

SEQ ID NO: 7583 - DNA, 22 bp, Homo sapiens
ggagagcagggaggctgctctg

SEQ ID NO: 7584 - DNA, 22 bp, Homo sapiens
tgccttgtccttcgtcagggct

SEQ ID NO: 7585 - DNA, 22 bp, Homo sapiens
tgctgctcagaacccctgggct

SEQ ID NO: 7586 - DNA, 22 bp, Homo sapiens
ttctgccttggcagggtggtcc

SEQ ID NO: 7587 - DNA, 22 bp, Homo sapiens
aaagtgcttccttttagaggct

SEQ ID NO: 7588 - DNA, 22 bp, Homo sapiens
ctgtcaggttggtctcagagct

SEQ ID NO: 7589 - DNA, 22 bp, Homo sapiens
tggaacaagggcgtggcggtcg

SEQ ID NO: 7590 - DNA, 22 bp, Homo sapiens
ccagaggtgctctttggaagtg

SEQ ID NO: 7591 - DNA, 22 bp, Homo sapiens
agcccaggctggagtgcagtgg

SEQ ID NO: 7592 - DNA, 22 bp, Homo sapiens
ctcctctttagccccagctgga

SEQ ID NO: 7593 - DNA, 22 bp, Homo sapiens
ggtgtccacattccctggcagg

SEQ ID NO: 7594 - DNA, 22 bp, Homo sapiens
gcaaaaagtagtgctggttagg

SEQ ID NO: 7595 - DNA, 22 bp, Homo sapiens
ctgctttaaaactgatacatga

SEQ ID NO: 7596 - DNA, 22 bp, Homo sapiens
cgtaggtggctcagcacctggg

SEQ ID NO: 7597 - DNA, 22 bp, Homo sapiens
ggcttgaagggaggaaagcagg

SEQ ID NO: 7598 - DNA, 22 bp, Homo sapiens
ggattgtgataattgttgcaaa

SEQ ID NO: 7599 - DNA, 22 bp, Homo sapiens
gcagtgagttatgatcatgcca

SEQ ID NO: 7600 - DNA, 22 bp, Homo sapiens
caaagtgggtgccctgatgctc

SEQ ID NO: 7601 - DNA, 22 bp, Homo sapiens
aggtcacatacaaatgctcctt

SEQ ID NO: 7602 - DNA, 22 bp, Homo sapiens
ggctgggcaggtctgcacaggg

SEQ ID NO: 7603 - DNA, 22 bp, Homo sapiens
gaggtcctctcggaaccccttt

SEQ ID NO: 7604 - DNA, 22 bp, Homo sapiens
aagtccattaggcccctgcctg

SEQ ID NO: 7605 - DNA, 22 bp, Homo sapiens
cagggatggcgctggctgcccg

SEQ ID NO: 7606 - DNA, 22 bp, Homo sapiens
gccaggtatgaattacgcacga

SEQ ID NO: 7607 - DNA, 22 bp, Homo sapiens
gggtccagtagttggtggccgt

SEQ ID NO: 7608 - DNA, 18 bp, Homo sapiens
tccaccgcgtgcacctct

SEQ ID NO: 7609 - DNA, 22 bp, Homo sapiens
tgatgggaggtgctgcaggacc

SEQ ID NO: 7610 - DNA, 22 bp, Homo sapiens
tatctaataaatctgataagta

SEQ ID NO: 7611 - DNA, 22 bp, Homo sapiens
tggctacctgatttcttttcag

SEQ ID NO: 7612 - DNA, 22 bp, Homo sapiens
tgactggattgtcattacgacg

SEQ ID NO: 7613 - DNA, 22 bp, Homo sapiens
ctgtcaggtttcccggctcacg

SEQ ID NO: 7614 - DNA, 22 bp, Homo sapiens
cccgggaggaggaagttgcagt

SEQ ID NO: 7615 - DNA, 22 bp, Homo sapiens
atcagagtgtaagttctttcct

SEQ ID NO: 7616 - DNA, 22 bp, Homo sapiens
actgcattctttatcccacaac

SEQ ID NO: 7617 - DNA, 22 bp, Homo sapiens
tgccacctgtacatgctatctg

SEQ ID NO: 7618 - DNA, 22 bp, Homo sapiens
cgtgtgttgaaagatgtacatc

SEQ ID NO: 7619 - DNA, 22 bp, Homo sapiens
acctctgtacctcctctgacag

SEQ ID NO: 7620 - DNA, 22 bp, Homo sapiens
agcactgatttaaactggattt

SEQ ID NO: 7621 - DNA, 22 bp, Homo sapiens
ggtcactttaccccttggagcc

SEQ ID NO: 7622 - DNA, 23 bp, Homo sapiens
cccagaccttgtgctgcccttgg

SEQ ID NO: 7623 - DNA, 22 bp, Homo sapiens
ggagagtggattccagctgtat

SEQ ID NO: 7624 - DNA, 22 bp, Homo sapiens
gctactgattgaccttggagag

SEQ ID NO: 7625 - DNA, 22 bp, Homo sapiens
cttctttcaagaatggattagg

SEQ ID NO: 7626 - DNA, 22 bp, Homo sapiens
tgtgctcagtctttggctggga

SEQ ID NO: 7627 - DNA, 22 bp, Homo sapiens
tggagaagattggtcaccattc

SEQ ID NO: 7628 - DNA, 22 bp, Homo sapiens
ggggtgcgggccccatctggct

SEQ ID NO: 7629 - DNA, 22 bp, Homo sapiens
cagccccacacggtctagctct

SEQ ID NO: 7630 - DNA, 22 bp, Homo sapiens
tacagaagcttttgaaaagatg

SEQ ID NO: 7631 - DNA, 22 bp, Homo sapiens
gtttcactgcaaactgactttt

SEQ ID NO: 7632 - DNA, 22 bp, Homo sapiens
tagatagattctcctatagagt

SEQ ID NO: 7633 - DNA, 22 bp, Homo sapiens
atgccacttcattccagcctcg

SEQ ID NO: 7634 - DNA, 23 bp, Homo sapiens
ttgcagaagcagacgaccataat

SEQ ID NO: 7635 - DNA, 22 bp, Homo sapiens
agatggggtttcatcatgttgg

SEQ ID NO: 7636 - DNA, 22 bp, Homo sapiens
gtggtgtttgagctgccaggga

SEQ ID NO: 7637 - DNA, 22 bp, Homo sapiens
tgcttgaacccaggaagtggag

SEQ ID NO: 7638 - DNA, 22 bp, Homo sapiens
gcgctctcttctcctggcccgc

SEQ ID NO: 7639 - DNA, 22 bp, Homo sapiens
taggtttcagaggtgccgggaa

SEQ ID NO: 7640 - DNA, 22 bp, Homo sapiens
gaacgggtgcagccatgggccc

SEQ ID NO: 7641 - DNA, 22 bp, Homo sapiens
aatttaagaacatttcaggact

SEQ ID NO: 7642 - DNA, 22 bp, Homo sapiens
caaagcaggaagctcctgacag

SEQ ID NO: 7643 - DNA, 20 bp, Homo sapiens
gggaagtcccgcctgtcttc

SEQ ID NO: 7644 - DNA, 22 bp, Homo sapiens
tatgacagtttcgtaggggttg

SEQ ID NO: 7645 - DNA, 22 bp, Homo sapiens
aggaactccacggtcttgtcgg

SEQ ID NO: 7646 - DNA, 22 bp, Homo sapiens
ttttatctgtgacatctggcag

SEQ ID NO: 7647 - DNA, 22 bp, Homo sapiens
tacaacaatttccacattagaa

SEQ ID NO: 7648 - DNA, 18 bp, Homo sapiens
ccgggctttggtgacaca

SEQ ID NO: 7649 - DNA, 22 bp, Homo sapiens
gctttgcccctttagtgggtgc

SEQ ID NO: 7650 - DNA, 22 bp, Homo sapiens
tttgagctgggaggctgaagga

SEQ ID NO: 7651 - DNA, 22 bp, Homo sapiens
agtcaaagatgaccgagttcct

SEQ ID NO: 7652 - DNA, 22 bp, Homo sapiens
aatgcaccttggcagggattca

SEQ ID NO: 7653 - DNA, 22 bp, Homo sapiens
acattcccaccaacagtgtaaa

SEQ ID NO: 7654 - DNA, 22 bp, Homo sapiens
ccaggagctggagggtgcagtg

SEQ ID NO: 7655 - DNA, 22 bp, Homo sapiens
caggaacagggtgtcctggcag

SEQ ID NO: 7656 - DNA, 22 bp, Homo sapiens
aaatttgtattccttttccgta

SEQ ID NO: 7657 - DNA, 18 bp, Homo sapiens
tgtagagccaggtttgcc

SEQ ID NO: 7658 - DNA, 22 bp, Homo sapiens
atgtgcacggtgtcaaacgggg

SEQ ID NO: 7659 - DNA, 22 bp, Homo sapiens
gtacagaggttgctggaggctc

SEQ ID NO: 7660 - DNA, 22 bp, Homo sapiens
gagatacttaagatggggctcc

SEQ ID NO: 7661 - DNA, 22 bp, Homo sapiens
aacactgctgctgggttctgtg

SEQ ID NO: 7662 - DNA, 21 bp, Homo sapiens
atctcgggcttctcgcccagc

SEQ ID NO: 7663 - DNA, 22 bp, Homo sapiens
atcctcagagaacgaacacaat

SEQ ID NO: 7664 - DNA, 22 bp, Homo sapiens
agtggttttgaaagaggaagac

SEQ ID NO: 7665 - DNA, 22 bp, Homo sapiens
tctgaggctgaatggactccgt

SEQ ID NO: 7666 - DNA, 22 bp, Homo sapiens
cttcccgcagccctagcgctct

SEQ ID NO: 7667 - DNA, 22 bp, Homo sapiens
agggggctccttggtgtgcaga

SEQ ID NO: 7668 - DNA, 19 bp, Homo sapiens
aaaggtagtaacctctgat

SEQ ID NO: 7669 - DNA, 22 bp, Homo sapiens
tattccatttgggtcaggatga

SEQ ID NO: 7670 - DNA, 22 bp, Homo sapiens
ttacatgtttatgggggtacat

SEQ ID NO: 7671 - DNA, 22 bp, Homo sapiens
acaaagccagattctggagcac

SEQ ID NO: 7672 - DNA, 22 bp, Homo sapiens
tcccagagctctggaggttgga

SEQ ID NO: 7673 - DNA, 22 bp, Homo sapiens
cacaaaccttctgcagcctgta

SEQ ID NO: 7674 - DNA, 22 bp, Homo sapiens
tgatgcaattagattgtaattt

SEQ ID NO: 7675 - DNA, 22 bp, Homo sapiens
taatcctgtcttgaccatcagg

SEQ ID NO: 7676 - DNA, 22 bp, Homo sapiens
ttttgagatggtgtctcgctcc

SEQ ID NO: 7677 - DNA, 22 bp, Homo sapiens
gcctcctgagtagctgggattg

SEQ ID NO: 7678 - DNA, 22 bp, Homo sapiens
ctttaattgtagctcccataat

SEQ ID NO: 7679 - DNA, 22 bp, Homo sapiens
tgagcccagagatctgagctat

SEQ ID NO: 7680 - DNA, 22 bp, Homo sapiens
gagtggggggtccgtctcagtg

SEQ ID NO: 7681 - DNA, 22 bp, Homo sapiens
tgttcttgagcctttagaccta

SEQ ID NO: 7682 - DNA, 22 bp, Homo sapiens
ttggctgtgcagatcttgccta

SEQ ID NO: 7683 - DNA, 20 bp, Homo sapiens
tggcctctgagatgccacgg

SEQ ID NO: 7684 - DNA, 22 bp, Homo sapiens
cgcccacgaagtaggtggcatt

SEQ ID NO: 7685 - DNA, 22 bp, Homo sapiens
gcagttagtgaagcagcttaga

SEQ ID NO: 7686 - DNA, 22 bp, Homo sapiens
aaaagaggaactcttatatact

SEQ ID NO: 7687 - DNA, 22 bp, Homo sapiens
aacccaggctggagtgcagtgg

SEQ ID NO: 7688 - DNA, 22 bp, Homo sapiens
tggaggcagccgtgaaccacct

SEQ ID NO: 7689 - DNA, 22 bp, Homo sapiens
ggtcacgtgaccgcacctgcct

SEQ ID NO: 7690 - DNA, 22 bp, Homo sapiens
tcaagcaattctcctgcctcag

SEQ ID NO: 7691 - DNA, 22 bp, Homo sapiens
gtggatggccctgcacacaggt

SEQ ID NO: 7692 - DNA, 22 bp, Homo sapiens
agtggcgtcctaggaaaggagg

SEQ ID NO: 7693 - DNA, 22 bp, Homo sapiens
agggtcctgggtgcagttgctt

SEQ ID NO: 7694 - DNA, 22 bp, Homo sapiens
acagtccagcctagtatgtata

SEQ ID NO: 7695 - DNA, 22 bp, Homo sapiens
ttaggtattttgttatgtcagc

SEQ ID NO: 7696 - DNA, 22 bp, Homo sapiens
tttctataaaaagtgctaggat

SEQ ID NO: 7697 - DNA, 21 bp, Homo sapiens
tcagtggctcctggtgacgtc

SEQ ID NO: 7698 - DNA, 22 bp, Homo sapiens
atctccgccatcgcgaacgcct

SEQ ID NO: 7699 - DNA, 22 bp, Homo sapiens
atcatccaagcgtagttcttct

SEQ ID NO: 7700 - DNA, 23 bp, Homo sapiens
ctggggctttcaaatctgggcag

SEQ ID NO: 7701 - DNA, 22 bp, Homo sapiens
taaagggtaggttttactgtaa

SEQ ID NO: 7702 - DNA, 22 bp, Homo sapiens
tcaggaggcggaggttgcagtg

SEQ ID NO: 7703 - DNA, 22 bp, Homo sapiens
aattagttcacgtcctgtgctt

SEQ ID NO: 7704 - DNA, 22 bp, Homo sapiens
ggagggcagagtcccctgctga

SEQ ID NO: 7705 - DNA, 22 bp, Homo sapiens
gctcccagtctgatggaggaga

SEQ ID NO: 7706 - DNA, 22 bp, Homo sapiens
atcctagaatcagcccttgctg

SEQ ID NO: 7707 - DNA, 22 bp, Homo sapiens
ggaagctctgcctagatttcag

SEQ ID NO: 7708 - DNA, 22 bp, Homo sapiens
gctggaggatggactggaagaa

SEQ ID NO: 7709 - DNA, 22 bp, Homo sapiens
tgaatatgtgactttgatttca

SEQ ID NO: 7710 - DNA, 23 bp, Homo sapiens
ctcaccaagcgccgccgctgtgt

SEQ ID NO: 7711 - DNA, 22 bp, Homo sapiens
ctgggaggcagaggttgtagtg

SEQ ID NO: 7712 - DNA, 22 bp, Homo sapiens
ccgggaggcagaggttgcagtg

SEQ ID NO: 7713 - DNA, 22 bp, Homo sapiens
tcaccaccagaagagctattct

SEQ ID NO: 7714 - DNA, 22 bp, Homo sapiens
attgttcaatgtaataattttg

SEQ ID NO: 7715 - DNA, 22 bp, Homo sapiens
ccaaagaaacccaagctcaggg

SEQ ID NO: 7716 - DNA, 22 bp, Homo sapiens
tgcagtttaaacttggcaactt

SEQ ID NO: 7717 - DNA, 22 bp, Homo sapiens
agcgggctcacccggttgttgt

SEQ ID NO: 7718 - DNA, 22 bp, Homo sapiens
gtatgtgaggttggtttccagg

SEQ ID NO: 7719 - DNA, 22 bp, Homo sapiens
taagagaccgatattcttaagt

SEQ ID NO: 7720 - DNA, 22 bp, Homo sapiens
atgtatatgcatgcattcaaag

SEQ ID NO: 7721 - DNA, 22 bp, Homo sapiens
aggactgggtgcagagggcatc

SEQ ID NO: 7722 - DNA, 22 bp, Homo sapiens
gagctactgaaatattgatttt

SEQ ID NO: 7723 - DNA, 18 bp, Homo sapiens
ggaaaaggagtgtctagc

SEQ ID NO: 7724 - DNA, 22 bp, Homo sapiens
tgcaaaggtttgtgcttggaaa

SEQ ID NO: 7725 - DNA, 22 bp, Homo sapiens
gctttatccgcttgacccttac

SEQ ID NO: 7726 - DNA, 22 bp, Homo sapiens
tcgcccagctcatctcccacaa

SEQ ID NO: 7727 - DNA, 22 bp, Homo sapiens
gaatgcagtggcaccatctcag

SEQ ID NO: 7728 - DNA, 22 bp, Homo sapiens
aaggtatatctgatccatgagg

SEQ ID NO: 7729 - DNA, 22 bp, Homo sapiens
tcttacccggcaacgtgtgtcg

SEQ ID NO: 7730 - DNA, 22 bp, Homo sapiens
gaggcggaggttgcagtgagct

SEQ ID NO: 7731 - DNA, 22 bp, Homo sapiens
gggtacttaatatttacggggt

SEQ ID NO: 7732 - DNA, 22 bp, Homo sapiens
tggtatgcttattatcttcaac

SEQ ID NO: 7733 - DNA, 22 bp, Homo sapiens
gcccagcccagaaaggttcgga

SEQ ID NO: 7734 - DNA, 22 bp, Homo sapiens
acggcaggctcagagctggaat

SEQ ID NO: 7735 - DNA, 22 bp, Homo sapiens
gcttggcccattgatcagctgg

SEQ ID NO: 7736 - DNA, 19 bp, Homo sapiens
tccaaagaagttcacattt

SEQ ID NO: 7737 - DNA, 22 bp, Homo sapiens
ggagtgactctcggggccacta

SEQ ID NO: 7738 - DNA, 22 bp, Homo sapiens
aacccgagggccccaggctcgg

SEQ ID NO: 7739 - DNA, 22 bp, Homo sapiens
gccctgggcaaggttctggcca

SEQ ID NO: 7740 - DNA, 22 bp, Homo sapiens
ttgtcgggcttacgcagggcca

SEQ ID NO: 7741 - DNA, 22 bp, Homo sapiens
ctgggaggcggagcttgcagtg

SEQ ID NO: 7742 - DNA, 22 bp, Homo sapiens
tagtatagattgaagcagatca

SEQ ID NO: 7743 - DNA, 22 bp, Homo sapiens
ttcaccagcagctcactagtca

SEQ ID NO: 7744 - DNA, 22 bp, Homo sapiens
caccagtgtttacctgtgacaa

SEQ ID NO: 7745 - DNA, 22 bp, Homo sapiens
tgatatgggaaaagggctcgga

SEQ ID NO: 7746 - DNA, 22 bp, Homo sapiens
tggttcctcaagcgctggcggc

SEQ ID NO: 7747 - DNA, 22 bp, Homo sapiens
aaagcctcccaggttatgagta

SEQ ID NO: 7748 - DNA, 22 bp, Homo sapiens
tggtggctaccaggtcctgggg

SEQ ID NO: 7749 - DNA, 22 bp, Homo sapiens
tggaatgcagtgggagcttacc

SEQ ID NO: 7750 - DNA, 22 bp, Homo sapiens
aaggaaagctgtggttctgaga

SEQ ID NO: 7751 - DNA, 22 bp, Homo sapiens
tgtctgttattggtgtataaga

SEQ ID NO: 7752 - DNA, 22 bp, Homo sapiens
tggaaagaaagtaaaggcgtat

SEQ ID NO: 7753 - DNA, 19 bp, Homo sapiens
tgctaccgtgggatgctta

SEQ ID NO: 7754 - DNA, 22 bp, Homo sapiens
atctattttaaatggcagtaaa

SEQ ID NO: 7755 - DNA, 22 bp, Homo sapiens
catgatggctcatgcttgtaat

SEQ ID NO: 7756 - DNA, 22 bp, Homo sapiens
tagaactacaagcattaaaagt

SEQ ID NO: 7757 - DNA, 22 bp, Homo sapiens
atagcaacaccccaattttcta

SEQ ID NO: 7758 - DNA, 22 bp, Homo sapiens
acaggatcgccctgttgcccag

SEQ ID NO: 7759 - DNA, 22 bp, Homo sapiens
aaggtcgtgtgggggttgctgc

SEQ ID NO: 7760 - DNA, 19 bp, Homo sapiens
ctctgggcaagtcacttaa

SEQ ID NO: 7761 - DNA, 22 bp, Homo sapiens
ttggatggaggttcaagcacta

SEQ ID NO: 7762 - DNA, 22 bp, Homo sapiens
gaccttgtgatccacctgcctt

SEQ ID NO: 7763 - DNA, 22 bp, Homo sapiens
cccgggaggcagaggttgcagt

SEQ ID NO: 7764 - DNA, 22 bp, Homo sapiens
gcacatccaatgattgttttga

SEQ ID NO: 7765 - DNA, 22 bp, Homo sapiens
tgttccagatttagccaaccga

SEQ ID NO: 7766 - DNA, 22 bp, Homo sapiens
agtgggtgacagtgaacacgta

SEQ ID NO: 7767 - DNA, 22 bp, Homo sapiens
tttattggatatttacaagata

SEQ ID NO: 7768 - DNA, 22 bp, Homo sapiens
tggccttggccgtgctggggtc

SEQ ID NO: 7769 - DNA, 23 bp, Homo sapiens
actgattcttgaagttgacaagt

SEQ ID NO: 7770 - DNA, 22 bp, Homo sapiens
gccttgagaaatgtttggtttt

SEQ ID NO: 7771 - DNA, 22 bp, Homo sapiens
caggcgctgtggctcccacctg

SEQ ID NO: 7772 - DNA, 22 bp, Homo sapiens
tggaggtaggacgaagaactct

SEQ ID NO: 7773 - DNA, 22 bp, Homo sapiens
cctctgtgtgatgcgcaaagta

SEQ ID NO: 7774 - DNA, 22 bp, Homo sapiens
ttaataaagtatgaattggaaa

SEQ ID NO: 7775 - DNA, 22 bp, Homo sapiens
ttgcctgtgtcagcaggtggaa

SEQ ID NO: 7776 - DNA, 21 bp, Homo sapiens
aggcatgagccctgcatggac

SEQ ID NO: 7777 - DNA, 22 bp, Homo sapiens
tgagcattacctgaggccactg

SEQ ID NO: 7778 - DNA, 22 bp, Homo sapiens
ctgggggcagcaagaagccatg

SEQ ID NO: 7779 - DNA, 22 bp, Homo sapiens
tgacagtgaataagtctcttaa

SEQ ID NO: 7780 - DNA, 22 bp, Homo sapiens
aagcacctgcaccggtcgcctt

SEQ ID NO: 7781 - DNA, 22 bp, Homo sapiens
caggaaagggatgggctgccac

SEQ ID NO: 7782 - DNA, 22 bp, Homo sapiens
tgggccactgctgcggaaggcg

SEQ ID NO: 7783 - DNA, 19 bp, Homo sapiens
aggaatggaattaattctg

SEQ ID NO: 7784 - DNA, 16 bp, Homo sapiens
tgggtgggaggagcgg

SEQ ID NO: 7785 - DNA, 22 bp, Homo sapiens
gaggcctgggcaagggggtctg

SEQ ID NO: 7786 - DNA, 22 bp, Homo sapiens
aggtttctttatgctgctagaa

SEQ ID NO: 7787 - DNA, 22 bp, Homo sapiens
ctgtccgccgacttggccaggc

SEQ ID NO: 7788 - DNA, 22 bp, Homo sapiens
ccagaaaaatcctcccttgtcc

SEQ ID NO: 7789 - DNA, 22 bp, Homo sapiens
ctgcttctccctgagatagtgt

SEQ ID NO: 7790 - DNA, 22 bp, Homo sapiens
tactaggaagcagctgcattgg

SEQ ID NO: 7791 - DNA, 22 bp, Homo sapiens
agaatccctggggagctgcagc

SEQ ID NO: 7792 - DNA, 22 bp, Homo sapiens
ctggcaggagcattcacagagg

SEQ ID NO: 7793 - DNA, 22 bp, Homo sapiens
cagaggtagcatgctgtggctt

SEQ ID NO: 7794 - DNA, 16 bp, Homo sapiens
gcagaggaaaggggag

SEQ ID NO: 7795 - DNA, 22 bp, Homo sapiens
agcccaggttgaggctgcagtg

SEQ ID NO: 7796 - DNA, 22 bp, Homo sapiens
tacatgctccttatgagaatct

SEQ ID NO: 7797 - DNA, 22 bp, Homo sapiens
cgcaactcagcaacttaactgc

SEQ ID NO: 7798 - DNA, 22 bp, Homo sapiens
aggacctactgatatcttagca

SEQ ID NO: 7799 - DNA, 22 bp, Homo sapiens
agttattactctttaacatatt

SEQ ID NO: 7800 - DNA, 22 bp, Homo sapiens
catttacatttaaggttaatat

SEQ ID NO: 7801 - DNA, 22 bp, Homo sapiens
aggtgtctggacttgtgaagca

SEQ ID NO: 7802 - DNA, 22 bp, Homo sapiens
gctgacctcgtccaggcgcttc

SEQ ID NO: 7803 - DNA, 22 bp, Homo sapiens
gtgtctcttagcctgctaatgc

SEQ ID NO: 7804 - DNA, 22 bp, Homo sapiens
catccaccgcgtgcacctctac

SEQ ID NO: 7805 - DNA, 22 bp, Homo sapiens
cagtagccaactccaggaacta

SEQ ID NO: 7806 - DNA, 22 bp, Homo sapiens
tgtgggacctcagagggtcccc

SEQ ID NO: 7807 - DNA, 22 bp, Homo sapiens
ctgtctgtagacatttttggtt

SEQ ID NO: 7808 - DNA, 23 bp, Homo sapiens
agagcaaggaaatgaggtgtgat

SEQ ID NO: 7809 - DNA, 22 bp, Homo sapiens
tgcatgagcgaatgtgtcctgt

SEQ ID NO: 7810 - DNA, 22 bp, Homo sapiens
aggcaagggggcgccaccttcc

SEQ ID NO: 7811 - DNA, 22 bp, Homo sapiens
ctgaggcaggagagttgcttga

SEQ ID NO: 7812 - DNA, 22 bp, Homo sapiens
agggagcattgtgacatatcac

SEQ ID NO: 7813 - DNA, 22 bp, Homo sapiens
taggttctccacaggttctcca

SEQ ID NO: 7814 - DNA, 22 bp, Homo sapiens
ttggatgggcattaggaaagtc

SEQ ID NO: 7815 - DNA, 22 bp, Homo sapiens
cccaggaggcagatgttgcagt

SEQ ID NO: 7816 - DNA, 22 bp, Homo sapiens
tcccgtcttgctgttgtctgcg

SEQ ID NO: 7817 - DNA, 22 bp, Homo sapiens
atcacagttttaccatttggta

SEQ ID NO: 7818 - DNA, 22 bp, Homo sapiens
tacaggcatgtagcatggtgat

SEQ ID NO: 7819 - DNA, 22 bp, Homo sapiens
gattgtggaagtcagtggttct

SEQ ID NO: 7820 - DNA, 22 bp, Homo sapiens
tggagtgaagggttggcacggt

SEQ ID NO: 7821 - DNA, 22 bp, Homo sapiens
ggtgtcagactttgcatatcct

SEQ ID NO: 7822 - DNA, 18 bp, Homo sapiens
cagggctgtggggtcact

SEQ ID NO: 7823 - DNA, 22 bp, Homo sapiens
ctcactgcaagctctgcctccc

SEQ ID NO: 7824 - DNA, 22 bp, Homo sapiens
tggaggagaccgcattttattt

SEQ ID NO: 7825 - DNA, 22 bp, Homo sapiens
ctgctctgctgatcagtgtctc

SEQ ID NO: 7826 - DNA, 21 bp, Homo sapiens
ttctcctaggctgaggcggga

SEQ ID NO: 7827 - DNA, 22 bp, Homo sapiens
ttggaagttgatttaaaaagga

SEQ ID NO: 7828 - DNA, 22 bp, Homo sapiens
tgcctgtggaaaggctggtgct

SEQ ID NO: 7829 - DNA, 22 bp, Homo sapiens
aagaggtaaccatagcaaccac

SEQ ID NO: 7830 - DNA, 22 bp, Homo sapiens
agccctggtttgcagcatttgc

SEQ ID NO: 7831 - DNA, 22 bp, Homo sapiens
ttgaggtcttcaggatcaggct

SEQ ID NO: 7832 - DNA, 22 bp, Homo sapiens
aacttggctaccagcgttaaat

SEQ ID NO: 7833 - DNA, 22 bp, Homo sapiens
ttgtggttgactaaatttgtaa

SEQ ID NO: 7834 - DNA, 22 bp, Homo sapiens
aagaggttgtacctaaagtgtt

SEQ ID NO: 7835 - DNA, 22 bp, Homo sapiens
tgagaccttggactccatcctt

SEQ ID NO: 7836 - DNA, 22 bp, Homo sapiens
tgagctgtagcagatgctgttg

SEQ ID NO: 7837 - DNA, 22 bp, Homo sapiens
agctagtatttcattgaggatt

SEQ ID NO: 7838 - DNA, 22 bp, Homo sapiens
ctgcacatgtccctaagtgtca

SEQ ID NO: 7839 - DNA, 21 bp, Homo sapiens
gagcgccgctcacctcccctg

SEQ ID NO: 7840 - DNA, 22 bp, Homo sapiens
agaaatgggccttgggacacaa

SEQ ID NO: 7841 - DNA, 23 bp, Homo sapiens
ggaagctcacgtagtcctgcact

SEQ ID NO: 7842 - DNA, 22 bp, Homo sapiens
tgatatgtccctcgacatcagg

SEQ ID NO: 7843 - DNA, 22 bp, Homo sapiens
ttgtcttttgtgggaaatatgg

SEQ ID NO: 7844 - DNA, 22 bp, Homo sapiens
ttccgaacccggatctgctgct

SEQ ID NO: 7845 - DNA, 22 bp, Homo sapiens
gcagactgtatcaatgtcagta

SEQ ID NO: 7846 - DNA, 22 bp, Homo sapiens
cgttggtctgtcccctggcacc

SEQ ID NO: 7847 - DNA, 22 bp, Homo sapiens
cgctgataaacgtcacgttccc

SEQ ID NO: 7848 - DNA, 22 bp, Homo sapiens
caccatgcctggctaatttttt

SEQ ID NO: 7849 - DNA, 22 bp, Homo sapiens
tggtgcaaaactaattgcggtt

SEQ ID NO: 7850 - DNA, 22 bp, Homo sapiens
aggagcaccattgtgctggtgt

SEQ ID NO: 7851 - DNA, 22 bp, Homo sapiens
gagatggagtctcactctgtca

SEQ ID NO: 7852 - DNA, 22 bp, Homo sapiens
agctgctcattggcgtagttga

SEQ ID NO: 7853 - DNA, 22 bp, Homo sapiens
atacaccaccttggatctttca

SEQ ID NO: 7854 - DNA, 22 bp, Homo sapiens
agagttgctccattagaactta

SEQ ID NO: 7855 - DNA, 22 bp, Homo sapiens
ccgaggctggagtgcagtggcg

SEQ ID NO: 7856 - DNA, 22 bp, Homo sapiens
gacctcgtgatctgccagcctt

SEQ ID NO: 7857 - DNA, 22 bp, Homo sapiens
caggagctcagatgacatctca

SEQ ID NO: 7858 - DNA, 22 bp, Homo sapiens
ttactggctgggcctgagggct

SEQ ID NO: 7859 - DNA, 22 bp, Homo sapiens
taggtttaggagtgaaggtgaa

SEQ ID NO: 7860 - DNA, 22 bp, Homo sapiens
agtggccctggagtgactcgta

SEQ ID NO: 7861 - DNA, 22 bp, Homo sapiens
gggacttcatagctaggcactt

SEQ ID NO: 7862 - DNA, 21 bp, Homo sapiens
acatggactgtgaatggggac

SEQ ID NO: 7863 - DNA, 22 bp, Homo sapiens
cagctgcccctccagggctggg

SEQ ID NO: 7864 - DNA, 22 bp, Homo sapiens
ctttggtcaattgctgcgggga

SEQ ID NO: 7865 - DNA, 22 bp, Homo sapiens
aagccctggacggcccttcccc

SEQ ID NO: 7866 - DNA, 22 bp, Homo sapiens
tctcgctgaagaagctgcacat

SEQ ID NO: 7867 - DNA, 22 bp, Homo sapiens
aggacgctctcgctgaacttct

SEQ ID NO: 7868 - DNA, 22 bp, Homo sapiens
aggtaaatgtcagagcctttaa

SEQ ID NO: 7869 - DNA, 22 bp, Homo sapiens
atttcagtattatacaactgct

SEQ ID NO: 7870 - DNA, 22 bp, Homo sapiens
gaccctctagatggaagcactg

SEQ ID NO: 7871 - DNA, 22 bp, Homo sapiens
ctcccgaggagcctcagcgctc

SEQ ID NO: 7872 - DNA, 22 bp, Homo sapiens
ttttctagggtgctaaatgaac

SEQ ID NO: 7873 - DNA, 22 bp, Homo sapiens
tcggggatggtgtctgagggag

SEQ ID NO: 7874 - DNA, 22 bp, Homo sapiens
ctggccagatgttacgtccaat

SEQ ID NO: 7875 - DNA, 19 bp, Homo sapiens
tcctgcctggggccgcctg

SEQ ID NO: 7876 - DNA, 23 bp, Homo sapiens
aggtaggttattgctgctacctg

SEQ ID NO: 7877 - DNA, 22 bp, Homo sapiens
accttcaggtgagcacacagat

SEQ ID NO: 7878 - DNA, 22 bp, Homo sapiens
ttcttggggttccacaatggga

SEQ ID NO: 7879 - DNA, 19 bp, Homo sapiens
gctgttaaggaccctcgga

SEQ ID NO: 7880 - DNA, 22 bp, Homo sapiens
gagctgggcctgcgagtgctgc

SEQ ID NO: 7881 - DNA, 22 bp, Homo sapiens
caactgggataaagagctaaag

SEQ ID NO: 7882 - DNA, 22 bp, Homo sapiens
gcggggggcaggcagtacgttg

SEQ ID NO: 7883 - DNA, 22 bp, Homo sapiens
ccggctcggcgaccaggctgaa

SEQ ID NO: 7884 - DNA, 22 bp, Homo sapiens
agtgccctttacaacttcttga

SEQ ID NO: 7885 - DNA, 22 bp, Homo sapiens
caccttactccctctggatgcc

SEQ ID NO: 7886 - DNA, 22 bp, Homo sapiens
agatgctgggatgcttggatgg

SEQ ID NO: 7887 - DNA, 23 bp, Homo sapiens
gtgtgttcccggagtagctcccg

SEQ ID NO: 7888 - DNA, 22 bp, Homo sapiens
tgcaggctgtgtcatttagtga

SEQ ID NO: 7889 - DNA, 22 bp, Homo sapiens
tgccctttatttctggggcaga

SEQ ID NO: 7890 - DNA, 22 bp, Homo sapiens
tatggctaattctttactgacc

SEQ ID NO: 7891 - DNA, 22 bp, Homo sapiens
ctgggatccacgggctcccaag

SEQ ID NO: 7892 - DNA, 22 bp, Homo sapiens
aaagtgctgggattacaggctt

SEQ ID NO: 7893 - DNA, 22 bp, Homo sapiens
cacagtcctgccagagggcctt

SEQ ID NO: 7894 - DNA, 22 bp, Homo sapiens
agcttttagctcctggttgcaa

SEQ ID NO: 7895 - DNA, 22 bp, Homo sapiens
tccgggggtggtagatttcctt

SEQ ID NO: 7896 - DNA, 22 bp, Homo sapiens
tgtagctctccagccagcaagg

SEQ ID NO: 7897 - DNA, 22 bp, Homo sapiens
tgaaggggttcagcatgggggt

SEQ ID NO: 7898 - DNA, 22 bp, Homo sapiens
tgtcagttctctgcattgtctc

SEQ ID NO: 7899 - DNA, 22 bp, Homo sapiens
ccctggcagtgctcctttagac

SEQ ID NO: 7900 - DNA, 22 bp, Homo sapiens
ccgggccccacggtgacctcag

SEQ ID NO: 7901 - DNA, 22 bp, Homo sapiens
acgcccagactcccatactttg

SEQ ID NO: 7902 - DNA, 22 bp, Homo sapiens
gggagtgtgcacacatggtata

SEQ ID NO: 7903 - DNA, 22 bp, Homo sapiens
ttggaacatgccggggtccagg

SEQ ID NO: 7904 - DNA, 22 bp, Homo sapiens
tgcaatctcggcactttgggag

SEQ ID NO: 7905 - DNA, 22 bp, Homo sapiens
attagtcttcacctctctttgg

SEQ ID NO: 7906 - DNA, 21 bp, Homo sapiens
ggccagtggaattttatgtca

SEQ ID NO: 7907 - DNA, 22 bp, Homo sapiens
ggaggtagcctcaaaagcagct

SEQ ID NO: 7908 - DNA, 22 bp, Homo sapiens
agacggattacctgaggtcagg

SEQ ID NO: 7909 - DNA, 22 bp, Homo sapiens
agagggaagatggtccaatctt

SEQ ID NO: 7910 - DNA, 22 bp, Homo sapiens
ttcgggaggcggagcttgcagt

SEQ ID NO: 7911 - DNA, 22 bp, Homo sapiens
gaaagcatccgcctggaggtgg

SEQ ID NO: 7912 - DNA, 21 bp, Homo sapiens
ttaaagcctccctcataagga

SEQ ID NO: 7913 - DNA, 22 bp, Homo sapiens
cttcactttaagccaatcatga

SEQ ID NO: 7914 - DNA, 22 bp, Homo sapiens
aaggagtctgggccattcagag

SEQ ID NO: 7915 - DNA, 21 bp, Homo sapiens
tgcttgttctctgtccttgca

SEQ ID NO: 7916 - DNA, 22 bp, Homo sapiens
gtggggtctgtcctcttctggg

SEQ ID NO: 7917 - DNA, 22 bp, Homo sapiens
agggcaaagccagtgactccca

SEQ ID NO: 7918 - DNA, 22 bp, Homo sapiens
cccaggggttcaaggctgcagt

SEQ ID NO: 7919 - DNA, 22 bp, Homo sapiens
cccgtgtggatgcgctggtgct

SEQ ID NO: 7920 - DNA, 22 bp, Homo sapiens
ttccagttctgggctggctgct

SEQ ID NO: 7921 - DNA, 22 bp, Homo sapiens
gaagagctgacagtgtcatcct

SEQ ID NO: 7922 - DNA, 22 bp, Homo sapiens
atcagtgtgtcaaaagcacaaa

SEQ ID NO: 7923 - DNA, 22 bp, Homo sapiens
gaaaattattgaaaatggctct

SEQ ID NO: 7924 - DNA, 22 bp, Homo sapiens
cctgtaatcccaactacttggg

SEQ ID NO: 7925 - DNA, 22 bp, Homo sapiens
ataaagtggaggtagtattcat

SEQ ID NO: 7926 - DNA, 22 bp, Homo sapiens
tgattcatcagaataggagttt

SEQ ID NO: 7927 - DNA, 22 bp, Homo sapiens
cccaggaggcagagcttgcagt

SEQ ID NO: 7928 - DNA, 21 bp, Homo sapiens
tctcttcctccgcgccgccgc

SEQ ID NO: 7929 - DNA, 21 bp, Homo sapiens
cgtgactgggtccgtctggct

SEQ ID NO: 7930 - DNA, 22 bp, Homo sapiens
gattccacagcttcgaggtctt

SEQ ID NO: 7931 - DNA, 22 bp, Homo sapiens
cgcgctgcagacagcggaggcc

SEQ ID NO: 7932 - DNA, 18 bp, Homo sapiens
tgggaatgctcaaggccc

SEQ ID NO: 7933 - DNA, 22 bp, Homo sapiens
tcaagcacttacagtctggtaa

SEQ ID NO: 7934 - DNA, 22 bp, Homo sapiens
aacccgggaggcggaggttgtg

SEQ ID NO: 7935 - DNA, 22 bp, Homo sapiens
tccttgtaaaggagctctaaca

SEQ ID NO: 7936 - DNA, 22 bp, Homo sapiens
acatatgcgatcataggatgca

SEQ ID NO: 7937 - DNA, 21 bp, Homo sapiens
ggcaagaaacacaatcaagta

SEQ ID NO: 7938 - DNA, 22 bp, Homo sapiens
ttgtctctggaaggaaaaagca

SEQ ID NO: 7939 - DNA, 22 bp, Homo sapiens
acagttagttgaggagtgtttg

SEQ ID NO: 7940 - DNA, 22 bp, Homo sapiens
ggaccggtggcttcctcgggtc

SEQ ID NO: 7941 - DNA, 22 bp, Homo sapiens
gtttctctgtctgttacattgg

SEQ ID NO: 7942 - DNA, 21 bp, Homo sapiens
ggccccgcagacccagcacgt

SEQ ID NO: 7943 - DNA, 22 bp, Homo sapiens
tatgaagtgatgttgaattttg

SEQ ID NO: 7944 - DNA, 17 bp, Homo sapiens
gagattttcgtcctgaa

SEQ ID NO: 7945 - DNA, 22 bp, Homo sapiens
actgtactccaacctgggcaac

SEQ ID NO: 7946 - DNA, 22 bp, Homo sapiens
atggcaatgaatgactttatgt

SEQ ID NO: 7947 - DNA, 22 bp, Homo sapiens
ctcctggaggatagtgactggg

SEQ ID NO: 7948 - DNA, 22 bp, Homo sapiens
cgactgtcatacacaagacatg

SEQ ID NO: 7949 - DNA, 22 bp, Homo sapiens
cagaagactgcagggaagggac

SEQ ID NO: 7950 - DNA, 22 bp, Homo sapiens
ctcacctccaggagctgctggc

SEQ ID NO: 7951 - DNA, 22 bp, Homo sapiens
atggccctaatgagttggtgtt

SEQ ID NO: 7952 - DNA, 22 bp, Homo sapiens
gaagtattactctgaatgtatt

SEQ ID NO: 7953 - DNA, 22 bp, Homo sapiens
ggtagtcggccttgccctgggc

SEQ ID NO: 7954 - DNA, 22 bp, Homo sapiens
gggtggcaccacgtgtcttcaa

SEQ ID NO: 7955 - DNA, 22 bp, Homo sapiens
gattgagtctgaggatgctgca

SEQ ID NO: 7956 - DNA, 22 bp, Homo sapiens
ccaatgatggtgcccacgatga

SEQ ID NO: 7957 - DNA, 22 bp, Homo sapiens
ccaataattcttcaagtgtttt

SEQ ID NO: 7958 - DNA, 22 bp, Homo sapiens
ggccttatggcaaagtcagttg

SEQ ID NO: 7959 - DNA, 22 bp, Homo sapiens
cgggcccgagcacggcacccac

SEQ ID NO: 7960 - DNA, 22 bp, Homo sapiens
gggctgcactagggcaaggtga

SEQ ID NO: 7961 - DNA, 22 bp, Homo sapiens
cccagccaaaagcaagtttacc

SEQ ID NO: 7962 - DNA, 22 bp, Homo sapiens
gaagggaactgggtctccttgt

SEQ ID NO: 7963 - DNA, 22 bp, Homo sapiens
atgatgaagcatggttacactg

SEQ ID NO: 7964 - DNA, 22 bp, Homo sapiens
ttgatgaggggatcagggtagc

SEQ ID NO: 7965 - DNA, 22 bp, Homo sapiens
tggggtgagattcagatattca

SEQ ID NO: 7966 - DNA, 22 bp, Homo sapiens
cctcttcaggcactcgaaggcc

SEQ ID NO: 7967 - DNA, 22 bp, Homo sapiens
ctgccatgccactgtgactgca

SEQ ID NO: 7968 - DNA, 22 bp, Homo sapiens
cccaggccctggcagagcttgt

SEQ ID NO: 7969 - DNA, 22 bp, Homo sapiens
tcttcccagaggaggtgccagc

SEQ ID NO: 7970 - DNA, 22 bp, Homo sapiens
ttggcaatgaaagctgcccggg

SEQ ID NO: 7971 - DNA, 22 bp, Homo sapiens
tgcagaaacaagccatcattca

SEQ ID NO: 7972 - DNA, 22 bp, Homo sapiens
ggctcaatgcaacttctgcctc

SEQ ID NO: 7973 - DNA, 22 bp, Homo sapiens
acgtagattcctccatgcgcag

SEQ ID NO: 7974 - DNA, 22 bp, Homo sapiens
attgtactccagcctgggtgac

SEQ ID NO: 7975 - DNA, 22 bp, Homo sapiens
ctcccataattctcatatgtca

SEQ ID NO: 7976 - DNA, 22 bp, Homo sapiens
catgcaggcgcaacttctacaa

SEQ ID NO: 7977 - DNA, 22 bp, Homo sapiens
taggtagctttggcgtttcttg

SEQ ID NO: 7978 - DNA, 22 bp, Homo sapiens
actgagcaggagaatcacttta

SEQ ID NO: 7979 - DNA, 22 bp, Homo sapiens
atccaccctgtggtggctttct

SEQ ID NO: 7980 - DNA, 22 bp, Homo sapiens
ctgggaggcagaggttgcagtg

SEQ ID NO: 7981 - DNA, 22 bp, Homo sapiens
gcagctgacatctggctgggcc

SEQ ID NO: 7982 - DNA, 22 bp, Homo sapiens
gtccagttgtatgtccagtgtc

SEQ ID NO: 7983 - DNA, 22 bp, Homo sapiens
tgactacaacctccacctcccg

SEQ ID NO: 7984 - DNA, 22 bp, Homo sapiens
tgacttcctgcactcaggtgat

SEQ ID NO: 7985 - DNA, 21 bp, Homo sapiens
ttggccgtgcagatgaacagc

SEQ ID NO: 7986 - DNA, 22 bp, Homo sapiens
gggcatggtggcaggcacctgt

SEQ ID NO: 7987 - DNA, 22 bp, Homo sapiens
tgtccagatcaatgcccacatg

SEQ ID NO: 7988 - DNA, 22 bp, Homo sapiens
acagcacttgggttttcctgtt

SEQ ID NO: 7989 - DNA, 22 bp, Homo sapiens
gagtgtgtcggtcagcgtggcg

SEQ ID NO: 7990 - DNA, 22 bp, Homo sapiens
ctagggacctcagctcctggag

SEQ ID NO: 7991 - DNA, 22 bp, Homo sapiens
tcccgttgatgacggtgcatcc

SEQ ID NO: 7992 - DNA, 18 bp, Homo sapiens
tgctgatggtccattagt

SEQ ID NO: 7993 - DNA, 22 bp, Homo sapiens
ttgtgttggcgaaagcatgtca

SEQ ID NO: 7994 - DNA, 22 bp, Homo sapiens
aggctggagtgcagttgcatga

SEQ ID NO: 7995 - DNA, 22 bp, Homo sapiens
aggcgcacagggtgttgatgtg

SEQ ID NO: 7996 - DNA, 22 bp, Homo sapiens
agagctgggtggacttgtagtt

SEQ ID NO: 7997 - DNA, 17 bp, Homo sapiens
cgggcatggagggcagg

SEQ ID NO: 7998 - DNA, 22 bp, Homo sapiens
ttggggtcccacaggctgcctg

SEQ ID NO: 7999 - DNA, 22 bp, Homo sapiens
cggggaagcggttctggcggta

SEQ ID NO: 8000 - DNA, 22 bp, Homo sapiens
tgagataatcatgtgatttcat

SEQ ID NO: 8001 - DNA, 22 bp, Homo sapiens
tgctggaggccagaagtctgag

SEQ ID NO: 8002 - DNA, 22 bp, Homo sapiens
gacccggctccaggcccagcag

SEQ ID NO: 8003 - DNA, 22 bp, Homo sapiens
agggatgtaaattcttcttctt

SEQ ID NO: 8004 - DNA, 22 bp, Homo sapiens
cccagcaggtcggtgctgcctg

SEQ ID NO: 8005 - DNA, 22 bp, Homo sapiens
aaagtgctgcgacatttgagcg

SEQ ID NO: 8006 - DNA, 22 bp, Homo sapiens
cccatgtgtgacagtccatttg

SEQ ID NO: 8007 - DNA, 22 bp, Homo sapiens
aaattgtaatgacttcacttga

SEQ ID NO: 8008 - DNA, 22 bp, Homo sapiens
tacgtgtgttcgtgtaagcact

SEQ ID NO: 8009 - DNA, 22 bp, Homo sapiens
atgtcatgaggctagcccccaa

SEQ ID NO: 8010 - DNA, 22 bp, Homo sapiens
tgcaatttttccatgacctaga

SEQ ID NO: 8011 - DNA, 22 bp, Homo sapiens
ccggaaggcggaacgtgcagtg

SEQ ID NO: 8012 - DNA, 22 bp, Homo sapiens
gtgtttggtcagacgtccgggg

SEQ ID NO: 8013 - DNA, 22 bp, Homo sapiens
agtgcaggccccaggccaggcc

SEQ ID NO: 8014 - DNA, 22 bp, Homo sapiens
tcactgcactccagcctgggtg

SEQ ID NO: 8015 - DNA, 22 bp, Homo sapiens
acccaggccattggcaagagtc

SEQ ID NO: 8016 - DNA, 22 bp, Homo sapiens
ttggccttagcttcttcttaaa

SEQ ID NO: 8017 - DNA, 23 bp, Homo sapiens
tgctaattggacttgattctgca

SEQ ID NO: 8018 - DNA, 22 bp, Homo sapiens
caccaggaggacaggcccctac

SEQ ID NO: 8019 - DNA, 18 bp, Homo sapiens
agcatcactgatcatcct

SEQ ID NO: 8020 - DNA, 22 bp, Homo sapiens
agccaagcactcaactcctgga

SEQ ID NO: 8021 - DNA, 22 bp, Homo sapiens
acccaggagacggaggtgcagt

SEQ ID NO: 8022 - DNA, 22 bp, Homo sapiens
gtgcaaacatcatagagtgtac

SEQ ID NO: 8023 - DNA, 22 bp, Homo sapiens
ctattattagataatctacttg

SEQ ID NO: 8024 - DNA, 19 bp, Homo sapiens
ttgacgttgtggaattaac

SEQ ID NO: 8025 - DNA, 22 bp, Homo sapiens
acgcctgtaatcccagcacttt

SEQ ID NO: 8026 - DNA, 22 bp, Homo sapiens
cctggctctgccacttactgcc

SEQ ID NO: 8027 - DNA, 22 bp, Homo sapiens
cctcccctcagacagagactgg

SEQ ID NO: 8028 - DNA, 22 bp, Homo sapiens
atgctattgaaaagaaataaga

SEQ ID NO: 8029 - DNA, 22 bp, Homo sapiens
caatagtgtctgcttgtttcta

SEQ ID NO: 8030 - DNA, 22 bp, Homo sapiens
acttcttcttcagctgggggat

SEQ ID NO: 8031 - DNA, 22 bp, Homo sapiens
gcttggccagcagccgggatgc

SEQ ID NO: 8032 - DNA, 22 bp, Homo sapiens
ttgagtgtactttagtcatctg

SEQ ID NO: 8033 - DNA, 22 bp, Homo sapiens
tacagggattgttttaatcacc

SEQ ID NO: 8034 - DNA, 22 bp, Homo sapiens
ttcaatttgtgctaaggcaccg

SEQ ID NO: 8035 - DNA, 22 bp, Homo sapiens
gggcataacgggcagccaggtg

SEQ ID NO: 8036 - DNA, 22 bp, Homo sapiens
gaactttgcgcagttcccgggg

SEQ ID NO: 8037 - DNA, 22 bp, Homo sapiens
cgggcagtgtggctccagagtc

SEQ ID NO: 8038 - DNA, 22 bp, Homo sapiens
aagcatttcaggtagagatatt

SEQ ID NO: 8039 - DNA, 18 bp, Homo sapiens
taatccatatgctttgcc

SEQ ID NO: 8040 - DNA, 22 bp, Homo sapiens
ttccggaaggttctctagaatt

SEQ ID NO: 8041 - DNA, 22 bp, Homo sapiens
tacactgctgggcagtgaatga

SEQ ID NO: 8042 - DNA, 22 bp, Homo sapiens
cctgaccaacgtggtgaaaccc

SEQ ID NO: 8043 - DNA, 22 bp, Homo sapiens
ctgctccccagcctgcgccttt

SEQ ID NO: 8044 - DNA, 22 bp, Homo sapiens
atgtggcaccgatctttagcca

SEQ ID NO: 8045 - DNA, 22 bp, Homo sapiens
cggagcctgcttgttgcagctg

SEQ ID NO: 8046 - DNA, 22 bp, Homo sapiens
cccagggaggcccaggctctgc

SEQ ID NO: 8047 - DNA, 22 bp, Homo sapiens
atggaccagagcctcattctgt

SEQ ID NO: 8048 - DNA, 22 bp, Homo sapiens
tttggaaatgaccccgtctaag

SEQ ID NO: 8049 - DNA, 22 bp, Homo sapiens
agctcaagctacacacagagtc

SEQ ID NO: 8050 - DNA, 22 bp, Homo sapiens
gcagagctcatgcctgcacctc

SEQ ID NO: 8051 - DNA, 22 bp, Homo sapiens
ggcgctcagtgttgccccagag

SEQ ID NO: 8052 - DNA, 22 bp, Homo sapiens
ctgcagtatgagctacccaggt

SEQ ID NO: 8053 - DNA, 19 bp, Homo sapiens
taccatccaagctggtttg

SEQ ID NO: 8054 - DNA, 22 bp, Homo sapiens
gcagattgtggggttcaggttt

SEQ ID NO: 8055 - DNA, 18 bp, Homo sapiens
agtgtcagctgcagctca

SEQ ID NO: 8056 - DNA, 22 bp, Homo sapiens
cagtgcttttaaaacaacatca

SEQ ID NO: 8057 - DNA, 22 bp, Homo sapiens
actctttgtctgttgccgctta

SEQ ID NO: 8058 - DNA, 22 bp, Homo sapiens
tggtatcgtgttggcactcagt

SEQ ID NO: 8059 - DNA, 22 bp, Homo sapiens
tgagactcagcacttgtgtgtc

SEQ ID NO: 8060 - DNA, 22 bp, Homo sapiens
caagagtgaaactctgtctcaa

SEQ ID NO: 8061 - DNA, 22 bp, Homo sapiens
tgtgccatgaggctctgatatg

SEQ ID NO: 8062 - DNA, 18 bp, Homo sapiens
tcaaatactttgggcagt

SEQ ID NO: 8063 - DNA, 22 bp, Homo sapiens
aggcgggttcagggctgccatg

SEQ ID NO: 8064 - DNA, 22 bp, Homo sapiens
tagtgtctcttcctgtttgaaa

SEQ ID NO: 8065 - DNA, 22 bp, Homo sapiens
gccgccgctgtgcaatttagca

SEQ ID NO: 8066 - DNA, 22 bp, Homo sapiens
aaagtgctgggattacaagcgt

SEQ ID NO: 8067 - DNA, 22 bp, Homo sapiens
cccgagtgtctactcactccca

SEQ ID NO: 8068 - DNA, 18 bp, Homo sapiens
actctttctgcccacagg

SEQ ID NO: 8069 - DNA, 22 bp, Homo sapiens
agggagcaaaggtttcagggtt

SEQ ID NO: 8070 - DNA, 22 bp, Homo sapiens
ctgcattaagttgcctgtaaga

SEQ ID NO: 8071 - DNA, 22 bp, Homo sapiens
ggctcctggcaatgtaacttta

SEQ ID NO: 8072 - DNA, 22 bp, Homo sapiens
tacttttctataggtttgaaat

SEQ ID NO: 8073 - DNA, 22 bp, Homo sapiens
ggctcactgcaaactgtgcctc

SEQ ID NO: 8074 - DNA, 22 bp, Homo sapiens
ctgggatgcggaggttgcggtg

SEQ ID NO: 8075 - DNA, 19 bp, Homo sapiens
catctggatgattctcctg

SEQ ID NO: 8076 - DNA, 22 bp, Homo sapiens
gaacttggaactggggctactg

SEQ ID NO: 8077 - DNA, 22 bp, Homo sapiens
accattgccccctagtgtctgt

SEQ ID NO: 8078 - DNA, 22 bp, Homo sapiens
cattgcactccagcctgggtga

SEQ ID NO: 8079 - DNA, 22 bp, Homo sapiens
ttcctggtcactgctgttccct

SEQ ID NO: 8080 - DNA, 22 bp, Homo sapiens
ggtgggccacggcataacgggc

SEQ ID NO: 8081 - DNA, 22 bp, Homo sapiens
gtcatggtgctagcgggaatgt

SEQ ID NO: 8082 - DNA, 22 bp, Homo sapiens
tggaaccatcaaagagatcctg

SEQ ID NO: 8083 - DNA, 22 bp, Homo sapiens
agccaggatggtctcgatcggc

SEQ ID NO: 8084 - DNA, 22 bp, Homo sapiens
gccctcctggcaggcagtgatg

SEQ ID NO: 8085 - DNA, 22 bp, Homo sapiens
atagtggggacaggatggttgg

SEQ ID NO: 8086 - DNA, 18 bp, Homo sapiens
tccagttttcccagcatc

SEQ ID NO: 8087 - DNA, 22 bp, Homo sapiens
atccatttgacataatttcagc

SEQ ID NO: 8088 - DNA, 21 bp, Homo sapiens
gagagctaacagtgacagctc

SEQ ID NO: 8089 - DNA, 22 bp, Homo sapiens
ggaggcccagaaggaagcccag

SEQ ID NO: 8090 - DNA, 22 bp, Homo sapiens
ttgtgaatagtgctgcagtaaa

SEQ ID NO: 8091 - DNA, 22 bp, Homo sapiens
tgtaatattgtagtgacagtac

SEQ ID NO: 8092 - DNA, 22 bp, Homo sapiens
ctgtaatcccagctacctggga

SEQ ID NO: 8093 - DNA, 22 bp, Homo sapiens
ccctgtgggaactcctgagttg

SEQ ID NO: 8094 - DNA, 23 bp, Homo sapiens
aggaaagcattcatttttaccat

SEQ ID NO: 8095 - DNA, 22 bp, Homo sapiens
aatcactgtggccaggtggtgt

SEQ ID NO: 8096 - DNA, 22 bp, Homo sapiens
tgtgagacgtaggccatcgagg

SEQ ID NO: 8097 - DNA, 22 bp, Homo sapiens
accccttggagtccgcgcccag

SEQ ID NO: 8098 - DNA, 22 bp, Homo sapiens
tgttgattagtgtttagactta

SEQ ID NO: 8099 - DNA, 22 bp, Homo sapiens
aggagcggatgtgtcctgccag

SEQ ID NO: 8100 - DNA, 20 bp, Homo sapiens
caagggtttgcattggcttt

SEQ ID NO: 8101 - DNA, 19 bp, Homo sapiens
aggctaaagagtcttgcgt

SEQ ID NO: 8102 - DNA, 22 bp, Homo sapiens
atgtgagctctcttctgattgg

SEQ ID NO: 8103 - DNA, 22 bp, Homo sapiens
ctttaaggtgatgagagatgct

SEQ ID NO: 8104 - DNA, 22 bp, Homo sapiens
tgatcagcatcttcccagctcg

SEQ ID NO: 8105 - DNA, 22 bp, Homo sapiens
tgggaaggggagctggaaagga

SEQ ID NO: 8106 - DNA, 22 bp, Homo sapiens
cctcccggatcatgtcccgcac

SEQ ID NO: 8107 - DNA, 22 bp, Homo sapiens
gtccagtgttggaggttttacc

SEQ ID NO: 8108 - DNA, 22 bp, Homo sapiens
ctgaggagaggtggcctgtgtt

SEQ ID NO: 8109 - DNA, 22 bp, Homo sapiens
ccaaagtgctgagattacaggt

SEQ ID NO: 8110 - DNA, 22 bp, Homo sapiens
tttttccacataccctaggcca

SEQ ID NO: 8111 - DNA, 22 bp, Homo sapiens
tgttttggtggtctataggaaa

SEQ ID NO: 8112 - DNA, 22 bp, Homo sapiens
aaattacagccttgggtagctt

SEQ ID NO: 8113 - DNA, 22 bp, Homo sapiens
cttgtctgctataaaaatccag

SEQ ID NO: 8114 - DNA, 22 bp, Homo sapiens
ccggaggaggacgagcccgcgg

SEQ ID NO: 8115 - DNA, 22 bp, Homo sapiens
gcagctcaaaggccacggacgg

SEQ ID NO: 8116 - DNA, 22 bp, Homo sapiens
gtggaatttttacctatgaatg

SEQ ID NO: 8117 - DNA, 22 bp, Homo sapiens
ggcgtggggccttctgcccgct

SEQ ID NO: 8118 - DNA, 18 bp, Homo sapiens
gaccccgggatctgtcga

SEQ ID NO: 8119 - DNA, 22 bp, Homo sapiens
ttctgccatctgcagaagggga

SEQ ID NO: 8120 - DNA, 22 bp, Homo sapiens
cctgggaggctgaggctgcagt

SEQ ID NO: 8121 - DNA, 22 bp, Homo sapiens
aagttactggcaagggctgcag

SEQ ID NO: 8122 - DNA, 22 bp, Homo sapiens
atggatcagaatcccgggaggg

SEQ ID NO: 8123 - DNA, 22 bp, Homo sapiens
cactgcaagctccacctcccgg

SEQ ID NO: 8124 - DNA, 22 bp, Homo sapiens
ttgtgctgactgcgcccagctc

SEQ ID NO: 8125 - DNA, 22 bp, Homo sapiens
cccgggttgtccgcgcgtccgg

SEQ ID NO: 8126 - DNA, 23 bp, Homo sapiens
gcagaggagcaagctggacacca

SEQ ID NO: 8127 - DNA, 23 bp, Homo sapiens
tcccatctattgtgatcaatgcc

SEQ ID NO: 8128 - DNA, 22 bp, Homo sapiens
tagcacagggctcctcaaccca

SEQ ID NO: 8129 - DNA, 22 bp, Homo sapiens
ttgcttcttagatattcctctc

SEQ ID NO: 8130 - DNA, 22 bp, Homo sapiens
tcctccccaaagcccagcctgg

SEQ ID NO: 8131 - DNA, 22 bp, Homo sapiens
tgctgtgaggttgagaaggaag

SEQ ID NO: 8132 - DNA, 22 bp, Homo sapiens
acttttcttatcagaaaggcca

SEQ ID NO: 8133 - DNA, 22 bp, Homo sapiens
taattctgacaacagtggcgtt

SEQ ID NO: 8134 - DNA, 19 bp, Homo sapiens
actgtagcactgcagtata

SEQ ID NO: 8135 - DNA, 22 bp, Homo sapiens
cccgggaggtggagcttgcagt

SEQ ID NO: 8136 - DNA, 22 bp, Homo sapiens
gcttagcaaacatctgtagtcc

SEQ ID NO: 8137 - DNA, 22 bp, Homo sapiens
cactgcactccagcctggcgac

SEQ ID NO: 8138 - DNA, 22 bp, Homo sapiens
ctgggctcaagtgatccaccca

SEQ ID NO: 8139 - DNA, 22 bp, Homo sapiens
tttgaaatgtatcagtataggt

SEQ ID NO: 8140 - DNA, 22 bp, Homo sapiens
tctttgctattgtgaatagtgc

SEQ ID NO: 8141 - DNA, 22 bp, Homo sapiens
tagcagcatttttgtagagtat

SEQ ID NO: 8142 - DNA, 22 bp, Homo sapiens
tgggcagggagctggaaccaca

SEQ ID NO: 8143 - DNA, 22 bp, Homo sapiens
ccagtgtgcattatcatgtgtc

SEQ ID NO: 8144 - DNA, 22 bp, Homo sapiens
ttggagtgacagatgaggaaac

SEQ ID NO: 8145 - DNA, 22 bp, Homo sapiens
aagaggttgtctgtgatgagtt

SEQ ID NO: 8146 - DNA, 20 bp, Homo sapiens
tttctgtgagaaacactgtt

SEQ ID NO: 8147 - DNA, 22 bp, Homo sapiens
agctttgccaggaggcttggtc

SEQ ID NO: 8148 - DNA, 22 bp, Homo sapiens
tcgaactcatagtcgtagctgt

SEQ ID NO: 8149 - DNA, 22 bp, Homo sapiens
gaagcctcaacatctctgcgtc

SEQ ID NO: 8150 - DNA, 18 bp, Homo sapiens
tcactgtgtgtcttgggt

SEQ ID NO: 8151 - DNA, 20 bp, Homo sapiens
ggcagagggcctgggagaag

SEQ ID NO: 8152 - DNA, 22 bp, Homo sapiens
tgacctattagatttccttgcc

SEQ ID NO: 8153 - DNA, 22 bp, Homo sapiens
cctgacgaaaggcgtgctggag

SEQ ID NO: 8154 - DNA, 22 bp, Homo sapiens
gaggtgctgctgtacttcttgc

SEQ ID NO: 8155 - DNA, 22 bp, Homo sapiens
tctcgctctgtcgcccaggctg

SEQ ID NO: 8156 - DNA, 22 bp, Homo sapiens
aggggatggagctggaaggcag

SEQ ID NO: 8157 - DNA, 22 bp, Homo sapiens
gaggagggagctggaagctctt

SEQ ID NO: 8158 - DNA, 22 bp, Homo sapiens
gggaaggccttgtcagcggatt

SEQ ID NO: 8159 - DNA, 22 bp, Homo sapiens
gcgagggcacgcggttgaaggc

SEQ ID NO: 8160 - DNA, 22 bp, Homo sapiens
gctggtagacctcactgcactc

SEQ ID NO: 8161 - DNA, 22 bp, Homo sapiens
tttgggcaggcttttccctaga

SEQ ID NO: 8162 - DNA, 22 bp, Homo sapiens
acaaacagagttgaaaaatagg

SEQ ID NO: 8163 - DNA, 22 bp, Homo sapiens
ggggatggaggcgtgtggtcct

SEQ ID NO: 8164 - DNA, 22 bp, Homo sapiens
ccaggggggcgtagatgctggg

SEQ ID NO: 8165 - DNA, 22 bp, Homo sapiens
agggaaattaatgtgagcaatg

SEQ ID NO: 8166 - DNA, 22 bp, Homo sapiens
gggagtgggtttggcctaggcc

SEQ ID NO: 8167 - DNA, 22 bp, Homo sapiens
ggctccaccctgcttccagaag

SEQ ID NO: 8168 - DNA, 22 bp, Homo sapiens
ccactgtggaaagcagttcaga

SEQ ID NO: 8169 - DNA, 22 bp, Homo sapiens
tcaccgaggctggagtgcagtg

SEQ ID NO: 8170 - DNA, 22 bp, Homo sapiens
ctggcaggtggaggttgcagtg

SEQ ID NO: 8171 - DNA, 22 bp, Homo sapiens
tgggaagggtcaacagctggaa

SEQ ID NO: 8172 - DNA, 22 bp, Homo sapiens
gggacatctttctagtcagggt

SEQ ID NO: 8173 - DNA, 23 bp, Homo sapiens
ccaagactgttaggagtggggag

SEQ ID NO: 8174 - DNA, 22 bp, Homo sapiens
ggtgggagagctctgtctccag

SEQ ID NO: 8175 - DNA, 22 bp, Homo sapiens
tggcacgacaattggcaccaat

SEQ ID NO: 8176 - DNA, 22 bp, Homo sapiens
gaggggcacagtaaagggtccc

SEQ ID NO: 8177 - DNA, 22 bp, Homo sapiens
cgagcatgatgacggctgtggc

SEQ ID NO: 8178 - DNA, 22 bp, Homo sapiens
tgggggagctcagtccagccca

SEQ ID NO: 8179 - DNA, 22 bp, Homo sapiens
cacatgaaggctggggtcgtga

SEQ ID NO: 8180 - DNA, 22 bp, Homo sapiens
tctcgacagcctggcacagtgg

SEQ ID NO: 8181 - DNA, 22 bp, Homo sapiens
gggcaggggtcagtggccccaa

SEQ ID NO: 8182 - DNA, 22 bp, Homo sapiens
gactggaaagcctgtcctcaga

SEQ ID NO: 8183 - DNA, 17 bp, Homo sapiens
tactgaggggtctggag

SEQ ID NO: 8184 - DNA, 22 bp, Homo sapiens
ggtgggagagcttgctttgatg

SEQ ID NO: 8185 - DNA, 22 bp, Homo sapiens
ggagaagaggagctggaagcct

SEQ ID NO: 8186 - DNA, 22 bp, Homo sapiens
cagggccagggacacgctgtca

SEQ ID NO: 8187 - DNA, 22 bp, Homo sapiens
ggggcaggagcccttcttcagc

SEQ ID NO: 8188 - DNA, 22 bp, Homo sapiens
gacggagctggttgctgcggct

SEQ ID NO: 8189 - DNA, 22 bp, Homo sapiens
ggtgggaggactgtttgaggca

SEQ ID NO: 8190 - DNA, 22 bp, Homo sapiens
cccccggttcctgtttgcagag

SEQ ID NO: 8191 - DNA, 22 bp, Homo sapiens
gagggagggactagcattctct

SEQ ID NO: 8192 - DNA, 22 bp, Homo sapiens
ggctgtggcagctggaagtggt

SEQ ID NO: 8193 - DNA, 22 bp, Homo sapiens
agctgccgatgcccagctgcat

SEQ ID NO: 8194 - DNA, 22 bp, Homo sapiens
actgcaacctccacctcctggg

SEQ ID NO: 8195 - DNA, 19 bp, Homo sapiens
agggaatccggctgaggga

SEQ ID NO: 8196 - DNA, 22 bp, Homo sapiens
ggtgggagccaacacccttctg

SEQ ID NO: 8197 - DNA, 22 bp, Homo sapiens
cccagcgagtttgccggtgaac

SEQ ID NO: 8198 - DNA, 22 bp, Homo sapiens
ggtggcagtagcactgggcctg

SEQ ID NO: 8199 - DNA, 22 bp, Homo sapiens
tttgtggcaggagcggagaccg

SEQ ID NO: 8200 - DNA, 19 bp, Homo sapiens
ctgctgccggagactcgtc

SEQ ID NO: 8201 - DNA, 22 bp, Homo sapiens
catgcaggcgcaacttctacaa

SEQ ID NO: 8202 - DNA, 22 bp, Homo sapiens
gggagctgagctggaagagaat

SEQ ID NO: 8203 - DNA, 22 bp, Homo sapiens
ctggcaggagcattcacagagg

SEQ ID NO: 8204 - DNA, 22 bp, Homo sapiens
agagggtgggcacgtgatggat

SEQ ID NO: 8205 - DNA, 22 bp, Homo sapiens
tgggaggccaaggcaggcggat

SEQ ID NO: 8206 - DNA, 22 bp, Homo sapiens
gggactggagtagaggccggtg

SEQ ID NO: 8207 - DNA, 22 bp, Homo sapiens
gagcactgagctggaattggag

SEQ ID NO: 8208 - DNA, 22 bp, Homo sapiens
agggccagcactcctggcagga

SEQ ID NO: 8209 - DNA, 22 bp, Homo sapiens
ggaggtgggctaaggactctct

SEQ ID NO: 8210 - DNA, 22 bp, Homo sapiens
gctgcagggagctggaaggctc

SEQ ID NO: 8211 - DNA, 22 bp, Homo sapiens
ctccttctgggcctggcagtgg

SEQ ID NO: 8212 - DNA, 22 bp, Homo sapiens
gaggtgggtgtatcacaggtca

SEQ ID NO: 8213 - DNA, 22 bp, Homo sapiens
ctcattgcccagatccccacag

SEQ ID NO: 8214 - DNA, 22 bp, Homo sapiens
tcctcagcttttatttcacttg

SEQ ID NO: 8215 - DNA, 19 bp, Homo sapiens
gttggcactgaaaatggct

SEQ ID NO: 8216 - DNA, 22 bp, Homo sapiens
gaagctgagctgaggcatgttg

SEQ ID NO: 8217 - DNA, 22 bp, Homo sapiens
agctggtgctcggggagctggc

SEQ ID NO: 8218 - DNA, 22 bp, Homo sapiens
tcactggaaagacagcactctt

SEQ ID NO: 8219 - DNA, 22 bp, Homo sapiens
tgtgggagaaggaagcaagctg

SEQ ID NO: 8220 - DNA, 19 bp, Homo sapiens
ggcatggggtccggggacc

SEQ ID NO: 8221 - DNA, 22 bp, Homo sapiens
ctaggctggagtgcagtggcac

SEQ ID NO: 8222 - DNA, 22 bp, Homo sapiens
cctcttctaggacgtccttgtg

SEQ ID NO: 8223 - DNA, 22 bp, Homo sapiens
gctgctgggatcctgggtctca

SEQ ID NO: 8224 - DNA, 21 bp, Homo sapiens
gggcagaggggcctcctgggt

SEQ ID NO: 8225 - DNA, 22 bp, Homo sapiens
aactgaggtatctgctgtgttt

SEQ ID NO: 8226 - DNA, 22 bp, Homo sapiens
ggggtggatttcaggcggtgtc

SEQ ID NO: 8227 - DNA, 22 bp, Homo sapiens
tgtctcatctcttaaccccact

SEQ ID NO: 8228 - DNA, 22 bp, Homo sapiens
cgggcaaggcgagactaggccc

SEQ ID NO: 8229 - DNA, 22 bp, Homo sapiens
tcactgcaacctccacctcctg

SEQ ID NO: 8230 - DNA, 22 bp, Homo sapiens
aggagatggagctcagtgggca

SEQ ID NO: 8231 - DNA, 22 bp, Homo sapiens
tcagtgttaatcagtggtacct

SEQ ID NO: 8232 - DNA, 22 bp, Homo sapiens
tgctggtaccgcgcctccgcca

SEQ ID NO: 8233 - DNA, 22 bp, Homo sapiens
ttaggctgttcttgtgttgtta

SEQ ID NO: 8234 - DNA, 22 bp, Homo sapiens
tgggaggccgaggcaggtggat

SEQ ID NO: 8235 - DNA, 22 bp, Homo sapiens
tgagcttgcagtgccagccttg

SEQ ID NO: 8236 - DNA, 22 bp, Homo sapiens
tgggactcactcttttggccag

SEQ ID NO: 8237 - DNA, 22 bp, Homo sapiens
cagtggcgtgatctctgctcac

SEQ ID NO: 8238 - DNA, 22 bp, Homo sapiens
agtgaggggcagctgagtgggc

SEQ ID NO: 8239 - DNA, 22 bp, Homo sapiens
gcgggccaccttggagagcgct

SEQ ID NO: 8240 - DNA, 22 bp, Homo sapiens
ggaggctgaggcaggcggatca

SEQ ID NO: 8241 - DNA, 22 bp, Homo sapiens
tctcgtgcaggccttgctcgga

SEQ ID NO: 8242 - DNA, 22 bp, Homo sapiens
ggctcactgcaacttccgcctc

SEQ ID NO: 8243 - DNA, 22 bp, Homo sapiens
tggaatggaaacaaactgagga

SEQ ID NO: 8244 - DNA, 22 bp, Homo sapiens
gggaggttgaggctgcagtgag

SEQ ID NO: 8245 - DNA, 17 bp, Homo sapiens
gggcagggactcctggg

SEQ ID NO: 8246 - DNA, 22 bp, Homo sapiens
tggaagggagctggaatttgga

SEQ ID NO: 8247 - DNA, 22 bp, Homo sapiens
acacccaggctggcgtgcagtg

SEQ ID NO: 8248 - DNA, 22 bp, Homo sapiens
ttatttaaaagtggtaagattc

SEQ ID NO: 8249 - DNA, 22 bp, Homo sapiens
aaccaccattctctcctcttcc

SEQ ID NO: 8250 - DNA, 22 bp, Homo sapiens
aggaggaagggaagacaagtaa

SEQ ID NO: 8251 - DNA, 22 bp, Homo sapiens
gagctcattcattcattgcctg

SEQ ID NO: 8252 - DNA, 22 bp, Homo sapiens
ggaggtggaggttgcagtgagc

SEQ ID NO: 8253 - DNA, 22 bp, Homo sapiens
agtgcaggccccaggccaggcc

SEQ ID NO: 8254 - DNA, 22 bp, Homo sapiens
cctggcaggtggcgccctcggc

SEQ ID NO: 8255 - DNA, 19 bp, Homo sapiens
agggttacccgctgccacc

SEQ ID NO: 8256 - DNA, 22 bp, Homo sapiens
gggcggggtggctcatgcctgt

SEQ ID NO: 8257 - DNA, 22 bp, Homo sapiens
ctgggaggcggagcttgcagtg

SEQ ID NO: 8258 - DNA, 22 bp, Homo sapiens
gtggtgtaggtcacagttagga

SEQ ID NO: 8259 - DNA, 22 bp, Homo sapiens
ggaggggatttagtagatgcta

SEQ ID NO: 8260 - DNA, 22 bp, Homo sapiens
ctggctggagtgcaggtgagtg

SEQ ID NO: 8261 - DNA, 22 bp, Homo sapiens
gaagagctgacagtgtcatcct

SEQ ID NO: 8262 - DNA, 22 bp, Homo sapiens
ggcagggcaggaaagtcaggaa

SEQ ID NO: 8263 - DNA, 22 bp, Homo sapiens
taagaaatttagttatagaatg

SEQ ID NO: 8264 - DNA, 22 bp, Homo sapiens
ggggtgggcgtgcagggacacc

SEQ ID NO: 8265 - DNA, 22 bp, Homo sapiens
agacagggtgatcgcttgagcc

SEQ ID NO: 8266 - DNA, 23 bp, Homo sapiens
tcggtgggcgtggaggccgaggc

SEQ ID NO: 8267 - DNA, 22 bp, Homo sapiens
aaagagccgctgatgtcagccc

SEQ ID NO: 8268 - DNA, 18 bp, Homo sapiens
gaggatggaaggagatgc

SEQ ID NO: 8269 - DNA, 22 bp, Homo sapiens
tctggtgtcagtattctttgaa

SEQ ID NO: 8270 - DNA, 22 bp, Homo sapiens
gcggcggagacagcaggaagcc

SEQ ID NO: 8271 - DNA, 22 bp, Homo sapiens
gggagctggagctggaagactc

SEQ ID NO: 8272 - DNA, 22 bp, Homo sapiens
gtcactgtatccaggttccagc

SEQ ID NO: 8273 - DNA, 22 bp, Homo sapiens
cactgcaacctccacctcctgg

SEQ ID NO: 8274 - DNA, 23 bp, Homo sapiens
tgagctgggcctgcaggggtctc

SEQ ID NO: 8275 - DNA, 22 bp, Homo sapiens
ggaatcctgccagctctgcccc

SEQ ID NO: 8276 - DNA, 22 bp, Homo sapiens
gctggcaaggtgctggagggcc

SEQ ID NO: 8277 - DNA, 23 bp, Homo sapiens
ggagtgcaatggcgccatctcgg

SEQ ID NO: 8278 - DNA, 22 bp, Homo sapiens
tggtaaggttccagatctagaa

SEQ ID NO: 8279 - DNA, 22 bp, Homo sapiens
agaggccggccgagcccatggg

SEQ ID NO: 8280 - DNA, 22 bp, Homo sapiens
aacagtgtttttcttcagcact

SEQ ID NO: 8281 - DNA, 22 bp, Homo sapiens
gttgagtgggttaggatgctga

SEQ ID NO: 8282 - DNA, 22 bp, Homo sapiens
gaggtgggcggatcacaaggtc

SEQ ID NO: 8283 - DNA, 22 bp, Homo sapiens
gcaactgaacatgtgtgtggcc

SEQ ID NO: 8284 - DNA, 22 bp, Homo sapiens
gagctgggcctgcgagtgctgc

SEQ ID NO: 8285 - DNA, 22 bp, Homo sapiens
ctggcaggttatagagctgccc

SEQ ID NO: 8286 - DNA, 22 bp, Homo sapiens
gagcactgatttatttttgtct

SEQ ID NO: 8287 - DNA, 22 bp, Homo sapiens
tttaaaaaactagtctgagtct

SEQ ID NO: 8288 - DNA, 22 bp, Homo sapiens
ctcattgcaacctccgcctccc

SEQ ID NO: 8289 - DNA, 22 bp, Homo sapiens
tatgcaggattatctactacca

SEQ ID NO: 8290 - DNA, 22 bp, Homo sapiens
ctgggaggtggaggttgcattg

SEQ ID NO: 8291 - DNA, 22 bp, Homo sapiens
cggagtcttgctatgttgccca

SEQ ID NO: 8292 - DNA, 22 bp, Homo sapiens
tcactgcaacctccacctcccg

SEQ ID NO: 8293 - DNA, 21 bp, Homo sapiens
cagagctgtccaaaccctgac

SEQ ID NO: 8294 - DNA, 22 bp, Homo sapiens
acccatccagtgtccctgctag

SEQ ID NO: 8295 - DNA, 21 bp, Homo sapiens
ggtgacacgtggccccgctct

SEQ ID NO: 8296 - DNA, 22 bp, Homo sapiens
cacagctgaagtagccatgtgg

SEQ ID NO: 8297 - DNA, 22 bp, Homo sapiens
cagagctgtccaaaccctgaca

SEQ ID NO: 8298 - DNA, 22 bp, Homo sapiens
cactgcactccagcctgggcaa

SEQ ID NO: 8299 - DNA, 22 bp, Homo sapiens
cactgcacttcagcctgggtga

SEQ ID NO: 8300 - DNA, 22 bp, Homo sapiens
ctgggatccacgggctcccaag

SEQ ID NO: 8301 - DNA, 22 bp, Homo sapiens
agctggggctgtggttgtgatt

SEQ ID NO: 8302 - DNA, 22 bp, Homo sapiens
cagagctggtgtgtcctggcat

SEQ ID NO: 8303 - DNA, 22 bp, Homo sapiens
ctgggctagaaggaccaggatg

SEQ ID NO: 8304 - DNA, 22 bp, Homo sapiens
gggcccctgggaattctgtgat

SEQ ID NO: 8305 - DNA, 22 bp, Homo sapiens
gccctgtgcaggtgtgcagcag

SEQ ID NO: 8306 - DNA, 22 bp, Homo sapiens
agcctgggccctgcctcttctc

SEQ ID NO: 8307 - DNA, 22 bp, Homo sapiens
cactgcactccagcttgggtga

SEQ ID NO: 8308 - DNA, 22 bp, Homo sapiens
cctggggtcacttgcagccgca

SEQ ID NO: 8309 - DNA, 22 bp, Homo sapiens
gagctgggcctgcgagtgctgc

SEQ ID NO: 8310 - DNA, 22 bp, Homo sapiens
cactgcactccatcctgggaaa

SEQ ID NO: 8311 - DNA, 22 bp, Homo sapiens
cactgcactccagcctgggtca

SEQ ID NO: 8312 - DNA, 22 bp, Homo sapiens
cactgcactccagcctgggaga

SEQ ID NO: 8313 - DNA, 22 bp, Homo sapiens
gcagagctcatgcctgcacctc

SEQ ID NO: 8314 - DNA, 22 bp, Homo sapiens
cactgcactccagcctgggtga

SEQ ID NO: 8315 - DNA, 22 bp, Homo sapiens
gcaccgagaaggaagcatgcct

SEQ ID NO: 8316 - DNA, 22 bp, Homo sapiens
agagctgggtggacttgtagtt

SEQ ID NO: 8317 - DNA, 22 bp, Homo sapiens
ccctgtgggaactcctgagttg

SEQ ID NO: 8318 - DNA, 22 bp, Homo sapiens
caccaggctggagtgcagtggc

SEQ ID NO: 8319 - DNA, 22 bp, Homo sapiens
gcagagctgggatatgaaccca

SEQ ID NO: 8320 - DNA, 21 bp, Homo sapiens
ttctcctaggctgaggcggga

SEQ ID NO: 8321 - DNA, 16 bp, Homo sapiens
tgggtgggaggagcgg

SEQ ID NO: 8322 - DNA, 22 bp, Homo sapiens
cacatgaaggctggggtcgtga

SEQ ID NO: 8323 - DNA, 22 bp, Homo sapiens
tccttaggcaatttgggagagt

SEQ ID NO: 8324 - DNA, 22 bp, Homo sapiens
agtatgtcagagtgaaaatggt

SEQ ID NO: 8325 - DNA, 22 bp, Homo sapiens
cccaggaggcagagatagcagt

SEQ ID NO: 8326 - DNA, 22 bp, Homo sapiens
taacatttaaatttttcacata

SEQ ID NO: 8327 - DNA, 22 bp, Homo sapiens
tttattctgtgctacatgaaga

SEQ ID NO: 8328 - DNA, 22 bp, Homo sapiens
atacaaaatatatactggagac

SEQ ID NO: 8329 - DNA, 22 bp, Homo sapiens
tgggaggccaaggcaggcggat

SEQ ID NO: 8330 - DNA, 22 bp, Homo sapiens
atcctttcatctggtaatatat

SEQ ID NO: 8331 - DNA, 22 bp, Homo sapiens
cgagtgtccctaccatttccta

SEQ ID NO: 8332 - DNA, 22 bp, Homo sapiens
gccctgggcaaggttctggcca

SEQ ID NO: 8333 - DNA, 22 bp, Homo sapiens
gtggagggtgattgccggctgt

SEQ ID NO: 8334 - DNA, 22 bp, Homo sapiens
aagtctctcacatatctggtcc

SEQ ID NO: 8335 - DNA, 22 bp, Homo sapiens
gtatgtctatagtttttaaata

SEQ ID NO: 8336 - DNA, 22 bp, Homo sapiens
cccagctcttcaagtcaccccc

SEQ ID NO: 8337 - DNA, 22 bp, Homo sapiens
tacctcaagttccaggaaagcg

SEQ ID NO: 8338 - DNA, 22 bp, Homo sapiens
cctgggccctcaccgccggtgg

SEQ ID NO: 8339 - DNA, 22 bp, Homo sapiens
tgatttcaagccagggggcgtt

SEQ ID NO: 8340 - DNA, 22 bp, Homo sapiens
gcaggagaacaaagcaagctgc

SEQ ID NO: 8341 - DNA, 22 bp, Homo sapiens
ttatttttaaaagttcacacag

SEQ ID NO: 8342 - DNA, 22 bp, Homo sapiens
ggctgggcaggtctgcacaggg

SEQ ID NO: 8343 - DNA, 23 bp, Homo sapiens
ctggggctttcaaatctgggcag

SEQ ID NO: 8344 - DNA, 22 bp, Homo sapiens
ctaccgggttctcagccaggca

SEQ ID NO: 8345 - DNA, 22 bp, Homo sapiens
ttggaagttgatttaaaaagga

SEQ ID NO: 8346 - DNA, 22 bp, Homo sapiens
tttaaaaaactagtctgagtct

SEQ ID NO: 8347 - DNA, 20 bp, Homo sapiens
aggccccaggtggacactag

SEQ ID NO: 8348 - DNA, 22 bp, Homo sapiens
ctagttctagatccctgaggaa

SEQ ID NO: 8349 - DNA, 22 bp, Homo sapiens
gggagctgagctggaagagaat

SEQ ID NO: 8350 - DNA, 22 bp, Homo sapiens
cactgcactccagcttgggtga

SEQ ID NO: 8351 - DNA, 22 bp, Homo sapiens
agctgattccactttttcccca

SEQ ID NO: 8352 - DNA, 22 bp, Homo sapiens
atgaggcaggtggaggctgcca

SEQ ID NO: 8353 - DNA, 19 bp, Homo sapiens
catggtgaaaccccgtctc

SEQ ID NO: 8354 - DNA, 22 bp, Homo sapiens
tactttaatatatgtgaagttc

SEQ ID NO: 8355 - DNA, 22 bp, Homo sapiens
ctgggggcagcaagaagccatg

SEQ ID NO: 8356 - DNA, 22 bp, Homo sapiens
actgtgaacggactgaagccca

SEQ ID NO: 8357 - DNA, 22 bp, Homo sapiens
tcagtttttctatactttgtag

SEQ ID NO: 8358 - DNA, 22 bp, Homo sapiens
cccagcgagtttgccggtgaac

SEQ ID NO: 8359 - DNA, 22 bp, Homo sapiens
gtagagttgagtagtggtaaca

SEQ ID NO: 8360 - DNA, 21 bp, Homo sapiens
agtagtttagcacagggtttg

SEQ ID NO: 8361 - DNA, 22 bp, Homo sapiens
tgaggcaggaggttgagaactg

SEQ ID NO: 8362 - DNA, 22 bp, Homo sapiens
gcctcctgtcccaggctgagga

SEQ ID NO: 8363 - DNA, 22 bp, Homo sapiens
ctctgtggtggagtgggtcacc

SEQ ID NO: 8364 - DNA, 22 bp, Homo sapiens
ttcataaacaaattaaggcctg

SEQ ID NO: 8365 - DNA, 22 bp, Homo sapiens
caagggctcaaacggtggttgc

SEQ ID NO: 8366 - DNA, 22 bp, Homo sapiens
ggctgggcctctccctcagctg

SEQ ID NO: 8367 - DNA, 22 bp, Homo sapiens
atatacacatctttttaaatat

SEQ ID NO: 8368 - DNA, 22 bp, Homo sapiens
ttaggcaattttgtcattgtgt

SEQ ID NO: 8369 - DNA, 22 bp, Homo sapiens
atgccactgcgctccagcctgg

SEQ ID NO: 8370 - DNA, 22 bp, Homo sapiens
tcagggctgcagaagaggcagg

SEQ ID NO: 8371 - DNA, 22 bp, Homo sapiens
tgccgcagtgcggggagggccc

SEQ ID NO: 8372 - DNA, 22 bp, Homo sapiens
ttttaagttggattgctaagta

SEQ ID NO: 8373 - DNA, 20 bp, Homo sapiens
gtctccactgggggttaacc

SEQ ID NO: 8374 - DNA, 17 bp, Homo sapiens
gggcagggactcctggg

SEQ ID NO: 8375 - DNA, 22 bp, Homo sapiens
cggtcaggtgcagcgttggcac

SEQ ID NO: 8376 - DNA, 22 bp, Homo sapiens
cagtggaggccttgggaccttt

SEQ ID NO: 8377 - DNA, 22 bp, Homo sapiens
acacttggagcaacacttatgg

SEQ ID NO: 8378 - DNA, 22 bp, Homo sapiens
tatttcttttcgtgacttattg

SEQ ID NO: 8379 - DNA, 23 bp, Homo sapiens
cttcacaggttcaggggattaag

SEQ ID NO: 8380 - DNA, 20 bp, Homo sapiens
gctgaggggtctatggcata

SEQ ID NO: 8381 - DNA, 22 bp, Homo sapiens
agcccaggagtttgaggctgtg

SEQ ID NO: 8382 - DNA, 22 bp, Homo sapiens
gtgggccactgggaggcaaggg

SEQ ID NO: 8383 - DNA, 22 bp, Homo sapiens
cccaggaggcggaggttgcagt

SEQ ID NO: 8384 - DNA, 22 bp, Homo sapiens
ctatacagcagcttactagtta

SEQ ID NO: 8385 - DNA, 22 bp, Homo sapiens
tggtatgaccgtggtgcaagca

SEQ ID NO: 8386 - DNA, 22 bp, Homo sapiens
taattcttcaggccttttgtct

SEQ ID NO: 8387 - DNA, 22 bp, Homo sapiens
aagaggagaaaggctggctttg

SEQ ID NO: 8388 - DNA, 22 bp, Homo sapiens
cccagggaggcccaggctctgc

SEQ ID NO: 8389 - DNA, 22 bp, Homo sapiens
cagtctctaaatcaatctgaat

SEQ ID NO: 8390 - DNA, 22 bp, Homo sapiens
ttatagcagcatgatttataat

SEQ ID NO: 8391 - DNA, 22 bp, Homo sapiens
actctccttttgatcttcagaa

SEQ ID NO: 8392 - DNA, 22 bp, Homo sapiens
ggctgtggcagctggaagtggt

SEQ ID NO: 8393 - DNA, 19 bp, Homo sapiens
tctgaagaattagagagca

SEQ ID NO: 8394 - DNA, 22 bp, Homo sapiens
aaatgcacaaagattttgcact

SEQ ID NO: 8395 - DNA, 22 bp, Homo sapiens
tgcttacgagctattttcactt

SEQ ID NO: 8396 - DNA, 22 bp, Homo sapiens
tccattatacttctgattcaaa

SEQ ID NO: 8397 - DNA, 23 bp, Homo sapiens
gcagaggagcaagctggacacca

SEQ ID NO: 8398 - DNA, 22 bp, Homo sapiens
ttttctaacatctagtaatttg

SEQ ID NO: 8399 - DNA, 22 bp, Homo sapiens
tctttcttgtgggtgccctttt

SEQ ID NO: 8400 - DNA, 22 bp, Homo sapiens
actgcactcctgcctgggtaac

SEQ ID NO: 8401 - DNA, 22 bp, Homo sapiens
agccagggacgctgcaggctac

SEQ ID NO: 8402 - DNA, 22 bp, Homo sapiens
aggctatttccactcttctcat

SEQ ID NO: 8403 - DNA, 22 bp, Homo sapiens
gactttgtgccaaacgccagaa

SEQ ID NO: 8404 - DNA, 22 bp, Homo sapiens
cccatgcaccctctaagaagga

SEQ ID NO: 8405 - DNA, 22 bp, Homo sapiens
tgaggcaggacttgcataaagt

SEQ ID NO: 8406 - DNA, 22 bp, Homo sapiens
ggagatatttgtattctgtctc

SEQ ID NO: 8407 - DNA, 22 bp, Homo sapiens
aagggaatgttgtggttggttt

SEQ ID NO: 8408 - DNA, 22 bp, Homo sapiens
ttcagtttcaagtccctctggg

SEQ ID NO: 8409 - DNA, 22 bp, Homo sapiens
tccttgtaaaggagctctaaca

SEQ ID NO: 8410 - DNA, 22 bp, Homo sapiens
atgccactgcactccagcctgg

SEQ ID NO: 8411 - DNA, 22 bp, Homo sapiens
gggaggcagtgctggaggctgg

SEQ ID NO: 8412 - DNA, 22 bp, Homo sapiens
gagtctctgaccagggtgccaa

SEQ ID NO: 8413 - DNA, 22 bp, Homo sapiens
tagcagcaaagcaggatctgct

SEQ ID NO: 8414 - DNA, 22 bp, Homo sapiens
atcacaaaggtctcagagcaca

SEQ ID NO: 8415 - DNA, 22 bp, Homo sapiens
tgggggctttatgtaatgcaca

SEQ ID NO: 8416 - DNA, 22 bp, Homo sapiens
ggagggcagagtcccctgctga

SEQ ID NO: 8417 - DNA, 22 bp, Homo sapiens
aaaacctcagttctgctcttaa

SEQ ID NO: 8418 - DNA, 22 bp, Homo sapiens
gaactttataactgtaaatgtc

SEQ ID NO: 8419 - DNA, 22 bp, Homo sapiens
aaaagcaattgcagttcttgcc

SEQ ID NO: 8420 - DNA, 22 bp, Homo sapiens
gacaatatagttgaatgagcaa

SEQ ID NO: 8421 - DNA, 22 bp, Homo sapiens
agcgctgtgggcgtgcgaggag

SEQ ID NO: 8422 - DNA, 22 bp, Homo sapiens
tgaggcaggaggattgcaggat

SEQ ID NO: 8423 - DNA, 22 bp, Homo sapiens
cccaggaggtggagttcacagt

SEQ ID NO: 8424 - DNA, 22 bp, Homo sapiens
ttatagcagcatgatttatagt

SEQ ID NO: 8425 - DNA, 22 bp, Homo sapiens
gcccaggagttcaagtctagtg

SEQ ID NO: 8426 - DNA, 21 bp, Homo sapiens
tcagtggctcctggtgacgtc

SEQ ID NO: 8427 - DNA, 22 bp, Homo sapiens
agtaatcaatttttcggtggat

SEQ ID NO: 8428 - DNA, 18 bp, Homo sapiens
ccctcttgcacaaagcaa

SEQ ID NO: 8429 - DNA, 22 bp, Homo sapiens
gagccaggaggcagagactgca

SEQ ID NO: 8430 - DNA, 22 bp, Homo sapiens
tagatgtgttgcctggagttgt

SEQ ID NO: 8431 - DNA, 21 bp, Homo sapiens
tcgacctgctgggctcgggct

SEQ ID NO: 8432 - DNA, 22 bp, Homo sapiens
gccagatttacagatttgccct

SEQ ID NO: 8433 - DNA, 22 bp, Homo sapiens
atggggctgttctctgccctgc

SEQ ID NO: 8434 - DNA, 22 bp, Homo sapiens
aggtggcagatgggggtgctcg

SEQ ID NO: 8435 - DNA, 22 bp, Homo sapiens
cccaggagttggaggctgcagt

SEQ ID NO: 8436 - DNA, 22 bp, Homo sapiens
cccaggaggcagatgttgcagt

SEQ ID NO: 8437 - DNA, 22 bp, Homo sapiens
ggctgggctccgggagcatgcg

SEQ ID NO: 8438 - DNA, 22 bp, Homo sapiens
ggagcagggaattacagcgcag

SEQ ID NO: 8439 - DNA, 22 bp, Homo sapiens
gtgggctgcccttgaggtcagc

SEQ ID NO: 8440 - DNA, 22 bp, Homo sapiens
cttcagctgcagttatgtttag

SEQ ID NO: 8441 - DNA, 22 bp, Homo sapiens
tcaggggcttgaggtgcatgtc

SEQ ID NO: 8442 - DNA, 21 bp, Homo sapiens
ggagtttttctggaagggact

SEQ ID NO: 8443 - DNA, 22 bp, Homo sapiens
ctgggctagaaggaccaggatg

SEQ ID NO: 8444 - DNA, 22 bp, Homo sapiens
actgcactccagcctcggggtc

SEQ ID NO: 8445 - DNA, 22 bp, Homo sapiens
gagccaggttggaggctgcagt

SEQ ID NO: 8446 - DNA, 22 bp, Homo sapiens
catgcggctctttccaaaccgg

SEQ ID NO: 8447 - DNA, 22 bp, Homo sapiens
ttcttttaattgtgggggagtg

SEQ ID NO: 8448 - DNA, 22 bp, Homo sapiens
ttaagtgcaaaaatgaaagtat

SEQ ID NO: 8449 - DNA, 22 bp, Homo sapiens
agcactgatttaaactggattt

SEQ ID NO: 8450 - DNA, 22 bp, Homo sapiens
acaggggcaagggctcacggcc

SEQ ID NO: 8451 - DNA, 22 bp, Homo sapiens
tggagaagattggtcaccattc

SEQ ID NO: 8452 - DNA, 22 bp, Homo sapiens
aggtggggaggagtgtctcttt

SEQ ID NO: 8453 - DNA, 22 bp, Homo sapiens
caggagtccatctggcctggtg

SEQ ID NO: 8454 - DNA, 22 bp, Homo sapiens
agagttgctccattagaactta

SEQ ID NO: 8455 - DNA, 22 bp, Homo sapiens
agaaaacataggagacaggaaa

SEQ ID NO: 8456 - DNA, 22 bp, Homo sapiens
atatatttgagaatattcatga

SEQ ID NO: 8457 - DNA, 22 bp, Homo sapiens
tacaaaggaggtgcatagaaca

SEQ ID NO: 8458 - DNA, 22 bp, Homo sapiens
cactgggcgtgtcctgggtgag

SEQ ID NO: 8459 - DNA, 22 bp, Homo sapiens
ccagaggtgctctttggaagtg

SEQ ID NO: 8460 - DNA, 18 bp, Homo sapiens
actctttctgcccacagg

SEQ ID NO: 8461 - DNA, 22 bp, Homo sapiens
gttactcctggttgagcttggt

SEQ ID NO: 8462 - DNA, 22 bp, Homo sapiens
gagcaggaaggccagaagggtc

SEQ ID NO: 8463 - DNA, 22 bp, Homo sapiens
tttgtcttatccaatctctcag

SEQ ID NO: 8464 - DNA, 22 bp, Homo sapiens
tgatatgtaactactccttata

SEQ ID NO: 8465 - DNA, 22 bp, Homo sapiens
cctgggctctgtcagaattggg

SEQ ID NO: 8466 - DNA, 22 bp, Homo sapiens
gcaaacaaggacatacatcctg

SEQ ID NO: 8467 - DNA, 22 bp, Homo sapiens
ccagatgtccctctcaggtttg

SEQ ID NO: 8468 - DNA, 22 bp, Homo sapiens
ggagagcttggagtgcgatttt

SEQ ID NO: 8469 - DNA, 22 bp, Homo sapiens
cggcatgggcgtccccctcact

SEQ ID NO: 8470 - DNA, 22 bp, Homo sapiens
gagtagaactggttatctaata

SEQ ID NO: 8471 - DNA, 22 bp, Homo sapiens
aaaagcaattgcgggttttgcc

SEQ ID NO: 8472 - DNA, 22 bp, Homo sapiens
acaaacagagttgaaaaatagg

SEQ ID NO: 8473 - DNA, 22 bp, Homo sapiens
aggcaggaggatcatggatgca

SEQ ID NO: 8474 - DNA, 22 bp, Homo sapiens
acatacttctttacattccata

SEQ ID NO: 8475 - DNA, 22 bp, Homo sapiens
caggctggagtgcagtggtgcc

SEQ ID NO: 8476 - DNA, 22 bp, Homo sapiens
accctcaacaaattcactctat

SEQ ID NO: 8477 - DNA, 22 bp, Homo sapiens
caggaggattgcttgaggccag

SEQ ID NO: 8478 - DNA, 22 bp, Homo sapiens
gggcctcaggttctggagaagg

SEQ ID NO: 8479 - DNA, 22 bp, Homo sapiens
tctgttttgcataatgttcttt

SEQ ID NO: 8480 - DNA, 22 bp, Homo sapiens
atgccactgcactccagcctag

SEQ ID NO: 8481 - DNA, 22 bp, Homo sapiens
tggacaacatagtgagacctca

SEQ ID NO: 8482 - DNA, 22 bp, Homo sapiens
ctgggcgcgtcccctgaggcgg

SEQ ID NO: 8483 - DNA, 22 bp, Homo sapiens
tactaattgttcacacttgttt

SEQ ID NO: 8484 - DNA, 22 bp, Homo sapiens
tcagttatagatacttttacca

SEQ ID NO: 8485 - DNA, 23 bp, Homo sapiens
gctcatcaggcttagagtcaagg

SEQ ID NO: 8486 - DNA, 22 bp, Homo sapiens
cccaggaggtcaaggctgcagt

SEQ ID NO: 8487 - DNA, 22 bp, Homo sapiens
gtgggccttcaaccctgtctgg

SEQ ID NO: 8488 - DNA, 22 bp, Homo sapiens
ggaggcagaatagagtgtgggt

SEQ ID NO: 8489 - DNA, 22 bp, Homo sapiens
atacaaagtattaatcctggat

SEQ ID NO: 8490 - DNA, 22 bp, Homo sapiens
acatgggcatctatgaggctct

SEQ ID NO: 8491 - DNA, 22 bp, Homo sapiens
gacaggaggcagagctcaggtg

SEQ ID NO: 8492 - DNA, 22 bp, Homo sapiens
actggacagaggaaatatggag

SEQ ID NO: 8493 - DNA, 22 bp, Homo sapiens
tgggagcagttgcatctccagt

SEQ ID NO: 8494 - DNA, 22 bp, Homo sapiens
acatgtttaagtttgttatatg

SEQ ID NO: 8495 - DNA, 22 bp, Homo sapiens
gcccaggctggagtgcagtggc

SEQ ID NO: 8496 - DNA, 22 bp, Homo sapiens
tttggaaattttcatccagaca

SEQ ID NO: 8497 - DNA, 22 bp, Homo sapiens
gcagttaaaaataaaccttcat

SEQ ID NO: 8498 - DNA, 22 bp, Homo sapiens
agcgccactgcactccagcctg

SEQ ID NO: 8499 - DNA, 22 bp, Homo sapiens
tgaatgtgatgctaaacatatg

SEQ ID NO: 8500 - DNA, 22 bp, Homo sapiens
cttcaggggtgttagttttgtg

SEQ ID NO: 8501 - DNA, 22 bp, Homo sapiens
gagccaggtcgggccgcggcga

SEQ ID NO: 8502 - DNA, 22 bp, Homo sapiens
gggctgcatcagcaggacccgg

SEQ ID NO: 8503 - DNA, 23 bp, Homo sapiens
aatatcaaggtgatgttcccaga

SEQ ID NO: 8504 - DNA, 22 bp, Homo sapiens
tgagacgaagtcttgctctgtt

SEQ ID NO: 8505 - DNA, 22 bp, Homo sapiens
aaatgtaagtctttgtttctta

SEQ ID NO: 8506 - DNA, 17 bp, Homo sapiens
cgggcatggagggcagg

SEQ ID NO: 8507 - DNA, 22 bp, Homo sapiens
gttttgaatactactagaactt

SEQ ID NO: 8508 - DNA, 20 bp, Homo sapiens
ggcagagggcctgggagaag

SEQ ID NO: 8509 - DNA, 22 bp, Homo sapiens
atgatccaaagccacaggggca

SEQ ID NO: 8510 - DNA, 22 bp, Homo sapiens
aagatgcggttgaccatggtgt

SEQ ID NO: 8511 - DNA, 23 bp, Homo sapiens
ctatttctcatagttcaggtctt

SEQ ID NO: 8512 - DNA, 22 bp, Homo sapiens
tttcataatactgtacatgaaa

SEQ ID NO: 8513 - DNA, 21 bp, Homo sapiens
cactccacttagaacagggtt

SEQ ID NO: 8514 - DNA, 22 bp, Homo sapiens
tgtgactggttgtcccgctttc

SEQ ID NO: 8515 - DNA, 22 bp, Homo sapiens
gctgcagtgagccaagatcgtg

SEQ ID NO: 8516 - DNA, 22 bp, Homo sapiens
gttgattccggggccatttcaa

SEQ ID NO: 8517 - DNA, 22 bp, Homo sapiens
ggctgagttgagaggattactt

SEQ ID NO: 8518 - DNA, 22 bp, Homo sapiens
ctgtggctctcagaggctgctg

SEQ ID NO: 8519 - DNA, 22 bp, Homo sapiens
gggaggctctgctcagcccccg

SEQ ID NO: 8520 - DNA, 22 bp, Homo sapiens
atgcattgtcaggcaatttcat

SEQ ID NO: 8521 - DNA, 22 bp, Homo sapiens
tgaggcaggtggattacaaggt

SEQ ID NO: 8522 - DNA, 22 bp, Homo sapiens
tgttttaagggtcaactgtcac

SEQ ID NO: 8523 - DNA, 22 bp, Homo sapiens
gagccaggggtcagctccgagg

SEQ ID NO: 8524 - DNA, 22 bp, Homo sapiens
gcacatgagaagctggcgatgc

SEQ ID NO: 8525 - DNA, 22 bp, Homo sapiens
tgatgcctaatatacttcaatt

SEQ ID NO: 8526 - DNA, 22 bp, Homo sapiens
agggccagcactcctggcagga

SEQ ID NO: 8527 - DNA, 22 bp, Homo sapiens
ttgtgttaaggtgcatctagtg

SEQ ID NO: 8528 - DNA, 22 bp, Homo sapiens
cccaggaggcgcaggttgcggt

SEQ ID NO: 8529 - DNA, 22 bp, Homo sapiens
tctcaagcttgttggtatgttt

SEQ ID NO: 8530 - DNA, 22 bp, Homo sapiens
ctgctttgcatagctgccagag

SEQ ID NO: 8531 - DNA, 22 bp, Homo sapiens
ctttttcactgtgtcctcacac

SEQ ID NO: 8532 - DNA, 22 bp, Homo sapiens
ctgggcctggggctgttgagag

SEQ ID NO: 8533 - DNA, 18 bp, Homo sapiens
ggagactaaactgttgac

SEQ ID NO: 8534 - DNA, 22 bp, Homo sapiens
gcaaaagtacagccggatttct

SEQ ID NO: 8535 - DNA, 22 bp, Homo sapiens
cagccccacacggtctagctct

SEQ ID NO: 8536 - DNA, 22 bp, Homo sapiens
atcaggggagctgcgacctcag

SEQ ID NO: 8537 - DNA, 22 bp, Homo sapiens
aagattttcagtgcctaaaaca

SEQ ID NO: 8538 - DNA, 22 bp, Homo sapiens
tgaggctccttgtagagagtgg

SEQ ID NO: 8539 - DNA, 22 bp, Homo sapiens
cctttcctgtgtccttttaagg

SEQ ID NO: 8540 - DNA, 22 bp, Homo sapiens
tgcactactgtgatacacagcc

SEQ ID NO: 8541 - DNA, 22 bp, Homo sapiens
actgcacttcagcctgggtgtc

SEQ ID NO: 8542 - DNA, 22 bp, Homo sapiens
ggcatcgtcctgggcataggga

SEQ ID NO: 8543 - DNA, 22 bp, Homo sapiens
actttcttggtcccatgtttga

SEQ ID NO: 8544 - DNA, 22 bp, Homo sapiens
actttaaaactgatcatcagag

SEQ ID NO: 8545 - DNA, 22 bp, Homo sapiens
tccgggaggcagaggttgcagt

SEQ ID NO: 8546 - DNA, 22 bp, Homo sapiens
ggcccaggctggagtgcagtgg

SEQ ID NO: 8547 - DNA, 22 bp, Homo sapiens
cttgacactgtcactcaggcca

SEQ ID NO: 8548 - DNA, 22 bp, Homo sapiens
actgcaaagggaagccctttct

SEQ ID NO: 8549 - DNA, 16 bp, Homo sapiens
ccacctgcagctctca

SEQ ID NO: 8550 - DNA, 22 bp, Homo sapiens
atgctttctcttagttcattga

SEQ ID NO: 8551 - DNA, 22 bp, Homo sapiens
tgggggctgggatgtcactttc

SEQ ID NO: 8552 - DNA, 22 bp, Homo sapiens
ttgtggttaaccgcacattttt

SEQ ID NO: 8553 - DNA, 22 bp, Homo sapiens
tgcagcaccgtcccactggcta

SEQ ID NO: 8554 - DNA, 20 bp, Homo sapiens
acctcctggcgggcatcctc

SEQ ID NO: 8555 - DNA, 22 bp, Homo sapiens
tggggcacagtctgaatgtttc

SEQ ID NO: 8556 - DNA, 22 bp, Homo sapiens
tacagaagcttttgaaaagatg

SEQ ID NO: 8557 - DNA, 22 bp, Homo sapiens
tgggaggccgaggcaggtggat

SEQ ID NO: 8558 - DNA, 22 bp, Homo sapiens
tgtgggtggcatcgtcctggcc

SEQ ID NO: 8559 - DNA, 22 bp, Homo sapiens
gctgcagggagctggaaggctc

SEQ ID NO: 8560 - DNA, 22 bp, Homo sapiens
gtgcacttgatctagacagatt

SEQ ID NO: 8561 - DNA, 22 bp, Homo sapiens
cccaggaggtggaggctgcagt

SEQ ID NO: 8562 - DNA, 22 bp, Homo sapiens
gcctccggagttgcagtgtctt

SEQ ID NO: 8563 - DNA, 22 bp, Homo sapiens
agccaggatggtctcgatcggc

SEQ ID NO: 8564 - DNA, 22 bp, Homo sapiens
tttcttctatgtgtgatatttt

SEQ ID NO: 8565 - DNA, 22 bp, Homo sapiens
aattttctggtgtgtaatgaag

SEQ ID NO: 8566 - DNA, 22 bp, Homo sapiens
agcccaggctggagtgcagtgg

SEQ ID NO: 8567 - DNA, 19 bp, Homo sapiens
agggaatccggctgaggga

SEQ ID NO: 8568 - DNA, 22 bp, Homo sapiens
tttcttcctgctttgtcccatg

SEQ ID NO: 8569 - DNA, 22 bp, Homo sapiens
gttgcagatgtggaactcgtgc

SEQ ID NO: 8570 - DNA, 22 bp, Homo sapiens
ttgagcccaggaggcctgggtg

SEQ ID NO: 8571 - DNA, 22 bp, Homo sapiens
taggggcaggatcctttgagcc

SEQ ID NO: 8572 - DNA, 22 bp, Homo sapiens
agaggctgcacttgctcatgat

SEQ ID NO: 8573 - DNA, 22 bp, Homo sapiens
gaaaggagagggttaaggagct

SEQ ID NO: 8574 - DNA, 22 bp, Homo sapiens
attttctatgttgtaattgtta

SEQ ID NO: 8575 - DNA, 21 bp, Homo sapiens
tcacgtggtcacatgagcttt

SEQ ID NO: 8576 - DNA, 23 bp, Homo sapiens
tgaggcaggcggatcacgaggtc

SEQ ID NO: 8577 - DNA, 22 bp, Homo sapiens
ggggccttttctgaatgtggaa

SEQ ID NO: 8578 - DNA, 22 bp, Homo sapiens
ttcaatatgatattagctgtgg

SEQ ID NO: 8579 - DNA, 22 bp, Homo sapiens
ttccatatctgttgcatatcat

SEQ ID NO: 8580 - DNA, 22 bp, Homo sapiens
cccattcatcctcgcttccttc

SEQ ID NO: 8581 - DNA, 22 bp, Homo sapiens
gggcctgctgcaggttcaggat

SEQ ID NO: 8582 - DNA, 22 bp, Homo sapiens
tgagcccagagatctgagctat

SEQ ID NO: 8583 - DNA, 22 bp, Homo sapiens
tacaaaaaattgatactgacga

SEQ ID NO: 8584 - DNA, 22 bp, Homo sapiens
tggtggggccagacttcagctc

SEQ ID NO: 8585 - DNA, 22 bp, Homo sapiens
cacagggcttctcatggggtgc

SEQ ID NO: 8586 - DNA, 20 bp, Homo sapiens
aaattactgccacacatttc

SEQ ID NO: 8587 - DNA, 22 bp, Homo sapiens
tacaacaatttccacattagaa

SEQ ID NO: 8588 - DNA, 22 bp, Homo sapiens
taagaaatttagttatagaatg

SEQ ID NO: 8589 - DNA, 22 bp, Homo sapiens
tgagccaggagtttgaggctgt

SEQ ID NO: 8590 - DNA, 22 bp, Homo sapiens
actttatttcctattgcatcca

SEQ ID NO: 8591 - DNA, 22 bp, Homo sapiens
actgcactccagcctgggtgat

SEQ ID NO: 8592 - DNA, 22 bp, Homo sapiens
actgcacttcagcctgggtgac

SEQ ID NO: 8593 - DNA, 22 bp, Homo sapiens
gcctccggagtcacagtgtctt

SEQ ID NO: 8594 - DNA, 22 bp, Homo sapiens
gcccaggctggagtgcagtggt

SEQ ID NO: 8595 - DNA, 23 bp, Homo sapiens
ggggcctgcaccggtctgcgcgg

SEQ ID NO: 8596 - DNA, 22 bp, Homo sapiens
ttctcttttcaccagttgctaa

SEQ ID NO: 8597 - DNA, 22 bp, Homo sapiens
atagaatatgacttttagatcc

SEQ ID NO: 8598 - DNA, 22 bp, Homo sapiens
aggggtgacacatatcagtgca

SEQ ID NO: 8599 - DNA, 22 bp, Homo sapiens
agacagggtgatcgcttgagcc

SEQ ID NO: 8600 - DNA, 22 bp, Homo sapiens
gagagaagggggatatgagcct

SEQ ID NO: 8601 - DNA, 22 bp, Homo sapiens
atctagattaggtataagagct

SEQ ID NO: 8602 - DNA, 22 bp, Homo sapiens
ccagatatcactgccgtgttgt

SEQ ID NO: 8603 - DNA, 22 bp, Homo sapiens
tacttttagcctatttgattct

SEQ ID NO: 8604 - DNA, 22 bp, Homo sapiens
ggggtgggcgtgcagggacacc

SEQ ID NO: 8605 - DNA, 22 bp, Homo sapiens
gtttcaggttggacaacatgcc

SEQ ID NO: 8606 - DNA, 22 bp, Homo sapiens
tggacacaaagatcaaatattg

SEQ ID NO: 8607 - DNA, 22 bp, Homo sapiens
gaggggcacagtaaagggtccc

SEQ ID NO: 8608 - DNA, 22 bp, Homo sapiens
ttacaaagtttaaggtggcact

SEQ ID NO: 8609 - DNA, 22 bp, Homo sapiens
ttttaatactgctattgtagga

SEQ ID NO: 8610 - DNA, 22 bp, Homo sapiens
tgagccagaggaggctgtgtgg

SEQ ID NO: 8611 - DNA, 22 bp, Homo sapiens
gtagttctgcagtgtcacctga

SEQ ID NO: 8612 - DNA, 22 bp, Homo sapiens
ttgcacagaatgacaatatgta

SEQ ID NO: 8613 - DNA, 22 bp, Homo sapiens
gaccagtcattactcatgccct

SEQ ID NO: 8614 - DNA, 22 bp, Homo sapiens
gacggagctggttgctgcggct

SEQ ID NO: 8615 - DNA, 22 bp, Homo sapiens
ttataagactgtagtgagtatt

SEQ ID NO: 8616 - DNA, 22 bp, Homo sapiens
cagagcccctcgtctccaccac

SEQ ID NO: 8617 - DNA, 22 bp, Homo sapiens
tcttcaggtagtgagtggggtg

SEQ ID NO: 8618 - DNA, 22 bp, Homo sapiens
cccaggaggcagaagttgcagt

SEQ ID NO: 8619 - DNA, 22 bp, Homo sapiens
cggtctcccgtgtgtgtgcgct

SEQ ID NO: 8620 - DNA, 22 bp, Homo sapiens
actgcactccagcctgggtgac

SEQ ID NO: 8621 - DNA, 22 bp, Homo sapiens
cccaggaggtcgaagctgcagt

SEQ ID NO: 8622 - DNA, 19 bp, Homo sapiens
ccagagagctaggtacaga

SEQ ID NO: 8623 - DNA, 22 bp, Homo sapiens
tgaggcaggagaatcacatgaa

SEQ ID NO: 8624 - DNA, 19 bp, Homo sapiens
tcctgcccaccagccaggg

SEQ ID NO: 8625 - DNA, 22 bp, Homo sapiens
ccaagggcgcctccgttccccc

SEQ ID NO: 8626 - DNA, 22 bp, Homo sapiens
gctcactgcaacctccacctcc

SEQ ID NO: 8627 - DNA, 22 bp, Homo sapiens
tgaggcaggagttcaggctgcg

SEQ ID NO: 8628 - DNA, 22 bp, Homo sapiens
gggaacagcttgggctctgcca

SEQ ID NO: 8629 - DNA, 22 bp, Homo sapiens
aaatttgtattccttttccgta

SEQ ID NO: 8630 - DNA, 21 bp, Homo sapiens
tggtaggtactggcttcaggc

SEQ ID NO: 8631 - DNA, 22 bp, Homo sapiens
tggcccagtatgtataatctta

SEQ ID NO: 8632 - DNA, 22 bp, Homo sapiens
gaccctgtttctacaaataatt

SEQ ID NO: 8633 - DNA, 22 bp, Homo sapiens
taaaatttgtccctgagtgttg

SEQ ID NO: 8634 - DNA, 22 bp, Homo sapiens
gtcttttgctagccagagagct

SEQ ID NO: 8635 - DNA, 22 bp, Homo sapiens
tccctagtcgcatctgtggaga

SEQ ID NO: 8636 - DNA, 22 bp, Homo sapiens
gggatgcagactacagggctta

SEQ ID NO: 8637 - DNA, 22 bp, Homo sapiens
atgccacttcattccagcctcg

SEQ ID NO: 8638 - DNA, 22 bp, Homo sapiens
ggctctgcttgaggccagcctg

SEQ ID NO: 8639 - DNA, 22 bp, Homo sapiens
atacaaaaattagccgggagta

SEQ ID NO: 8640 - DNA, 22 bp, Homo sapiens
caggctggagttcagtggtgtg

SEQ ID NO: 8641 - DNA, 23 bp, Homo sapiens
cgcccagcctcagtgacctgggc

SEQ ID NO: 8642 - DNA, 23 bp, Homo sapiens
atgggccaagcaagacccatgac

SEQ ID NO: 8643 - DNA, 22 bp, Homo sapiens
ttggggctcaggccgccgatgc

SEQ ID NO: 8644 - DNA, 22 bp, Homo sapiens
ttatatgtttctgtttggaggc

SEQ ID NO: 8645 - DNA, 22 bp, Homo sapiens
ccaggaggttgaggctgcagtg

SEQ ID NO: 8646 - DNA, 19 bp, Homo sapiens
ttttggaaatgtgaacagc

SEQ ID NO: 8647 - DNA, 22 bp, Homo sapiens
gccatgggcaaatgcagagctg

SEQ ID NO: 8648 - DNA, 22 bp, Homo sapiens
actgcactccagcctgggtaac

SEQ ID NO: 8649 - DNA, 22 bp, Homo sapiens
actgcactccaacctgggtgac

SEQ ID NO: 8650 - DNA, 22 bp, Homo sapiens
cccagttttctgattgaagagc

SEQ ID NO: 8651 - DNA, 22 bp, Homo sapiens
cccaggaggcctgcctggccgg

SEQ ID NO: 8652 - DNA, 22 bp, Homo sapiens
tctcatggagtcaggagcagaa

SEQ ID NO: 8653 - DNA, 22 bp, Homo sapiens
ctctggagtgtctggccagggt

SEQ ID NO: 8654 - DNA, 21 bp, Homo sapiens
tttcaagggaccctggggatc

SEQ ID NO: 8655 - DNA, 22 bp, Homo sapiens
gggagaggttacccgagcaact

SEQ ID NO: 8656 - DNA, 22 bp, Homo sapiens
gcccagctgcaccctggtgggt

SEQ ID NO: 8657 - DNA, 22 bp, Homo sapiens
gatttttatataaagtgagaaa

SEQ ID NO: 8658 - DNA, 22 bp, Homo sapiens
ccaggaggtggagattgcagtg

SEQ ID NO: 8659 - DNA, 22 bp, Homo sapiens
cccaggaggtggagcttgcagt

SEQ ID NO: 8660 - DNA, 22 bp, Homo sapiens
cggagtcttgctatgttgccca

SEQ ID NO: 8661 - DNA, 22 bp, Homo sapiens
ctgggcagctgtatcagggagt

SEQ ID NO: 8662 - DNA, 15 bp, Homo sapiens
tggcccacccgttga

SEQ ID NO: 8663 - DNA, 22 bp, Homo sapiens
ggaggtggaggttgcagtgagc

SEQ ID NO: 8664 - DNA, 22 bp, Homo sapiens
agggcactgcaagggttgaagg

SEQ ID NO: 8665 - DNA, 22 bp, Homo sapiens
ttactttaagggtgtcttatta

SEQ ID NO: 8666 - DNA, 19 bp, Homo sapiens
ccctcttgcacaaagcaaa

SEQ ID NO: 8667 - DNA, 22 bp, Homo sapiens
ctttggaacacccagctctgtg

SEQ ID NO: 8668 - DNA, 22 bp, Homo sapiens
atacaaagtattgatcctgagt

SEQ ID NO: 8669 - DNA, 22 bp, Homo sapiens
tgcagcttcactcctgaagcca

SEQ ID NO: 8670 - DNA, 22 bp, Homo sapiens
agggcactctgcagggaccacc

SEQ ID NO: 8671 - DNA, 22 bp, Homo sapiens
cctgggcctctcaaagtgctgg

SEQ ID NO: 8672 - DNA, 22 bp, Homo sapiens
gcccaggaggagaggctgcagt

SEQ ID NO: 8673 - DNA, 22 bp, Homo sapiens
ttatttaatgtgatctgaagag

SEQ ID NO: 8674 - DNA, 22 bp, Homo sapiens
ttagatttacaagcactgttta

SEQ ID NO: 8675 - DNA, 22 bp, Homo sapiens
agagaagagtcttgtcaaatta

SEQ ID NO: 8676 - DNA, 22 bp, Homo sapiens
ataatacatggttgatcttttc

SEQ ID NO: 8677 - DNA, 22 bp, Homo sapiens
tgtagatattaattattccttt

SEQ ID NO: 8678 - DNA, 22 bp, Homo sapiens
cgctgcagaagcgtgttcagga

SEQ ID NO: 8679 - DNA, 22 bp, Homo sapiens
ggacaattcagtgatttgggga

SEQ ID NO: 8680 - DNA, 22 bp, Homo sapiens
gcttccgcgatgtcctaggtgg

SEQ ID NO: 8681 - DNA, 22 bp, Homo sapiens
cccaggctggagtgcagtggcg

SEQ ID NO: 8682 - DNA, 22 bp, Homo sapiens
cagggccagcgtctcgggctat

SEQ ID NO: 8683 - DNA, 22 bp, Homo sapiens
agggtagtacagagagtgtcct

SEQ ID NO: 8684 - DNA, 22 bp, Homo sapiens
gggcaggggtcagtggccccaa

SEQ ID NO: 8685 - DNA, 22 bp, Homo sapiens
acagtcttcagaagggattggg

SEQ ID NO: 8686 - DNA, 22 bp, Homo sapiens
ttattttaccttcctctgagct

SEQ ID NO: 8687 - DNA, 22 bp, Homo sapiens
gtgtaagtatctttgtatcttt

SEQ ID NO: 8688 - DNA, 22 bp, Homo sapiens
aaagcactgcacatatatttgc

SEQ ID NO: 8689 - DNA, 20 bp, Homo sapiens
ttggatgtgcatggccgtgc

SEQ ID NO: 8690 - DNA, 22 bp, Homo sapiens
tgtttcttacgtttttagaggc

SEQ ID NO: 8691 - DNA, 22 bp, Homo sapiens
gcagaggacacaggagggcaag

SEQ ID NO: 8692 - DNA, 22 bp, Homo sapiens
taagtcgtggatgattcttcgg

SEQ ID NO: 8693 - DNA, 22 bp, Homo sapiens
gggctgggattgcttgctgtga

SEQ ID NO: 8694 - DNA, 18 bp, Homo sapiens
agagtatacagacaacaa

SEQ ID NO: 8695 - DNA, 22 bp, Homo sapiens
ctacaaaagtaattgtggtttt

SEQ ID NO: 8696 - DNA, 22 bp, Homo sapiens
aggagggagcttaagccaggca

SEQ ID NO: 8697 - DNA, 22 bp, Homo sapiens
ttaattctgcctttcatgtaac

SEQ ID NO: 8698 - DNA, 22 bp, Homo sapiens
cattctctctacttgttttcaa

SEQ ID NO: 8699 - DNA, 22 bp, Homo sapiens
ccaggcaggcgatggtgcagtg

SEQ ID NO: 8700 - DNA, 22 bp, Homo sapiens
tctgccttctatcttttgtctg

SEQ ID NO: 8701 - DNA, 22 bp, Homo sapiens
aggaaataggaccagacaaagc

SEQ ID NO: 8702 - DNA, 22 bp, Homo sapiens
ggctgcaggttggttggcagct

SEQ ID NO: 8703 - DNA, 22 bp, Homo sapiens
gcgaggaggggtgctgggcccc

SEQ ID NO: 8704 - DNA, 22 bp, Homo sapiens
tcgctgaggctgcacggctgcc

SEQ ID NO: 8705 - DNA, 22 bp, Homo sapiens
ttcatatttctttaaggacttt

SEQ ID NO: 8706 - DNA, 22 bp, Homo sapiens
accaggcccgctgctatggtgg

SEQ ID NO: 8707 - DNA, 22 bp, Homo sapiens
agggagcaaaggtttcagggtt

SEQ ID NO: 8708 - DNA, 23 bp, Homo sapiens
ctcctggtgctgctatcaggggt

SEQ ID NO: 8709 - DNA, 22 bp, Homo sapiens
aacaattactaccaaggcctgt

SEQ ID NO: 8710 - DNA, 22 bp, Homo sapiens
ctttcaggagaggattataaca

SEQ ID NO: 8711 - DNA, 22 bp, Homo sapiens
cttctcttcctttgtcaactga

SEQ ID NO: 8712 - DNA, 22 bp, Homo sapiens
aaaaaattatcatagttcctga

SEQ ID NO: 8713 - DNA, 22 bp, Homo sapiens
tctcctggtacccttcctagca

SEQ ID NO: 8714 - DNA, 22 bp, Homo sapiens
cggagcctgcttgttgcagctg

SEQ ID NO: 8715 - DNA, 20 bp, Homo sapiens
ttcatgggagcaaagaggcc

SEQ ID NO: 8716 - DNA, 22 bp, Homo sapiens
aaacttttttaggttcataggc

SEQ ID NO: 8717 - DNA, 22 bp, Homo sapiens
ggggccttggatctgtgccccg

SEQ ID NO: 8718 - DNA, 22 bp, Homo sapiens
ttcaatttgtgctaaggcaccg

SEQ ID NO: 8719 - DNA, 22 bp, Homo sapiens
ttggaaacgtcaccttttcctt

SEQ ID NO: 8720 - DNA, 22 bp, Homo sapiens
ttatttaaaagtggtaagattc

SEQ ID NO: 8721 - DNA, 22 bp, Homo sapiens
gcagtggcatgatgtgggctca

SEQ ID NO: 8722 - DNA, 22 bp, Homo sapiens
ttttcaggctgatttgtgttag

SEQ ID NO: 8723 - DNA, 22 bp, Homo sapiens
acttttaaatgagtttcagttg

SEQ ID NO: 8724 - DNA, 22 bp, Homo sapiens
cccaggaggcagagcttgcagt

SEQ ID NO: 8725 - DNA, 23 bp, Homo sapiens
gggggccgtcctggggattatag

SEQ ID NO: 8726 - DNA, 22 bp, Homo sapiens
cagtggcaggatttcagctcag

SEQ ID NO: 8727 - DNA, 22 bp, Homo sapiens
gctcggtggccagcctgaggcc

SEQ ID NO: 8728 - DNA, 22 bp, Homo sapiens
tggcccgaagatccgagggtca

SEQ ID NO: 8729 - DNA, 22 bp, Homo sapiens
acccatccagtgtccctgctag

SEQ ID NO: 8730 - DNA, 22 bp, Homo sapiens
agttctttgcatagatttggct

SEQ ID NO: 8731 - DNA, 22 bp, Homo sapiens
ttccctccatttcattttataa

SEQ ID NO: 8732 - DNA, 22 bp, Homo sapiens
gctcagacctgtaatcttagca

SEQ ID NO: 8733 - DNA, 19 bp, Homo sapiens
caggcctcttaccctctct

SEQ ID NO: 8734 - DNA, 22 bp, Homo sapiens
cccaggagttagaggttgtggt

SEQ ID NO: 8735 - DNA, 22 bp, Homo sapiens
atattacacacggtatcacggg

SEQ ID NO: 8736 - DNA, 23 bp, Homo sapiens
aaacttgctatggctgaaatcat

SEQ ID NO: 8737 - DNA, 22 bp, Homo sapiens
cttggggcagcccaggctgagc

SEQ ID NO: 8738 - DNA, 22 bp, Homo sapiens
tgctgagcgcatccggcggccg

SEQ ID NO: 8739 - DNA, 22 bp, Homo sapiens
ccggctactcgggaggctgacg

SEQ ID NO: 8740 - DNA, 22 bp, Homo sapiens
aagatactttgcatgcatgaag

SEQ ID NO: 8741 - DNA, 17 bp, Homo sapiens
ggctgcagtccaggagg

SEQ ID NO: 8742 - DNA, 22 bp, Homo sapiens
ggatgcacgaaggcgcctcgga

SEQ ID NO: 8743 - DNA, 22 bp, Homo sapiens
cctacagttatattcttgattg

SEQ ID NO: 8744 - DNA, 22 bp, Homo sapiens
aaagagccgctgatgtcagccc

SEQ ID NO: 8745 - DNA, 22 bp, Homo sapiens
cttctcggggttcccgcgccct

SEQ ID NO: 8746 - DNA, 22 bp, Homo sapiens
tctttcattctagtctgaggtt

SEQ ID NO: 8747 - DNA, 22 bp, Homo sapiens
actgcacttcaccctgggtgac

SEQ ID NO: 8748 - DNA, 22 bp, Homo sapiens
tcccagctactctagaggctga

SEQ ID NO: 8749 - DNA, 22 bp, Homo sapiens
aaaatcttgtgacttaggaagg

SEQ ID NO: 8750 - DNA, 22 bp, Homo sapiens
cccaggaggttgaggctgcagt

SEQ ID NO: 8751 - DNA, 22 bp, Homo sapiens
atgctgtttgcttttagtctgc

SEQ ID NO: 8752 - DNA, 22 bp, Homo sapiens
atgaggcaggagtgcagtggca

SEQ ID NO: 8753 - DNA, 22 bp, Homo sapiens
ttgcccagagtcacccagctca

SEQ ID NO: 8754 - DNA, 22 bp, Homo sapiens
cggctcactgcagctccgcctc

SEQ ID NO: 8755 - DNA, 22 bp, Homo sapiens
tgcactccaggctgggtgacag

SEQ ID NO: 8756 - DNA, 22 bp, Homo sapiens
gaggagggagctggaagctctt

SEQ ID NO: 8757 - DNA, 22 bp, Homo sapiens
ggtccccgtggaggctggagcg

SEQ ID NO: 8758 - DNA, 22 bp, Homo sapiens
tttgtagcagcatgatttataa

SEQ ID NO: 8759 - DNA, 22 bp, Homo sapiens
catataaatacaacatgtgtta

SEQ ID NO: 8760 - DNA, 22 bp, Homo sapiens
acccatggtctggtggggccct

SEQ ID NO: 8761 - DNA, 20 bp, Homo sapiens
ataaaataactgccacaaga

SEQ ID NO: 8762 - DNA, 22 bp, Homo sapiens
aaattgcaaaagtacttttagg

SEQ ID NO: 8763 - DNA, 22 bp, Homo sapiens
gggctgagacgatggggtcttc

SEQ ID NO: 8764 - DNA, 22 bp, Homo sapiens
tccccatgtctgcagggagggt

SEQ ID NO: 8765 - DNA, 22 bp, Homo sapiens
gagcccaggagtttgatgctgc

SEQ ID NO: 8766 - DNA, 19 bp, Homo sapiens
accttctgggaaacattcc

SEQ ID NO: 8767 - DNA, 22 bp, Homo sapiens
ctgggaggtggaggttgcattg

SEQ ID NO: 8768 - DNA, 22 bp, Homo sapiens
tatttaataaaactatggcatg

SEQ ID NO: 8769 - DNA, 18 bp, Homo sapiens
tgagaggctattttttgc

SEQ ID NO: 8770 - DNA, 22 bp, Homo sapiens
gcccagagttcaaggctgcagt

SEQ ID NO: 8771 - DNA, 22 bp, Homo sapiens
gcaggaggttgagccaggactg

SEQ ID NO: 8772 - DNA, 22 bp, Homo sapiens
gggttcagtccctcttgctact

SEQ ID NO: 8773 - DNA, 22 bp, Homo sapiens
ggccaggcgatgacccctccac

SEQ ID NO: 8774 - DNA, 22 bp, Homo sapiens
gaggagggagctggaagctctt

SEQ ID NO: 8775 - DNA, 22 bp, Homo sapiens
tcagggctgcagaagaggcagg

SEQ ID NO: 8776 - DNA, 22 bp, Homo sapiens
ggtcagccttggatttggtagc

SEQ ID NO: 8777 - DNA, 22 bp, Homo sapiens
attaaagctatccagtcatgaa

SEQ ID NO: 8778 - DNA, 22 bp, Homo sapiens
tgataaacttagaaagaatgtt

SEQ ID NO: 8779 - DNA, 20 bp, Homo sapiens
cagagccagggttttgtttt

SEQ ID NO: 8780 - DNA, 22 bp, Homo sapiens
tcgtgaggctctgcatcgcaca

SEQ ID NO: 8781 - DNA, 22 bp, Homo sapiens
gtatgtgaggttggtttccagg

SEQ ID NO: 8782 - DNA, 22 bp, Homo sapiens
cagggatggcgctggctgcccg

SEQ ID NO: 8783 - DNA, 22 bp, Homo sapiens
ctgctaaacctctctgagagct

SEQ ID NO: 8784 - DNA, 22 bp, Homo sapiens
accacctcatcaagctggattg

SEQ ID NO: 8785 - DNA, 22 bp, Homo sapiens
gacagctgcatcctcagacaca

SEQ ID NO: 8786 - DNA, 22 bp, Homo sapiens
tgtgctctgactttctcctggt

SEQ ID NO: 8787 - DNA, 22 bp, Homo sapiens
gaagctgagctgaggcatgttg

SEQ ID NO: 8788 - DNA, 22 bp, Homo sapiens
tgacttcctgcactcaggtgat

SEQ ID NO: 8789 - DNA, 22 bp, Homo sapiens
tgtccccacccaaatctcatct

SEQ ID NO: 8790 - DNA, 22 bp, Homo sapiens
atgattgaaaatgacattgcca

SEQ ID NO: 8791 - DNA, 22 bp, Homo sapiens
gaggctgaggcggatggatcac

SEQ ID NO: 8792 - DNA, 22 bp, Homo sapiens
tcacccaggctggactgcagtg

SEQ ID NO: 8793 - DNA, 22 bp, Homo sapiens
gtgaccatcatctcagctagtt

SEQ ID NO: 8794 - DNA, 22 bp, Homo sapiens
cctgccagagcagcttgtcctc

SEQ ID NO: 8795 - DNA, 22 bp, Homo sapiens
gtgcacatcgtgcaggtttgtt

SEQ ID NO: 8796 - DNA, 22 bp, Homo sapiens
gttgaggtgatgccagccctgc

SEQ ID NO: 8797 - DNA, 22 bp, Homo sapiens
cctgagtagctggaattaaagg

SEQ ID NO: 8798 - DNA, 22 bp, Homo sapiens
gggtacagttcttccagtgtca

SEQ ID NO: 8799 - DNA, 22 bp, Homo sapiens
aacagctttgtatacagtaact

SEQ ID NO: 8800 - DNA, 22 bp, Homo sapiens
tgtctgttattggtgtataaga

SEQ ID NO: 8801 - DNA, 22 bp, Homo sapiens
tgttatcctcagctcacctcta

SEQ ID NO: 8802 - DNA, 22 bp, Homo sapiens
actctgctctgtatttcactgt

SEQ ID NO: 8803 - DNA, 22 bp, Homo sapiens
gtggggtagatctttctcagga

SEQ ID NO: 8804 - DNA, 22 bp, Homo sapiens
cactgcacttcagcctgggtga

SEQ ID NO: 8805 - DNA, 20 bp, Homo sapiens
tatttctgggcaaccattta

SEQ ID NO: 8806 - DNA, 22 bp, Homo sapiens
ttctccgctaagttctctgcag

SEQ ID NO: 8807 - DNA, 22 bp, Homo sapiens
ctcaggacccggtccaggtggg

SEQ ID NO: 8808 - DNA, 22 bp, Homo sapiens
ccaaagtgctaggattacaggt

SEQ ID NO: 8809 - DNA, 22 bp, Homo sapiens
gagggtggtggcttaaggtgct

SEQ ID NO: 8810 - DNA, 22 bp, Homo sapiens
taagaaatttagttatagaatg

SEQ ID NO: 8811 - DNA, 22 bp, Homo sapiens
tagtttaggatccaatctaaga

SEQ ID NO: 8812 - DNA, 22 bp, Homo sapiens
aggagctgtcagagtgccagag

SEQ ID NO: 8813 - DNA, 22 bp, Homo sapiens
atcatccaagcgtagttcttct

SEQ ID NO: 8814 - DNA, 22 bp, Homo sapiens
aaaatcttgtgacttaggaagg

SEQ ID NO: 8815 - DNA, 22 bp, Homo sapiens
agaatagaattctcatagaatt

SEQ ID NO: 8816 - DNA, 22 bp, Homo sapiens
ggtgacgaatccatagcatcga

SEQ ID NO: 8817 - DNA, 22 bp, Homo sapiens
tttgatccgttgctggtgagga

SEQ ID NO: 8818 - DNA, 22 bp, Homo sapiens
gaggcagaagttgcagtgagca

SEQ ID NO: 8819 - DNA, 22 bp, Homo sapiens
agggagcaaaggtttcagggtt

SEQ ID NO: 8820 - DNA, 21 bp, Homo sapiens
ttaaagcctccctcataagga

SEQ ID NO: 8821 - DNA, 22 bp, Homo sapiens
gcctccagggatgattccttcc

SEQ ID NO: 8822 - DNA, 18 bp, Homo sapiens
tcactgggtgtatgtggc

SEQ ID NO: 8823 - DNA, 22 bp, Homo sapiens
tgctcatcaacatgatgatcat

SEQ ID NO: 8824 - DNA, 22 bp, Homo sapiens
gaggcacagagtaggtgcacac

SEQ ID NO: 8825 - DNA, 22 bp, Homo sapiens
actaggggctcaggcccaggga

SEQ ID NO: 8826 - DNA, 22 bp, Homo sapiens
tcctccccaaagcccagcctgg

SEQ ID NO: 8827 - DNA, 20 bp, Homo sapiens
gggcagtggcgctatctcag

SEQ ID NO: 8828 - DNA, 22 bp, Homo sapiens
ggagtgaagtggcgcgatctcg

SEQ ID NO: 8829 - DNA, 22 bp, Homo sapiens
gctgaaggcccggaggacaggg

SEQ ID NO: 8830 - DNA, 22 bp, Homo sapiens
tgtctctgtgactccttccgcc

SEQ ID NO: 8831 - DNA, 17 bp, Homo sapiens
gagcccctttccaagtt

SEQ ID NO: 8832 - DNA, 22 bp, Homo sapiens
ggtgacctcacctggtcccacc

SEQ ID NO: 8833 - DNA, 22 bp, Homo sapiens
ctgtcctgccagtcctggactc

SEQ ID NO: 8834 - DNA, 22 bp, Homo sapiens
atcatgttttaattagcaaact

SEQ ID NO: 8835 - DNA, 22 bp, Homo sapiens
ccatgtggtgggaaggagaatg

SEQ ID NO: 8836 - DNA, 21 bp, Homo sapiens
cgcagagcgaacttgcggcgc

SEQ ID NO: 8837 - DNA, 22 bp, Homo sapiens
cacttcaacctctgagtcctgg

SEQ ID NO: 8838 - DNA, 22 bp, Homo sapiens
tgttgagtatatacctacaagt

SEQ ID NO: 8839 - DNA, 22 bp, Homo sapiens
ggggccttttctgaatgtggaa

SEQ ID NO: 8840 - DNA, 22 bp, Homo sapiens
tcccagattcctgctcttatat

SEQ ID NO: 8841 - DNA, 22 bp, Homo sapiens
ggttgcaaactcctgggatcaa

SEQ ID NO: 8842 - DNA, 22 bp, Homo sapiens
gctgcagggagctggaaggctc

SEQ ID NO: 8843 - DNA, 22 bp, Homo sapiens
atatgggggggcgtgcagagga

SEQ ID NO: 8844 - DNA, 22 bp, Homo sapiens
tcacatctaattccatttctgc

SEQ ID NO: 8845 - DNA, 22 bp, Homo sapiens
ccagcttgaagatgtgctggtt

SEQ ID NO: 8846 - DNA, 22 bp, Homo sapiens
gagatggagtctttttctgtca

SEQ ID NO: 8847 - DNA, 22 bp, Homo sapiens
gagaaatgcatgcatgtcatca

SEQ ID NO: 8848 - DNA, 22 bp, Homo sapiens
agggccagcactcctggcagga

SEQ ID NO: 8849 - DNA, 22 bp, Homo sapiens
ttgacctatgtttcttcatctg

SEQ ID NO: 8850 - DNA, 22 bp, Homo sapiens
gggacgtgagtgaagaaggtct

SEQ ID NO: 8851 - DNA, 23 bp, Homo sapiens
aaaacagcttcctccagtggctc

SEQ ID NO: 8852 - DNA, 22 bp, Homo sapiens
caaagtgctggaattacaggtg

SEQ ID NO: 8853 - DNA, 16 bp, Homo sapiens
atgctgctattagagg

SEQ ID NO: 8854 - DNA, 22 bp, Homo sapiens
gggaggctctgctcagcccccg

SEQ ID NO: 8855 - DNA, 22 bp, Homo sapiens
gtatcacttttgagagtgagaa

SEQ ID NO: 8856 - DNA, 21 bp, Homo sapiens
cagagctgtccaaaccctgac

SEQ ID NO: 8857 - DNA, 22 bp, Homo sapiens
tgggggagctcagtccagccca

SEQ ID NO: 8858 - DNA, 22 bp, Homo sapiens
attctggacaaggcaagctcct

SEQ ID NO: 8859 - DNA, 22 bp, Homo sapiens
gtgctgacaggagcctggcggt

SEQ ID NO: 8860 - DNA, 22 bp, Homo sapiens
tccaggtgggctgcacccaggc

SEQ ID NO: 8861 - DNA, 22 bp, Homo sapiens
tcctcagcttttatttcacttg

SEQ ID NO: 8862 - DNA, 22 bp, Homo sapiens
cagaggctggcggccgccccga

SEQ ID NO: 8863 - DNA, 22 bp, Homo sapiens
ccaggctgctgttggtgtccgc

SEQ ID NO: 8864 - DNA, 20 bp, Homo sapiens
ccagagctgatggctgcccg

SEQ ID NO: 8865 - DNA, 22 bp, Homo sapiens
tcccagtttttctccactaagg

SEQ ID NO: 8866 - DNA, 22 bp, Homo sapiens
ggcagggagtggagactcccta

SEQ ID NO: 8867 - DNA, 22 bp, Homo sapiens
aaggctgtggttctatacagaa

SEQ ID NO: 8868 - DNA, 22 bp, Homo sapiens
cccaggagttggaggctgcagt

SEQ ID NO: 8869 - DNA, 22 bp, Homo sapiens
ttaataaagtatgaattggaaa

SEQ ID NO: 8870 - DNA, 22 bp, Homo sapiens
tcacattttcaaaagctggtgc

SEQ ID NO: 8871 - DNA, 22 bp, Homo sapiens
ccagtggctacaggggggttga

SEQ ID NO: 8872 - DNA, 22 bp, Homo sapiens
cttgtcagccaattgtggattt

SEQ ID NO: 8873 - DNA, 22 bp, Homo sapiens
aggggtgacacatatcagtgca

SEQ ID NO: 8874 - DNA, 22 bp, Homo sapiens
aggggaggtgtccccaaatctc

SEQ ID NO: 8875 - DNA, 22 bp, Homo sapiens
tctcccaggcaggagtgcagtg

SEQ ID NO: 8876 - DNA, 22 bp, Homo sapiens
gagctgggcctgcgagtgctgc

SEQ ID NO: 8877 - DNA, 18 bp, Homo sapiens
ttcacaagggcttggttt

SEQ ID NO: 8878 - DNA, 22 bp, Homo sapiens
tctgacattttgagaatgacat

SEQ ID NO: 8879 - DNA, 22 bp, Homo sapiens
gaaggtggcgagcggattgctg

SEQ ID NO: 8880 - DNA, 22 bp, Homo sapiens
cccaggaggcagatgttgcagt

SEQ ID NO: 8881 - DNA, 22 bp, Homo sapiens
gggctgggattgcttgctgtga

SEQ ID NO: 8882 - DNA, 22 bp, Homo sapiens
cctgggcctctcaaagtgctgg

SEQ ID NO: 8883 - DNA, 22 bp, Homo sapiens
tgggaagggtcaacagctggaa

SEQ ID NO: 8884 - DNA, 22 bp, Homo sapiens
agttgggtttgtgtcagttgca

SEQ ID NO: 8885 - DNA, 22 bp, Homo sapiens
atgaaaacggaccagagctatt

SEQ ID NO: 8886 - DNA, 22 bp, Homo sapiens
tgatgggaggtgctgcaggacc

SEQ ID NO: 8887 - DNA, 22 bp, Homo sapiens
caggaaggggctcactctggcc

SEQ ID NO: 8888 - DNA, 22 bp, Homo sapiens
cagtgcagccaaggacaggcac

SEQ ID NO: 8889 - DNA, 22 bp, Homo sapiens
ctggagagaatgtggaatgatt

SEQ ID NO: 8890 - DNA, 22 bp, Homo sapiens
cgcccaggctggagtgcagtga

SEQ ID NO: 8891 - DNA, 22 bp, Homo sapiens
tcccccaggctggagtgcagtg

SEQ ID NO: 8892 - DNA, 22 bp, Homo sapiens
aactcactttgtggcttctgaa

SEQ ID NO: 8893 - DNA, 22 bp, Homo sapiens
atttagacatgtatctgatagc

SEQ ID NO: 8894 - DNA, 22 bp, Homo sapiens
aggaatgacagatgtccgcacc

SEQ ID NO: 8895 - DNA, 22 bp, Homo sapiens
ggccactgctctccagcctggg

SEQ ID NO: 8896 - DNA, 22 bp, Homo sapiens
gggaagtgatggagccaggatt

SEQ ID NO: 8897 - DNA, 22 bp, Homo sapiens
gctcttgtcaaaaattagttga

SEQ ID NO: 8898 - DNA, 22 bp, Homo sapiens
ggagacagggttgaaccacgca

SEQ ID NO: 8899 - DNA, 22 bp, Homo sapiens
ggcagggcaggaaagtcaggaa

SEQ ID NO: 8900 - DNA, 22 bp, Homo sapiens
tgaggcaggagaatcacatgaa

SEQ ID NO: 8901 - DNA, 22 bp, Homo sapiens
tcaccgaggctggagtgcagtg

SEQ ID NO: 8902 - DNA, 19 bp, Homo sapiens
taggaccctggtggccccc

SEQ ID NO: 8903 - DNA, 20 bp, Homo sapiens
ctgggtggcaagcaaggggg

SEQ ID NO: 8904 - DNA, 22 bp, Homo sapiens
cattgctttgtgcatatttaaa

SEQ ID NO: 8905 - DNA, 22 bp, Homo sapiens
gcgagcctctggagtcctctgg

SEQ ID NO: 8906 - DNA, 22 bp, Homo sapiens
tgaatgtgatgctaaacatatg

SEQ ID NO: 8907 - DNA, 22 bp, Homo sapiens
aagaggtttaactgactcacag

SEQ ID NO: 8908 - DNA, 22 bp, Homo sapiens
ggtgccaggctgtagtcagggt

SEQ ID NO: 8909 - DNA, 22 bp, Homo sapiens
atcttctcatgtgtaatgaggt

SEQ ID NO: 8910 - DNA, 23 bp, Homo sapiens
gcagaggagcaagctggacacca

SEQ ID NO: 8911 - DNA, 22 bp, Homo sapiens
cactgcactccatcctgggaaa

SEQ ID NO: 8912 - DNA, 22 bp, Homo sapiens
taggctgggaagaaagattctc

SEQ ID NO: 8913 - DNA, 22 bp, Homo sapiens
gcaggtggatcacctgaggtca

SEQ ID NO: 8914 - DNA, 22 bp, Homo sapiens
ttctagtgtccttggacttgct

SEQ ID NO: 8915 - DNA, 22 bp, Homo sapiens
tctctcttttttgaacccgctc

SEQ ID NO: 8916 - DNA, 22 bp, Homo sapiens
agtggaccagaagactgaagct

SEQ ID NO: 8917 - DNA, 22 bp, Homo sapiens
gctcccaccttaaccttcacat

SEQ ID NO: 8918 - DNA, 22 bp, Homo sapiens
aaactgctttccacagtggcta

SEQ ID NO: 8919 - DNA, 22 bp, Homo sapiens
ccagaagtcaagtaagatgaag

SEQ ID NO: 8920 - DNA, 22 bp, Homo sapiens
tgaggcaggagttcaggctgcg

SEQ ID NO: 8921 - DNA, 22 bp, Homo sapiens
aggggatggagctggaaggcag

SEQ ID NO: 8922 - DNA, 22 bp, Homo sapiens
ttgtaacaggtactaaataact

SEQ ID NO: 8923 - DNA, 22 bp, Homo sapiens
aggggagccagggctgcgagtt

SEQ ID NO: 8924 - DNA, 22 bp, Homo sapiens
aggcgcctgcgggatccttgcc

SEQ ID NO: 8925 - DNA, 22 bp, Homo sapiens
gcccctgcctttgaacctggag

SEQ ID NO: 8926 - DNA, 22 bp, Homo sapiens
gtaggtcagacataagaggaca

SEQ ID NO: 8927 - DNA, 22 bp, Homo sapiens
tcactgcaacctccacctcctg

SEQ ID NO: 8928 - DNA, 22 bp, Homo sapiens
agagggtgggcacgtgatggat

SEQ ID NO: 8929 - DNA, 22 bp, Homo sapiens
tcacttcccagacggggtggca

SEQ ID NO: 8930 - DNA, 22 bp, Homo sapiens
ttgtgaatagtgccgcaataaa

SEQ ID NO: 8931 - DNA, 22 bp, Homo sapiens
gaatttaagaggatgaatctgt

SEQ ID NO: 8932 - DNA, 22 bp, Homo sapiens
agagagcccgggccagggcaca

SEQ ID NO: 8933 - DNA, 22 bp, Homo sapiens
ggtgtccgcgctgtagaaggtc

SEQ ID NO: 8934 - DNA, 22 bp, Homo sapiens
aggactgggtgcagagggcatc

SEQ ID NO: 8935 - DNA, 22 bp, Homo sapiens
tgatcaaaacattactccacca

SEQ ID NO: 8936 - DNA, 22 bp, Homo sapiens
tcatcagggatattggcctgaa

SEQ ID NO: 8937 - DNA, 22 bp, Homo sapiens
ttttctcttccctctggacctg

SEQ ID NO: 8938 - DNA, 22 bp, Homo sapiens
tgaggcaggagaatcaccggaa

SEQ ID NO: 8939 - DNA, 22 bp, Homo sapiens
agttattactctttaacatatt

SEQ ID NO: 8940 - DNA, 22 bp, Homo sapiens
gctcactgcctgggcaacaaga

SEQ ID NO: 8941 - DNA, 22 bp, Homo sapiens
cgggcaaggcgagactaggccc

SEQ ID NO: 8942 - DNA, 22 bp, Homo sapiens
ttcctttctctggactgcagcc

SEQ ID NO: 8943 - DNA, 22 bp, Homo sapiens
gtggatggagctggaagccatt

SEQ ID NO: 8944 - DNA, 22 bp, Homo sapiens
tgtgactggttgtcccgctttc

SEQ ID NO: 8945 - DNA, 22 bp, Homo sapiens
agggctggagccacagctggga

SEQ ID NO: 8946 - DNA, 22 bp, Homo sapiens
ctgggggcagcaagaagccatg

SEQ ID NO: 8947 - DNA, 22 bp, Homo sapiens
ttgtgtgtactggttatgggca

SEQ ID NO: 8948 - DNA, 21 bp, Homo sapiens
tgtaagtttcatctgaattgg

SEQ ID NO: 8949 - DNA, 22 bp, Homo sapiens
tcttgaattgtactcccataag

SEQ ID NO: 8950 - DNA, 21 bp, Homo sapiens
tcactagtgccttctgtcatt

SEQ ID NO: 8951 - DNA, 22 bp, Homo sapiens
acagacaagtagttcagacaag

SEQ ID NO: 8952 - DNA, 22 bp, Homo sapiens
cttgcctttgtcttcaaaggct

SEQ ID NO: 8953 - DNA, 22 bp, Homo sapiens
cacattccttacattcatagag

SEQ ID NO: 8954 - DNA, 22 bp, Homo sapiens
catgagataatttttctccagt

SEQ ID NO: 8955 - DNA, 22 bp, Homo sapiens
tctcaagcttgttggtatgttt

SEQ ID NO: 8956 - DNA, 22 bp, Homo sapiens
actgcaacctccacctcctggg

SEQ ID NO: 8957 - DNA, 22 bp, Homo sapiens
tggagaagattggtcaccattc

SEQ ID NO: 8958 - DNA, 22 bp, Homo sapiens
tgctcgaggtccccaccggctc

SEQ ID NO: 8959 - DNA, 22 bp, Homo sapiens
acctggacacctgctgtcatct

SEQ ID NO: 8960 - DNA, 22 bp, Homo sapiens
agtccgcctgctgccgtggcag

SEQ ID NO: 8961 - DNA, 22 bp, Homo sapiens
cactgcaacctccacctcctgg

SEQ ID NO: 8962 - DNA, 22 bp, Homo sapiens
aggtgggcggattcatgaggtc

SEQ ID NO: 8963 - DNA, 22 bp, Homo sapiens
ccagaggtgctctttggaagtg

SEQ ID NO: 8964 - DNA, 22 bp, Homo sapiens
tgctgtgaggttgagaaggaag

SEQ ID NO: 8965 - DNA, 22 bp, Homo sapiens
gttaaggatcttgagatgagga

SEQ ID NO: 8966 - DNA, 22 bp, Homo sapiens
tccattatacttctgattcaaa

SEQ ID NO: 8967 - DNA, 21 bp, Homo sapiens
cctcaaagatgatggggtttc

SEQ ID NO: 8968 - DNA, 22 bp, Homo sapiens
cccaggaggtggagttcacagt

SEQ ID NO: 8969 - DNA, 22 bp, Homo sapiens
tgaggcaggaggattgcaggat

SEQ ID NO: 8970 - DNA, 22 bp, Homo sapiens
tacaacaatttccacattagaa

SEQ ID NO: 8971 - DNA, 22 bp, Homo sapiens
ctttatgaaaacctgaattatg

SEQ ID NO: 8972 - DNA, 22 bp, Homo sapiens
gctcactgcaacctccacctcc

SEQ ID NO: 8973 - DNA, 22 bp, Homo sapiens
ctgggaggcagaggttgcagtg

SEQ ID NO: 8974 - DNA, 22 bp, Homo sapiens
ccaaagtgctaggattacaggc

SEQ ID NO: 8975 - DNA, 22 bp, Homo sapiens
tagctaccattattgagcacct

SEQ ID NO: 8976 - DNA, 22 bp, Homo sapiens
atgattgaccatctgctgggct

SEQ ID NO: 8977 - DNA, 22 bp, Homo sapiens
catgtaaagaatttcacacaag

SEQ ID NO: 8978 - DNA, 22 bp, Homo sapiens
agcgagtgggtcagcgttgcag

SEQ ID NO: 8979 - DNA, 22 bp, Homo sapiens
ctgggcagctgtatcagggagt

SEQ ID NO: 8980 - DNA, 22 bp, Homo sapiens
ccaggctggagtgcagtggcac

SEQ ID NO: 8981 - DNA, 22 bp, Homo sapiens
ctgctctgctgatcagtgtctc

SEQ ID NO: 8982 - DNA, 22 bp, Homo sapiens
gggtaggcaaagcaatgacgtt

SEQ ID NO: 8983 - DNA, 22 bp, Homo sapiens
ttgagcccaggaggcctgggtg

SEQ ID NO: 8984 - DNA, 22 bp, Homo sapiens
agctggtgtgccagttccagtt

SEQ ID NO: 8985 - DNA, 22 bp, Homo sapiens
ggttggacactaggtaggagcg

SEQ ID NO: 8986 - DNA, 20 bp, Homo sapiens
gacatgtctttctcacacaa

SEQ ID NO: 8987 - DNA, 22 bp, Homo sapiens
gtgtgcacagagctccagtgtt

SEQ ID NO: 8988 - DNA, 22 bp, Homo sapiens
ggtgacagtggttaaaatttgt

SEQ ID NO: 8989 - DNA, 22 bp, Homo sapiens
cgggttcacgccattctcctgc

SEQ ID NO: 8990 - DNA, 22 bp, Homo sapiens
gaggtgggtgtatcacaggtca

SEQ ID NO: 8991 - DNA, 22 bp, Homo sapiens
aagatattcaaagatttattag

SEQ ID NO: 8992 - DNA, 22 bp, Homo sapiens
gctgtatgtgaggccacagtga

SEQ ID NO: 8993 - DNA, 22 bp, Homo sapiens
ttcttctcagggtcccacatgg

SEQ ID NO: 8994 - DNA, 22 bp, Homo sapiens
ggcgctcagtgttgccccagag

SEQ ID NO: 8995 - DNA, 22 bp, Homo sapiens
tcacaatatttatcttccaatt

SEQ ID NO: 8996 - DNA, 22 bp, Homo sapiens
atgccaggaacaaacagtggtg

SEQ ID NO: 8997 - DNA, 22 bp, Homo sapiens
aggctgagataggtggatcatt

SEQ ID NO: 8998 - DNA, 22 bp, Homo sapiens
accctccccaagaggtcgtgcc

SEQ ID NO: 8999 - DNA, 22 bp, Homo sapiens
tgtatgaggcatacatcaggca

SEQ ID NO: 9000 - DNA, 20 bp, Homo sapiens
gggcagagccagccagtccc

SEQ ID NO: 9001 - DNA, 22 bp, Homo sapiens
aaggctgaggcagtgaggcaga

SEQ ID NO: 9002 - DNA, 22 bp, Homo sapiens
cagcctgccgtcagccaggtag

SEQ ID NO: 9003 - DNA, 22 bp, Homo sapiens
cccaggggttcaaggctgcagt

SEQ ID NO: 9004 - DNA, 22 bp, Homo sapiens
gatcgggtgggttctgccatca

SEQ ID NO: 9005 - DNA, 22 bp, Homo sapiens
cacagagatggtctggcaggtg

SEQ ID NO: 9006 - DNA, 22 bp, Homo sapiens
ggagaagcagcttcttgatgaa

SEQ ID NO: 9007 - DNA, 22 bp, Homo sapiens
ggaggggatttagtagatgcta

SEQ ID NO: 9008 - DNA, 22 bp, Homo sapiens
ggcagcactgcagcttgttggg

SEQ ID NO: 9009 - DNA, 22 bp, Homo sapiens
tttaaaaaactagtctgagtct

SEQ ID NO: 9010 - DNA, 22 bp, Homo sapiens
ggagactgatctgagtgataac

SEQ ID NO: 9011 - DNA, 22 bp, Homo sapiens
ttccatttggcacttcactgag

SEQ ID NO: 9012 - DNA, 22 bp, Homo sapiens
taagggttcagaatgcagtggt

SEQ ID NO: 9013 - DNA, 22 bp, Homo sapiens
agtaatcaatttttcggtggat

SEQ ID NO: 9014 - DNA, 22 bp, Homo sapiens
cctcttctaggacgtccttgtg

SEQ ID NO: 9015 - DNA, 17 bp, Homo sapiens
aatctgtttacagtcag

SEQ ID NO: 9016 - DNA, 22 bp, Homo sapiens
tcttagaaattccccagtggct

SEQ ID NO: 9017 - DNA, 23 bp, Homo sapiens
aggtaggttattgctgctacctg

SEQ ID NO: 9018 - DNA, 23 bp, Homo sapiens
ggctgggagctccgggtgcacgt

SEQ ID NO: 9019 - DNA, 22 bp, Homo sapiens
accccaggaagtggaggtcatg

SEQ ID NO: 9020 - DNA, 22 bp, Homo sapiens
attcgcgggcctggagggtggg

SEQ ID NO: 9021 - DNA, 22 bp, Homo sapiens
ctgggaggcggaggttgtagtg

SEQ ID NO: 9022 - DNA, 22 bp, Homo sapiens
gctcactgcaacctctgcctcc

SEQ ID NO: 9023 - DNA, 21 bp, Homo sapiens
aaactgaccttgcctgagaca

SEQ ID NO: 9024 - DNA, 22 bp, Homo sapiens
ctgaggcaggatggcctggctg

SEQ ID NO: 9025 - DNA, 22 bp, Homo sapiens
cagccacttgtgatgctgggga

SEQ ID NO: 9026 - DNA, 22 bp, Homo sapiens
gccagtggtcactgaggaagaa

SEQ ID NO: 9027 - DNA, 22 bp, Homo sapiens
attgtaaatagtgccacaataa

SEQ ID NO: 9028 - DNA, 22 bp, Homo sapiens
atgccacttcattccagcctcg

SEQ ID NO: 9029 - DNA, 22 bp, Homo sapiens
gaccatcctggccaacgtggta

SEQ ID NO: 9030 - DNA, 22 bp, Homo sapiens
gggaagatagtgttgagggccc

SEQ ID NO: 9031 - DNA, 22 bp, Homo sapiens
cggctcactgcagctccgcctc

SEQ ID NO: 9032 - DNA, 22 bp, Homo sapiens
tgtcctcatcctccagtctgtc

SEQ ID NO: 9033 - DNA, 22 bp, Homo sapiens
cagatgtacatgaagggcaatg

SEQ ID NO: 9034 - DNA, 22 bp, Homo sapiens
tttgcttcacaagtatggttct

SEQ ID NO: 9035 - DNA, 22 bp, Homo sapiens
ctgaggctggagtgcagtggtg

SEQ ID NO: 9036 - DNA, 22 bp, Homo sapiens
tgtttcttacgtttttagaggc

SEQ ID NO: 9037 - DNA, 22 bp, Homo sapiens
agaggccggccgagcccatggg

SEQ ID NO: 9038 - DNA, 22 bp, Homo sapiens
tgagcaggcgcagcaggaggtc

SEQ ID NO: 9039 - DNA, 22 bp, Homo sapiens
ttctttcagaacacaagtgatt

SEQ ID NO: 9040 - DNA, 22 bp, Homo sapiens
gcaggcagaggtggaggagaca

SEQ ID NO: 9041 - DNA, 22 bp, Homo sapiens
tttgtgaataggttggcttcca

SEQ ID NO: 9042 - DNA, 22 bp, Homo sapiens
tgcactactgtgatacacagcc

SEQ ID NO: 9043 - DNA, 22 bp, Homo sapiens
ctgtctgcaggatagtaccctc

SEQ ID NO: 9044 - DNA, 22 bp, Homo sapiens
ttaaacatttatggaggcagca

SEQ ID NO: 9045 - DNA, 22 bp, Homo sapiens
gagtagaactggttatctaata

SEQ ID NO: 9046 - DNA, 22 bp, Homo sapiens
gtgccgcgacgcagtcggtgcc

SEQ ID NO: 9047 - DNA, 23 bp, Homo sapiens
aaacttgctatggctgaaatcat

SEQ ID NO: 9048 - DNA, 22 bp, Homo sapiens
ctcgttgctgaagccaaagtca

SEQ ID NO: 9049 - DNA, 18 bp, Homo sapiens
ggtgagggagctggaagc

SEQ ID NO: 9050 - DNA, 22 bp, Homo sapiens
ggctgggcaggtctgcacaggg

SEQ ID NO: 9051 - DNA, 22 bp, Homo sapiens
catggcactgagcaggtatgca

SEQ ID NO: 9052 - DNA, 22 bp, Homo sapiens
ggagtagctgcattccgagcac

SEQ ID NO: 9053 - DNA, 22 bp, Homo sapiens
ttgcactccagcccgagcaaca

SEQ ID NO: 9054 - DNA, 22 bp, Homo sapiens
ctggcaagaaatatatatctta

SEQ ID NO: 9055 - DNA, 22 bp, Homo sapiens
gcagctgacatctggctgggcc

SEQ ID NO: 9056 - DNA, 22 bp, Homo sapiens
gtgggctgcccttgaggtcagc

SEQ ID NO: 9057 - DNA, 22 bp, Homo sapiens
ggctgtggcagctggaagtggt

SEQ ID NO: 9058 - DNA, 22 bp, Homo sapiens
ggagtgactctcggggccacta

SEQ ID NO: 9059 - DNA, 22 bp, Homo sapiens
gcaagacatgtctaaggtttaa

SEQ ID NO: 9060 - DNA, 22 bp, Homo sapiens
gaggccactgtccctgccttcc

SEQ ID NO: 9061 - DNA, 22 bp, Homo sapiens
gaggctgaggttgcagtgagct

SEQ ID NO: 9062 - DNA, 22 bp, Homo sapiens
gggttgaggcggatgtcggcgg

SEQ ID NO: 9063 - DNA, 22 bp, Homo sapiens
aggtctcttgctgtctctgggc

SEQ ID NO: 9064 - DNA, 22 bp, Homo sapiens
cttcttgctgggggcctcagtg

SEQ ID NO: 9065 - DNA, 22 bp, Homo sapiens
gagccaggaggcagagactgca

SEQ ID NO: 9066 - DNA, 22 bp, Homo sapiens
cagggggctcaaaggagagtgc

SEQ ID NO: 9067 - DNA, 22 bp, Homo sapiens
ccccacaactcatgttgaaact

SEQ ID NO: 9068 - DNA, 22 bp, Homo sapiens
atattacacacggtatcacggg

SEQ ID NO: 9069 - DNA, 22 bp, Homo sapiens
agcccaggtccagttcactgca

SEQ ID NO: 9070 - DNA, 22 bp, Homo sapiens
agctgattccactttttcccca

SEQ ID NO: 9071 - DNA, 22 bp, Homo sapiens
gggagctgagctggaagagaat

SEQ ID NO: 9072 - DNA, 22 bp, Homo sapiens
gcctccagcccacgcaggcctg

SEQ ID NO: 9073 - DNA, 22 bp, Homo sapiens
atagaatatgacttttagatcc

SEQ ID NO: 9074 - DNA, 21 bp, Homo sapiens
ttagaagctaatgcagctggt

SEQ ID NO: 9075 - DNA, 22 bp, Homo sapiens
tggaatggaaacaaactgagga

SEQ ID NO: 9076 - DNA, 22 bp, Homo sapiens
agaggaggctctgggatcgtcc

SEQ ID NO: 9077 - DNA, 22 bp, Homo sapiens
cattaaacaaccttgaatcaat

SEQ ID NO: 9078 - DNA, 22 bp, Homo sapiens
atatattttttgagacagagtc

SEQ ID NO: 9079 - DNA, 21 bp, Homo sapiens
gccatttcacacagacatttg

SEQ ID NO: 9080 - DNA, 22 bp, Homo sapiens
gctcactgcaagctccgcctcc

SEQ ID NO: 9081 - DNA, 22 bp, Homo sapiens
cagtggaggccttgggaccttt

SEQ ID NO: 9082 - DNA, 20 bp, Homo sapiens
acgtggccaccagtggctta

SEQ ID NO: 9083 - DNA, 20 bp, Homo sapiens
tcacatcctctcccaacatg

SEQ ID NO: 9084 - DNA, 22 bp, Homo sapiens
actgcaacacctcctgggttca

SEQ ID NO: 9085 - DNA, 22 bp, Homo sapiens
ttccagctaactcacatccctt

SEQ ID NO: 9086 - DNA, 22 bp, Homo sapiens
ctttggcaatgtcattttcaat

SEQ ID NO: 9087 - DNA, 22 bp, Homo sapiens
agctggggctgtggttgtgatt

SEQ ID NO: 9088 - DNA, 22 bp, Homo sapiens
catgtctgtgtacacatgcaca

SEQ ID NO: 9089 - DNA, 22 bp, Homo sapiens
gggacatctttctagtcagggt

SEQ ID NO: 9090 - DNA, 22 bp, Homo sapiens
tgggcttaggtcggaggcggcc

SEQ ID NO: 9091 - DNA, 22 bp, Homo sapiens
cgcccaggctggagagcagtgg

SEQ ID NO: 9092 - DNA, 22 bp, Homo sapiens
tttacaacccaagtccagagag

SEQ ID NO: 9093 - DNA, 21 bp, Homo sapiens
gctcctggtgctgcgtggcgc

SEQ ID NO: 9094 - DNA, 22 bp, Homo sapiens
gggaagagggagctggaatgat

SEQ ID NO: 9095 - DNA, 21 bp, Homo sapiens
gggcagaggggcctcctgggt

SEQ ID NO: 9096 - DNA, 22 bp, Homo sapiens
gtctgctcatgctaccgcgggc

SEQ ID NO: 9097 - DNA, 22 bp, Homo sapiens
ggggcccctcggacacgtgcgg

SEQ ID NO: 9098 - DNA, 22 bp, Homo sapiens
aactctatttaccctactaaac

SEQ ID NO: 9099 - DNA, 22 bp, Homo sapiens
cggcatccccacttcctcctgc

SEQ ID NO: 9100 - DNA, 22 bp, Homo sapiens
tggattcacaccattctcctgc

SEQ ID NO: 9101 - DNA, 22 bp, Homo sapiens
ggggccgaccgcggttcaggcc

SEQ ID NO: 9102 - DNA, 20 bp, Homo sapiens
tgtcattcttctttcacagg

SEQ ID NO: 9103 - DNA, 22 bp, Homo sapiens
accctcaacaaattcactctat

SEQ ID NO: 9104 - DNA, 21 bp, Homo sapiens
caatggcgagatcttggctca

SEQ ID NO: 9105 - DNA, 20 bp, Homo sapiens
tgctggaaattgttctagga

SEQ ID NO: 9106 - DNA, 22 bp, Homo sapiens
caggagatgacagggaagaacc

SEQ ID NO: 9107 - DNA, 22 bp, Homo sapiens
ggctcactgcaacttccgcctc

SEQ ID NO: 9108 - DNA, 22 bp, Homo sapiens
tctgccgtgcgaggtcccacca

SEQ ID NO: 9109 - DNA, 22 bp, Homo sapiens
cacccaggctggagagcagtgg

SEQ ID NO: 9110 - DNA, 22 bp, Homo sapiens
ggctgagtctgtgacccatgcg

SEQ ID NO: 9111 - DNA, 22 bp, Homo sapiens
gcagcgaggtgatgaaatagct

SEQ ID NO: 9112 - DNA, 22 bp, Homo sapiens
tgtccagatcaatgcccacatg

SEQ ID NO: 9113 - DNA, 22 bp, Homo sapiens
agatgtgtttctagttcctgca

SEQ ID NO: 9114 - DNA, 22 bp, Homo sapiens
catataaatacaacatgtgtta

SEQ ID NO: 9115 - DNA, 22 bp, Homo sapiens
atgctaaggcccaggagaaaat

SEQ ID NO: 9116 - DNA, 22 bp, Homo sapiens
acagtctgtcccccaggtgcta

SEQ ID NO: 9117 - DNA, 22 bp, Homo sapiens
atgcacctgaactccatcagct

SEQ ID NO: 9118 - DNA, 22 bp, Homo sapiens
tccaggctttggggcaggagcg

SEQ ID NO: 9119 - DNA, 22 bp, Homo sapiens
ccaggaggcagaagttgcagtg

SEQ ID NO: 9120 - DNA, 22 bp, Homo sapiens
cagcacatgctcatcagggaag

SEQ ID NO: 9121 - DNA, 23 bp, Homo sapiens
aggttatgattatagagcgagga

SEQ ID NO: 9122 - DNA, 22 bp, Homo sapiens
tcctgggccctccggatcaggt

SEQ ID NO: 9123 - DNA, 22 bp, Homo sapiens
cactgcactccagcctgggaga

SEQ ID NO: 9124 - DNA, 22 bp, Homo sapiens
gatataggttcatagtgttaca

SEQ ID NO: 9125 - DNA, 22 bp, Homo sapiens
tttgtagcagcatgatttataa

SEQ ID NO: 9126 - DNA, 22 bp, Homo sapiens
tccacgtgagcttcgtgtgcag

SEQ ID NO: 9127 - DNA, 22 bp, Homo sapiens
tcctgaagaaggcagatatttg

SEQ ID NO: 9128 - DNA, 22 bp, Homo sapiens
tcctgagataaatctcatgtga

SEQ ID NO: 9129 - DNA, 22 bp, Homo sapiens
ttacatgtttatgtggtacatg

SEQ ID NO: 9130 - DNA, 23 bp, Homo sapiens
agaaagtcatggccaggtttgat

SEQ ID NO: 9131 - DNA, 22 bp, Homo sapiens
cactgctacctctgcctcccgg

SEQ ID NO: 9132 - DNA, 22 bp, Homo sapiens
ggctgcaggttggttggcagct

SEQ ID NO: 9133 - DNA, 22 bp, Homo sapiens
tcccagagctctggaggttgga

SEQ ID NO: 9134 - DNA, 22 bp, Homo sapiens
ggcggaggttgcagtaagccga

SEQ ID NO: 9135 - DNA, 22 bp, Homo sapiens
atcaaatacaaagggcataagg

SEQ ID NO: 9136 - DNA, 22 bp, Homo sapiens
gctgacccctacaggttgtgtt

SEQ ID NO: 9137 - DNA, 22 bp, Homo sapiens
gctgctctcagagctcatgctg

SEQ ID NO: 9138 - DNA, 22 bp, Homo sapiens
accttcaggtgagcacacagat

SEQ ID NO: 9139 - DNA, 22 bp, Homo sapiens
tcagggattgcaaaattcatcc

SEQ ID NO: 9140 - DNA, 22 bp, Homo sapiens
gtgggtggacggtgcttttgtt

SEQ ID NO: 9141 - DNA, 22 bp, Homo sapiens
gaggtaggtgtaggaggcctgc

SEQ ID NO: 9142 - DNA, 22 bp, Homo sapiens
aagaggagaaaggctggctttg

SEQ ID NO: 9143 - DNA, 22 bp, Homo sapiens
ataaaatttgctactgttaaat

SEQ ID NO: 9144 - DNA, 22 bp, Homo sapiens
tctagctctgcttatcatggct

SEQ ID NO: 9145 - DNA, 22 bp, Homo sapiens
caggctggagttcagtggtgtg

SEQ ID NO: 9146 - DNA, 22 bp, Homo sapiens
gggcgccgtgggaaacagccgg

SEQ ID NO: 9147 - DNA, 22 bp, Homo sapiens
tcttgcacttcatgaatatgtt

SEQ ID NO: 9148 - DNA, 22 bp, Homo sapiens
agctttacctgccttggggcac

SEQ ID NO: 9149 - DNA, 22 bp, Homo sapiens
tgcgggtcccagggtcacaggc

SEQ ID NO: 9150 - DNA, 22 bp, Homo sapiens
tctgagctccatgcaggaggct

SEQ ID NO: 9151 - DNA, 22 bp, Homo sapiens
ctgaatccacacaaggtgatgg

SEQ ID NO: 9152 - DNA, 22 bp, Homo sapiens
aggctgaggcaagaggatcact

SEQ ID NO: 9153 - DNA, 22 bp, Homo sapiens
ttgggctgaaccctgcagctga

SEQ ID NO: 9154 - DNA, 22 bp, Homo sapiens
gatggaggagatggcagggtgc

SEQ ID NO: 9155 - DNA, 22 bp, Homo sapiens
aggtgactggtttatctggcag

SEQ ID NO: 9156 - DNA, 22 bp, Homo sapiens
ctgagatctttatacgaggcac

SEQ ID NO: 9157 - DNA, 22 bp, Homo sapiens
tgcctctgaggaagattgtgtt

SEQ ID NO: 9158 - DNA, 22 bp, Homo sapiens
agagtgcaaccgaaacaagcag

SEQ ID NO: 9159 - DNA, 22 bp, Homo sapiens
cttctgagatgttgttttacag

SEQ ID NO: 9160 - DNA, 22 bp, Homo sapiens
acaattctgatggtttcccagt

SEQ ID NO: 9161 - DNA, 23 bp, Homo sapiens
cagagctggctcagagctgcctg

SEQ ID NO: 9162 - DNA, 22 bp, Homo sapiens
gccctgccctctcggcactcgc

SEQ ID NO: 9163 - DNA, 20 bp, Homo sapiens
gctgaggtggaggaaggaga

SEQ ID NO: 9164 - DNA, 22 bp, Homo sapiens
ctgggaggcggaggttgcagtg

SEQ ID NO: 9165 - DNA, 22 bp, Homo sapiens
tatttccttgagacggagtctc

SEQ ID NO: 9166 - DNA, 22 bp, Homo sapiens
gtagaccatttatctggggagt

SEQ ID NO: 9167 - DNA, 22 bp, Homo sapiens
agcccaggagtttgaggctgtg

SEQ ID NO: 9168 - DNA, 22 bp, Homo sapiens
tccaggtgacagagacaggata

SEQ ID NO: 9169 - DNA, 22 bp, Homo sapiens
ggaggcggaggctgcagtgagc

SEQ ID NO: 9170 - DNA, 22 bp, Homo sapiens
gaggcgggcagatcacctgagg

SEQ ID NO: 9171 - DNA, 22 bp, Homo sapiens
gcgtggcttagagtggggtacc

SEQ ID NO: 9172 - DNA, 22 bp, Homo sapiens
catttacatttaaggttaatat

SEQ ID NO: 9173 - DNA, 22 bp, Homo sapiens
actgcaaagggaagccctttct

SEQ ID NO: 9174 - DNA, 22 bp, Homo sapiens
gctgggctgcgtcggggaagcc

SEQ ID NO: 9175 - DNA, 22 bp, Homo sapiens
agacagggtgatcgcttgagcc

SEQ ID NO: 9176 - DNA, 22 bp, Homo sapiens
tcttgccacttcatcccctttc

SEQ ID NO: 9177 - DNA, 23 bp, Homo sapiens
ctggggctttcaaatctgggcag

SEQ ID NO: 9178 - DNA, 19 bp, Homo sapiens
gcccacggccctgctctgc

SEQ ID NO: 9179 - DNA, 22 bp, Homo sapiens
tgacatttcctagtgctttgtg

SEQ ID NO: 9180 - DNA, 22 bp, Homo sapiens
ttctgggcacacaggccctggt

SEQ ID NO: 9181 - DNA, 22 bp, Homo sapiens
tataaagagtctcaaagaagtt

SEQ ID NO: 9182 - DNA, 22 bp, Homo sapiens
tgatatgtaactactccttata

SEQ ID NO: 9183 - DNA, 22 bp, Homo sapiens
ctctccattccctacagttttc

SEQ ID NO: 9184 - DNA, 17 bp, Homo sapiens
caggtgacctggtgatg

SEQ ID NO: 9185 - DNA, 22 bp, Homo sapiens
ttcattcttttacatgtgaata

SEQ ID NO: 9186 - DNA, 22 bp, Homo sapiens
tgatttatgcattatactgttg

SEQ ID NO: 9187 - DNA, 22 bp, Homo sapiens
cgagtgtccctaccatttccta

SEQ ID NO: 9188 - DNA, 22 bp, Homo sapiens
tgaccctgagagctgaatggct

SEQ ID NO: 9189 - DNA, 22 bp, Homo sapiens
tgcacgtgggctctctgctctt

SEQ ID NO: 9190 - DNA, 22 bp, Homo sapiens
accaggcccgctgctatggtgg

SEQ ID NO: 9191 - DNA, 22 bp, Homo sapiens
aaggcaggatgggaaaagattt

SEQ ID NO: 9192 - DNA, 22 bp, Homo sapiens
ttgtggttaaccgcacattttt

SEQ ID NO: 9193 - DNA, 22 bp, Homo sapiens
ccagatgtccctctcaggtttg

SEQ ID NO: 9194 - DNA, 23 bp, Homo sapiens
tgaggcaggcggatcacgaggtc

SEQ ID NO: 9195 - DNA, 22 bp, Homo sapiens
tcctgccttgcctgggacatca

SEQ ID NO: 9196 - DNA, 22 bp, Homo sapiens
tcaggcaatctgacagctggag

SEQ ID NO: 9197 - DNA, 22 bp, Homo sapiens
tgtcatagtgtggtagcagtgg

SEQ ID NO: 9198 - DNA, 22 bp, Homo sapiens
actctccttttgatcttcagaa

SEQ ID NO: 9199 - DNA, 17 bp, Homo sapiens
gagattttcgtcctgaa

SEQ ID NO: 9200 - DNA, 22 bp, Homo sapiens
cttcctctgtggccagagtgta

SEQ ID NO: 9201 - DNA, 22 bp, Homo sapiens
aaggctgagacagcacaggtcc

SEQ ID NO: 9202 - DNA, 22 bp, Homo sapiens
gattcactcatattttacgttt

SEQ ID NO: 9203 - DNA, 22 bp, Homo sapiens
ggacctgaacataaaacgaggc

SEQ ID NO: 9204 - DNA, 22 bp, Homo sapiens
caggctgaagtgcagtggtgtg

SEQ ID NO: 9205 - DNA, 22 bp, Homo sapiens
tttctcggcagagatgatgggc

SEQ ID NO: 9206 - DNA, 22 bp, Homo sapiens
tctctcaggctggagtgcagtg

SEQ ID NO: 9207 - DNA, 22 bp, Homo sapiens
ggaactcctgctccaagcagct

SEQ ID NO: 9208 - DNA, 22 bp, Homo sapiens
agccaggatggtctcgatcggc

SEQ ID NO: 9209 - DNA, 22 bp, Homo sapiens
atatgcagtctcttgcccttct

SEQ ID NO: 9210 - DNA, 22 bp, Homo sapiens
ctctggagtgtctggccagggt

SEQ ID NO: 9211 - DNA, 22 bp, Homo sapiens
gctgtggcctggcgcagagctg

SEQ ID NO: 9212 - DNA, 22 bp, Homo sapiens
tagatgaccttgtgttaggcaa

SEQ ID NO: 9213 - DNA, 21 bp, Homo sapiens
aggcttggatctagacaggcc

SEQ ID NO: 9214 - DNA, 22 bp, Homo sapiens
ttttcctggagatggagttgtt

SEQ ID NO: 9215 - DNA, 22 bp, Homo sapiens
aggtggcagatgggggtgctcg

SEQ ID NO: 9216 - DNA, 22 bp, Homo sapiens
atgccactgcgctccagcctgg

SEQ ID NO: 9217 - DNA, 22 bp, Homo sapiens
acccaggctggagtgcagtggc

SEQ ID NO: 9218 - DNA, 22 bp, Homo sapiens
ggcatcgtcctgggcataggga

SEQ ID NO: 9219 - DNA, 22 bp, Homo sapiens
agcccaggctggagtgcagtgg

SEQ ID NO: 9220 - DNA, 22 bp, Homo sapiens
ttagggttacaccagcctcctg

SEQ ID NO: 9221 - DNA, 22 bp, Homo sapiens
agagaagagtcttgtcaaatta

SEQ ID NO: 9222 - DNA, 22 bp, Homo sapiens
ctgtaatcccagctacctggga

SEQ ID NO: 9223 - DNA, 22 bp, Homo sapiens
tccaccatgtaacaagctctgt

SEQ ID NO: 9224 - DNA, 22 bp, Homo sapiens
tcacgtgagggacctgtgtctg

SEQ ID NO: 9225 - DNA, 22 bp, Homo sapiens
tgggtgagcggctgcacacccg

SEQ ID NO: 9226 - DNA, 22 bp, Homo sapiens
accagcctggccaacatggcaa

SEQ ID NO: 9227 - DNA, 19 bp, Homo sapiens
aggcttcaggccacatgct

SEQ ID NO: 9228 - DNA, 22 bp, Homo sapiens
ctcctctttagccccagctgga

SEQ ID NO: 9229 - DNA, 22 bp, Homo sapiens
cagagagaatcttggcagctga

SEQ ID NO: 9230 - DNA, 22 bp, Homo sapiens
tgagccaagatcatgccgttgt

SEQ ID NO: 9231 - DNA, 22 bp, Homo sapiens
tccaactttctcctccggcttg

SEQ ID NO: 9232 - DNA, 22 bp, Homo sapiens
ttgtgctctgtgttatttaagg

SEQ ID NO: 9233 - DNA, 22 bp, Homo sapiens
agggtgaatctcacaactctta

SEQ ID NO: 9234 - DNA, 22 bp, Homo sapiens
cgtgtggtcccggcaaggcaag

SEQ ID NO: 9235 - DNA, 22 bp, Homo sapiens
gtccctgagcctggcatttccc

SEQ ID NO: 9236 - DNA, 19 bp, Homo sapiens
tcctgcccaccagccaggg

SEQ ID NO: 9237 - DNA, 22 bp, Homo sapiens
atattgaaccctacagactgta

SEQ ID NO: 9238 - DNA, 22 bp, Homo sapiens
ttttcatttttgtagatgcaag

SEQ ID NO: 9239 - DNA, 22 bp, Homo sapiens
aaagaggcaatcaatgtagcaa

SEQ ID NO: 9240 - DNA, 19 bp, Homo sapiens
ggcttcgaggctggggaag

SEQ ID NO: 9241 - DNA, 22 bp, Homo sapiens
gcagggaggtttgctgacctgg

SEQ ID NO: 9242 - DNA, 22 bp, Homo sapiens
tgccctggctcttcttgttcca

SEQ ID NO: 9243 - DNA, 23 bp, Homo sapiens
tcggtgggcgtggaggccgaggc

SEQ ID NO: 9244 - DNA, 22 bp, Homo sapiens
tgtcacagtttgtactttatag

SEQ ID NO: 9245 - DNA, 22 bp, Homo sapiens
gagagtgagatcctcctgggga

SEQ ID NO: 9246 - DNA, 22 bp, Homo sapiens
ctgggaggcggagcttgcagtg

SEQ ID NO: 9247 - DNA, 22 bp, Homo sapiens
cctcttcaggcactcgaaggcc

SEQ ID NO: 9248 - DNA, 22 bp, Homo sapiens
caccaggctggagtgcagtggc

SEQ ID NO: 9249 - DNA, 22 bp, Homo sapiens
gggcccttcagcttcctctgca

SEQ ID NO: 9250 - DNA, 22 bp, Homo sapiens
gggcaggggtcagtggccccaa

SEQ ID NO: 9251 - DNA, 22 bp, Homo sapiens
gcgctgcgcctcctcttccgca

SEQ ID NO: 9252 - DNA, 22 bp, Homo sapiens
tgtctggtgggttgacaggcag

SEQ ID NO: 9253 - DNA, 22 bp, Homo sapiens
gcaaaagtacagccggatttct

SEQ ID NO: 9254 - DNA, 22 bp, Homo sapiens
attgtggtgtcagttataggca

SEQ ID NO: 9255 - DNA, 19 bp, Homo sapiens
ctgtccttggctgcactgt

SEQ ID NO: 9256 - DNA, 22 bp, Homo sapiens
aagtgctgagactacaggcatg

SEQ ID NO: 9257 - DNA, 19 bp, Homo sapiens
tcctggggaggggcatggc

SEQ ID NO: 9258 - DNA, 22 bp, Homo sapiens
agcccggcttccccggttgcta

SEQ ID NO: 9259 - DNA, 22 bp, Homo sapiens
gctttatccgcttgacccttac

SEQ ID NO: 9260 - DNA, 22 bp, Homo sapiens
tctccgatcacaggttttcaat

SEQ ID NO: 9261 - DNA, 22 bp, Homo sapiens
ctcccagccttcgccagtctga

SEQ ID NO: 9262 - DNA, 22 bp, Homo sapiens
ttcttctttccaattacatggt

SEQ ID NO: 9263 - DNA, 22 bp, Homo sapiens
acacggcactttaggaaggggc

SEQ ID NO: 9264 - DNA, 22 bp, Homo sapiens
ctgtccctgagcaactcctgtt

SEQ ID NO: 9265 - DNA, 22 bp, Homo sapiens
ctggcaggtggaggttgcagtg

SEQ ID NO: 9266 - DNA, 22 bp, Homo sapiens
gaggcagaggttgttgcagtga

SEQ ID NO: 9267 - DNA, 22 bp, Homo sapiens
aggagggagcttaagccaggca

SEQ ID NO: 9268 - DNA, 21 bp, Homo sapiens
tggtacaccttgcctgtcaga

SEQ ID NO: 9269 - DNA, 22 bp, Homo sapiens
ctatacagcagcttactagtta

SEQ ID NO: 9270 - DNA, 22 bp, Homo sapiens
tagggtagtaccatgctgccag

SEQ ID NO: 9271 - DNA, 22 bp, Homo sapiens
cgagagatgggttggcaggggc

SEQ ID NO: 9272 - DNA, 22 bp, Homo sapiens
gtggcagagccaaggctggagc

SEQ ID NO: 9273 - DNA, 22 bp, Homo sapiens
ctcattgcaacctccgcctccc

SEQ ID NO: 9274 - DNA, 22 bp, Homo sapiens
cctccccacagcccaggagact

SEQ ID NO: 9275 - DNA, 22 bp, Homo sapiens
ttcctgttcaggaaagttgtgt

SEQ ID NO: 9276 - DNA, 20 bp, Homo sapiens
tgagacccgctgacaagttc

SEQ ID NO: 9277 - DNA, 22 bp, Homo sapiens
tcactgcaacctccacctcccg

SEQ ID NO: 9278 - DNA, 22 bp, Homo sapiens
ctctgtagaaagagcccaggtg

SEQ ID NO: 9279 - DNA, 22 bp, Homo sapiens
gaatgcagatggctggtgtatg

SEQ ID NO: 9280 - DNA, 21 bp, Homo sapiens
tccttcagtctagatgattgt

SEQ ID NO: 9281 - DNA, 22 bp, Homo sapiens
gcagaggacacaggagggcaag

SEQ ID NO: 9282 - DNA, 22 bp, Homo sapiens
gtggagggtgattgccggctgt

SEQ ID NO: 9283 - DNA, 22 bp, Homo sapiens
aggagcagaccgtagtcctgca

SEQ ID NO: 9284 - DNA, 19 bp, Homo sapiens
catctggatgattctcctg

SEQ ID NO: 9285 - DNA, 22 bp, Homo sapiens
gaggaggcttccgggaggcacg

SEQ ID NO: 9286 - DNA, 22 bp, Homo sapiens
gaagccagtgtttgaagaattt

SEQ ID NO: 9287 - DNA, 22 bp, Homo sapiens
tggatctcggcaatgcgggact

SEQ ID NO: 9288 - DNA, 22 bp, Homo sapiens
tgaagactcagaagctaagata

SEQ ID NO: 9289 - DNA, 22 bp, Homo sapiens
ccaggggggcgtagatgctggg

SEQ ID NO: 9290 - DNA, 22 bp, Homo sapiens
tgcctcagctgaggccgctcca

SEQ ID NO: 9291 - DNA, 22 bp, Homo sapiens
caggctgatcagggctgggatg

SEQ ID NO: 9292 - DNA, 19 bp, Homo sapiens
gatttaaacgtggctctat

SEQ ID NO: 9293 - DNA, 22 bp, Homo sapiens
tccttgactgtgaggaactagc

SEQ ID NO: 9294 - DNA, 22 bp, Homo sapiens
aggctatttccactcttctcat

SEQ ID NO: 9295 - DNA, 22 bp, Homo sapiens
actgggcagcagctcgagccgc

SEQ ID NO: 9296 - DNA, 22 bp, Homo sapiens
catgagatctgcagggatgggc

SEQ ID NO: 9297 - DNA, 22 bp, Homo sapiens
cgccaggcttggtagctcatgc

SEQ ID NO: 9298 - DNA, 22 bp, Homo sapiens
tagatttgtttccttctctcca

SEQ ID NO: 9299 - DNA, 23 bp, Homo sapiens
gttttacaggtgagaaaatggag

SEQ ID NO: 9300 - DNA, 23 bp, Homo sapiens
attttttgtctttgtaactagat

SEQ ID NO: 9301 - DNA, 22 bp, Homo sapiens
aaaatatgtataactcttctgc

SEQ ID NO: 9302 - DNA, 22 bp, Homo sapiens
gtcagcgtgctcagcctattat

SEQ ID NO: 9303 - DNA, 22 bp, Homo sapiens
ttatttgtggcatatgagacga

SEQ ID NO: 9304 - DNA, 22 bp, Homo sapiens
tggtcgaccagttggaaagtaa

SEQ ID NO: 9305 - DNA, 22 bp, Homo sapiens
aagcccttggcgcacaccgggc

SEQ ID NO: 9306 - DNA, 22 bp, Homo sapiens
ggctgggctccgggagcatgcg

SEQ ID NO: 9307 - DNA, 19 bp, Homo sapiens
ggtatatgggcctcacttg

SEQ ID NO: 9308 - DNA, 22 bp, Homo sapiens
gctggaggatggactggaagaa

SEQ ID NO: 9309 - DNA, 22 bp, Homo sapiens
atatatttgagaatattcatga

SEQ ID NO: 9310 - DNA, 22 bp, Homo sapiens
ataaaaactgacccatcctttg

SEQ ID NO: 9311 - DNA, 22 bp, Homo sapiens
tcaggaggcggaggttgcagtg

SEQ ID NO: 9312 - DNA, 22 bp, Homo sapiens
gttatataagacaaatcagagt

SEQ ID NO: 9313 - DNA, 22 bp, Homo sapiens
ctgctttgcatagctgccagag

SEQ ID NO: 9314 - DNA, 22 bp, Homo sapiens
tggagccagcggcctgctgagg

SEQ ID NO: 9315 - DNA, 22 bp, Homo sapiens
gccctgagaagaagtcggaggg

SEQ ID NO: 9316 - DNA, 22 bp, Homo sapiens
agagggatcaccctgtttctgg

SEQ ID NO: 9317 - DNA, 22 bp, Homo sapiens
taggttttcctaaaattctggt

SEQ ID NO: 9318 - DNA, 22 bp, Homo sapiens
ctgaggcaggcagatcacttga

SEQ ID NO: 9319 - DNA, 22 bp, Homo sapiens
gcagctattgtctcctgggccc

SEQ ID NO: 9320 - DNA, 22 bp, Homo sapiens
attataggcttgagccaccgtg

SEQ ID NO: 9321 - DNA, 20 bp, Homo sapiens
gctgaggggtctatggcata

SEQ ID NO: 9322 - DNA, 22 bp, Homo sapiens
caggcagaagaagtggaaggac

SEQ ID NO: 9323 - DNA, 22 bp, Homo sapiens
atacctgtgtatccacaagcgt

SEQ ID NO: 9324 - DNA, 22 bp, Homo sapiens
cccaggcttttctcttgcccca

SEQ ID NO: 9325 - DNA, 22 bp, Homo sapiens
atgaggcaggtggaggctgcca

SEQ ID NO: 9326 - DNA, 22 bp, Homo sapiens
ctacccttaagtttctgtgggg

SEQ ID NO: 9327 - DNA, 23 bp, Homo sapiens
caccactttctccttctccttgg

SEQ ID NO: 9328 - DNA, 22 bp, Homo sapiens
gctggcagacttcctctggaac

SEQ ID NO: 9329 - DNA, 22 bp, Homo sapiens
tgtcaccatgcgaggctaattt

SEQ ID NO: 9330 - DNA, 22 bp, Homo sapiens
actttcttggtcccatgtttga

SEQ ID NO: 9331 - DNA, 22 bp, Homo sapiens
ctacaaaagtaattgtggtttt

SEQ ID NO: 9332 - DNA, 22 bp, Homo sapiens
cacccaggctggagtgcagtga

SEQ ID NO: 9333 - DNA, 18 bp, Homo sapiens
gaggtagataagattttc

SEQ ID NO: 9334 - DNA, 22 bp, Homo sapiens
tgggcaggggccctgcttccgt

SEQ ID NO: 9335 - DNA, 22 bp, Homo sapiens
tacaaaaaattgatactgacga

SEQ ID NO: 9336 - DNA, 22 bp, Homo sapiens
agaagcattggaccaggggccc

SEQ ID NO: 9337 - DNA, 22 bp, Homo sapiens
gagagtctaggaacctcatata

SEQ ID NO: 9338 - DNA, 22 bp, Homo sapiens
ggaggcagaatagagtgtgggt

SEQ ID NO: 9339 - DNA, 22 bp, Homo sapiens
tctaccctgcggtcttggggca

SEQ ID NO: 9340 - DNA, 22 bp, Homo sapiens
tttgaagactactgggagtgaa

SEQ ID NO: 9341 - DNA, 17 bp, Homo sapiens
tctgagaatgctggagg

SEQ ID NO: 9342 - DNA, 22 bp, Homo sapiens
ttttaatactgctattgtagga

SEQ ID NO: 9343 - DNA, 21 bp, Homo sapiens
accctgctttatgccgtcctc

SEQ ID NO: 9344 - DNA, 22 bp, Homo sapiens
tcgctgaggctgcacggctgcc

SEQ ID NO: 9345 - DNA, 22 bp, Homo sapiens
ggtgtagctctgtgtcccactg

SEQ ID NO: 9346 - DNA, 22 bp, Homo sapiens
tgtctcatctcttaaccccact

SEQ ID NO: 9347 - DNA, 22 bp, Homo sapiens
ttctatttttgtggaactgtag

SEQ ID NO: 9348 - DNA, 22 bp, Homo sapiens
tgccaggcgtggtggtgcgcac

SEQ ID NO: 9349 - DNA, 22 bp, Homo sapiens
ccgggcctcgggacaccgggta

SEQ ID NO: 9350 - DNA, 22 bp, Homo sapiens
gagagtctagtgcacctagttt

SEQ ID NO: 9351 - DNA, 22 bp, Homo sapiens
ctgcatccatgttgctgcaaag

SEQ ID NO: 9352 - DNA, 22 bp, Homo sapiens
taacaatacccattctaattac

SEQ ID NO: 9353 - DNA, 22 bp, Homo sapiens
gtgctccctccttcctcaagga

SEQ ID NO: 9354 - DNA, 22 bp, Homo sapiens
ctgtccccacccaaatctcatc

SEQ ID NO: 9355 - DNA, 22 bp, Homo sapiens
cccaggctggagtgcagtggcg

SEQ ID NO: 9356 - DNA, 22 bp, Homo sapiens
ttaaatattatgttgtctgcaa

SEQ ID NO: 9357 - DNA, 22 bp, Homo sapiens
tgcctccctggcaagtctctcc

SEQ ID NO: 9358 - DNA, 22 bp, Homo sapiens
gtgagactcgcctttgtgtagc

SEQ ID NO: 9359 - DNA, 22 bp, Homo sapiens
ctcactgcaagctcagcctccc

SEQ ID NO: 9360 - DNA, 22 bp, Homo sapiens
gctcactgcaagctctgcctcc

SEQ ID NO: 9361 - DNA, 22 bp, Homo sapiens
aagtgctgggattacaggcatg

SEQ ID NO: 9362 - DNA, 20 bp, Homo sapiens
aggggcacctgcgacggggc

SEQ ID NO: 9363 - DNA, 22 bp, Homo sapiens
aggtttctttatgctgctagaa

SEQ ID NO: 9364 - DNA, 22 bp, Homo sapiens
tgtttgagttctagcgcattta

SEQ ID NO: 9365 - DNA, 21 bp, Homo sapiens
ctggaggcaggtggtgccagg

SEQ ID NO: 9366 - DNA, 20 bp, Homo sapiens
gctctgtggtttgagtctcc

SEQ ID NO: 9367 - DNA, 21 bp, Homo sapiens
cttccccaggctggtctgtat

SEQ ID NO: 9368 - DNA, 23 bp, Homo sapiens
ggagtgcaatggcgccatctcgg

SEQ ID NO: 9369 - DNA, 22 bp, Homo sapiens
cccagcaggtcggtgctgcctg

SEQ ID NO: 9370 - DNA, 22 bp, Homo sapiens
caggtgagaggcggtcctgcat

SEQ ID NO: 9371 - DNA, 22 bp, Homo sapiens
atgaggcaggagtgcagtggca

SEQ ID NO: 9372 - DNA, 22 bp, Homo sapiens
acatatgcgatcataggatgca

SEQ ID NO: 9373 - DNA, 22 bp, Homo sapiens
tgcgttgcgctcctgcagcagg

SEQ ID NO: 9374 - DNA, 22 bp, Homo sapiens
cacccaggttggagtgcagtgg

SEQ ID NO: 9375 - DNA, 22 bp, Homo sapiens
ctgaggagaggtggcctgtgtt

SEQ ID NO: 9376 - DNA, 22 bp, Homo sapiens
aagaaatgctgatgttggatgg

SEQ ID NO: 9377 - DNA, 17 bp, Homo sapiens
tggctctgtcctcagct

SEQ ID NO: 9378 - DNA, 23 bp, Homo sapiens
agctctgctcgggcatgccctgc

SEQ ID NO: 9379 - DNA, 22 bp, Homo sapiens
ctgaggcaggagagttgcttga

SEQ ID NO: 9380 - DNA, 22 bp, Homo sapiens
ttgtgagtagtgccgcaataaa

SEQ ID NO: 9381 - DNA, 22 bp, Homo sapiens
ctgctcagtaatagtcctatct

SEQ ID NO: 9382 - DNA, 22 bp, Homo sapiens
gggagaggttacccgagcaact

SEQ ID NO: 9383 - DNA, 22 bp, Homo sapiens
ccacctgagataagagagctca

SEQ ID NO: 9384 - DNA, 22 bp, Homo sapiens
aaggagaaatggtagatgtgca

SEQ ID NO: 9385 - DNA, 22 bp, Homo sapiens
tacatttataaggcttctctgt

SEQ ID NO: 9386 - DNA, 19 bp, Homo sapiens
aggaatggaattaattctg

SEQ ID NO: 9387 - DNA, 22 bp, Homo sapiens
gggctgtaggagctggaatggg

SEQ ID NO: 9388 - DNA, 22 bp, Homo sapiens
ttattttaccttcctctgagct

SEQ ID NO: 9389 - DNA, 17 bp, Homo sapiens
gggcagggactcctggg

SEQ ID NO: 9390 - DNA, 22 bp, Homo sapiens
cattctctctacttgttttcaa

SEQ ID NO: 9391 - DNA, 21 bp, Homo sapiens
gctgctcgagatccagtgctt

SEQ ID NO: 9392 - DNA, 22 bp, Homo sapiens
atatacacatctttttaaatat

SEQ ID NO: 9393 - DNA, 22 bp, Homo sapiens
tccttcactccctctgcatcca

SEQ ID NO: 9394 - DNA, 20 bp, Homo sapiens
ggcagagggcctgggagaag

SEQ ID NO: 9395 - DNA, 22 bp, Homo sapiens
gtggagaggaacccagctctgt

SEQ ID NO: 9396 - DNA, 22 bp, Homo sapiens
acctagaatttaaaacattgct

SEQ ID NO: 9397 - DNA, 22 bp, Homo sapiens
ttttctaacatctagtaatttg

SEQ ID NO: 9398 - DNA, 22 bp, Homo sapiens
aaggatgattggtaatgacact

SEQ ID NO: 9399 - DNA, 22 bp, Homo sapiens
caggctggagtgcagtggtgcc

SEQ ID NO: 9400 - DNA, 22 bp, Homo sapiens
aattttctggtgtgtaatgaag

SEQ ID NO: 9401 - DNA, 22 bp, Homo sapiens
ctgggcctggggctgttgagag

SEQ ID NO: 9402 - DNA, 22 bp, Homo sapiens
ggcaggaggtgagtggcgggtg

SEQ ID NO: 9403 - DNA, 22 bp, Homo sapiens
tgcctgcctaggaagctgtgaa

SEQ ID NO: 9404 - DNA, 22 bp, Homo sapiens
ggctgagttgagaggattactt

SEQ ID NO: 9405 - DNA, 22 bp, Homo sapiens
cccagcgagtttgccggtgaac

SEQ ID NO: 9406 - DNA, 22 bp, Homo sapiens
gaggccaaggtgggcagatcac

SEQ ID NO: 9407 - DNA, 22 bp, Homo sapiens
ctctgcctcccaggttcaagcg

SEQ ID NO: 9408 - DNA, 22 bp, Homo sapiens
cagaggtagcatgctgtggctt

SEQ ID NO: 9409 - DNA, 22 bp, Homo sapiens
caaagggaaaagccatgtgggc

SEQ ID NO: 9410 - DNA, 22 bp, Homo sapiens
ccagatatcactgccgtgttgt

SEQ ID NO: 9411 - DNA, 22 bp, Homo sapiens
tcacttagatggggatcatcac

SEQ ID NO: 9412 - DNA, 22 bp, Homo sapiens
aaaagtcttggggaaggccagg

SEQ ID NO: 9413 - DNA, 22 bp, Homo sapiens
caggcagggagctggaaaggat

SEQ ID NO: 9414 - DNA, 22 bp, Homo sapiens
acccagggctcaagcgtaggca

SEQ ID NO: 9415 - DNA, 22 bp, Homo sapiens
gcaggcagatcacctgtcagga

SEQ ID NO: 9416 - DNA, 22 bp, Homo sapiens
tttctggcagcgggacaggggt

SEQ ID NO: 9417 - DNA, 22 bp, Homo sapiens
ttagctcagaaaatttaaactt

SEQ ID NO: 9418 - DNA, 22 bp, Homo sapiens
gaggcagaggttgcagtgagct

SEQ ID NO: 9419 - DNA, 22 bp, Homo sapiens
cccagttgttgccggctctgga

SEQ ID NO: 9420 - DNA, 22 bp, Homo sapiens
agcccaggttgaggctgcagtg

SEQ ID NO: 9421 - DNA, 22 bp, Homo sapiens
cacgcacgctgggtggaggcgc

SEQ ID NO: 9422 - DNA, 22 bp, Homo sapiens
ttgaggtccccagtacccactg

SEQ ID NO: 9423 - DNA, 22 bp, Homo sapiens
agctgtcaccaggagccggacc

SEQ ID NO: 9424 - DNA, 22 bp, Homo sapiens
gtcctgacggctgattggcctg

SEQ ID NO: 9425 - DNA, 22 bp, Homo sapiens
gcccagtggtaaaagcaggcct

SEQ ID NO: 9426 - DNA, 22 bp, Homo sapiens
ctgcagtatgagctacccaggt

SEQ ID NO: 9427 - DNA, 22 bp, Homo sapiens
tgccctctttctgtacagctcc

SEQ ID NO: 9428 - DNA, 22 bp, Homo sapiens
tcatctccatacggtctcgcag

SEQ ID NO: 9429 - DNA, 23 bp, Homo sapiens
ggaagctcacgtagtcctgcact

SEQ ID NO: 9430 - DNA, 22 bp, Homo sapiens
taggcatgcaaataaatgtgca

SEQ ID NO: 9431 - DNA, 22 bp, Homo sapiens
cccaggaggttgaggctgcagt

SEQ ID NO: 9432 - DNA, 22 bp, Homo sapiens
gaggctgaggcaggaggatcac

SEQ ID NO: 9433 - DNA, 22 bp, Homo sapiens
cagaggaacgtttggattgatt

SEQ ID NO: 9434 - DNA, 22 bp, Homo sapiens
cagagctgtccaaaccctgaca

SEQ ID NO: 9435 - DNA, 22 bp, Homo sapiens
gcacggctaatttttgtatttt

SEQ ID NO: 9436 - DNA, 22 bp, Homo sapiens
acaaggcactttatgaagagga

SEQ ID NO: 9437 - DNA, 22 bp, Homo sapiens
cagagcccctcgtctccaccac

SEQ ID NO: 9438 - DNA, 22 bp, Homo sapiens
aatgttacgatcaacaacacat

SEQ ID NO: 9439 - DNA, 22 bp, Homo sapiens
gtccaaaagagccagccgggcg

SEQ ID NO: 9440 - DNA, 22 bp, Homo sapiens
ttttgcaatgagatgcttgtca

SEQ ID NO: 9441 - DNA, 22 bp, Homo sapiens
tttgcttgttcaagatttctgt

SEQ ID NO: 9442 - DNA, 22 bp, Homo sapiens
ggaggaggggtgactgaatgct

SEQ ID NO: 9443 - DNA, 22 bp, Homo sapiens
cctgcctactgagttttatatt

SEQ ID NO: 9444 - DNA, 22 bp, Homo sapiens
ttagcttttgagaatgatttct

SEQ ID NO: 9445 - DNA, 22 bp, Homo sapiens
gagccaggggtcagctccgagg

SEQ ID NO: 9446 - DNA, 22 bp, Homo sapiens
tgttgcccaggttctctcctgc

SEQ ID NO: 9447 - DNA, 22 bp, Homo sapiens
gagtggggggtccgtctcagtg

SEQ ID NO: 9448 - DNA, 22 bp, Homo sapiens
gctcactgcaacctccgccttc

SEQ ID NO: 9449 - DNA, 22 bp, Homo sapiens
caaagtgctgggattacaggct

SEQ ID NO: 9450 - DNA, 22 bp, Homo sapiens
tcttggattttaatggatcaaa

SEQ ID NO: 9451 - DNA, 22 bp, Homo sapiens
ggacaagcctgtgagtgggttt

SEQ ID NO: 9452 - DNA, 22 bp, Homo sapiens
agcattccacactgaagtctgc

SEQ ID NO: 9453 - DNA, 22 bp, Homo sapiens
ccctgctgtcaggtgctgggag

SEQ ID NO: 9454 - DNA, 22 bp, Homo sapiens
ttgtgaatagtgccgctataaa

SEQ ID NO: 9455 - DNA, 22 bp, Homo sapiens
cctacagttatattcttgattg

SEQ ID NO: 9456 - DNA, 22 bp, Homo sapiens
ggctgatgggcatgagctgtca

SEQ ID NO: 9457 - DNA, 22 bp, Homo sapiens
tgggaggtgattaaattatggg

SEQ ID NO: 9458 - DNA, 22 bp, Homo sapiens
tacaccattcccaggtggattt

SEQ ID NO: 9459 - DNA, 22 bp, Homo sapiens
ctgggaggcagaggttgtagtg

SEQ ID NO: 9460 - DNA, 22 bp, Homo sapiens
gttccaggtggtcacagagctc

SEQ ID NO: 9461 - DNA, 22 bp, Homo sapiens
ttgggctcaggagtttgagacc

SEQ ID NO: 9462 - DNA, 22 bp, Homo sapiens
cttgctttcagtctcggcctca

SEQ ID NO: 9463 - DNA, 22 bp, Homo sapiens
ctgtaatcccagctactcggga

SEQ ID NO: 9464 - DNA, 22 bp, Homo sapiens
gaccctctagatggaagcactg

SEQ ID NO: 9465 - DNA, 22 bp, Homo sapiens
gtgggccactgggaggcaaggg

SEQ ID NO: 9466 - DNA, 22 bp, Homo sapiens
cccacgttgaaccgcttacaga

SEQ ID NO: 9467 - DNA, 22 bp, Homo sapiens
tttacacagaggacactgggct

SEQ ID NO: 9468 - DNA, 22 bp, Homo sapiens
tgaaatgattatatggtgtttg

SEQ ID NO: 9469 - DNA, 22 bp, Homo sapiens
gggagtgggtttggcctaggcc

SEQ ID NO: 9470 - DNA, 19 bp, Homo sapiens
agggaatccggctgaggga

SEQ ID NO: 9471 - DNA, 17 bp, Homo sapiens
acttcccacccctccag

SEQ ID NO: 9472 - DNA, 22 bp, Homo sapiens
tgagcccagagatctgagctat

SEQ ID NO: 9473 - DNA, 22 bp, Homo sapiens
cccattcatcctcgcttccttc

SEQ ID NO: 9474 - DNA, 22 bp, Homo sapiens
gctgcagtgagccaagatcgtg

SEQ ID NO: 9475 - DNA, 22 bp, Homo sapiens
tttctttatcatagcatctttg

SEQ ID NO: 9476 - DNA, 22 bp, Homo sapiens
agcctggtttaagcattttata

SEQ ID NO: 9477 - DNA, 22 bp, Homo sapiens
ttattgaaggaactgaaataaa

SEQ ID NO: 9478 - DNA, 22 bp, Homo sapiens
ccagaggagttgaggctttggg

SEQ ID NO: 9479 - DNA, 22 bp, Homo sapiens
gaggctggacgtgcatttctac

SEQ ID NO: 9480 - DNA, 22 bp, Homo sapiens
ccaggaggttgaggctgcagtg

SEQ ID NO: 9481 - DNA, 22 bp, Homo sapiens
caaagtgctgggattacaggtg

SEQ ID NO: 9482 - DNA, 22 bp, Homo sapiens
gtgtgggctgcagaggcacagc

SEQ ID NO: 9483 - DNA, 22 bp, Homo sapiens
gttaggtagaagtttactttga

SEQ ID NO: 9484 - DNA, 22 bp, Homo sapiens
ttttaagttggattgctaagta

SEQ ID NO: 9485 - DNA, 22 bp, Homo sapiens
tatttcttttcgtgacttattg

SEQ ID NO: 9486 - DNA, 22 bp, Homo sapiens
ctccaacgaggctggggtacaa

SEQ ID NO: 9487 - DNA, 22 bp, Homo sapiens
tgggcagggagctggaaccaca

SEQ ID NO: 9488 - DNA, 22 bp, Homo sapiens
caggccagggttgagaagagaa

SEQ ID NO: 9489 - DNA, 22 bp, Homo sapiens
caggtggcagtgcctgcattct

SEQ ID NO: 9490 - DNA, 22 bp, Homo sapiens
gttctgagtcctcctttgaagg

SEQ ID NO: 9491 - DNA, 23 bp, Homo sapiens
tgagctgggcctgcaggggtctc

SEQ ID NO: 9492 - DNA, 22 bp, Homo sapiens
tccagcttataggtagatttaa

SEQ ID NO: 9493 - DNA, 22 bp, Homo sapiens
acccaggctggcgtgcagtggc

SEQ ID NO: 9494 - DNA, 19 bp, Homo sapiens
ccagagagctaggtacaga

SEQ ID NO: 9495 - DNA, 22 bp, Homo sapiens
ccaggctggagtgcaatggcat

SEQ ID NO: 9496 - DNA, 22 bp, Homo sapiens
ctcctgggaaaggctggacaca

SEQ ID NO: 9497 - DNA, 22 bp, Homo sapiens
ccacccttgggttcggaggccg

SEQ ID NO: 9498 - DNA, 22 bp, Homo sapiens
aagtgatgctacgactttgaca

SEQ ID NO: 9499 - DNA, 22 bp, Homo sapiens
ctggagggctgcagcgaggctg

SEQ ID NO: 9500 - DNA, 22 bp, Homo sapiens
tgtagtagcattcacgaagtgt

SEQ ID NO: 9501 - DNA, 22 bp, Homo sapiens
tgtgcacaatgtgcaggtttgt

SEQ ID NO: 9502 - DNA, 22 bp, Homo sapiens
tttatagtagcatgatttataa

SEQ ID NO: 9503 - DNA, 22 bp, Homo sapiens
gctcatgactgtaatcccagca

SEQ ID NO: 9504 - DNA, 22 bp, Homo sapiens
gaggtggccaagcgaggaaggg

SEQ ID NO: 9505 - DNA, 22 bp, Homo sapiens
gccgggttcaagccattctcct

SEQ ID NO: 9506 - DNA, 22 bp, Homo sapiens
gccggggctggggagagacatg

SEQ ID NO: 9507 - DNA, 19 bp, Homo sapiens
gactcacaccttccgctgt

SEQ ID NO: 9508 - DNA, 22 bp, Homo sapiens
taggctgggggtaggaattgag

SEQ ID NO: 9509 - DNA, 22 bp, Homo sapiens
taaagggtaggttttactgtaa

SEQ ID NO: 9510 - DNA, 22 bp, Homo sapiens
aggagatggagctcagtgggca

SEQ ID NO: 9511 - DNA, 22 bp, Homo sapiens
gctggggaggcagcagagaaca

SEQ ID NO: 9512 - DNA, 22 bp, Homo sapiens
caggctggagtacaattgtgtg

SEQ ID NO: 9513 - DNA, 22 bp, Homo sapiens
agcctggcctgggcaggcacat

SEQ ID NO: 9514 - DNA, 22 bp, Homo sapiens
cagtggcgtgatctctgctcac

SEQ ID NO: 9515 - DNA, 22 bp, Homo sapiens
gaggggagcccccatcctccag

SEQ ID NO: 9516 - DNA, 22 bp, Homo sapiens
gccatgggcaaatgcagagctg

SEQ ID NO: 9517 - DNA, 22 bp, Homo sapiens
gcctcctggggtgccatcatct

SEQ ID NO: 9518 - DNA, 22 bp, Homo sapiens
cacccaggctggagtgcagtgg

SEQ ID NO: 9519 - DNA, 22 bp, Homo sapiens
atgaaatatcttgaagaaattc

SEQ ID NO: 9520 - DNA, 22 bp, Homo sapiens
gaccttcttgctgtgtcctaac

SEQ ID NO: 9521 - DNA, 22 bp, Homo sapiens
gcttaattctggctcagtttcc

SEQ ID NO: 9522 - DNA, 22 bp, Homo sapiens
gggcagagactcagaaacagaa

SEQ ID NO: 9523 - DNA, 22 bp, Homo sapiens
cccaggaggcggaggttgcagt

SEQ ID NO: 9524 - DNA, 22 bp, Homo sapiens
ctccagttggccccagttggtt

SEQ ID NO: 9525 - DNA, 22 bp, Homo sapiens
ggaggtggagctggaagttcca

SEQ ID NO: 9526 - DNA, 22 bp, Homo sapiens
tcttaagcagagaagaagttga

SEQ ID NO: 9527 - DNA, 22 bp, Homo sapiens
ggtggttcacgcctataatccc

SEQ ID NO: 9528 - DNA, 22 bp, Homo sapiens
ccctggaggcggagcttgcagt

SEQ ID NO: 9529 - DNA, 22 bp, Homo sapiens
gagctgagaagcagcgcttgat

SEQ ID NO: 9530 - DNA, 22 bp, Homo sapiens
tatccaattcaccattgatggg

SEQ ID NO: 9531 - DNA, 22 bp, Homo sapiens
gctcgaccgccagaaacttcct

SEQ ID NO: 9532 - DNA, 22 bp, Homo sapiens
gtcctggggattatagagtgtt

SEQ ID NO: 9533 - DNA, 22 bp, Homo sapiens
tctgttgcaatgtgcatggtga

SEQ ID NO: 9534 - DNA, 22 bp, Homo sapiens
agtgcagtggttaggagccagg

SEQ ID NO: 9535 - DNA, 22 bp, Homo sapiens
agaggaagtaatcaggacctgc

SEQ ID NO: 9536 - DNA, 22 bp, Homo sapiens
gaatgctaagcatgtgggagtt

SEQ ID NO: 9537 - DNA, 22 bp, Homo sapiens
ttatttaaaagtggtaagattc

SEQ ID NO: 9538 - DNA, 22 bp, Homo sapiens
ggaggctgagaggtcgcagtgg

SEQ ID NO: 9539 - DNA, 22 bp, Homo sapiens
aaagtgcttcctttttgagggt

SEQ ID NO: 9540 - DNA, 22 bp, Homo sapiens
catccaggctgaagtgcagtgg

SEQ ID NO: 9541 - DNA, 22 bp, Homo sapiens
ggccctggcagccacgaaagcc

SEQ ID NO: 9542 - DNA, 20 bp, Homo sapiens
tttcttgtcggctgttgctg

SEQ ID NO: 9543 - DNA, 22 bp, Homo sapiens
ggccggggcctgctcgcctgtg

SEQ ID NO: 9544 - DNA, 22 bp, Homo sapiens
aaaaaattatcatagttcctga

SEQ ID NO: 9545 - DNA, 22 bp, Homo sapiens
aaatgtaagtctttgtttctta

SEQ ID NO: 9546 - DNA, 22 bp, Homo sapiens
gctcccaggatgaggagccagg

SEQ ID NO: 9547 - DNA, 22 bp, Homo sapiens
tcctcggctgggccccaggctt

SEQ ID NO: 9548 - DNA, 22 bp, Homo sapiens
acaaagtgctgacattacaggc

SEQ ID NO: 9549 - DNA, 22 bp, Homo sapiens
tcgcccaggctggaagtgcagt

SEQ ID NO: 9550 - DNA, 22 bp, Homo sapiens
aggctgtagtgcatgtgctatg

SEQ ID NO: 9551 - DNA, 22 bp, Homo sapiens
ccctggaggttgaggctgcagt

SEQ ID NO: 9552 - DNA, 22 bp, Homo sapiens
ggaggcggaggttgcagtgagc

SEQ ID NO: 9553 - DNA, 22 bp, Homo sapiens
gagagaagggggatatgagcct

SEQ ID NO: 9554 - DNA, 22 bp, Homo sapiens
gacttttgaataaggtaggata

SEQ ID NO: 9555 - DNA, 19 bp, Homo sapiens
atctgccttagtgctgctg

SEQ ID NO: 9556 - DNA, 18 bp, Homo sapiens
cagggctgtggggtcact

SEQ ID NO: 9557 - DNA, 22 bp, Homo sapiens
agcaagatttttcaggttagta

SEQ ID NO: 9558 - DNA, 20 bp, Homo sapiens
aactcctagcctcaagtgat

SEQ ID NO: 9559 - DNA, 21 bp, Homo sapiens
ccaccaggtcttctgctcggg

SEQ ID NO: 9560 - DNA, 22 bp, Homo sapiens
agctggtgctcggggagctggc

SEQ ID NO: 9561 - DNA, 22 bp, Homo sapiens
attctcataggagcgtgaacct

SEQ ID NO: 9562 - DNA, 22 bp, Homo sapiens
ggttttatcctacccacacagc

SEQ ID NO: 9563 - DNA, 22 bp, Homo sapiens
cttgacactgtcactcaggcca

SEQ ID NO: 9564 - DNA, 22 bp, Homo sapiens
ggctcaatgcaacttctgcctc

SEQ ID NO: 9565 - DNA, 22 bp, Homo sapiens
aagtggactaatacaaggacta

SEQ ID NO: 9566 - DNA, 22 bp, Homo sapiens
aggcactgtgcagtcccaagca

SEQ ID NO: 9567 - DNA, 22 bp, Homo sapiens
tgggcgacagagcaagactccg

SEQ ID NO: 9568 - DNA, 22 bp, Homo sapiens
gagcccaggaagtggaggctga

SEQ ID NO: 9569 - DNA, 22 bp, Homo sapiens
ctttgcttgacactgtgattgt

SEQ ID NO: 9570 - DNA, 22 bp, Homo sapiens
gattgagtctgaggatgctgca

SEQ ID NO: 9571 - DNA, 21 bp, Homo sapiens
tctgatggtagatgagatgtg

SEQ ID NO: 9572 - DNA, 22 bp, Homo sapiens
acttgccccagaattgctgctg

SEQ ID NO: 9573 - DNA, 22 bp, Homo sapiens
catgcggctctttccaaaccgg

SEQ ID NO: 9574 - DNA, 22 bp, Homo sapiens
ccaaagtgctgggattacaggt

SEQ ID NO: 9575 - DNA, 22 bp, Homo sapiens
tttgggttcagacatgattaca

SEQ ID NO: 9576 - DNA, 22 bp, Homo sapiens
acgcccagactcccatactttg

SEQ ID NO: 9577 - DNA, 23 bp, Homo sapiens
tagatgtattaagtgcattttca

SEQ ID NO: 9578 - DNA, 22 bp, Homo sapiens
agagtggagagaaacaactctg

SEQ ID NO: 9579 - DNA, 22 bp, Homo sapiens
ggaagaaaggtggacaacaggt

SEQ ID NO: 9580 - DNA, 22 bp, Homo sapiens
ttggagatatcacaccttcaca

SEQ ID NO: 9581 - DNA, 22 bp, Homo sapiens
tcagccccacggggtcagccaa

SEQ ID NO: 9582 - DNA, 22 bp, Homo sapiens
aggatgagccgcgcaagctgac

SEQ ID NO: 9583 - DNA, 22 bp, Homo sapiens
agggctgcccagtgtgagagct

SEQ ID NO: 9584 - DNA, 19 bp, Homo sapiens
ctctgggcaagtcacttaa

SEQ ID NO: 9585 - DNA, 22 bp, Homo sapiens
tcagtggagagcttccaggatt

SEQ ID NO: 9586 - DNA, 22 bp, Homo sapiens
cttcactttaagccaatcatga

SEQ ID NO: 9587 - DNA, 22 bp, Homo sapiens
tctcagaacctcagtttgctct

SEQ ID NO: 9588 - DNA, 22 bp, Homo sapiens
accccagaggcggaggctgcag

SEQ ID NO: 9589 - DNA, 19 bp, Homo sapiens
atgtacccagtgtcaatcc

SEQ ID NO: 9590 - DNA, 22 bp, Homo sapiens
gccagatttacagatttgccct

SEQ ID NO: 9591 - DNA, 22 bp, Homo sapiens
caaagtgctaggattacaggcg

SEQ ID NO: 9592 - DNA, 18 bp, Homo sapiens
acacttcctggtggtgtg

SEQ ID NO: 9593 - DNA, 22 bp, Homo sapiens
tttctcctcatgactggttgtg

SEQ ID NO: 9594 - DNA, 22 bp, Homo sapiens
tctgacattagattaattggaa

SEQ ID NO: 9595 - DNA, 22 bp, Homo sapiens
tggcatctttgtcccagaagct

SEQ ID NO: 9596 - DNA, 22 bp, Homo sapiens
tgaggaaacttacaaggcagaa

SEQ ID NO: 9597 - DNA, 22 bp, Homo sapiens
ctgaggtgtgaaatggtggcaa

SEQ ID NO: 9598 - DNA, 22 bp, Homo sapiens
ggagagcagggaggctgctctg

SEQ ID NO: 9599 - DNA, 22 bp, Homo sapiens
tttaagaagttatgttataaat

SEQ ID NO: 9600 - DNA, 22 bp, Homo sapiens
tttgagtgcccatgtttcccag

SEQ ID NO: 9601 - DNA, 21 bp, Homo sapiens
gaccccagaccagcagacaca

SEQ ID NO: 9602 - DNA, 22 bp, Homo sapiens
ccaaagtgctgagattacaggt

SEQ ID NO: 9603 - DNA, 22 bp, Homo sapiens
gggtccctggaattacttgaca

SEQ ID NO: 9604 - DNA, 22 bp, Homo sapiens
catgctgtgtgttttagctcca

SEQ ID NO: 9605 - DNA, 21 bp, Homo sapiens
ttgctgttttcccaatgcagt

SEQ ID NO: 9606 - DNA, 22 bp, Homo sapiens
aggtaaagacagtgaaagaggg

SEQ ID NO: 9607 - DNA, 22 bp, Homo sapiens
acacttggagcaacacttatgg

SEQ ID NO: 9608 - DNA, 22 bp, Homo sapiens
catgatctggtcctactgtggg

SEQ ID NO: 9609 - DNA, 22 bp, Homo sapiens
agaccactaaaactttctctat

SEQ ID NO: 9610 - DNA, 22 bp, Homo sapiens
cgtgagcaaaatggacactccc

SEQ ID NO: 9611 - DNA, 22 bp, Homo sapiens
gaccctgtttctacaaataatt

SEQ ID NO: 9612 - DNA, 22 bp, Homo sapiens
tacccaaggccctttcaatttc

SEQ ID NO: 9613 - DNA, 22 bp, Homo sapiens
aaattgcaaaagtacttttagg

SEQ ID NO: 9614 - DNA, 22 bp, Homo sapiens
ggagaggggaacttgttgcttg

SEQ ID NO: 9615 - DNA, 22 bp, Homo sapiens
gctcaagccttctgcccacctc

SEQ ID NO: 9616 - DNA, 22 bp, Homo sapiens
tttttagtagaggtgggtttca

SEQ ID NO: 9617 - DNA, 22 bp, Homo sapiens
tgctagtgtgtgagatgttcaa

SEQ ID NO: 9618 - DNA, 22 bp, Homo sapiens
tggcactgaagctggaaagcct

SEQ ID NO: 9619 - DNA, 22 bp, Homo sapiens
tagaaaagccccagctggaggg

SEQ ID NO: 9620 - DNA, 22 bp, Homo sapiens
gaggttggggctgcagtgagct

SEQ ID NO: 9621 - DNA, 21 bp, Homo sapiens
cagggccaatcctgacctcta

SEQ ID NO: 9622 - DNA, 22 bp, Homo sapiens
gcaggtggatcaccacgtcagg

SEQ ID NO: 9623 - DNA, 22 bp, Homo sapiens
tgcatattatgtgtatctgtct

SEQ ID NO: 9624 - DNA, 22 bp, Homo sapiens
tttatagtagcatgatttatag

SEQ ID NO: 9625 - DNA, 22 bp, Homo sapiens
cccaggaggtcaaggctgcagt

SEQ ID NO: 9626 - DNA, 22 bp, Homo sapiens
attgataaattgcaatggggct

SEQ ID NO: 9627 - DNA, 22 bp, Homo sapiens
attggtggtgaggacatgccag

SEQ ID NO: 9628 - DNA, 22 bp, Homo sapiens
ggaggcggaagttgcagtgagc

SEQ ID NO: 9629 - DNA, 22 bp, Homo sapiens
cgttctctcatgatcttcccga

SEQ ID NO: 9630 - DNA, 22 bp, Homo sapiens
cccagggaggcccaggctctgc

SEQ ID NO: 9631 - DNA, 22 bp, Homo sapiens
gtgattttctcctcctagaagt

SEQ ID NO: 9632 - DNA, 22 bp, Homo sapiens
gccaggttgctgacgacgatct

SEQ ID NO: 9633 - DNA, 22 bp, Homo sapiens
tttctcttcactgtgtgcctca

SEQ ID NO: 9634 - DNA, 22 bp, Homo sapiens
ctgctgggatagaagtatctca

SEQ ID NO: 9635 - DNA, 22 bp, Homo sapiens
ctatggtgatagaaatcagaat

SEQ ID NO: 9636 - DNA, 22 bp, Homo sapiens
ggtcgctgtgtaggttcagcta

SEQ ID NO: 9637 - DNA, 23 bp, Homo sapiens
cagggccctgctcaatttctcca

SEQ ID NO: 9638 - DNA, 22 bp, Homo sapiens
gcagtggcatgatgtgggctca

SEQ ID NO: 9639 - DNA, 22 bp, Homo sapiens
ggcagagcttgcagtgagccga

SEQ ID NO: 9640 - DNA, 22 bp, Homo sapiens
cttaatctcacctgcaaagtcc

SEQ ID NO: 9641 - DNA, 22 bp, Homo sapiens
gggagctggagctggaagactc

SEQ ID NO: 9642 - DNA, 22 bp, Homo sapiens
aagaaatgtgaatattgaatag

SEQ ID NO: 9643 - DNA, 18 bp, Homo sapiens
gaggatggaaggagatgc

SEQ ID NO: 9644 - DNA, 22 bp, Homo sapiens
gggagaagaatgtgtcaattgt

SEQ ID NO: 9645 - DNA, 20 bp, Homo sapiens
caagggtttgcattggcttt

SEQ ID NO: 9646 - DNA, 22 bp, Homo sapiens
ttgcaaatcagaagtatagatt

SEQ ID NO: 9647 - DNA, 22 bp, Homo sapiens
ttcagcagtgcagacacccagt

SEQ ID NO: 9648 - DNA, 22 bp, Homo sapiens
caagtctgacctctgggtgaag

SEQ ID NO: 9649 - DNA, 22 bp, Homo sapiens
ttataagactgtagtgagtatt

SEQ ID NO: 9650 - DNA, 22 bp, Homo sapiens
tctttgctccacactctagaga

SEQ ID NO: 9651 - DNA, 22 bp, Homo sapiens
tgggccacacacagaagaatca

SEQ ID NO: 9652 - DNA, 20 bp, Homo sapiens
tgaggcccagcagagtcggg

SEQ ID NO: 9653 - DNA, 22 bp, Homo sapiens
aataaaatggtcagttttctca

SEQ ID NO: 9654 - DNA, 22 bp, Homo sapiens
ggggtgggcgtgcagggacacc

SEQ ID NO: 9655 - DNA, 21 bp, Homo sapiens
gtggttctagagaaacagaat

SEQ ID NO: 9656 - DNA, 22 bp, Homo sapiens
ggctagggatctagaccaggac

SEQ ID NO: 9657 - DNA, 22 bp, Homo sapiens
gctgatagactgaatgttggga

SEQ ID NO: 9658 - DNA, 22 bp, Homo sapiens
ttatgatttgccacagattggt

SEQ ID NO: 9659 - DNA, 22 bp, Homo sapiens
acttttaaatgagtttcagttg

SEQ ID NO: 9660 - DNA, 22 bp, Homo sapiens
atcactgtgtatgtatatgcag

SEQ ID NO: 9661 - DNA, 22 bp, Homo sapiens
cccagggagagcgcggaggcgg

SEQ ID NO: 9662 - DNA, 22 bp, Homo sapiens
taatatctacttcatagagttt

SEQ ID NO: 9663 - DNA, 22 bp, Homo sapiens
acaggggaatttactgtcatta

SEQ ID NO: 9664 - DNA, 22 bp, Homo sapiens
acatcccttgctcggggcccct

SEQ ID NO: 9665 - DNA, 22 bp, Homo sapiens
taggatttaataaaagaataga

SEQ ID NO: 9666 - DNA, 22 bp, Homo sapiens
aagaatgagctcaaagatctta

SEQ ID NO: 9667 - DNA, 23 bp, Homo sapiens
ggggcctgcaccggtctgcgcgg

SEQ ID NO: 9668 - DNA, 22 bp, Homo sapiens
cagtggctggttagggacagga

SEQ ID NO: 9669 - DNA, 22 bp, Homo sapiens
ggctcacgcaattatcccggcc

SEQ ID NO: 9670 - DNA, 22 bp, Homo sapiens
agtggactcttcccagtgcttg

SEQ ID NO: 9671 - DNA, 23 bp, Homo sapiens
cttcacaggttcaggggattaag

SEQ ID NO: 9672 - DNA, 22 bp, Homo sapiens
atgaattgaggaaaacagtcgt

SEQ ID NO: 9673 - DNA, 22 bp, Homo sapiens
tctcctggagcccagatgctgg

SEQ ID NO: 9674 - DNA, 22 bp, Homo sapiens
gggctagcctcttccctgctcc

SEQ ID NO: 9675 - DNA, 22 bp, Homo sapiens
agcaggaaggggatgatgggca

SEQ ID NO: 9676 - DNA, 15 bp, Homo sapiens
catatcactgggaat

SEQ ID NO: 9677 - DNA, 22 bp, Homo sapiens
gtggagagagataagcctggtc

SEQ ID NO: 9678 - DNA, 22 bp, Homo sapiens
cagtcactggaatagctgagga

SEQ ID NO: 9679 - DNA, 22 bp, Homo sapiens
tgagagcctgtgttcaaatgcc

SEQ ID NO: 9680 - DNA, 22 bp, Homo sapiens
tggtcttagctggaaggaggga

SEQ ID NO: 9681 - DNA, 22 bp, Homo sapiens
actgcaacctccgcctgccagg

SEQ ID NO: 9682 - DNA, 22 bp, Homo sapiens
ttggatgagagggtgtggtaca

SEQ ID NO: 9683 - DNA, 22 bp, Homo sapiens
ttggatccatctcaggcatagg

SEQ ID NO: 9684 - DNA, 22 bp, Homo sapiens
ctctgcctcagtgatttcttta

SEQ ID NO: 9685 - DNA, 22 bp, Homo sapiens
tttagattgtgacctcccccca

SEQ ID NO: 9686 - DNA, 22 bp, Homo sapiens
gaaaattattgaaaatggctct

SEQ ID NO: 9687 - DNA, 22 bp, Homo sapiens
tatgtgtttgacaccctgcaag

SEQ ID NO: 9688 - DNA, 23 bp, Homo sapiens
cctgcctccccatcagttataca

SEQ ID NO: 9689 - DNA, 22 bp, Homo sapiens
ggcatctggatctgcttctccc

SEQ ID NO: 9690 - DNA, 22 bp, Homo sapiens
agtgctgggctatctactgcta

SEQ ID NO: 9691 - DNA, 22 bp, Homo sapiens
agtggagacaggacagtcgata

SEQ ID NO: 9692 - DNA, 20 bp, Homo sapiens
agcagagtgcccatcccgga

SEQ ID NO: 9693 - DNA, 21 bp, Homo sapiens
tctctttctggaagcttccct

SEQ ID NO: 9694 - DNA, 22 bp, Homo sapiens
agcaggagtttgatgcttttat

SEQ ID NO: 9695 - DNA, 22 bp, Homo sapiens
caggctggagtgcaatgacgcc

SEQ ID NO: 9696 - DNA, 23 bp, Homo sapiens
caggagatggctgctgtgtcagc

SEQ ID NO: 9697 - DNA, 22 bp, Homo sapiens
ccagcagagcatggggaggaag

SEQ ID NO: 9698 - DNA, 22 bp, Homo sapiens
tatgttgcaccaacctaataat

SEQ ID NO: 9699 - DNA, 22 bp, Homo sapiens
tctctagtctcctttaacctga

SEQ ID NO: 9700 - DNA, 22 bp, Homo sapiens
tgggaagctgcattttaacaag

SEQ ID NO: 9701 - DNA, 22 bp, Homo sapiens
ctcattgcccagatccccacag

SEQ ID NO: 9702 - DNA, 22 bp, Homo sapiens
cacagctgaagtagccatgtgg

SEQ ID NO: 9703 - DNA, 22 bp, Homo sapiens
ccggagtgtctggcctgctggg

SEQ ID NO: 9704 - DNA, 22 bp, Homo sapiens
gatgtgtttccaggatttgttt

SEQ ID NO: 9705 - DNA, 22 bp, Homo sapiens
gtgttgatgacattttagaaac

SEQ ID NO: 9706 - DNA, 22 bp, Homo sapiens
cctgcctatgagacgttttgcc

SEQ ID NO: 9707 - DNA, 22 bp, Homo sapiens
tcaagcaaagtttagctggtta

SEQ ID NO: 9708 - DNA, 22 bp, Homo sapiens
gccttattacctgcactttgaa

SEQ ID NO: 9709 - DNA, 22 bp, Homo sapiens
tttctgagaaattaaacacttt

SEQ ID NO: 9710 - DNA, 23 bp, Homo sapiens
atcattaacagtgcaggggtagg

SEQ ID NO: 9711 - DNA, 22 bp, Homo sapiens
cagtctctaaatcaatctgaat

SEQ ID NO: 9712 - DNA, 22 bp, Homo sapiens
ctggcctcggcagcaggaacag

SEQ ID NO: 9713 - DNA, 22 bp, Homo sapiens
aggcaagggggcgccaccttcc

SEQ ID NO: 9714 - DNA, 22 bp, Homo sapiens
ccctcccagatgggcttgaggt

SEQ ID NO: 9715 - DNA, 22 bp, Homo sapiens
ccaagctacttaggagtctgag

SEQ ID NO: 9716 - DNA, 19 bp, Homo sapiens
gtgtccatggagcatggag

SEQ ID NO: 9717 - DNA, 22 bp, Homo sapiens
gctgctaagcgtttctgttcca

SEQ ID NO: 9718 - DNA, 22 bp, Homo sapiens
atgttggagtcgtaaggcatgg

SEQ ID NO: 9719 - DNA, 22 bp, Homo sapiens
ctcaggagttggaggctacagt

SEQ ID NO: 9720 - DNA, 18 bp, Homo sapiens
cccggctaatttttggta

SEQ ID NO: 9721 - DNA, 22 bp, Homo sapiens
atgcgagtgatgcagagtggct

SEQ ID NO: 9722 - DNA, 22 bp, Homo sapiens
ggaggctgaggcaggcggatca

SEQ ID NO: 9723 - DNA, 22 bp, Homo sapiens
acgcagtttgtggacatttttt

SEQ ID NO: 9724 - DNA, 22 bp, Homo sapiens
ttgagggtctggatctgctgct

SEQ ID NO: 9725 - DNA, 22 bp, Homo sapiens
agaggcaggaggttgacttgag

SEQ ID NO: 9726 - DNA, 21 bp, Homo sapiens
tgactgaggcttcttcacaca

SEQ ID NO: 9727 - DNA, 22 bp, Homo sapiens
cacagacagtgtccctttgttg

SEQ ID NO: 9728 - DNA, 22 bp, Homo sapiens
agtgcaggccccaggccaggcc

SEQ ID NO: 9729 - DNA, 22 bp, Homo sapiens
aggtggagaagagatgggcagt

SEQ ID NO: 9730 - DNA, 22 bp, Homo sapiens
tgcgggttggtggcatatgcag

SEQ ID NO: 9731 - DNA, 22 bp, Homo sapiens
gaagaaggtggcccaggggtag

SEQ ID NO: 9732 - DNA, 22 bp, Homo sapiens
atttagaactttgtttgccaat

SEQ ID NO: 9733 - DNA, 16 bp, Homo sapiens
gcaggcagatcacatg

SEQ ID NO: 9734 - DNA, 22 bp, Homo sapiens
aagtgctgggattacaggtgtc

SEQ ID NO: 9735 - DNA, 22 bp, Homo sapiens
aggccagcagcatgacggcatc

SEQ ID NO: 9736 - DNA, 22 bp, Homo sapiens
gctcccagtctgatggaggaga

SEQ ID NO: 9737 - DNA, 22 bp, Homo sapiens
cttccgtgtcagttccaggtgg

SEQ ID NO: 9738 - DNA, 22 bp, Homo sapiens
ccaaagtgctggggttacaggc

SEQ ID NO: 9739 - DNA, 23 bp, Homo sapiens
aaactacaacgccaggcactgag

SEQ ID NO: 9740 - DNA, 22 bp, Homo sapiens
cgggcgcactccgggcagctgt

SEQ ID NO: 9741 - DNA, 22 bp, Homo sapiens
tttaatgtagcgtgaaatgatt

SEQ ID NO: 9742 - DNA, 22 bp, Homo sapiens
ttctctgcctcacaggtctaag

SEQ ID NO: 9743 - DNA, 22 bp, Homo sapiens
tccctagtcgcatctgtggaga

SEQ ID NO: 9744 - DNA, 22 bp, Homo sapiens
aagaggtagcagtcacaaaaga

SEQ ID NO: 9745 - DNA, 22 bp, Homo sapiens
agacactgttctcacatgcttg

SEQ ID NO: 9746 - DNA, 22 bp, Homo sapiens
gagaggtggaggttgcagtgag

SEQ ID NO: 9747 - DNA, 20 bp, Homo sapiens
agagtgagactccatctcag

SEQ ID NO: 9748 - DNA, 22 bp, Homo sapiens
ggaaatgacttggtgcttcgtt

SEQ ID NO: 9749 - DNA, 22 bp, Homo sapiens
ggatgttctggggttctcttgt

SEQ ID NO: 9750 - DNA, 18 bp, Homo sapiens
gcagtgaagaaagagctt

SEQ ID NO: 9751 - DNA, 22 bp, Homo sapiens
ctgaagagaaagggagctcttc

SEQ ID NO: 9752 - DNA, 22 bp, Homo sapiens
tgctcgccccacatgccctcat

SEQ ID NO: 9753 - DNA, 22 bp, Homo sapiens
cagcttggaggaggatctaaga

SEQ ID NO: 9754 - DNA, 22 bp, Homo sapiens
aagcttcctgcatgggactgct

SEQ ID NO: 9755 - DNA, 22 bp, Homo sapiens
tagaggctttcagcggtaggtc

SEQ ID NO: 9756 - DNA, 22 bp, Homo sapiens
aggacagagggaccagagccca

SEQ ID NO: 9757 - DNA, 22 bp, Homo sapiens
atgggctgtccattgctggctg

SEQ ID NO: 9758 - DNA, 22 bp, Homo sapiens
aaacccagggttttgtcttccc

SEQ ID NO: 9759 - DNA, 22 bp, Homo sapiens
tgttgattagtgtttagactta

SEQ ID NO: 9760 - DNA, 22 bp, Homo sapiens
cggggttcatccatgctgtggc

SEQ ID NO: 9761 - DNA, 22 bp, Homo sapiens
gaaggaagtcattagtgcagac

SEQ ID NO: 9762 - DNA, 22 bp, Homo sapiens
aatgccagtgtgttgattccag

SEQ ID NO: 9763 - DNA, 22 bp, Homo sapiens
ctgagatggagttttgctcttg

SEQ ID NO: 9764 - DNA, 22 bp, Homo sapiens
aagactgtgtctatggctactc

SEQ ID NO: 9765 - DNA, 22 bp, Homo sapiens
tgaagttgttaaggttgccatt

SEQ ID NO: 9766 - DNA, 22 bp, Homo sapiens
cggggccctggggctgaaggtc

SEQ ID NO: 9767 - DNA, 22 bp, Homo sapiens
cagatctgtggtatctctattt

SEQ ID NO: 9768 - DNA, 22 bp, Homo sapiens
tgagacgaagtcttgctctgtt

SEQ ID NO: 9769 - DNA, 22 bp, Homo sapiens
ggaggacaggggctgcagcaca

SEQ ID NO: 9770 - DNA, 22 bp, Homo sapiens
tgtctgcctgcgggccggcaca

SEQ ID NO: 9771 - DNA, 22 bp, Homo sapiens
gctctctgcagcctccttggag

SEQ ID NO: 9772 - DNA, 22 bp, Homo sapiens
gcgaggaggggtgctgggcccc

SEQ ID NO: 9773 - DNA, 22 bp, Homo sapiens
ggggtggatttcaggcggtgtc

SEQ ID NO: 9774 - DNA, 22 bp, Homo sapiens
tttttgggtccaggctgtatct

SEQ ID NO: 9775 - DNA, 22 bp, Homo sapiens
cttctcttcctttgtcaactga

SEQ ID NO: 9776 - DNA, 22 bp, Homo sapiens
cccaactactctcaggcagctt

SEQ ID NO: 9777 - DNA, 22 bp, Homo sapiens
ggaggagcatgagagggtagtg

SEQ ID NO: 9778 - DNA, 22 bp, Homo sapiens
taggctaggctgaaggttttgg

SEQ ID NO: 9779 - DNA, 22 bp, Homo sapiens
agtgcactggcaccatctcagc

SEQ ID NO: 9780 - DNA, 22 bp, Homo sapiens
aaggagtctgggccattcagag

SEQ ID NO: 9781 - DNA, 22 bp, Homo sapiens
ctgctgtttctcaaaattaagt

SEQ ID NO: 9782 - DNA, 23 bp, Homo sapiens
cagagctggcttcatgggtgtgc

SEQ ID NO: 9783 - DNA, 22 bp, Homo sapiens
gacggagctggttgctgcggct

SEQ ID NO: 9784 - DNA, 22 bp, Homo sapiens
atcttcccaggctggggagagg

SEQ ID NO: 9785 - DNA, 22 bp, Homo sapiens
aaattgtaatgacttcacttga

SEQ ID NO: 9786 - DNA, 22 bp, Homo sapiens
aatattatcaaaagctttttca

SEQ ID NO: 9787 - DNA, 22 bp, Homo sapiens
cagcagagaaattacatatttg

SEQ ID NO: 9788 - DNA, 22 bp, Homo sapiens
tcaccaggctggagtgcagtgg

SEQ ID NO: 9789 - DNA, 22 bp, Homo sapiens
cctggaggcggaggttgcagtg

SEQ ID NO: 9790 - DNA, 22 bp, Homo sapiens
actattagcatatcatgaatgg

SEQ ID NO: 9791 - DNA, 19 bp, Homo sapiens
ggagtttccaatgggtaaa

SEQ ID NO: 9792 - DNA, 22 bp, Homo sapiens
ccgaggctggagtgcagtggcg

SEQ ID NO: 9793 - DNA, 22 bp, Homo sapiens
agatgaatccacacatggcaaa

SEQ ID NO: 9794 - DNA, 22 bp, Homo sapiens
ccaggaggcggaggttgcagtg

SEQ ID NO: 9795 - DNA, 22 bp, Homo sapiens
tctcgctctgtcgcccaggctg

SEQ ID NO: 9796 - DNA, 22 bp, Homo sapiens
gcatatgatcacgtgtgtcggt

SEQ ID NO: 9797 - DNA, 22 bp, Homo sapiens
gcccttacagggtggtcagcca

SEQ ID NO: 9798 - DNA, 22 bp, Homo sapiens
tgagaacggatactaagggctg

SEQ ID NO: 9799 - DNA, 22 bp, Homo sapiens
tggtacacatgtccaaggtcag

SEQ ID NO: 9800 - DNA, 22 bp, Homo sapiens
ataatacatggttgatcttttc

SEQ ID NO: 9801 - DNA, 17 bp, Homo sapiens
ggctgcagtccaggagg

SEQ ID NO: 9802 - DNA, 22 bp, Homo sapiens
actacagtgtgataagaggggc

SEQ ID NO: 9803 - DNA, 22 bp, Homo sapiens
ttcttctccgaggagggctggt

SEQ ID NO: 9804 - DNA, 22 bp, Homo sapiens
atgccactgcactccagcctag

SEQ ID NO: 9805 - DNA, 22 bp, Homo sapiens
aagtgctgggattacaggtgtg

SEQ ID NO: 9806 - DNA, 22 bp, Homo sapiens
ctggcagatagtaagtgatcaa

SEQ ID NO: 9807 - DNA, 22 bp, Homo sapiens
cactgcactccagcccgggcaa

SEQ ID NO: 9808 - DNA, 22 bp, Homo sapiens
tcaggggcttgaggtgcatgtc

SEQ ID NO: 9809 - DNA, 22 bp, Homo sapiens
aacactctctgttggtaaggct

SEQ ID NO: 9810 - DNA, 22 bp, Homo sapiens
cagaccagaaggaagccgacaa

SEQ ID NO: 9811 - DNA, 22 bp, Homo sapiens
ccctcccaggagtggccagaga

SEQ ID NO: 9812 - DNA, 22 bp, Homo sapiens
tctagttctagatccctgagga

SEQ ID NO: 9813 - DNA, 22 bp, Homo sapiens
aggagaagccaagttgtgagca

SEQ ID NO: 9814 - DNA, 22 bp, Homo sapiens
ctttaaggtgatgagagatgct

SEQ ID NO: 9815 - DNA, 22 bp, Homo sapiens
tgcccaggctggagtacagtgg

SEQ ID NO: 9816 - DNA, 22 bp, Homo sapiens
cactctgcagctgaagggctgg

SEQ ID NO: 9817 - DNA, 22 bp, Homo sapiens
tctgagaatggtggatgtggtg

SEQ ID NO: 9818 - DNA, 22 bp, Homo sapiens
attttctatgttgtaattgtta

SEQ ID NO: 9819 - DNA, 22 bp, Homo sapiens
gatagtcacctcccttaacttt

SEQ ID NO: 9820 - DNA, 22 bp, Homo sapiens
gaccactggggtgagggccatc

SEQ ID NO: 9821 - DNA, 22 bp, Homo sapiens
tgagaattacaaatgagtcaca

SEQ ID NO: 9822 - DNA, 21 bp, Homo sapiens
gggcactgaaagggaatagca

SEQ ID NO: 9823 - DNA, 22 bp, Homo sapiens
aggcaaggtgctacagacagtg

SEQ ID NO: 9824 - DNA, 22 bp, Homo sapiens
gactacaggccggcatcagaga

SEQ ID NO: 9825 - DNA, 22 bp, Homo sapiens
tgcccaggctggagtgcagtgg

SEQ ID NO: 9826 - DNA, 22 bp, Homo sapiens
aagaggttgtctgtgatgagtt

SEQ ID NO: 9827 - DNA, 22 bp, Homo sapiens
gtagcccacctggggagggcga

SEQ ID NO: 9828 - DNA, 22 bp, Homo sapiens
gcagagtgctgtcgtacgcccc

SEQ ID NO: 9829 - DNA, 22 bp, Homo sapiens
ggagagggtaggggtcctgccc

SEQ ID NO: 9830 - DNA, 22 bp, Homo sapiens
tctcctggtacccttcctagca

SEQ ID NO: 9831 - DNA, 22 bp, Homo sapiens
ttgcgcgcggctaggtctcggt

SEQ ID NO: 9832 - DNA, 22 bp, Homo sapiens
cttgtagaattgaaatggtctc

SEQ ID NO: 9833 - DNA, 22 bp, Homo sapiens
accactgcccatggtgaaaact

SEQ ID NO: 9834 - DNA, 22 bp, Homo sapiens
cctcagctcccatgagatctgc

SEQ ID NO: 9835 - DNA, 22 bp, Homo sapiens
agccacacagcttaatgacaga

SEQ ID NO: 9836 - DNA, 22 bp, Homo sapiens
aagttactggcaagggctgcag

SEQ ID NO: 9837 - DNA, 22 bp, Homo sapiens
ccgtggtcacctgagctccttg

SEQ ID NO: 9838 - DNA, 22 bp, Homo sapiens
ccctctacagggaagcgctttc

SEQ ID NO: 9839 - DNA, 22 bp, Homo sapiens
ggaggtgggctaaggactctct

SEQ ID NO: 9840 - DNA, 22 bp, Homo sapiens
caggctggagtgcagtggcgct

SEQ ID NO: 9841 - DNA, 22 bp, Homo sapiens
ggactgggaatcagggagatgc

SEQ ID NO: 9842 - DNA, 22 bp, Homo sapiens
cgcccaggctggagtgcagtgg

SEQ ID NO: 9843 - DNA, 22 bp, Homo sapiens
tgagctgtagcagatgctgttg

SEQ ID NO: 9844 - DNA, 22 bp, Homo sapiens
ctccagattccgtttattcagg

SEQ ID NO: 9845 - DNA, 22 bp, Homo sapiens
attcacagggggagaagggtat

SEQ ID NO: 9846 - DNA, 22 bp, Homo sapiens
gcttggccagcagccgggatgc

SEQ ID NO: 9847 - DNA, 22 bp, Homo sapiens
cagggtttcaccatgttagcag

SEQ ID NO: 9848 - DNA, 23 bp, Homo sapiens
gggggccgtcctggggattatag

SEQ ID NO: 9849 - DNA, 22 bp, Homo sapiens
gctgaggtggaggaaggagacc

SEQ ID NO: 9850 - DNA, 22 bp, Homo sapiens
tgaggcaggtggattacaaggt

SEQ ID NO: 9851 - DNA, 22 bp, Homo sapiens
gaataatcatgaaattcagtga

SEQ ID NO: 9852 - DNA, 22 bp, Homo sapiens
gtggtgagattgctggatcaaa

SEQ ID NO: 9853 - DNA, 20 bp, Homo sapiens
tgtccccaccaaaatttcat

SEQ ID NO: 9854 - DNA, 22 bp, Homo sapiens
caggaggacatactggctcaca

SEQ ID NO: 9855 - DNA, 20 bp, Homo sapiens
atgctttcttgtgtgctgct

SEQ ID NO: 9856 - DNA, 16 bp, Homo sapiens
gcagaggaaaggggag

SEQ ID NO: 9857 - DNA, 22 bp, Homo sapiens
caggaaggcgcggctgtgcctg

SEQ ID NO: 9858 - DNA, 22 bp, Homo sapiens
cccaggaggtcgaagctgcagt

SEQ ID NO: 9859 - DNA, 22 bp, Homo sapiens
acatcctcccgatctactggct

SEQ ID NO: 9860 - DNA, 19 bp, Homo sapiens
tcctgcctggggccgcctg

SEQ ID NO: 9861 - DNA, 22 bp, Homo sapiens
gaggcaggaggattgcttgagc

SEQ ID NO: 9862 - DNA, 22 bp, Homo sapiens
aaagcctcccaggttatgagta

SEQ ID NO: 9863 - DNA, 22 bp, Homo sapiens
cggctgggttcggctgcaggcc

SEQ ID NO: 9864 - DNA, 22 bp, Homo sapiens
cccaggaggtggaggctgcagt

SEQ ID NO: 9865 - DNA, 22 bp, Homo sapiens
gtcactgtatccaggttccagc

SEQ ID NO: 9866 - DNA, 22 bp, Homo sapiens
gggtacttaatatttacggggt

SEQ ID NO: 9867 - DNA, 21 bp, Homo sapiens
tttcttaggctctaaaatgac

SEQ ID NO: 9868 - DNA, 22 bp, Homo sapiens
tcagagtctgtgcattctgcta

SEQ ID NO: 9869 - DNA, 22 bp, Homo sapiens
tcgcgggttgcacatggccatc

SEQ ID NO: 9870 - DNA, 22 bp, Homo sapiens
aggaggggttctcgggtgctga

SEQ ID NO: 9871 - DNA, 22 bp, Homo sapiens
actgttgaagtgccagcttgat

SEQ ID NO: 9872 - DNA, 22 bp, Homo sapiens
gaggctgaggttgcagtgagcc

SEQ ID NO: 9873 - DNA, 22 bp, Homo sapiens
accattgccccctagtgtctgt

SEQ ID NO: 9874 - DNA, 22 bp, Homo sapiens
ttaagggccattatggatgggt

SEQ ID NO: 9875 - DNA, 22 bp, Homo sapiens
agaagccaccagctgaggaaga

SEQ ID NO: 9876 - DNA, 22 bp, Homo sapiens
tgcccagggtggagtgcagtgg

SEQ ID NO: 9877 - DNA, 16 bp, Homo sapiens
ccacctgcagctctca

SEQ ID NO: 9878 - DNA, 22 bp, Homo sapiens
accctgctttatgccgtcctct

SEQ ID NO: 9879 - DNA, 22 bp, Homo sapiens
tagcccctgcctttgaacctgg

SEQ ID NO: 9880 - DNA, 20 bp, Homo sapiens
gccaacgcgctggggctgcc

SEQ ID NO: 9881 - DNA, 22 bp, Homo sapiens
cactgcactccagcttgggtga

SEQ ID NO: 9882 - DNA, 22 bp, Homo sapiens
ctgaggaaggctgggggcatcc

SEQ ID NO: 9883 - DNA, 22 bp, Homo sapiens
ccattgtaaattctgtggaagt

SEQ ID NO: 9884 - DNA, 22 bp, Homo sapiens
ttctgattgctgatgaggccca

SEQ ID NO: 9885 - DNA, 22 bp, Homo sapiens
ggtggcagtagcactgggcctg

SEQ ID NO: 9886 - DNA, 22 bp, Homo sapiens
cagtaatgggcaagacaatatg

SEQ ID NO: 9887 - DNA, 20 bp, Homo sapiens
aagacaccagtggcagcccc

SEQ ID NO: 9888 - DNA, 22 bp, Homo sapiens
tgggactcactcttttggccag

SEQ ID NO: 9889 - DNA, 22 bp, Homo sapiens
gggggaagaaagaacatggcat

SEQ ID NO: 9890 - DNA, 22 bp, Homo sapiens
ggccactgacctacatctgggg

SEQ ID NO: 9891 - DNA, 22 bp, Homo sapiens
tgggaaggggagctggaaagga

SEQ ID NO: 9892 - DNA, 22 bp, Homo sapiens
acaggcttacaggctgcaagta

SEQ ID NO: 9893 - DNA, 22 bp, Homo sapiens
tgcacgtgtgagcattcacatg

SEQ ID NO: 9894 - DNA, 22 bp, Homo sapiens
atacaaaatatatactggagac

SEQ ID NO: 9895 - DNA, 21 bp, Homo sapiens
ggagtttttctggaagggact

SEQ ID NO: 9896 - DNA, 22 bp, Homo sapiens
cactgcactccagcctgggtca

SEQ ID NO: 9897 - DNA, 22 bp, Homo sapiens
caggaagaccagggctgtggct

SEQ ID NO: 9898 - DNA, 22 bp, Homo sapiens
gatgcgggcccgctccactgcc

SEQ ID NO: 9899 - DNA, 22 bp, Homo sapiens
gaggggctgccctggtgtcagg

SEQ ID NO: 9900 - DNA, 22 bp, Homo sapiens
cctcgacctccccaggctcagg

SEQ ID NO: 9901 - DNA, 22 bp, Homo sapiens
ttatgggagcaattggggaggt

SEQ ID NO: 9902 - DNA, 20 bp, Homo sapiens
gaaatgtacacattaccaca

SEQ ID NO: 9903 - DNA, 22 bp, Homo sapiens
agaggctgcacttgctcatgat

SEQ ID NO: 9904 - DNA, 22 bp, Homo sapiens
tgctgggggtagctctgcgtag

SEQ ID NO: 9905 - DNA, 22 bp, Homo sapiens
tccgggggtggtagatttcctt

SEQ ID NO: 9906 - DNA, 22 bp, Homo sapiens
ggaggcggaggttgcagtgagt

SEQ ID NO: 9907 - DNA, 22 bp, Homo sapiens
ggaggtggaggttgcagtgagc

SEQ ID NO: 9908 - DNA, 22 bp, Homo sapiens
ttattagagtgctttgagaaag

SEQ ID NO: 9909 - DNA, 22 bp, Homo sapiens
gggctgagacgatggggtcttc

SEQ ID NO: 9910 - DNA, 22 bp, Homo sapiens
tgcagtcttccagctgcacaaa

SEQ ID NO: 9911 - DNA, 23 bp, Homo sapiens
ggagcctccggtgtgtgagaggc

SEQ ID NO: 9912 - DNA, 22 bp, Homo sapiens
ctgcagggagaggggacagcct

SEQ ID NO: 9913 - DNA, 22 bp, Homo sapiens
ctgaggaggctaatttgaggat

SEQ ID NO: 9914 - DNA, 22 bp, Homo sapiens
ttctgtgaatcttttttcccac

SEQ ID NO: 9915 - DNA, 22 bp, Homo sapiens
tggacaacatagtgagacctca

SEQ ID NO: 9916 - DNA, 22 bp, Homo sapiens
accatgtcatttattggccaaa

SEQ ID NO: 9917 - DNA, 18 bp, Homo sapiens
cagctgccagctcatgga

SEQ ID NO: 9918 - DNA, 22 bp, Homo sapiens
ctgagatggagtttcgctcttc

SEQ ID NO: 9919 - DNA, 22 bp, Homo sapiens
ttcattttctttcacgctgctg

SEQ ID NO: 9920 - DNA, 22 bp, Homo sapiens
ggcatagatttctttaggttta

SEQ ID NO: 9921 - DNA, 22 bp, Homo sapiens
agatttatgtggtcacactcag

SEQ ID NO: 9922 - DNA, 22 bp, Homo sapiens
atgtgggccgtgcgggtgtcct

SEQ ID NO: 9923 - DNA, 22 bp, Homo sapiens
gcgagaaactaagtgccctttg

SEQ ID NO: 9924 - DNA, 22 bp, Homo sapiens
agtgctgtcagttttatagata

SEQ ID NO: 9925 - DNA, 22 bp, Homo sapiens
agcgccactgcactccagcctg

SEQ ID NO: 9926 - DNA, 22 bp, Homo sapiens
atggtggacgggagacaggact

SEQ ID NO: 9927 - DNA, 22 bp, Homo sapiens
cggctggtgtcgggcacagcaa

SEQ ID NO: 9928 - DNA, 22 bp, Homo sapiens
gcgagggcacgcggttgaaggc

SEQ ID NO: 9929 - DNA, 22 bp, Homo sapiens
aaagggaagttgcacatgttcc

SEQ ID NO: 9930 - DNA, 22 bp, Homo sapiens
ctgagccaaggggacagtgaca

SEQ ID NO: 9931 - DNA, 22 bp, Homo sapiens
gcagcctcaaactccccagctc

SEQ ID NO: 9932 - DNA, 21 bp, Homo sapiens
ttgaccaagggtgcgtgctcc

SEQ ID NO: 9933 - DNA, 22 bp, Homo sapiens
caggaggattgcttgaggccag

SEQ ID NO: 9934 - DNA, 22 bp, Homo sapiens
ccaggaggcggaggttgcagcg

SEQ ID NO: 9935 - DNA, 22 bp, Homo sapiens
catctgctgttccttggactca

SEQ ID NO: 9936 - DNA, 22 bp, Homo sapiens
ccaggtgtgctctgcagtggat

SEQ ID NO: 9937 - DNA, 18 bp, Homo sapiens
tgtagagccaggtttgcc

SEQ ID NO: 9938 - DNA, 22 bp, Homo sapiens
ggaggactcaggtctggccatg

SEQ ID NO: 9939 - DNA, 22 bp, Homo sapiens
ccttttgctctcccatccagaa

SEQ ID NO: 9940 - DNA, 22 bp, Homo sapiens
gacaggtgctaagggacctggc

SEQ ID NO: 9941 - DNA, 22 bp, Homo sapiens
gcttcggggtccaagcgcgtgt

SEQ ID NO: 9942 - DNA, 22 bp, Homo sapiens
tgagacaggcttccttcttggg

SEQ ID NO: 9943 - DNA, 22 bp, Homo sapiens
ctgggtggcagagcctgcagtg

SEQ ID NO: 9944 - DNA, 22 bp, Homo sapiens
gccaggctgaggctctggaaga

SEQ ID NO: 9945 - DNA, 22 bp, Homo sapiens
aactaatacattaatacatgtg

SEQ ID NO: 9946 - DNA, 22 bp, Homo sapiens
ggtccccgtggaggctggagcg

SEQ ID NO: 9947 - DNA, 22 bp, Homo sapiens
ctagttctagatccctgaggaa

SEQ ID NO: 9948 - DNA, 22 bp, Homo sapiens
gacctcatgatccacctgcctt

SEQ ID NO: 9949 - DNA, 22 bp, Homo sapiens
ccttctcagccccagctcccgc

SEQ ID NO: 9950 - DNA, 23 bp, Homo sapiens
ttgcatagacatcctcatagatt

SEQ ID NO: 9951 - DNA, 22 bp, Homo sapiens
tggtgcaaaactaattgcggtt

SEQ ID NO: 9952 - DNA, 22 bp, Homo sapiens
tctagcaagctcgtgctcaagg

SEQ ID NO: 9953 - DNA, 22 bp, Homo sapiens
ctgccttttaaagccagtgtta

SEQ ID NO: 9954 - DNA, 22 bp, Homo sapiens
tgaggtgccacccaagagcctt

SEQ ID NO: 9955 - DNA, 22 bp, Homo sapiens
ggcctcgcggcttctggtggct

SEQ ID NO: 9956 - DNA, 22 bp, Homo sapiens
gcccgcagagatctttaacaaa

SEQ ID NO: 9957 - DNA, 22 bp, Homo sapiens
agaggccgggtgcctgctcaga

SEQ ID NO: 9958 - DNA, 22 bp, Homo sapiens
ccaggcaggcgatggtgcagtg

SEQ ID NO: 9959 - DNA, 22 bp, Homo sapiens
acaggggacctaggaccctcgg

SEQ ID NO: 9960 - DNA, 22 bp, Homo sapiens
agggaattcactggaacgccct

SEQ ID NO: 9961 - DNA, 22 bp, Homo sapiens
agcttgggcaacacagcaagac

SEQ ID NO: 9962 - DNA, 22 bp, Homo sapiens
gccgggaccaaggccacggagc

SEQ ID NO: 9963 - DNA, 22 bp, Homo sapiens
tggttggatggctcttgtggct

SEQ ID NO: 9964 - DNA, 21 bp, Homo sapiens
aaggacgaggttttgattaca

SEQ ID NO: 9965 - DNA, 22 bp, Homo sapiens
gcaggcaggcttccttgaactg

SEQ ID NO: 9966 - DNA, 22 bp, Homo sapiens
gcagacgtcaccgagtcgatgg

SEQ ID NO: 9967 - DNA, 22 bp, Homo sapiens
tgaaatgtgttctagtgttttg

SEQ ID NO: 9968 - DNA, 22 bp, Homo sapiens
tggaaatgtttcttgagctcag

SEQ ID NO: 9969 - DNA, 22 bp, Homo sapiens
ggcgtttcaccatgttgaccag

SEQ ID NO: 9970 - DNA, 22 bp, Homo sapiens
tgttcttaggtatttgacagtc

SEQ ID NO: 9971 - DNA, 22 bp, Homo sapiens
tcaccgccttgcccggccgggc

SEQ ID NO: 9972 - DNA, 22 bp, Homo sapiens
cgcagggccgcgagcgggacca

SEQ ID NO: 9973 - DNA, 22 bp, Homo sapiens
gctgctctccaagcctccttga

SEQ ID NO: 9974 - DNA, 22 bp, Homo sapiens
tccaagatctacagcagtttag

SEQ ID NO: 9975 - DNA, 22 bp, Homo sapiens
agcagcagtgttctggaattct

SEQ ID NO: 9976 - DNA, 22 bp, Homo sapiens
ttcttcagcctaccttgacctc

SEQ ID NO: 9977 - DNA, 22 bp, Homo sapiens
gaagcgcggcgtcggcgtgggt

SEQ ID NO: 9978 - DNA, 22 bp, Homo sapiens
cccaggaggcagagcttgcagt

SEQ ID NO: 9979 - DNA, 22 bp, Homo sapiens
ctacattaaattggcttactta

SEQ ID NO: 9980 - DNA, 22 bp, Homo sapiens
aggtggggaggagtgtctcttt

SEQ ID NO: 9981 - DNA, 22 bp, Homo sapiens
ccctgccttgtctgggctaggt

SEQ ID NO: 9982 - DNA, 22 bp, Homo sapiens
aagccctggcgggtggagggcc

SEQ ID NO: 9983 - DNA, 22 bp, Homo sapiens
tgaggctccttgtagagagtgg

SEQ ID NO: 9984 - DNA, 22 bp, Homo sapiens
cgggcagcggcgtggccatggt

SEQ ID NO: 9985 - DNA, 22 bp, Homo sapiens
gggaaggaaagttattagcaga

SEQ ID NO: 9986 - DNA, 22 bp, Homo sapiens
gcttctggtgaggcctcaggaa

SEQ ID NO: 9987 - DNA, 22 bp, Homo sapiens
ctgcttctagcaccaagtccct

SEQ ID NO: 9988 - DNA, 22 bp, Homo sapiens
ctacttgttcactgtaggtcgc

SEQ ID NO: 9989 - DNA, 22 bp, Homo sapiens
cagccagtgtgaccgaggagga

SEQ ID NO: 9990 - DNA, 22 bp, Homo sapiens
atctggttcttcttaggcatca

SEQ ID NO: 9991 - DNA, 22 bp, Homo sapiens
acccaggctggagtgcagtggg

SEQ ID NO: 9992 - DNA, 22 bp, Homo sapiens
ggggatggaggcgtgtggtcct

SEQ ID NO: 9993 - DNA, 22 bp, Homo sapiens
tcaccaggctagagtgcagtgg

SEQ ID NO: 9994 - DNA, 22 bp, Homo sapiens
tacaggcatgtagcatggtgat

SEQ ID NO: 9995 - DNA, 22 bp, Homo sapiens
gctgggttttcttccgggccta

SEQ ID NO: 9996 - DNA, 22 bp, Homo sapiens
tgagtgtggggaatgtcatgag

SEQ ID NO: 9997 - DNA, 22 bp, Homo sapiens
atttttctctttccactgagat

SEQ ID NO: 9998 - DNA, 19 bp, Homo sapiens
gctgttaaggaccctcgga

SEQ ID NO: 9999 - DNA, 22 bp, Homo sapiens
agatcacagtggcaactccctt

SEQ ID NO: 10000 - DNA, 22 bp, Homo sapiens
cccaggaggcagaagttgcagt

SEQ ID NO: 10001 - DNA, 21 bp, Homo sapiens
tgttttccaccttgaggcaag

SEQ ID NO: 10002 - DNA, 22 bp, Homo sapiens
ccggctactcgggaggctgacg

SEQ ID NO: 10003 - DNA, 22 bp, Homo sapiens
agacggattacctgaggtcagg

SEQ ID NO: 10004 - DNA, 22 bp, Homo sapiens
acccaggctggagtgcagtgat

SEQ ID NO: 10005 - DNA, 22 bp, Homo sapiens
aactatgttaataagtttcatt

SEQ ID NO: 10006 - DNA, 22 bp, Homo sapiens
ccaaagtgctgggattacaggc

SEQ ID NO: 10007 - DNA, 22 bp, Homo sapiens
ttatttttaaaagttcacacag

SEQ ID NO: 10008 - DNA, 22 bp, Homo sapiens
accatgttggccaagctggtct

SEQ ID NO: 10009 - DNA, 22 bp, Homo sapiens
acatttatataactcactagga

SEQ ID NO: 10010 - DNA, 22 bp, Homo sapiens
tctctatttgcctaggcttgtg

SEQ ID NO: 10011 - DNA, 22 bp, Homo sapiens
ctggggtcagggatcagagagc

SEQ ID NO: 10012 - DNA, 22 bp, Homo sapiens
tagcagcaaagcaggatctgct

SEQ ID NO: 10013 - DNA, 22 bp, Homo sapiens
agaaaatttaaagagacacaca

SEQ ID NO: 10014 - DNA, 22 bp, Homo sapiens
ctggtgtggactccgcgcggag

SEQ ID NO: 10015 - DNA, 22 bp, Homo sapiens
ggctccctgcaacctccgcctc

SEQ ID NO: 10016 - DNA, 22 bp, Homo sapiens
tgctttgtgacagattagtttt

SEQ ID NO: 10017 - DNA, 22 bp, Homo sapiens
gggcagagagctggaactcctt

SEQ ID NO: 10018 - DNA, 22 bp, Homo sapiens
accgggaagtcctgcactgggc

SEQ ID NO: 10019 - DNA, 22 bp, Homo sapiens
gcctcctgagtagctgggattg

SEQ ID NO: 10020 - DNA, 22 bp, Homo sapiens
ggagtgactcacagctgggaca

SEQ ID NO: 10021 - DNA, 22 bp, Homo sapiens
agctacctgatccttcttctga

SEQ ID NO: 10022 - DNA, 22 bp, Homo sapiens
ttactttaagggtgtcttatta

SEQ ID NO: 10023 - DNA, 22 bp, Homo sapiens
ttctgccttggcagggtggtcc

SEQ ID NO: 10024 - DNA, 22 bp, Homo sapiens
taattataacagttacatctta

SEQ ID NO: 10025 - DNA, 22 bp, Homo sapiens
ttgaggcaggtccgggtccttc

SEQ ID NO: 10026 - DNA, 22 bp, Homo sapiens
tggctcatttctaaacccagct

SEQ ID NO: 10027 - DNA, 22 bp, Homo sapiens
cggccaagccggggccccgaag

SEQ ID NO: 10028 - DNA, 22 bp, Homo sapiens
tcagtgatttctggggtgaggg

SEQ ID NO: 10029 - DNA, 22 bp, Homo sapiens
agtccaggcattccagccattc

SEQ ID NO: 10030 - DNA, 22 bp, Homo sapiens
gttttgaatactactagaactt

SEQ ID NO: 10031 - DNA, 22 bp, Homo sapiens
aacagcttgctgcaccttaata

SEQ ID NO: 10032 - DNA, 22 bp, Homo sapiens
gaaaggagagggttaaggagct

SEQ ID NO: 10033 - DNA, 22 bp, Homo sapiens
ttcccacattctttacattcat

SEQ ID NO: 10034 - DNA, 22 bp, Homo sapiens
ccagagctgattcctgggactt

SEQ ID NO: 10035 - DNA, 22 bp, Homo sapiens
tggctgagttacgaacagagca

SEQ ID NO: 10036 - DNA, 21 bp, Homo sapiens
agctgcctccacttctgaggc

SEQ ID NO: 10037 - DNA, 22 bp, Homo sapiens
tgagccaggagtttgaggctgt

SEQ ID NO: 10038 - DNA, 22 bp, Homo sapiens
acccacgaagatgagcggcatg

SEQ ID NO: 10039 - DNA, 22 bp, Homo sapiens
cagctgctgttcagttttgttt

SEQ ID NO: 10040 - DNA, 22 bp, Homo sapiens
caaatgtataaatgtactttct

SEQ ID NO: 10041 - DNA, 22 bp, Homo sapiens
agaggacagagtgctggattta

SEQ ID NO: 10042 - DNA, 22 bp, Homo sapiens
tttgttttcaatgtgtcattca

SEQ ID NO: 10043 - DNA, 22 bp, Homo sapiens
taagagaatgttgtggctaggt

SEQ ID NO: 10044 - DNA, 22 bp, Homo sapiens
ttgatgagaccattgccgcgtc

SEQ ID NO: 10045 - DNA, 22 bp, Homo sapiens
aagccaatgctagcccacatgc

SEQ ID NO: 10046 - DNA, 22 bp, Homo sapiens
cagagctggtgtgtcctggcat

SEQ ID NO: 10047 - DNA, 22 bp, Homo sapiens
attgaaaataaggccagaaaca

SEQ ID NO: 10048 - DNA, 22 bp, Homo sapiens
cgcgctgcagacagcggaggcc

SEQ ID NO: 10049 - DNA, 22 bp, Homo sapiens
caaggtgccatgctgggcgggg

SEQ ID NO: 10050 - DNA, 22 bp, Homo sapiens
cttagatgaagtcacagaaccc

SEQ ID NO: 10051 - DNA, 22 bp, Homo sapiens
acggcttcttgactgtgggttg

SEQ ID NO: 10052 - DNA, 22 bp, Homo sapiens
ccctgcctacagggttttcttt

SEQ ID NO: 10053 - DNA, 20 bp, Homo sapiens
gccactgggcaccagcaggg

SEQ ID NO: 10054 - DNA, 23 bp, Homo sapiens
aaataggagtatctggatcatga

SEQ ID NO: 10055 - DNA, 22 bp, Homo sapiens
tctgctctgtggcttcagctaa

SEQ ID NO: 10056 - DNA, 22 bp, Homo sapiens
tctgaggctgaatggactccgt

SEQ ID NO: 10057 - DNA, 22 bp, Homo sapiens
tggttttagggaatcaatctat

SEQ ID NO: 10058 - DNA, 22 bp, Homo sapiens
gtgctggggagataggaagaga

SEQ ID NO: 10059 - DNA, 22 bp, Homo sapiens
ctgctttggacaactattcttg

SEQ ID NO: 10060 - DNA, 22 bp, Homo sapiens
ttggagtgacagatgaggaaac

SEQ ID NO: 10061 - DNA, 23 bp, Homo sapiens
actcgtggaattctctgcgatcg

SEQ ID NO: 10062 - DNA, 22 bp, Homo sapiens
tcctcctgtctaccagttcctg

SEQ ID NO: 10063 - DNA, 22 bp, Homo sapiens
ttctcttttcaccagttgctaa

SEQ ID NO: 10064 - DNA, 22 bp, Homo sapiens
actcagtacatctggagttggc

SEQ ID NO: 10065 - DNA, 22 bp, Homo sapiens
tctggcttccctctgttctggg

SEQ ID NO: 10066 - DNA, 22 bp, Homo sapiens
cattccttaacgtggggagtct

SEQ ID NO: 10067 - DNA, 22 bp, Homo sapiens
ccgaggtcctggacttggccct

SEQ ID NO: 10068 - DNA, 22 bp, Homo sapiens
tcattgagttgcacttttacta

SEQ ID NO: 10069 - DNA, 22 bp, Homo sapiens
actaaagctcacagagttgaac

SEQ ID NO: 10070 - DNA, 22 bp, Homo sapiens
gggaggcagtgctggaggctgg

SEQ ID NO: 10071 - DNA, 19 bp, Homo sapiens
atcccaaggagctgggact

SEQ ID NO: 10072 - DNA, 22 bp, Homo sapiens
agccaccaccactgaaaggtta

SEQ ID NO: 10073 - DNA, 22 bp, Homo sapiens
acggcaggctcagagctggaat

SEQ ID NO: 10074 - DNA, 22 bp, Homo sapiens
tgggggtgtcctggtgcacaca

SEQ ID NO: 10075 - DNA, 22 bp, Homo sapiens
aggcaggaggatcatggatgca

SEQ ID NO: 10076 - DNA, 22 bp, Homo sapiens
tcctccagttccttggtttcag

SEQ ID NO: 10077 - DNA, 22 bp, Homo sapiens
agggactatttacccatctcac

SEQ ID NO: 10078 - DNA, 22 bp, Homo sapiens
agtcaaagatgaccgagttcct

SEQ ID NO: 10079 - DNA, 19 bp, Homo sapiens
gctgaggtggaggaaggag

SEQ ID NO: 10080 - DNA, 22 bp, Homo sapiens
caggctggagtgcagtggggcg

SEQ ID NO: 10081 - DNA, 22 bp, Homo sapiens
ccaggctggagtatagtggcgc

SEQ ID NO: 10082 - DNA, 22 bp, Homo sapiens
catgtgtgtctccaccagctgc

SEQ ID NO: 10083 - DNA, 16 bp, Homo sapiens
tgggtgggaggagcgg

SEQ ID NO: 10084 - DNA, 22 bp, Homo sapiens
cactgcactccagcctgggtga

SEQ ID NO: 10085 - DNA, 19 bp, Homo sapiens
ttcacattggaagaagtag

SEQ ID NO: 10086 - DNA, 22 bp, Homo sapiens
cgcaggtgaaagaggctgggca

SEQ ID NO: 10087 - DNA, 22 bp, Homo sapiens
agccagggacgctgcaggctac

SEQ ID NO: 10088 - DNA, 22 bp, Homo sapiens
gctcccaccgccgctatgggta

SEQ ID NO: 10089 - DNA, 22 bp, Homo sapiens
aggggaatgggtagactgttga

SEQ ID NO: 10090 - DNA, 20 bp, Homo sapiens
ttgttagaggaatgccatag

SEQ ID NO: 10091 - DNA, 22 bp, Homo sapiens
cctactctgagcgcctccgcat

SEQ ID NO: 10092 - DNA, 22 bp, Homo sapiens
gctcggtggccagcctgaggcc

SEQ ID NO: 10093 - DNA, 22 bp, Homo sapiens
tggggagtgatgcctcggataa

SEQ ID NO: 10094 - DNA, 22 bp, Homo sapiens
atcacaaaggtctcagagcaca

SEQ ID NO: 10095 - DNA, 22 bp, Homo sapiens
cccaggaggtggagcttgcagt

SEQ ID NO: 10096 - DNA, 18 bp, Homo sapiens
tgtccctgcaaataacat

SEQ ID NO: 10097 - DNA, 22 bp, Homo sapiens
catcatcaaaagtgacagagaa

SEQ ID NO: 10098 - DNA, 22 bp, Homo sapiens
aggtgacaggacaggagctggt

SEQ ID NO: 10099 - DNA, 22 bp, Homo sapiens
tggccaccaccaatacttgcct

SEQ ID NO: 10100 - DNA, 22 bp, Homo sapiens
tggagaattctatgttgagggg

SEQ ID NO: 10101 - DNA, 22 bp, Homo sapiens
tcttcacgccaagtgcccctca

SEQ ID NO: 10102 - DNA, 22 bp, Homo sapiens
ctgccctggggggcctccttgc

SEQ ID NO: 10103 - DNA, 22 bp, Homo sapiens
ccaggaggcggaaggtacagtg

SEQ ID NO: 10104 - DNA, 22 bp, Homo sapiens
agcactgatttaaactggattt

SEQ ID NO: 10105 - DNA, 22 bp, Homo sapiens
catagagtgatgtaaggtatgt

SEQ ID NO: 10106 - DNA, 22 bp, Homo sapiens
tacttttagcctatttgattct

SEQ ID NO: 10107 - DNA, 22 bp, Homo sapiens
ttgtctgcatgattctaggcag

SEQ ID NO: 10108 - DNA, 22 bp, Homo sapiens
aggtcacccgtttgactatcca

SEQ ID NO: 10109 - DNA, 17 bp, Homo sapiens
cgggcatggagggcagg

SEQ ID NO: 10110 - DNA, 22 bp, Homo sapiens
aagcatttcaggtagagatatt

SEQ ID NO: 10111 - DNA, 22 bp, Homo sapiens
ctgggctagaaggaccaggatg

SEQ ID NO: 10112 - DNA, 22 bp, Homo sapiens
atgaccagccgagataaacaga

SEQ ID NO: 10113 - DNA, 22 bp, Homo sapiens
tcctttgcttctgtcattctcc

SEQ ID NO: 10114 - DNA, 22 bp, Homo sapiens
ttgtgaatggtgccgcaataaa

SEQ ID NO: 10115 - DNA, 22 bp, Homo sapiens
cccgagcctcggtttcttttct

SEQ ID NO: 10116 - DNA, 22 bp, Homo sapiens
gactacaggtgtgtgccaccat

SEQ ID NO: 10117 - DNA, 22 bp, Homo sapiens
ggcagacctctccagccccaca

SEQ ID NO: 10118 - DNA, 21 bp, Homo sapiens
ggtgctcgctgatgaggagtg

SEQ ID NO: 10119 - DNA, 22 bp, Homo sapiens
tttgagatggagtcttgctctg

SEQ ID NO: 10120 - DNA, 22 bp, Homo sapiens
gaggactgaaacttacaggaaa

SEQ ID NO: 10121 - DNA, 22 bp, Homo sapiens
ttgaggtcatctgaagtactag

SEQ ID NO: 10122 - DNA, 22 bp, Homo sapiens
cggtcaggtgcagcgttggcac

SEQ ID NO: 10123 - DNA, 22 bp, Homo sapiens
cggagtcttgctatgttgccca

SEQ ID NO: 10124 - DNA, 22 bp, Homo sapiens
tgtggactcgcatggctgaggc

SEQ ID NO: 10125 - DNA, 22 bp, Homo sapiens
cccgtgtggatgcgctggtgct

SEQ ID NO: 10126 - DNA, 22 bp, Homo sapiens
ttatcacttatgagctttttgc

SEQ ID NO: 10127 - DNA, 22 bp, Homo sapiens
atacaaaaattagccgggagta

SEQ ID NO: 10128 - DNA, 22 bp, Homo sapiens
ctctcgccagcggggctgcgct

SEQ ID NO: 10129 - DNA, 22 bp, Homo sapiens
gatgtgtttgtttctggaggag

SEQ ID NO: 10130 - DNA, 18 bp, Homo sapiens
aggcttacagcagcaggc

SEQ ID NO: 10131 - DNA, 22 bp, Homo sapiens
gtggcagaccttcccttctcct

SEQ ID NO: 10132 - DNA, 22 bp, Homo sapiens
ggagctgttcaggactgcttca

SEQ ID NO: 10133 - DNA, 22 bp, Homo sapiens
gatttttatataaagtgagaaa

SEQ ID NO: 10134 - DNA, 22 bp, Homo sapiens
tgtacacatggtgtacactccc

SEQ ID NO: 10135 - DNA, 22 bp, Homo sapiens
gcagagctcatgcctgcacctc

SEQ ID NO: 10136 - DNA, 22 bp, Homo sapiens
atgccactgcactccagcctgg

SEQ ID NO: 10137 - DNA, 22 bp, Homo sapiens
tgttcagaacaaaggtaaatga

SEQ ID NO: 10138 - DNA, 22 bp, Homo sapiens
gttgagtgggttaggatgctga

SEQ ID NO: 10139 - DNA, 22 bp, Homo sapiens
tgtgtctgtgtatacacggcat

SEQ ID NO: 10140 - DNA, 22 bp, Homo sapiens
aagaggtaaccatagcaaccac

SEQ ID NO: 10141 - DNA, 22 bp, Homo sapiens
tgccgcagtgcggggagggccc

SEQ ID NO: 10142 - DNA, 22 bp, Homo sapiens
cgagagttagctaggagtcaca

SEQ ID NO: 10143 - DNA, 21 bp, Homo sapiens
tcgtgcagcagctgaggcttg

SEQ ID NO: 10144 - DNA, 22 bp, Homo sapiens
aagtgctgggattataggcatg

SEQ ID NO: 10145 - DNA, 22 bp, Homo sapiens
ccaggctggagtgcaatggcgt

SEQ ID NO: 10146 - DNA, 22 bp, Homo sapiens
cacttcattgggaccagggctg

SEQ ID NO: 10147 - DNA, 23 bp, Homo sapiens
acagcaagaggaccagatgtgag

SEQ ID NO: 10148 - DNA, 22 bp, Homo sapiens
ttccaactttgtcatatattat

SEQ ID NO: 10149 - DNA, 22 bp, Homo sapiens
ttgaggtcttcaggatcaggct

SEQ ID NO: 10150 - DNA, 22 bp, Homo sapiens
gcctcagtctcccgagtagctg

SEQ ID NO: 10151 - DNA, 22 bp, Homo sapiens
gctccctggtagccatgctctc

SEQ ID NO: 10152 - DNA, 22 bp, Homo sapiens
atgagaaagttaatcatcatga

SEQ ID NO: 10153 - DNA, 22 bp, Homo sapiens
gcttacaggtgaggcagcaaga

SEQ ID NO: 10154 - DNA, 22 bp, Homo sapiens
cgagcatgatgacggctgtggc

SEQ ID NO: 10155 - DNA, 22 bp, Homo sapiens
caaagtgctaggattacaggcc

SEQ ID NO: 10156 - DNA, 22 bp, Homo sapiens
ctctgcctgtctcatcctgcaa

SEQ ID NO: 10157 - DNA, 22 bp, Homo sapiens
tggacaggcaagcaagacatac

SEQ ID NO: 10158 - DNA, 22 bp, Homo sapiens
aagattttcagtgcctaaaaca

SEQ ID NO: 10159 - DNA, 21 bp, Homo sapiens
ctacttaagtaggggattagg

SEQ ID NO: 10160 - DNA, 22 bp, Homo sapiens
ttgcctgtgtcagcaggtggaa

SEQ ID NO: 10161 - DNA, 22 bp, Homo sapiens
tgacttgtctctttgggagaca

SEQ ID NO: 10162 - DNA, 22 bp, Homo sapiens
aaacactcatgtgttactctcc

SEQ ID NO: 10163 - DNA, 22 bp, Homo sapiens
tgtgttgtgacattcttggatg

SEQ ID NO: 10164 - DNA, 22 bp, Homo sapiens
ggggaccctcaggactgcgtct

SEQ ID NO: 10165 - DNA, 22 bp, Homo sapiens
gaggcaggcagattgcttgagg

SEQ ID NO: 10166 - DNA, 22 bp, Homo sapiens
gccatgcttggtatgctgtgag

SEQ ID NO: 10167 - DNA, 22 bp, Homo sapiens
gacaggaggcagagctcaggtg

SEQ ID NO: 10168 - DNA, 23 bp, Homo sapiens
gacagagtgagaccttgtcttac

SEQ ID NO: 10169 - DNA, 22 bp, Homo sapiens
caggctggagtgcagtggcgcc

SEQ ID NO: 10170 - DNA, 22 bp, Homo sapiens
ttcctagggcagagccgctggg

SEQ ID NO: 10171 - DNA, 22 bp, Homo sapiens
aaagaaggtagggctggtgact

SEQ ID NO: 10172 - DNA, 22 bp, Homo sapiens
gcaggctgtctaaagttagagt

SEQ ID NO: 10173 - DNA, 22 bp, Homo sapiens
agtgaatgtccccgcgggtcag

SEQ ID NO: 10174 - DNA, 22 bp, Homo sapiens
accctcaacaaattcactctat

SEQ ID NO: 10175 - DNA, 22 bp, Homo sapiens
ctccagttggccccagttggtt

SEQ ID NO: 10176 - DNA, 22 bp, Homo sapiens
tcctccccaaagcccagcctgg

SEQ ID NO: 10177 - DNA, 22 bp, Homo sapiens
cctcccctcagacagagactgg

SEQ ID NO: 10178 - DNA, 22 bp, Homo sapiens
caccctcaagcagtggcacgtg

SEQ ID NO: 10179 - DNA, 21 bp, Homo sapiens
tagcccttctccacctcgccc

SEQ ID NO: 10180 - DNA, 22 bp, Homo sapiens
ccctgcctacagggttttcttt

SEQ ID NO: 10181 - DNA, 22 bp, Homo sapiens
tatccaattcaccattgatggg

SEQ ID NO: 10182 - DNA, 22 bp, Homo sapiens
atttcccagggcctgggatttg

SEQ ID NO: 10183 - DNA, 21 bp, Homo sapiens
atctcgggcttctcgcccagc

SEQ ID NO: 10184 - DNA, 22 bp, Homo sapiens
ggagttgattttggatatatta

SEQ ID NO: 10185 - DNA, 22 bp, Homo sapiens
tagtgccctcccctttgggata

SEQ ID NO: 10186 - DNA, 22 bp, Homo sapiens
attaggtcatggggaggcccta

SEQ ID NO: 10187 - DNA, 22 bp, Homo sapiens
gttggtgagtttctgatcacaa

SEQ ID NO: 10188 - DNA, 22 bp, Homo sapiens
ttatatgtttctgtttggaggc

SEQ ID NO: 10189 - DNA, 22 bp, Homo sapiens
tgtgtgagtaaggctgagagag

SEQ ID NO: 10190 - DNA, 23 bp, Homo sapiens
ccactagcacctgttcaacttct

SEQ ID NO: 10191 - DNA, 22 bp, Homo sapiens
gtctttcttaaacaacagaaca

SEQ ID NO: 10192 - DNA, 22 bp, Homo sapiens
gacagacacaattgatccatga

SEQ ID NO: 10193 - DNA, 22 bp, Homo sapiens
atctggttcttcttaggcatca

SEQ ID NO: 10194 - DNA, 23 bp, Homo sapiens
aatggtcttcctccacccctctg

SEQ ID NO: 10195 - DNA, 22 bp, Homo sapiens
tagtcccggaactccttcaggt

SEQ ID NO: 10196 - DNA, 22 bp, Homo sapiens
aggttatcatcagttgagcact

SEQ ID NO: 10197 - DNA, 22 bp, Homo sapiens
ctggcaagaaatatatatctta

SEQ ID NO: 10198 - DNA, 22 bp, Homo sapiens
atacacgtgccatgttggtgtg

SEQ ID NO: 10199 - DNA, 22 bp, Homo sapiens
atgagttgaagctacaagaggc

SEQ ID NO: 10200 - DNA, 22 bp, Homo sapiens
ccttttgctctcccatccagaa

SEQ ID NO: 10201 - DNA, 22 bp, Homo sapiens
cacagacagtgtccctttgttg

SEQ ID NO: 10202 - DNA, 22 bp, Homo sapiens
ggctccaccctgcttccagaag

SEQ ID NO: 10203 - DNA, 22 bp, Homo sapiens
tggtagtcggcctcggtggctc

SEQ ID NO: 10204 - DNA, 22 bp, Homo sapiens
gtagtcccagctaccccggagg

SEQ ID NO: 10205 - DNA, 22 bp, Homo sapiens
gatgtagacacttggaggctta

SEQ ID NO: 10206 - DNA, 22 bp, Homo sapiens
gaggctgcagctatcagacatt

SEQ ID NO: 10207 - DNA, 22 bp, Homo sapiens
ctgtggctctttagttgagcac

SEQ ID NO: 10208 - DNA, 18 bp, Homo sapiens
actctttctgcccacagg

SEQ ID NO: 10209 - DNA, 22 bp, Homo sapiens
accatgttggccaagctggtct

SEQ ID NO: 10210 - DNA, 22 bp, Homo sapiens
acatcctcccgatctactggct

SEQ ID NO: 10211 - DNA, 22 bp, Homo sapiens
ccctttagcccctgcagagact

SEQ ID NO: 10212 - DNA, 22 bp, Homo sapiens
acccgggaggcaggagtcatag

SEQ ID NO: 10213 - DNA, 22 bp, Homo sapiens
ataggtccaaggagaggtcttt

SEQ ID NO: 10214 - DNA, 22 bp, Homo sapiens
ccttctcagccccagctcccgc

SEQ ID NO: 10215 - DNA, 22 bp, Homo sapiens
ggggccttggatctgtgccccg

SEQ ID NO: 10216 - DNA, 22 bp, Homo sapiens
ctgtggctcaggcctgtaagcc

SEQ ID NO: 10217 - DNA, 22 bp, Homo sapiens
tagcccctgcctttgaacctgg

SEQ ID NO: 10218 - DNA, 22 bp, Homo sapiens
tcccctttgtcttcctgtgggt

SEQ ID NO: 10219 - DNA, 22 bp, Homo sapiens
tctgagacaggaagtggagggt

SEQ ID NO: 10220 - DNA, 22 bp, Homo sapiens
tctgtggcccaagtgatggctg

SEQ ID NO: 10221 - DNA, 22 bp, Homo sapiens
taggtttactgaattagtggaa

SEQ ID NO: 10222 - DNA, 22 bp, Homo sapiens
gggtccctggaattacttgaca

SEQ ID NO: 10223 - DNA, 22 bp, Homo sapiens
ggtagtcggccttgccctgggc

SEQ ID NO: 10224 - DNA, 22 bp, Homo sapiens
agtacccttttcactgtcacaa

SEQ ID NO: 10225 - DNA, 17 bp, Homo sapiens
cttcccaccatctcctg

SEQ ID NO: 10226 - DNA, 22 bp, Homo sapiens
ctgtggctctcagaggctgctg

SEQ ID NO: 10227 - DNA, 22 bp, Homo sapiens
ttttctagggtgctaaatgaac

SEQ ID NO: 10228 - DNA, 22 bp, Homo sapiens
ctgattgagaaggaaggggatc

SEQ ID NO: 10229 - DNA, 22 bp, Homo sapiens
tgtctcttttcaagctaccctt

SEQ ID NO: 10230 - DNA, 22 bp, Homo sapiens
atcttggggaatcctctgtgta

SEQ ID NO: 10231 - DNA, 22 bp, Homo sapiens
tccgggagctgaacgtcttgcg

SEQ ID NO: 10232 - DNA, 22 bp, Homo sapiens
caggagttttaaatctagcatg

SEQ ID NO: 10233 - DNA, 22 bp, Homo sapiens
ccctgccttgtctgggctaggt

SEQ ID NO: 10234 - DNA, 22 bp, Homo sapiens
acttcttcttcagctgggggat

SEQ ID NO: 10235 - DNA, 22 bp, Homo sapiens
ggcatagatttctttaggttta

SEQ ID NO: 10236 - DNA, 22 bp, Homo sapiens
ggcgctcagtgttgccccagag

SEQ ID NO: 10237 - DNA, 22 bp, Homo sapiens
aagaggttgtctgtgatgagtt

SEQ ID NO: 10238 - DNA, 21 bp, Homo sapiens
ctgtggtacagctgggacgga

SEQ ID NO: 10239 - DNA, 22 bp, Homo sapiens
tgttgcccaggttctctcctgc

SEQ ID NO: 10240 - DNA, 22 bp, Homo sapiens
acccacgaagatgagcggcatg

SEQ ID NO: 10241 - DNA, 18 bp, Homo sapiens
cagcctctgattggttgc

SEQ ID NO: 10242 - DNA, 22 bp, Homo sapiens
ggttccccaggcggcccttgga

SEQ ID NO: 10243 - DNA, 18 bp, Homo sapiens
tgtccctgcaaataacat

SEQ ID NO: 10244 - DNA, 18 bp, Homo sapiens
tcctttctccctcatctt

SEQ ID NO: 10245 - DNA, 22 bp, Homo sapiens
ccacgacgagtcatcagggcga

SEQ ID NO: 10246 - DNA, 19 bp, Homo sapiens
gcctcatttccacctcccc

SEQ ID NO: 10247 - DNA, 22 bp, Homo sapiens
agggctgcccagtgtgagagct

SEQ ID NO: 10248 - DNA, 22 bp, Homo sapiens
cctttaggagtgaggaccgagc

SEQ ID NO: 10249 - DNA, 22 bp, Homo sapiens
cccacgtcgaacttgctccaga

SEQ ID NO: 10250 - DNA, 22 bp, Homo sapiens
ccaggaggtggaggttgcggtg

SEQ ID NO: 10251 - DNA, 22 bp, Homo sapiens
ccctgttgggaagagagatggc

SEQ ID NO: 10252 - DNA, 22 bp, Homo sapiens
tgaagctttaggatgggttcat

SEQ ID NO: 10253 - DNA, 22 bp, Homo sapiens
tcccccaggctggagtgcagtg

SEQ ID NO: 10254 - DNA, 22 bp, Homo sapiens
gtggcccaggctggagtgcagt

SEQ ID NO: 10255 - DNA, 22 bp, Homo sapiens
tgtatgaggcatacatcaggca

SEQ ID NO: 10256 - DNA, 22 bp, Homo sapiens
tgggggagctcagtccagccca

SEQ ID NO: 10257 - DNA, 22 bp, Homo sapiens
cagagggttgatgtgaggctta

SEQ ID NO: 10258 - DNA, 22 bp, Homo sapiens
aggagggagcttaagccaggca

SEQ ID NO: 10259 - DNA, 22 bp, Homo sapiens
gttgagtgggttaggatgctga

SEQ ID NO: 10260 - DNA, 22 bp, Homo sapiens
ggagagtggattccagctgtat

SEQ ID NO: 10261 - DNA, 22 bp, Homo sapiens
taagcctgcatgaaccatgaga

SEQ ID NO: 10262 - DNA, 22 bp, Homo sapiens
atgtgggccgtgcgggtgtcct

SEQ ID NO: 10263 - DNA, 22 bp, Homo sapiens
ggaggcagaatagagtgtgggt

SEQ ID NO: 10264 - DNA, 17 bp, Homo sapiens
ttaaggtggatcagcac

SEQ ID NO: 10265 - DNA, 22 bp, Homo sapiens
gagatatgttggcagctggtat

SEQ ID NO: 10266 - DNA, 22 bp, Homo sapiens
cgtgagcaaaatggacactccc

SEQ ID NO: 10267 - DNA, 22 bp, Homo sapiens
gaggggctgccctggtgtcagg

SEQ ID NO: 10268 - DNA, 22 bp, Homo sapiens
gggccctgcgactcgcggcgga

SEQ ID NO: 10269 - DNA, 22 bp, Homo sapiens
gggagctgagctggaagagaat

SEQ ID NO: 10270 - DNA, 22 bp, Homo sapiens
tgccgtggggctgaggctggag

SEQ ID NO: 10271 - DNA, 22 bp, Homo sapiens
gtggcccaggttggagtgcagt

SEQ ID NO: 10272 - DNA, 22 bp, Homo sapiens
ggcggaggttgcagtaagccga

SEQ ID NO: 10273 - DNA, 22 bp, Homo sapiens
gcccagtagttcaaggttgcag

SEQ ID NO: 10274 - DNA, 22 bp, Homo sapiens
ggcataggcactttaatttgga

SEQ ID NO: 10275 - DNA, 22 bp, Homo sapiens
tagggggctttgctgcttgaca

SEQ ID NO: 10276 - DNA, 22 bp, Homo sapiens
agtgaatgtccccgcgggtcag

SEQ ID NO: 10277 - DNA, 22 bp, Homo sapiens
atgccactgcacttcagcctgg

SEQ ID NO: 10278 - DNA, 22 bp, Homo sapiens
ggagagggtaggggtcctgccc

SEQ ID NO: 10279 - DNA, 22 bp, Homo sapiens
cgagcatgatgacggctgtggc

SEQ ID NO: 10280 - DNA, 22 bp, Homo sapiens
ccaggaggttgaggctgcagtg

SEQ ID NO: 10281 - DNA, 22 bp, Homo sapiens
ctcagctgcagcctggctggca

SEQ ID NO: 10282 - DNA, 22 bp, Homo sapiens
gctgcgccggatcccacgttcc

SEQ ID NO: 10283 - DNA, 22 bp, Homo sapiens
attggtggtgaggacatgccag

SEQ ID NO: 10284 - DNA, 22 bp, Homo sapiens
ccaggaggcagaagttgcagtg

SEQ ID NO: 10285 - DNA, 22 bp, Homo sapiens
ctcttagtaatgccatgaagca

SEQ ID NO: 10286 - DNA, 22 bp, Homo sapiens
cagggggctcaaaggagagtgc

SEQ ID NO: 10287 - DNA, 22 bp, Homo sapiens
aggaggtctcactatgttgccc

SEQ ID NO: 10288 - DNA, 22 bp, Homo sapiens
agccaggatggtctcgatcggc

SEQ ID NO: 10289 - DNA, 22 bp, Homo sapiens
tgctgagcgcatccggcggccg

SEQ ID NO: 10290 - DNA, 22 bp, Homo sapiens
ctaggtgatccactgctctctt

SEQ ID NO: 10291 - DNA, 22 bp, Homo sapiens
gaaggtgtctacgcgccttgag

SEQ ID NO: 10292 - DNA, 22 bp, Homo sapiens
ttgagcccaggaggcctgggtg

SEQ ID NO: 10293 - DNA, 22 bp, Homo sapiens
tgggcttaggtcggaggcggcc

SEQ ID NO: 10294 - DNA, 22 bp, Homo sapiens
tgagccagaggaggctgtgtgg

SEQ ID NO: 10295 - DNA, 22 bp, Homo sapiens
ggaggtagcctcaaaagcagct

SEQ ID NO: 10296 - DNA, 22 bp, Homo sapiens
gcctccagcccacgcaggcctg

SEQ ID NO: 10297 - DNA, 22 bp, Homo sapiens
tgtgtggattcatctcaaagag

SEQ ID NO: 10298 - DNA, 22 bp, Homo sapiens
ggcttagcaactcctgaggctc

SEQ ID NO: 10299 - DNA, 22 bp, Homo sapiens
gaggcagtccagtgggtaagaa

SEQ ID NO: 10300 - DNA, 22 bp, Homo sapiens
agagctgggtggacttgtagtt

SEQ ID NO: 10301 - DNA, 22 bp, Homo sapiens
cctgcttaacattgccatgaca

SEQ ID NO: 10302 - DNA, 22 bp, Homo sapiens
tgtgtgagtaaggctgagagag

SEQ ID NO: 10303 - DNA, 22 bp, Homo sapiens
caggtgttggaagggcagtggg

SEQ ID NO: 10304 - DNA, 22 bp, Homo sapiens
gggctgagacgatggggtcttc

SEQ ID NO: 10305 - DNA, 22 bp, Homo sapiens
tgtgttgtgacattcttggatg

SEQ ID NO: 10306 - DNA, 22 bp, Homo sapiens
ttgatcttttcttgctgcccca

SEQ ID NO: 10307 - DNA, 22 bp, Homo sapiens
ccaggaggcggaaggtacagtg

SEQ ID NO: 10308 - DNA, 22 bp, Homo sapiens
gtccccaaaattacaagacaca

SEQ ID NO: 10309 - DNA, 20 bp, Homo sapiens
ttgagcagcagtgctgtgtc

SEQ ID NO: 10310 - DNA, 22 bp, Homo sapiens
caggagtgttgattgctcagga

SEQ ID NO: 10311 - DNA, 22 bp, Homo sapiens
gcaggtggatcacctgaggtca

SEQ ID NO: 10312 - DNA, 22 bp, Homo sapiens
tagcatgtcagtcgccacacgt

SEQ ID NO: 10313 - DNA, 22 bp, Homo sapiens
agaggaggctctgggatcgtcc

SEQ ID NO: 10314 - DNA, 22 bp, Homo sapiens
tgttgcccaggttctctcctgc

SEQ ID NO: 10315 - DNA, 22 bp, Homo sapiens
gggagtgggtttggcctaggcc

SEQ ID NO: 10316 - DNA, 22 bp, Homo sapiens
gagcactgagctggaattggag

SEQ ID NO: 10317 - DNA, 22 bp, Homo sapiens
tgagccaggagtttgaggctgt

SEQ ID NO: 10318 - DNA, 22 bp, Homo sapiens
ggctgagttgagaggattactt

SEQ ID NO: 10319 - DNA, 22 bp, Homo sapiens
tggagtgcaatagtaataaggt

SEQ ID NO: 10320 - DNA, 21 bp, Homo sapiens
ggtgctcgctgatgaggagtg

SEQ ID NO: 10321 - DNA, 20 bp, Homo sapiens
ggcagagggcctgggagaag

SEQ ID NO: 10322 - DNA, 19 bp, Homo sapiens
ggggcccggggtctgcgag

SEQ ID NO: 10323 - DNA, 22 bp, Homo sapiens
gtgaggtggtacaatattaact

SEQ ID NO: 10324 - DNA, 22 bp, Homo sapiens
gctccccaaaagctccaggaaa

SEQ ID NO: 10325 - DNA, 22 bp, Homo sapiens
aagtgatgctacgactttgaca

SEQ ID NO: 10326 - DNA, 22 bp, Homo sapiens
agtgaggggcagctgagtgggc

SEQ ID NO: 10327 - DNA, 21 bp, Homo sapiens
cttccccaggctggtctgtat

SEQ ID NO: 10328 - DNA, 22 bp, Homo sapiens
caggtgagaggcggtcctgcat

SEQ ID NO: 10329 - DNA, 22 bp, Homo sapiens
atgccactgcgctctagcctgg

SEQ ID NO: 10330 - DNA, 22 bp, Homo sapiens
ccaggaggcggaggttgcagtg

SEQ ID NO: 10331 - DNA, 22 bp, Homo sapiens
gaggggcacagtaaagggtccc

SEQ ID NO: 10332 - DNA, 22 bp, Homo sapiens
tccccaagcaggcaatctcccg

SEQ ID NO: 10333 - DNA, 22 bp, Homo sapiens
tctgagctccatgcaggaggct

SEQ ID NO: 10334 - DNA, 22 bp, Homo sapiens
gggaagagggagctggaatgat

SEQ ID NO: 10335 - DNA, 22 bp, Homo sapiens
gcccagtggtaaaagcaggcct

SEQ ID NO: 10336 - DNA, 22 bp, Homo sapiens
gggctgtaggagctggaatggg

SEQ ID NO: 10337 - DNA, 22 bp, Homo sapiens
aggagctgtcagagtgccagag

SEQ ID NO: 10338 - DNA, 22 bp, Homo sapiens
gtggagggtgattgccggctgt

SEQ ID NO: 10339 - DNA, 22 bp, Homo sapiens
ggaagggcaaaagagatgaact

SEQ ID NO: 10340 - DNA, 21 bp, Homo sapiens
accctgctttatgccgtcctc

SEQ ID NO: 10341 - DNA, 22 bp, Homo sapiens
aaagcgcttccctttggagcgt

SEQ ID NO: 10342 - DNA, 22 bp, Homo sapiens
ggcatgagcacgaagtggtacc

SEQ ID NO: 10343 - DNA, 22 bp, Homo sapiens
ggagtgactcacagctgggaca

SEQ ID NO: 10344 - DNA, 22 bp, Homo sapiens
gaggttggggctgcagtgagct

SEQ ID NO: 10345 - DNA, 22 bp, Homo sapiens
tctccccagtatggattctctg

SEQ ID NO: 10346 - DNA, 22 bp, Homo sapiens
atccccagaaagaccgatgtac

SEQ ID NO: 10347 - DNA, 22 bp, Homo sapiens
tcctgggccctccggatcaggt

SEQ ID NO: 10348 - DNA, 22 bp, Homo sapiens
ccagggtggcgtagatgctggg

SEQ ID NO: 10349 - DNA, 22 bp, Homo sapiens
gccctagcgccagctcagcacc

SEQ ID NO: 10350 - DNA, 22 bp, Homo sapiens
gaaggaagtcattagtgcagac

SEQ ID NO: 10351 - DNA, 22 bp, Homo sapiens
accctgctttatgccgtcctct

SEQ ID NO: 10352 - DNA, 22 bp, Homo sapiens
ggaggaggggtgactgaatgct

SEQ ID NO: 10353 - DNA, 22 bp, Homo sapiens
ccaggaggcggaggttgcagcg

SEQ ID NO: 10354 - DNA, 22 bp, Homo sapiens
ttggatgagagggtgtggtaca

SEQ ID NO: 10355 - DNA, 22 bp, Homo sapiens
gggaggaggaatgttttgtgta

SEQ ID NO: 10356 - DNA, 20 bp, Homo sapiens
tgtttgtgtggggccttggc

SEQ ID NO: 10357 - DNA, 22 bp, Homo sapiens
ttttcctttgattcccagatgt

SEQ ID NO: 10358 - DNA, 22 bp, Homo sapiens
gaggagggagctggaagctctt

SEQ ID NO: 10359 - DNA, 23 bp, Homo sapiens
tgagctgggcctgcaggggtctc

SEQ ID NO: 10360 - DNA, 22 bp, Homo sapiens
tgagcaggcgcagcaggaggtc

SEQ ID NO: 10361 - DNA, 22 bp, Homo sapiens
tgagctcgagagctttggtcca

SEQ ID NO: 10362 - DNA, 22 bp, Homo sapiens
ggctagggatctagaccaggac

SEQ ID NO: 10363 - DNA, 22 bp, Homo sapiens
gctgcagtgagccaagatcgtg

SEQ ID NO: 10364 - DNA, 22 bp, Homo sapiens
gaagccagtgtttgaagaattt

SEQ ID NO: 10365 - DNA, 22 bp, Homo sapiens
gggtaggcaaagcaatgacgtt

SEQ ID NO: 10366 - DNA, 22 bp, Homo sapiens
gaaggaagtcattagtgcagac

SEQ ID NO: 10367 - DNA, 22 bp, Homo sapiens
agaacctcaattatttttgcac

SEQ ID NO: 10368 - DNA, 22 bp, Homo sapiens
gggggaagaaagaacatggcat

SEQ ID NO: 10369 - DNA, 22 bp, Homo sapiens
tggggtacttgtatcaaagcac

SEQ ID NO: 10370 - DNA, 22 bp, Homo sapiens
gaggggcacagtaaagggtccc

SEQ ID NO: 10371 - DNA, 22 bp, Homo sapiens
gaggcacagagtaggtgcacac

SEQ ID NO: 10372 - DNA, 22 bp, Homo sapiens
tgccgcagtgcggggagggccc

SEQ ID NO: 10373 - DNA, 22 bp, Homo sapiens
cagcctttgggtcagaagattc

SEQ ID NO: 10374 - DNA, 22 bp, Homo sapiens
aatggccagacagatggctgct

SEQ ID NO: 10375 - DNA, 22 bp, Homo sapiens
attcacagggggagaagggtat

SEQ ID NO: 10376 - DNA, 22 bp, Homo sapiens
aggccctattcaatggggccca

SEQ ID NO: 10377 - DNA, 22 bp, Homo sapiens
agcatggccatctgggccgtcc

SEQ ID NO: 10378 - DNA, 18 bp, Homo sapiens
gatcgggggcgccccaag

SEQ ID NO: 10379 - DNA, 21 bp, Homo sapiens
tgggggtcttcacggtgttgt

SEQ ID NO: 10380 - DNA, 22 bp, Homo sapiens
tggggagtgatgcctcggataa

SEQ ID NO: 10381 - DNA, 22 bp, Homo sapiens
agaggccggccgagcccatggg

SEQ ID NO: 10382 - DNA, 22 bp, Homo sapiens
ccgcccacactaaatatgagcg

SEQ ID NO: 10383 - DNA, 22 bp, Homo sapiens
gggcatggtggcaggcacctgt

SEQ ID NO: 10384 - DNA, 22 bp, Homo sapiens
agtggccagcagcctagcctag

SEQ ID NO: 10385 - DNA, 22 bp, Homo sapiens
cctgggggccaggaaggtgtga

SEQ ID NO: 10386 - DNA, 22 bp, Homo sapiens
atgggtgcagcatggtgggaac

SEQ ID NO: 10387 - DNA, 21 bp, Homo sapiens
gggcctggctgcgcaggacgg

SEQ ID NO: 10388 - DNA, 22 bp, Homo sapiens
tgttattctagtggatcacgtc

SEQ ID NO: 10389 - DNA, 22 bp, Homo sapiens
ggggccgaccgcggttcaggcc

SEQ ID NO: 10390 - DNA, 22 bp, Homo sapiens
ggagagggtaggggtcctgccc

SEQ ID NO: 10391 - DNA, 22 bp, Homo sapiens
ctgggggtcttgaaagggagag

SEQ ID NO: 10392 - DNA, 22 bp, Homo sapiens
atctggttcttcttaggcatca

SEQ ID NO: 10393 - DNA, 22 bp, Homo sapiens
gggccgtagaccacgtccgggc

SEQ ID NO: 10394 - DNA, 22 bp, Homo sapiens
gggggagagacgagcggctctg

SEQ ID NO: 10395 - DNA, 22 bp, Homo sapiens
ggttcagggctaccagtgggtg

SEQ ID NO: 10396 - DNA, 22 bp, Homo sapiens
aggcgcattgaggccctgttgc

SEQ ID NO: 10397 - DNA, 22 bp, Homo sapiens
aggggatggagctggaaggcag

SEQ ID NO: 10398 - DNA, 22 bp, Homo sapiens
aggggaggtgtccccaaatctc

SEQ ID NO: 10399 - DNA, 22 bp, Homo sapiens
ggcgagaagttgttagtggctt

SEQ ID NO: 10400 - DNA, 22 bp, Homo sapiens
acctgcaggcacaggtgtgcgc

SEQ ID NO: 10401 - DNA, 22 bp, Homo sapiens
gctggccacagatccccaggga

SEQ ID NO: 10402 - DNA, 22 bp, Homo sapiens
gcgagcctctggagtcctctgg

SEQ ID NO: 10403 - DNA, 22 bp, Homo sapiens
agggctggagccacagctggga

SEQ ID NO: 10404 - DNA, 22 bp, Homo sapiens
gagggagggactagcattctct

SEQ ID NO: 10405 - DNA, 22 bp, Homo sapiens
gggccggagctgggtcccgcgc

SEQ ID NO: 10406 - DNA, 19 bp, Homo sapiens
ggcatggggtccggggacc

SEQ ID NO: 10407 - DNA, 22 bp, Homo sapiens
cggccgcagcagtgtcggccca

SEQ ID NO: 10408 - DNA, 22 bp, Homo sapiens
ggccgccctttccacggtttct

SEQ ID NO: 10409 - DNA, 22 bp, Homo sapiens
gggactggagtagaggccggtg

SEQ ID NO: 10410 - DNA, 22 bp, Homo sapiens
aagagggctcgatttggcaaaa

SEQ ID NO: 10411 - DNA, 22 bp, Homo sapiens
attcgcgggcctggagggtggg

SEQ ID NO: 10412 - DNA, 22 bp, Homo sapiens
cgcaccactgaattccagcctg

SEQ ID NO: 10413 - DNA, 22 bp, Homo sapiens
gggaggcagtgctggaggctgg

SEQ ID NO: 10414 - DNA, 22 bp, Homo sapiens
ggcaaggggtcaggctgagaca

SEQ ID NO: 10415 - DNA, 22 bp, Homo sapiens
cgggcaaggcgagactaggccc

SEQ ID NO: 10416 - DNA, 22 bp, Homo sapiens
aagtggcagttcaggaagcaga

SEQ ID NO: 10417 - DNA, 22 bp, Homo sapiens
atttattcctttatggctggag

SEQ ID NO: 10418 - DNA, 22 bp, Homo sapiens
cagaagactgcagggaagggac

SEQ ID NO: 10419 - DNA, 22 bp, Homo sapiens
aagagggaaattgttggctgct

SEQ ID NO: 10420 - DNA, 22 bp, Homo sapiens
ttacaaagtttaaggtggcact

SEQ ID NO: 10421 - DNA, 22 bp, Homo sapiens
gccgccgctgtgcaatttagca

SEQ ID NO: 10422 - DNA, 22 bp, Homo sapiens
ggagaggggaacttgttgcttg

SEQ ID NO: 10423 - DNA, 22 bp, Homo sapiens
tttattggatatttacaagata

SEQ ID NO: 10424 - DNA, 22 bp, Homo sapiens
actttatttcctattgcatcca

SEQ ID NO: 10425 - DNA, 22 bp, Homo sapiens
gggcgcatcacctgaggtcagg

SEQ ID NO: 10426 - DNA, 22 bp, Homo sapiens
ggtgccaggctgtagtcagggt

SEQ ID NO: 10427 - DNA, 22 bp, Homo sapiens
tgcactactgtgatacacagcc

SEQ ID NO: 10428 - DNA, 22 bp, Homo sapiens
ccttcattcattaatttagccc

SEQ ID NO: 10429 - DNA, 22 bp, Homo sapiens
gcttggccagcagccgggatgc

SEQ ID NO: 10430 - DNA, 22 bp, Homo sapiens
cttctttcaagaatggattagg

SEQ ID NO: 10431 - DNA, 22 bp, Homo sapiens
agcgctgtgggcgtgcgaggag

SEQ ID NO: 10432 - DNA, 22 bp, Homo sapiens
gaggagggagctggaagctctt

SEQ ID NO: 10433 - DNA, 21 bp, Homo sapiens
ggccgccgccttgtgctctgc

SEQ ID NO: 10434 - DNA, 23 bp, Homo sapiens
gggggccgtcctggggattatag

SEQ ID NO: 10435 - DNA, 22 bp, Homo sapiens
gggcgccgtgggaaacagccgg

SEQ ID NO: 10436 - DNA, 22 bp, Homo sapiens
gccgtgtcatctgcgggtggca

SEQ ID NO: 10437 - DNA, 22 bp, Homo sapiens
ctcagactagcctgtaccgaca

SEQ ID NO: 10438 - DNA, 22 bp, Homo sapiens
tcaaagatcagatggttgtagg

SEQ ID NO: 10439 - DNA, 22 bp, Homo sapiens
agctttacctgccttggggcac

SEQ ID NO: 10440 - DNA, 22 bp, Homo sapiens
tagatatttctactgtggatta

SEQ ID NO: 10441 - DNA, 22 bp, Homo sapiens
acgggccttctcttcaggcgag

SEQ ID NO: 10442 - DNA, 20 bp, Homo sapiens
ttcgctgggagtggccaggc

SEQ ID NO: 10443 - DNA, 22 bp, Homo sapiens
ctgggaggcggagcttgcagtg

SEQ ID NO: 10444 - DNA, 22 bp, Homo sapiens
tgccgcactcggccaccagctg

SEQ ID NO: 10445 - DNA, 22 bp, Homo sapiens
cagggagtgtacaccatgtgta

SEQ ID NO: 10446 - DNA, 22 bp, Homo sapiens
ggagttgattttggatatatta

SEQ ID NO: 10447 - DNA, 22 bp, Homo sapiens
gacttctgaattcctatcaggt

SEQ ID NO: 10448 - DNA, 22 bp, Homo sapiens
tctgagccagggtctcctccct

SEQ ID NO: 10449 - DNA, 17 bp, Homo sapiens
gggcagggactcctggg

SEQ ID NO: 10450 - DNA, 22 bp, Homo sapiens
ttcagcttgctgactgcggcag

SEQ ID NO: 10451 - DNA, 22 bp, Homo sapiens
ttagtattaggatcatatttga

SEQ ID NO: 10452 - DNA, 22 bp, Homo sapiens
tgcaataactactttaatgttg

SEQ ID NO: 10453 - DNA, 20 bp, Homo sapiens
tttgaatgtaaagcatgtca

SEQ ID NO: 10454 - DNA, 22 bp, Homo sapiens
tatactacgcaccaaacaaagg

SEQ ID NO: 10455 - DNA, 22 bp, Homo sapiens
caaggtgccatgctgggcgggg

SEQ ID NO: 10456 - DNA, 22 bp, Homo sapiens
cagccttagcaggatcatctga

SEQ ID NO: 10457 - DNA, 22 bp, Homo sapiens
gcgagcctctggagtcctctgg

SEQ ID NO: 10458 - DNA, 22 bp, Homo sapiens
catgcggctctttccaaaccgg

SEQ ID NO: 10459 - DNA, 22 bp, Homo sapiens
gggcccttcagcttcctctgca

SEQ ID NO: 10460 - DNA, 22 bp, Homo sapiens
ctccaggctcgtccaagatcga

SEQ ID NO: 10461 - DNA, 22 bp, Homo sapiens
catctgtaaagtaggaatattg

SEQ ID NO: 10462 - DNA, 22 bp, Homo sapiens
atgaacttccagagcttggtga

SEQ ID NO: 10463 - DNA, 22 bp, Homo sapiens
ccccatttgaactccttcaact

SEQ ID NO: 10464 - DNA, 22 bp, Homo sapiens
ttcagacatgcaggctgaggct

SEQ ID NO: 10465 - DNA, 22 bp, Homo sapiens
atgccaggaacaaacagtggtg

SEQ ID NO: 10466 - DNA, 20 bp, Homo sapiens
ggtggccgtagcgggcggcg

SEQ ID NO: 10467 - DNA, 22 bp, Homo sapiens
cagaggtagcatgctgtggctt

SEQ ID NO: 10468 - DNA, 22 bp, Homo sapiens
gcacatgaggctgtctttgtct

SEQ ID NO: 10469 - DNA, 22 bp, Homo sapiens
aaacttgagccaagggcttggg

SEQ ID NO: 10470 - DNA, 22 bp, Homo sapiens
ggaatcctgccagctctgcccc

SEQ ID NO: 10471 - DNA, 22 bp, Homo sapiens
atggccctaatgagttggtgtt

SEQ ID NO: 10472 - DNA, 22 bp, Homo sapiens
aggtgggcgctgctcccgctgg

SEQ ID NO: 10473 - DNA, 22 bp, Homo sapiens
ggagcatgcgctctgtgaccga

SEQ ID NO: 10474 - DNA, 22 bp, Homo sapiens
ccgcccacactaaatatgagcg

SEQ ID NO: 10475 - DNA, 22 bp, Homo sapiens
gttcccaccatgctgcacccat

SEQ ID NO: 10476 - DNA, 22 bp, Homo sapiens
ttccgctgtttagttgaagttt

SEQ ID NO: 10477 - DNA, 22 bp, Homo sapiens
ttctccacccactcttttgttg

SEQ ID NO: 10478 - DNA, 22 bp, Homo sapiens
ttgaccactgaatggttctgaa

SEQ ID NO: 10479 - DNA, 19 bp, Homo sapiens
tttgatagggcataatata

SEQ ID NO: 10480 - DNA, 22 bp, Homo sapiens
tactgtgtgcccagccgagctg

SEQ ID NO: 10481 - DNA, 18 bp, Homo sapiens
tcttccaacactgacacc

SEQ ID NO: 10482 - DNA, 22 bp, Homo sapiens
aagtctctcacatatctggtcc

SEQ ID NO: 10483 - DNA, 22 bp, Homo sapiens
acgcctgtaatcccagcacttt

SEQ ID NO: 10484 - DNA, 22 bp, Homo sapiens
caagattaccaaggaccagcgg

SEQ ID NO: 10485 - DNA, 22 bp, Homo sapiens
catgcacttacctgaaattcaa

SEQ ID NO: 10486 - DNA, 22 bp, Homo sapiens
ggtccccgtggaggctggagcg

SEQ ID NO: 10487 - DNA, 22 bp, Homo sapiens
tatgcagtgagcactatttata

SEQ ID NO: 10488 - DNA, 22 bp, Homo sapiens
gggaggctctgctcagcccccg

SEQ ID NO: 10489 - DNA, 22 bp, Homo sapiens
tgcgcggctcagtcatctccag

SEQ ID NO: 10490 - DNA, 22 bp, Homo sapiens
tcattgccatggcatttgcaga

SEQ ID NO: 10491 - DNA, 22 bp, Homo sapiens
gcccccgtagtagatgaggcgc

SEQ ID NO: 10492 - DNA, 22 bp, Homo sapiens
attgtactacaccatagtactg

SEQ ID NO: 10493 - DNA, 22 bp, Homo sapiens
cccacgttgaaccgcttacaga

SEQ ID NO: 10494 - DNA, 22 bp, Homo sapiens
tttggaaatgaccccgtctaag

SEQ ID NO: 10495 - DNA, 22 bp, Homo sapiens
gcacttcaccactgtcctggtt

SEQ ID NO: 10496 - DNA, 22 bp, Homo sapiens
tttctataaaaagtgctaggat

SEQ ID NO: 10497 - DNA, 22 bp, Homo sapiens
tgtgtctcaagtcagagcatca

SEQ ID NO: 10498 - DNA, 22 bp, Homo sapiens
caggctggagtgcagtggcgcc

SEQ ID NO: 10499 - DNA, 22 bp, Homo sapiens
tcatctccatacggtctcgcag

SEQ ID NO: 10500 - DNA, 22 bp, Homo sapiens
atgaccagccgagataaacaga

SEQ ID NO: 10501 - DNA, 22 bp, Homo sapiens
cctggtgctgctatcaggggta

SEQ ID NO: 10502 - DNA, 21 bp, Homo sapiens
ttgatggtgggtgatgctctg

SEQ ID NO: 10503 - DNA, 22 bp, Homo sapiens
tcctggtcttcaggttgcaaaa

SEQ ID NO: 10504 - DNA, 22 bp, Homo sapiens
agaatttcctatgagagattcc

SEQ ID NO: 10505 - DNA, 22 bp, Homo sapiens
ttgtacatttgttcagttctga

SEQ ID NO: 10506 - DNA, 22 bp, Homo sapiens
aggtgtctggacttgtgaagca

SEQ ID NO: 10507 - DNA, 22 bp, Homo sapiens
tcttaattctgtgtcttcacta

SEQ ID NO: 10508 - DNA, 22 bp, Homo sapiens
tctgtggcccaagtgatggctg

SEQ ID NO: 10509 - DNA, 22 bp, Homo sapiens
tgacaggaaacatgcagtgatt

SEQ ID NO: 10510 - DNA, 22 bp, Homo sapiens
tggtgctgccaggctcctgcca

SEQ ID NO: 10511 - DNA, 22 bp, Homo sapiens
tgctgggggtagctctgcgtag

SEQ ID NO: 10512 - DNA, 22 bp, Homo sapiens
ggtgacctcacctggtcccacc

SEQ ID NO: 10513 - DNA, 22 bp, Homo sapiens
ggaggaggggtgactgaatgct

SEQ ID NO: 10514 - DNA, 22 bp, Homo sapiens
tcccttatctggtattttttag

SEQ ID NO: 10515 - DNA, 21 bp, Homo sapiens
cagaggcctatcacagactcc

SEQ ID NO: 10516 - DNA, 22 bp, Homo sapiens
tttaaaaaactagtctgagtct

SEQ ID NO: 10517 - DNA, 22 bp, Homo sapiens
atacaatgattggttctcaccc

SEQ ID NO: 10518 - DNA, 22 bp, Homo sapiens
tggcaggcgggagccatagagg

SEQ ID NO: 10519 - DNA, 22 bp, Homo sapiens
aatgtgaggccttggtagttat

SEQ ID NO: 10520 - DNA, 22 bp, Homo sapiens
caaatactacgattcttgcagt

SEQ ID NO: 10521 - DNA, 22 bp, Homo sapiens
agcaacctcatgagagtgaaat

SEQ ID NO: 10522 - DNA, 22 bp, Homo sapiens
ctgggatccacgggctcccaag

SEQ ID NO: 10523 - DNA, 22 bp, Homo sapiens
agttattactctttaacatatt

SEQ ID NO: 10524 - DNA, 22 bp, Homo sapiens
caattctgaggcctgctttgtt

SEQ ID NO: 10525 - DNA, 22 bp, Homo sapiens
tgcaggctcttggtgacgtggg

SEQ ID NO: 10526 - DNA, 22 bp, Homo sapiens
cacttgttggtggtgaaatcac

SEQ ID NO: 10527 - DNA, 22 bp, Homo sapiens
atctgagctccgcctcctgtca

SEQ ID NO: 10528 - DNA, 22 bp, Homo sapiens
tttcataatactgtacatgaaa

SEQ ID NO: 10529 - DNA, 22 bp, Homo sapiens
cattccttaacgtggggagtct

SEQ ID NO: 10530 - DNA, 22 bp, Homo sapiens
ccgccgtgcaggccgcgacgtg

SEQ ID NO: 10531 - DNA, 22 bp, Homo sapiens
gagtggctattgatccgtgatg

SEQ ID NO: 10532 - DNA, 22 bp, Homo sapiens
actcttgattgatttagtcttt

SEQ ID NO: 10533 - DNA, 22 bp, Homo sapiens
cctcagacccctgctgagcttc

SEQ ID NO: 10534 - DNA, 22 bp, Homo sapiens
atgattgaccatctgctgggct

SEQ ID NO: 10535 - DNA, 22 bp, Homo sapiens
gcggggcctgactctgacccgc

SEQ ID NO: 10536 - DNA, 22 bp, Homo sapiens
ttatttttaaaagttcacacag

SEQ ID NO: 10537 - DNA, 22 bp, Homo sapiens
cggctgggttcggctgcaggcc

SEQ ID NO: 10538 - DNA, 22 bp, Homo sapiens
acatgagactgggtttgtaggg

SEQ ID NO: 10539 - DNA, 22 bp, Homo sapiens
gtgggggctggaaatcttgcca

SEQ ID NO: 10540 - DNA, 22 bp, Homo sapiens
ggggaaggaaagttattagcag

SEQ ID NO: 10541 - DNA, 22 bp, Homo sapiens
gacctcatgatccacctgcctt

SEQ ID NO: 10542 - DNA, 22 bp, Homo sapiens
ggcccaggctggagtgcagtgg

SEQ ID NO: 10543 - DNA, 22 bp, Homo sapiens
agaaatgggccttgggacacaa

SEQ ID NO: 10544 - DNA, 22 bp, Homo sapiens
tgtctgttattggtgtataaga

SEQ ID NO: 10545 - DNA, 22 bp, Homo sapiens
atcttggggaatcctctgtgta

SEQ ID NO: 10546 - DNA, 22 bp, Homo sapiens
caggaaagggatgggctgccac

SEQ ID NO: 10547 - DNA, 21 bp, Homo sapiens
aggcaccacatctccctcccc

SEQ ID NO: 10548 - DNA, 22 bp, Homo sapiens
agggcagagctgtctaaatggc

SEQ ID NO: 10549 - DNA, 22 bp, Homo sapiens
gaggccacggaagggagctgtg

SEQ ID NO: 10550 - DNA, 18 bp, Homo sapiens
ctgccagtgtgctctccg

SEQ ID NO: 10551 - DNA, 22 bp, Homo sapiens
gaaaagagacagggtgggtgat

SEQ ID NO: 10552 - DNA, 22 bp, Homo sapiens
tcactgaaacctccacctctcg

SEQ ID NO: 10553 - DNA, 22 bp, Homo sapiens
aggccagcctgcccaaagctgc

SEQ ID NO: 10554 - DNA, 22 bp, Homo sapiens
gcaagacctatctagttgctgt

SEQ ID NO: 10555 - DNA, 22 bp, Homo sapiens
gtaatctcagctacttgggagg

SEQ ID NO: 10556 - DNA, 22 bp, Homo sapiens
gggcactcctctggtccagccc

SEQ ID NO: 10557 - DNA, 22 bp, Homo sapiens
ggcatagatttctttaggttta

SEQ ID NO: 10558 - DNA, 22 bp, Homo sapiens
gaaagacatagttgcaagatgg

SEQ ID NO: 10559 - DNA, 22 bp, Homo sapiens
caccttggccttgctatttctc

SEQ ID NO: 10560 - DNA, 22 bp, Homo sapiens
ctgaggagaggtggcctgtgtt

SEQ ID NO: 10561 - DNA, 22 bp, Homo sapiens
aggctgtgtgctccttatgaga

SEQ ID NO: 10562 - DNA, 22 bp, Homo sapiens
aaactgaggctcccgagggtgt

SEQ ID NO: 10563 - DNA, 22 bp, Homo sapiens
tagatgaccttgtgttaggcaa

SEQ ID NO: 10564 - DNA, 22 bp, Homo sapiens
gttcagtcacgtgcccaagttc

SEQ ID NO: 10565 - DNA, 22 bp, Homo sapiens
aaaccgcaattacttttgcgtc

SEQ ID NO: 10566 - DNA, 22 bp, Homo sapiens
gtggcccaggctggagtgcagt

SEQ ID NO: 10567 - DNA, 22 bp, Homo sapiens
aagaatgagctcaaagatctta

SEQ ID NO: 10568 - DNA, 22 bp, Homo sapiens
cccggcctctgcctggtggcct

SEQ ID NO: 10569 - DNA, 21 bp, Homo sapiens
acatggactgtgaatggggac

SEQ ID NO: 10570 - DNA, 22 bp, Homo sapiens
gagccccaccctagacattctg

SEQ ID NO: 10571 - DNA, 22 bp, Homo sapiens
tcgaaataatttagaatataga

SEQ ID NO: 10572 - DNA, 22 bp, Homo sapiens
gtagcccacctggggagggcga

SEQ ID NO: 10573 - DNA, 22 bp, Homo sapiens
aggcaggaggatcatggatgca

SEQ ID NO: 10574 - DNA, 22 bp, Homo sapiens
tggcccgaagatccgagggtca

SEQ ID NO: 10575 - DNA, 22 bp, Homo sapiens
tgagatgaataactcctgctaa

SEQ ID NO: 10576 - DNA, 22 bp, Homo sapiens
cacagtcctgccagagggcctt

SEQ ID NO: 10577 - DNA, 22 bp, Homo sapiens
taagagaatgttgtggctaggt

SEQ ID NO: 10578 - DNA, 22 bp, Homo sapiens
ttacatgtggtgtgaagaagag

SEQ ID NO: 10579 - DNA, 22 bp, Homo sapiens
acactgatgttggccctggtca

SEQ ID NO: 10580 - DNA, 22 bp, Homo sapiens
accctggaggtggaggtgcagt

SEQ ID NO: 10581 - DNA, 22 bp, Homo sapiens
ggagtttgcctattgcttttgg

SEQ ID NO: 10582 - DNA, 22 bp, Homo sapiens
gtaagggatttgaacataggtt

SEQ ID NO: 10583 - DNA, 22 bp, Homo sapiens
tgctcttcacagtttcagcatc

SEQ ID NO: 10584 - DNA, 22 bp, Homo sapiens
gggataagagagtatttatgca

SEQ ID NO: 10585 - DNA, 18 bp, Homo sapiens
atgagaggtgtcagaaga

SEQ ID NO: 10586 - DNA, 22 bp, Homo sapiens
aggtgactggtttatctggcag

SEQ ID NO: 10587 - DNA, 22 bp, Homo sapiens
tcaggggcttgaggtgcatgtc

SEQ ID NO: 10588 - DNA, 22 bp, Homo sapiens
actgcacttcagcctgggtgtc

SEQ ID NO: 10589 - DNA, 22 bp, Homo sapiens
gaggtgctgctgtacttcttgc

SEQ ID NO: 10590 - DNA, 22 bp, Homo sapiens
ggaagggcaaaagagatgaact

SEQ ID NO: 10591 - DNA, 22 bp, Homo sapiens
gggacgtgagtgaagaaggtct

SEQ ID NO: 10592 - DNA, 19 bp, Homo sapiens
gcctcatttccacctcccc

SEQ ID NO: 10593 - DNA, 22 bp, Homo sapiens
cgcaccactgaattccagcctg

SEQ ID NO: 10594 - DNA, 22 bp, Homo sapiens
cagatgtacatgaagggcaatg

SEQ ID NO: 10595 - DNA, 19 bp, Homo sapiens
acacagggatcagagggtt

SEQ ID NO: 10596 - DNA, 21 bp, Homo sapiens
gagagctaacagtgacagctc

SEQ ID NO: 10597 - DNA, 22 bp, Homo sapiens
ggccggggcctgctcgcctgtg

SEQ ID NO: 10598 - DNA, 22 bp, Homo sapiens
gcatggcttcggggtgctgcct

SEQ ID NO: 10599 - DNA, 22 bp, Homo sapiens
aggctgagataggtggatcatt

SEQ ID NO: 10600 - DNA, 22 bp, Homo sapiens
tcccgttgatgacggtgcatcc

SEQ ID NO: 10601 - DNA, 22 bp, Homo sapiens
tctgccttgtttgagctttgac

SEQ ID NO: 10602 - DNA, 22 bp, Homo sapiens
tggctgtacattggaattatct

SEQ ID NO: 10603 - DNA, 22 bp, Homo sapiens
tgatcaaaacattactccacca

SEQ ID NO: 10604 - DNA, 22 bp, Homo sapiens
tctggctccaggaccgggcaca

SEQ ID NO: 10605 - DNA, 22 bp, Homo sapiens
gaccttgtgatccacctgcctt

SEQ ID NO: 10606 - DNA, 22 bp, Homo sapiens
gccaggacctcagatgcagggc

SEQ ID NO: 10607 - DNA, 22 bp, Homo sapiens
taagaaatttagttatagaatg

SEQ ID NO: 10608 - DNA, 22 bp, Homo sapiens
ttatttgtggcatatgagacga

SEQ ID NO: 10609 - DNA, 19 bp, Homo sapiens
gagcagtgaggaccaccag

SEQ ID NO: 10610 - DNA, 21 bp, Homo sapiens
tcactagtgccttctgtcatt

SEQ ID NO: 10611 - DNA, 22 bp, Homo sapiens
ccagactgcttgcttcccagcc

SEQ ID NO: 10612 - DNA, 22 bp, Homo sapiens
atccaccctgtggtggctttct

SEQ ID NO: 10613 - DNA, 22 bp, Homo sapiens
cccaggctggagtgcagtggcg

SEQ ID NO: 10614 - DNA, 22 bp, Homo sapiens
aaggggaagagaccgcagagtc

SEQ ID NO: 10615 - DNA, 22 bp, Homo sapiens
aaggaaagctgtggttctgaga

SEQ ID NO: 10616 - DNA, 22 bp, Homo sapiens
gagaccttaggaacagcctcaa

SEQ ID NO: 10617 - DNA, 22 bp, Homo sapiens
agggaaattaatgtgagcaatg

SEQ ID NO: 10618 - DNA, 22 bp, Homo sapiens
tattttgtgccatgcactgcct

SEQ ID NO: 10619 - DNA, 22 bp, Homo sapiens
gctcactgcaagctccgcctcc

SEQ ID NO: 10620 - DNA, 22 bp, Homo sapiens
ccttgctcaagctagtgacggg

SEQ ID NO: 10621 - DNA, 22 bp, Homo sapiens
cccagttttctgattgaagagc

SEQ ID NO: 10622 - DNA, 22 bp, Homo sapiens
accactgcccatggtgaaaact

SEQ ID NO: 10623 - DNA, 22 bp, Homo sapiens
taattgtaaagtagtagtacag

SEQ ID NO: 10624 - DNA, 22 bp, Homo sapiens
tgagcaggcgcagcaggaggtc

SEQ ID NO: 10625 - DNA, 22 bp, Homo sapiens
atgctaaggcccaggagaaaat

SEQ ID NO: 10626 - DNA, 22 bp, Homo sapiens
cacccaggctggagtgcagtga

SEQ ID NO: 10627 - DNA, 22 bp, Homo sapiens
cacccaggctggaatgcagtgg

SEQ ID NO: 10628 - DNA, 22 bp, Homo sapiens
aagtgcttccatgtttgagtgt

SEQ ID NO: 10629 - DNA, 18 bp, Homo sapiens
tcctttctccctcatctt

SEQ ID NO: 10630 - DNA, 22 bp, Homo sapiens
attgtggtgtcagttataggca

SEQ ID NO: 10631 - DNA, 22 bp, Homo sapiens
cagtgacgtaaactgcatgtgc

SEQ ID NO: 10632 - DNA, 22 bp, Homo sapiens
tcgagctctggagccaaggatg

SEQ ID NO: 10633 - DNA, 22 bp, Homo sapiens
attgataaattgcaatggggct

SEQ ID NO: 10634 - DNA, 22 bp, Homo sapiens
agaggccggccgagcccatggg

SEQ ID NO: 10635 - DNA, 22 bp, Homo sapiens
gagggagggactagcattctct

SEQ ID NO: 10636 - DNA, 22 bp, Homo sapiens
tttattggatatttacaagata

SEQ ID NO: 10637 - DNA, 22 bp, Homo sapiens
actgcactccagcctcggggtc

SEQ ID NO: 10638 - DNA, 22 bp, Homo sapiens
tacaaaaaattgatactgacga

SEQ ID NO: 10639 - DNA, 22 bp, Homo sapiens
tggaatcattgctgtgttgctt

SEQ ID NO: 10640 - DNA, 22 bp, Homo sapiens
attgtcgtcaatggacacatag

SEQ ID NO: 10641 - DNA, 22 bp, Homo sapiens
gcagtatctatgtgatgggttg

SEQ ID NO: 10642 - DNA, 22 bp, Homo sapiens
cttatttgcccatgtttcttta

SEQ ID NO: 10643 - DNA, 22 bp, Homo sapiens
aaattgcaaaagtacttttagg

SEQ ID NO: 10644 - DNA, 22 bp, Homo sapiens
tgcagcctggcttcgcgcctcc

SEQ ID NO: 10645 - DNA, 22 bp, Homo sapiens
ggccgctctccggtgtggatct

SEQ ID NO: 10646 - DNA, 22 bp, Homo sapiens
cgttttcatgggtagaggttct

SEQ ID NO: 10647 - DNA, 22 bp, Homo sapiens
gagcccaggaagtggaggctga

SEQ ID NO: 10648 - DNA, 22 bp, Homo sapiens
gggggctccaggcgagaatgtg

SEQ ID NO: 10649 - DNA, 22 bp, Homo sapiens
gcgtctcaaggcccccaggcca

SEQ ID NO: 10650 - DNA, 22 bp, Homo sapiens
actgcactccagcctgggtaac

SEQ ID NO: 10651 - DNA, 22 bp, Homo sapiens
actgcactccaacctgggtgac

SEQ ID NO: 10652 - DNA, 22 bp, Homo sapiens
acccccaagaggggccttcagc

SEQ ID NO: 10653 - DNA, 23 bp, Homo sapiens
gttttacaggtgagaaaatggag

SEQ ID NO: 10654 - DNA, 22 bp, Homo sapiens
actgaataaggtgaatgctctg

SEQ ID NO: 10655 - DNA, 22 bp, Homo sapiens
aaagcagaactgagagagctgg

SEQ ID NO: 10656 - DNA, 22 bp, Homo sapiens
ccgcggggtcatggctgggccg

SEQ ID NO: 10657 - DNA, 22 bp, Homo sapiens
agagtactgcctcagttatgaa

SEQ ID NO: 10658 - DNA, 20 bp, Homo sapiens
cctgtcatcccagcattttg

SEQ ID NO: 10659 - DNA, 22 bp, Homo sapiens
caggcaggtcagtgaagaagga

SEQ ID NO: 10660 - DNA, 23 bp, Homo sapiens
tgtgggcgcattgtaagggtagc

SEQ ID NO: 10661 - DNA, 22 bp, Homo sapiens
ccaggcaggcgatggtgcagtg

SEQ ID NO: 10662 - DNA, 22 bp, Homo sapiens
ctgaggaggctaatttgaggat

SEQ ID NO: 10663 - DNA, 22 bp, Homo sapiens
agagcgagtctggggctcggat

SEQ ID NO: 10664 - DNA, 22 bp, Homo sapiens
ctcagcactttggaaggctgat

SEQ ID NO: 10665 - DNA, 22 bp, Homo sapiens
tgagcacatgccagcccttctc

SEQ ID NO: 10666 - DNA, 22 bp, Homo sapiens
tccaactttctcctccggcttg

SEQ ID NO: 10667 - DNA, 22 bp, Homo sapiens
gaaaggagagggttaaggagct

SEQ ID NO: 10668 - DNA, 23 bp, Homo sapiens
ggttctgccgcttactgctgtgc

SEQ ID NO: 10669 - DNA, 22 bp, Homo sapiens
tgtaggagtccaatcaggagac

SEQ ID NO: 10670 - DNA, 22 bp, Homo sapiens
cagcagtgtacaaggtgtcaga

SEQ ID NO: 10671 - DNA, 22 bp, Homo sapiens
agtccgtcctgtcaagcagctg

SEQ ID NO: 10672 - DNA, 14 bp, Homo sapiens
gcaggcagatcacc

SEQ ID NO: 10673 - DNA, 22 bp, Homo sapiens
aatcagaccgttctggctgtcc

SEQ ID NO: 10674 - DNA, 22 bp, Homo sapiens
tgacatgtatatcttacgctat

SEQ ID NO: 10675 - DNA, 20 bp, Homo sapiens
gtctccactgggggttaacc

SEQ ID NO: 10676 - DNA, 22 bp, Homo sapiens
ttggaaacgtcaccttttcctt

SEQ ID NO: 10677 - DNA, 22 bp, Homo sapiens
cagtcaccttgaggactcagac

SEQ ID NO: 10678 - DNA, 22 bp, Homo sapiens
tttgattgtcacctaccttgca

SEQ ID NO: 10679 - DNA, 22 bp, Homo sapiens
agacattttcgttggagaggtt

SEQ ID NO: 10680 - DNA, 22 bp, Homo sapiens
ttcccttaaattatggcatcta

SEQ ID NO: 10681 - DNA, 22 bp, Homo sapiens
gggtctcctaatggaggatgac

SEQ ID NO: 10682 - DNA, 20 bp, Homo sapiens
aaaatatgtataactcttct

SEQ ID NO: 10683 - DNA, 22 bp, Homo sapiens
cggtgggattcccagcgacttc

SEQ ID NO: 10684 - DNA, 18 bp, Homo sapiens
gaggatggaaggagatgc

SEQ ID NO: 10685 - DNA, 22 bp, Homo sapiens
aggctagaggcttctggcttca

SEQ ID NO: 10686 - DNA, 22 bp, Homo sapiens
gcatacatgggtgcagggacat

SEQ ID NO: 10687 - DNA, 22 bp, Homo sapiens
acggtgctgggtattggggttc

SEQ ID NO: 10688 - DNA, 22 bp, Homo sapiens
ctggatcatgggaaagggatca

SEQ ID NO: 10689 - DNA, 22 bp, Homo sapiens
cctgacaggcggaggctgcagt

SEQ ID NO: 10690 - DNA, 20 bp, Homo sapiens
tcagccattccttacctttc

SEQ ID NO: 10691 - DNA, 23 bp, Homo sapiens
attttttgtctttgtaactagat

SEQ ID NO: 10692 - DNA, 22 bp, Homo sapiens
gtgctttgtcttcaggatcata

SEQ ID NO: 10693 - DNA, 22 bp, Homo sapiens
gagccagactgcctgaagctca

SEQ ID NO: 10694 - DNA, 22 bp, Homo sapiens
cttgtagaattgaaatggtctc

SEQ ID NO: 10695 - DNA, 22 bp, Homo sapiens
ctgaagcagggagtgatgaagt

SEQ ID NO: 10696 - DNA, 22 bp, Homo sapiens
tgctagtgtgtgagatgttcaa

SEQ ID NO: 10697 - DNA, 22 bp, Homo sapiens
tatctatgtgctctgacctctc

SEQ ID NO: 10698 - DNA, 22 bp, Homo sapiens
ttctcttttcaccagttgctaa

SEQ ID NO: 10699 - DNA, 22 bp, Homo sapiens
gtcaggactctgacccgtcccg

SEQ ID NO: 10700 - DNA, 22 bp, Homo sapiens
cctgagtagctggaattaaagg

SEQ ID NO: 10701 - DNA, 22 bp, Homo sapiens
ccactgtggaaagcagttcaga

SEQ ID NO: 10702 - DNA, 22 bp, Homo sapiens
ctgaggcaggcagatcacttga

SEQ ID NO: 10703 - DNA, 22 bp, Homo sapiens
ggaagaaaggtggacaacaggt

SEQ ID NO: 10704 - DNA, 22 bp, Homo sapiens
tcaccttgtgatccgcccacct

SEQ ID NO: 10705 - DNA, 22 bp, Homo sapiens
agggagcattgtgacatatcac

SEQ ID NO: 10706 - DNA, 22 bp, Homo sapiens
tccacagtggttgaactagtaa

SEQ ID NO: 10707 - DNA, 22 bp, Homo sapiens
gccccgtcgtggggccagggat

SEQ ID NO: 10708 - DNA, 22 bp, Homo sapiens
gcttcggggtccaagcgcgtgt

SEQ ID NO: 10709 - DNA, 22 bp, Homo sapiens
agtccaggcattccagccattc

SEQ ID NO: 10710 - DNA, 22 bp, Homo sapiens
gatgaggcataaacacagtcac

SEQ ID NO: 10711 - DNA, 22 bp, Homo sapiens
gccccagcctcccgagtagctg

SEQ ID NO: 10712 - DNA, 22 bp, Homo sapiens
tgaagactcagaagctaagata

SEQ ID NO: 10713 - DNA, 22 bp, Homo sapiens
tgcgcatgcgtggctctccggc

SEQ ID NO: 10714 - DNA, 22 bp, Homo sapiens
agcccaggagtttgaggctgtg

SEQ ID NO: 10715 - DNA, 22 bp, Homo sapiens
ctctgcctgtctcatcctgcaa

SEQ ID NO: 10716 - DNA, 22 bp, Homo sapiens
gtggagaggaacccagctctgt

SEQ ID NO: 10717 - DNA, 22 bp, Homo sapiens
gcccaggctggagtgcagtggt

SEQ ID NO: 10718 - DNA, 22 bp, Homo sapiens
cttgccttcagtccatcagtca

SEQ ID NO: 10719 - DNA, 22 bp, Homo sapiens
gacaagctcccggtggccctcc

SEQ ID NO: 10720 - DNA, 22 bp, Homo sapiens
tgtgaagaattaatgtgaatca

SEQ ID NO: 10721 - DNA, 22 bp, Homo sapiens
taaagggtaggttttactgtaa

SEQ ID NO: 10722 - DNA, 17 bp, Homo sapiens
gacctttctctagcatt

SEQ ID NO: 10723 - DNA, 22 bp, Homo sapiens
ctagggtgtgcagattttgcct

SEQ ID NO: 10724 - DNA, 18 bp, Homo sapiens
cagctgccagctcatgga

SEQ ID NO: 10725 - DNA, 22 bp, Homo sapiens
tctttcttgtgggtgccctttt

SEQ ID NO: 10726 - DNA, 22 bp, Homo sapiens
aacatgatttcatgcatttaga

SEQ ID NO: 10727 - DNA, 22 bp, Homo sapiens
gcacatgagaagctggcgatgc

SEQ ID NO: 10728 - DNA, 21 bp, Homo sapiens
acacaggcagtgtcccgaggt

SEQ ID NO: 10729 - DNA, 22 bp, Homo sapiens
ttgtgaatagtgccgcaataaa

SEQ ID NO: 10730 - DNA, 22 bp, Homo sapiens
agattctaccagagctagtttg

SEQ ID NO: 10731 - DNA, 22 bp, Homo sapiens
gggtaggcaaagcaatgacgtt

SEQ ID NO: 10732 - DNA, 22 bp, Homo sapiens
cacctgccaaatggggatgctg

SEQ ID NO: 10733 - DNA, 20 bp, Homo sapiens
gagattaactgagaatctag

SEQ ID NO: 10734 - DNA, 22 bp, Homo sapiens
gggtacagttcttccagtgtca

SEQ ID NO: 10735 - DNA, 22 bp, Homo sapiens
cctcggtttccacatctgtaca

SEQ ID NO: 10736 - DNA, 22 bp, Homo sapiens
agttggcactgagctgtgattg

SEQ ID NO: 10737 - DNA, 22 bp, Homo sapiens
ttaagggccattatggatgggt

SEQ ID NO: 10738 - DNA, 22 bp, Homo sapiens
gagaatgtttctgtctgccctt

SEQ ID NO: 10739 - DNA, 22 bp, Homo sapiens
cccagcgagtttgccggtgaac

SEQ ID NO: 10740 - DNA, 22 bp, Homo sapiens
gaccttgtgatccagccacctt

SEQ ID NO: 10741 - DNA, 22 bp, Homo sapiens
tggcactgaagctggaaagcct

SEQ ID NO: 10742 - DNA, 22 bp, Homo sapiens
cactgcactccagcctgggaga

SEQ ID NO: 10743 - DNA, 22 bp, Homo sapiens
caggtgttggaagggcagtggg

SEQ ID NO: 10744 - DNA, 22 bp, Homo sapiens
gcgttggggaccccgaagctgg

SEQ ID NO: 10745 - DNA, 21 bp, Homo sapiens
caatggcgagatcttggctca

SEQ ID NO: 10746 - DNA, 22 bp, Homo sapiens
tgctccagcaccaagagctcca

SEQ ID NO: 10747 - DNA, 22 bp, Homo sapiens
ctgaagaggctccgcccacaag

SEQ ID NO: 10748 - DNA, 22 bp, Homo sapiens
aagccggctgggccgaggctgc

SEQ ID NO: 10749 - DNA, 22 bp, Homo sapiens
gcccatgcactttctgtgatgg

SEQ ID NO: 10750 - DNA, 22 bp, Homo sapiens
taggctgggaagaaagattctc

SEQ ID NO: 10751 - DNA, 22 bp, Homo sapiens
gttgcctaggctggtcttgaac

SEQ ID NO: 10752 - DNA, 22 bp, Homo sapiens
cacgcacgctgggtggaggcgc

SEQ ID NO: 10753 - DNA, 22 bp, Homo sapiens
agtacccttttcactgtcacaa

SEQ ID NO: 10754 - DNA, 22 bp, Homo sapiens
ctggcctggcgcagtggctcac

SEQ ID NO: 10755 - DNA, 22 bp, Homo sapiens
ggtgggagagctctgtctccag

SEQ ID NO: 10756 - DNA, 22 bp, Homo sapiens
accgtgtctgacactttgggcg

SEQ ID NO: 10757 - DNA, 22 bp, Homo sapiens
atacacgtgccatgttggtgtg

SEQ ID NO: 10758 - DNA, 22 bp, Homo sapiens
ttttctgtttgcttcaagacat

SEQ ID NO: 10759 - DNA, 22 bp, Homo sapiens
aggccagcagcatgacggcatc

SEQ ID NO: 10760 - DNA, 22 bp, Homo sapiens
gttctgagtcctcctttgaagg

SEQ ID NO: 10761 - DNA, 22 bp, Homo sapiens
tttgattgcaatagttttatga

SEQ ID NO: 10762 - DNA, 22 bp, Homo sapiens
cttgctttcagtctcggcctca

SEQ ID NO: 10763 - DNA, 20 bp, Homo sapiens
ctgggtggcaagcaaggggg

SEQ ID NO: 10764 - DNA, 22 bp, Homo sapiens
gaccttcttgctgtgtcctaac

SEQ ID NO: 10765 - DNA, 22 bp, Homo sapiens
agggactatttacccatctcac

SEQ ID NO: 10766 - DNA, 22 bp, Homo sapiens
aggggcacgagtagagctctag

SEQ ID NO: 10767 - DNA, 22 bp, Homo sapiens
actgcacttcagcctgggtgac

SEQ ID NO: 10768 - DNA, 22 bp, Homo sapiens
gcccagcgagcagaggtggacg

SEQ ID NO: 10769 - DNA, 23 bp, Homo sapiens
cctgcctccccatcagttataca

SEQ ID NO: 10770 - DNA, 21 bp, Homo sapiens
ggtgctcgctgatgaggagtg

SEQ ID NO: 10771 - DNA, 22 bp, Homo sapiens
tatcacagccttttggtgaggg

SEQ ID NO: 10772 - DNA, 22 bp, Homo sapiens
gctggcagacttcctctggaac

SEQ ID NO: 10773 - DNA, 19 bp, Homo sapiens
taggaccctggtggccccc

SEQ ID NO: 10774 - DNA, 22 bp, Homo sapiens
cttggtgtcatgggtcagcagc

SEQ ID NO: 10775 - DNA, 22 bp, Homo sapiens
ggacagccgagtggccttctcc

SEQ ID NO: 10776 - DNA, 22 bp, Homo sapiens
ttgagcaatgtcactgaggctt

SEQ ID NO: 10777 - DNA, 22 bp, Homo sapiens
tttgtgaataggttggcttcca

SEQ ID NO: 10778 - DNA, 23 bp, Homo sapiens
aagtggttttgaacccggaccct

SEQ ID NO: 10779 - DNA, 22 bp, Homo sapiens
ggagagggtaggggtcctgccc

SEQ ID NO: 10780 - DNA, 23 bp, Homo sapiens
gcgtccggcctctctcgctcccg

SEQ ID NO: 10781 - DNA, 22 bp, Homo sapiens
ctggagcaaaagtgactcctct

SEQ ID NO: 10782 - DNA, 22 bp, Homo sapiens
gctgcagtgagccaagatcgtg

SEQ ID NO: 10783 - DNA, 22 bp, Homo sapiens
ggatgctctgtctcttgctgtt

SEQ ID NO: 10784 - DNA, 22 bp, Homo sapiens
ggtttgacagcttggggctgtc

SEQ ID NO: 10785 - DNA, 22 bp, Homo sapiens
ctggtgggagataattgaatca

SEQ ID NO: 10786 - DNA, 22 bp, Homo sapiens
aggccctattcaatggggccca

SEQ ID NO: 10787 - DNA, 22 bp, Homo sapiens
cttcctttgctgttcggaggtt

SEQ ID NO: 10788 - DNA, 22 bp, Homo sapiens
ttcaatttgtgctaaggcaccg

SEQ ID NO: 10789 - DNA, 22 bp, Homo sapiens
agtgaatgtccccgcgggtcag

SEQ ID NO: 10790 - DNA, 22 bp, Homo sapiens
aagtcacttcttaggaaaggag

SEQ ID NO: 10791 - DNA, 22 bp, Homo sapiens
cactgcaccctcaaactcctgg

SEQ ID NO: 10792 - DNA, 22 bp, Homo sapiens
tgtcctcatcctccagtctgtc

SEQ ID NO: 10793 - DNA, 22 bp, Homo sapiens
aggcactgtgcagtcccaagca

SEQ ID NO: 10794 - DNA, 22 bp, Homo sapiens
ttttttgttgggtagaacggaa

SEQ ID NO: 10795 - DNA, 22 bp, Homo sapiens
gcacatgcatgcatattcctgg

SEQ ID NO: 10796 - DNA, 22 bp, Homo sapiens
tcttgccgcgcaggcgcagttc

SEQ ID NO: 10797 - DNA, 22 bp, Homo sapiens
ctccaccccgtgccggtgctgg

SEQ ID NO: 10798 - DNA, 22 bp, Homo sapiens
tattgggtaaagatccagtttt

SEQ ID NO: 10799 - DNA, 22 bp, Homo sapiens
tgatttatgcattatactgttg

SEQ ID NO: 10800 - DNA, 22 bp, Homo sapiens
tccttaggcaatttgggagagt

SEQ ID NO: 10801 - DNA, 22 bp, Homo sapiens
ataatacatggttgatcttttc

SEQ ID NO: 10802 - DNA, 22 bp, Homo sapiens
agctcaatgcaacctccgcctc

SEQ ID NO: 10803 - DNA, 22 bp, Homo sapiens
caggaggttgagggtgcagtga

SEQ ID NO: 10804 - DNA, 22 bp, Homo sapiens
gaataatcatgaaattcagtga

SEQ ID NO: 10805 - DNA, 22 bp, Homo sapiens
gagtcggaggcaggagacctgg

SEQ ID NO: 10806 - DNA, 22 bp, Homo sapiens
aactctatttaccctactaaac

SEQ ID NO: 10807 - DNA, 22 bp, Homo sapiens
cagagagaatcttggcagctga

SEQ ID NO: 10808 - DNA, 22 bp, Homo sapiens
cacagagatggtctggcaggtg

SEQ ID NO: 10809 - DNA, 22 bp, Homo sapiens
tggtatgaccgtggtgcaagca

SEQ ID NO: 10810 - DNA, 22 bp, Homo sapiens
gaggccaactttggagaacagg

SEQ ID NO: 10811 - DNA, 22 bp, Homo sapiens
tcacagctcactgtagcctcga

SEQ ID NO: 10812 - DNA, 22 bp, Homo sapiens
atattacacacggtatcacggg

SEQ ID NO: 10813 - DNA, 22 bp, Homo sapiens
gtgttgatgacattttagaaac

SEQ ID NO: 10814 - DNA, 22 bp, Homo sapiens
ggcggaggttgcagtaagccga

SEQ ID NO: 10815 - DNA, 22 bp, Homo sapiens
aggagctgtcagagtgccagag

SEQ ID NO: 10816 - DNA, 22 bp, Homo sapiens
cgatggtatcggccagccccgg

SEQ ID NO: 10817 - DNA, 22 bp, Homo sapiens
actcaagtcataggcttctttc

SEQ ID NO: 10818 - DNA, 21 bp, Homo sapiens
cagggccaatcctgacctcta

SEQ ID NO: 10819 - DNA, 22 bp, Homo sapiens
agcagcttgaggctggattcca

SEQ ID NO: 10820 - DNA, 22 bp, Homo sapiens
gtgctggggagataggaagaga

SEQ ID NO: 10821 - DNA, 22 bp, Homo sapiens
ctgatcctcctttaagtagctg

SEQ ID NO: 10822 - DNA, 22 bp, Homo sapiens
tggaggctggagtgcagtggcg

SEQ ID NO: 10823 - DNA, 22 bp, Homo sapiens
tgaggcaggagttcaggctgcg

SEQ ID NO: 10824 - DNA, 20 bp, Homo sapiens
ctgccgaccacagccatgga

SEQ ID NO: 10825 - DNA, 22 bp, Homo sapiens
tgcgggagggcaacgcggcatt

SEQ ID NO: 10826 - DNA, 21 bp, Homo sapiens
gcagcagtgttctagaatact

SEQ ID NO: 10827 - DNA, 22 bp, Homo sapiens
gctcgcgccgcaccggtccacc

SEQ ID NO: 10828 - DNA, 22 bp, Homo sapiens
aaggggtgcaagttaatcagca

SEQ ID NO: 10829 - DNA, 22 bp, Homo sapiens
ctggcagatagtaagtgatcaa

SEQ ID NO: 10830 - DNA, 22 bp, Homo sapiens
gcagactgtatcaatgtcagta

SEQ ID NO: 10831 - DNA, 22 bp, Homo sapiens
tttctcatggaacatcgtttag

SEQ ID NO: 10832 - DNA, 22 bp, Homo sapiens
tcaggaggcggaggttgcagtg

SEQ ID NO: 10833 - DNA, 22 bp, Homo sapiens
gtagcagagggcccaggtaact

SEQ ID NO: 10834 - DNA, 22 bp, Homo sapiens
tgagatgagggctgcactcaaa

SEQ ID NO: 10835 - DNA, 22 bp, Homo sapiens
gggcggggtggctcatgcctgt

SEQ ID NO: 10836 - DNA, 22 bp, Homo sapiens
tcctggcaaagatgttggtgtt

SEQ ID NO: 10837 - DNA, 22 bp, Homo sapiens
gggacgacaggctctgtggtag

SEQ ID NO: 10838 - DNA, 22 bp, Homo sapiens
agttggcttcaaaggcagagag

SEQ ID NO: 10839 - DNA, 23 bp, Homo sapiens
atgacactcctgtgcgcaccctg

SEQ ID NO: 10840 - DNA, 22 bp, Homo sapiens
tcagcctggcaggatggcctgg

SEQ ID NO: 10841 - DNA, 18 bp, Homo sapiens
gaccccgggatctgtcga

SEQ ID NO: 10842 - DNA, 22 bp, Homo sapiens
ggcgtttcaccatgttgaccag

SEQ ID NO: 10843 - DNA, 22 bp, Homo sapiens
aattttctggtgtgtaatgaag

SEQ ID NO: 10844 - DNA, 20 bp, Homo sapiens
aagacaccagtggcagcccc

SEQ ID NO: 10845 - DNA, 22 bp, Homo sapiens
gctgtctcatacaaggccctgc

SEQ ID NO: 10846 - DNA, 22 bp, Homo sapiens
ttcagagaattggataattcgt

SEQ ID NO: 10847 - DNA, 22 bp, Homo sapiens
atgccaataaatgttaatatct

SEQ ID NO: 10848 - DNA, 22 bp, Homo sapiens
caatccatcaattacacaggct

SEQ ID NO: 10849 - DNA, 21 bp, Homo sapiens
tagcccttctccacctcgccc

SEQ ID NO: 10850 - DNA, 22 bp, Homo sapiens
tgttgattagtgtttagactta

SEQ ID NO: 10851 - DNA, 22 bp, Homo sapiens
cccggacagaggggcagagtgt

SEQ ID NO: 10852 - DNA, 22 bp, Homo sapiens
acagcagcaatagcagtgacat

SEQ ID NO: 10853 - DNA, 22 bp, Homo sapiens
cggggaagcggttctggcggta

SEQ ID NO: 10854 - DNA, 22 bp, Homo sapiens
ccgcgccacccattcccactga

SEQ ID NO: 10855 - DNA, 22 bp, Homo sapiens
gttgaaatcctaaccccctagt

SEQ ID NO: 10856 - DNA, 22 bp, Homo sapiens
gagccaggggtcagctccgagg

SEQ ID NO: 10857 - DNA, 22 bp, Homo sapiens
agagtgtaccaaatatcctaca

SEQ ID NO: 10858 - DNA, 22 bp, Homo sapiens
gtcctggggattatagagtgtt

SEQ ID NO: 10859 - DNA, 22 bp, Homo sapiens
tgctcgaggtccccaccggctc

SEQ ID NO: 10860 - DNA, 19 bp, Homo sapiens
atcccaaggagctgggact

SEQ ID NO: 10861 - DNA, 22 bp, Homo sapiens
gtagaggtagacttccttgtct

SEQ ID NO: 10862 - DNA, 22 bp, Homo sapiens
ccaggaggcggaggttgcagcg

SEQ ID NO: 10863 - DNA, 22 bp, Homo sapiens
tgcccaggctggagtgcagtgg

SEQ ID NO: 10864 - DNA, 22 bp, Homo sapiens
ttcctcaggctgctttcacata

SEQ ID NO: 10865 - DNA, 22 bp, Homo sapiens
ggtgccaggctgtagtcagggt

SEQ ID NO: 10866 - DNA, 22 bp, Homo sapiens
caaagtgctaggattacaggcg

SEQ ID NO: 10867 - DNA, 22 bp, Homo sapiens
aggctctcaccctctgaccaga

SEQ ID NO: 10868 - DNA, 22 bp, Homo sapiens
tgaacatgctgttgatggcctg

SEQ ID NO: 10869 - DNA, 22 bp, Homo sapiens
tgtcttcagcagtcatctgggg

SEQ ID NO: 10870 - DNA, 22 bp, Homo sapiens
gtgtttgttcgtgactccaaag

SEQ ID NO: 10871 - DNA, 22 bp, Homo sapiens
tcccacaggtggagcttgcagt

SEQ ID NO: 10872 - DNA, 22 bp, Homo sapiens
ctgcttctagcaccaagtccct

SEQ ID NO: 10873 - DNA, 22 bp, Homo sapiens
ttttcctttgattcccagatgt

SEQ ID NO: 10874 - DNA, 22 bp, Homo sapiens
attttctatgttgtaattgtta

SEQ ID NO: 10875 - DNA, 17 bp, Homo sapiens
aggaggccctggcgttt

SEQ ID NO: 10876 - DNA, 22 bp, Homo sapiens
atgtatacgtgcaagtcacagg

SEQ ID NO: 10877 - DNA, 22 bp, Homo sapiens
gagatatgttggcagctggtat

SEQ ID NO: 10878 - DNA, 22 bp, Homo sapiens
aagaggtagcagtcacaaaaga

SEQ ID NO: 10879 - DNA, 22 bp, Homo sapiens
gtttcgtcaggcttattctatc

SEQ ID NO: 10880 - DNA, 22 bp, Homo sapiens
ccaccagctgcatatgcacgta

SEQ ID NO: 10881 - DNA, 22 bp, Homo sapiens
gttggacagtttgggaagggag

SEQ ID NO: 10882 - DNA, 22 bp, Homo sapiens
tctgacattagattaattggaa

SEQ ID NO: 10883 - DNA, 22 bp, Homo sapiens
ctgggggcagcaagaagccatg

SEQ ID NO: 10884 - DNA, 19 bp, Homo sapiens
agaatcccaggccccactg

SEQ ID NO: 10885 - DNA, 22 bp, Homo sapiens
aaaatcttgtgacttaggaagg

SEQ ID NO: 10886 - DNA, 22 bp, Homo sapiens
gcctccggagtcacagtgtctt

SEQ ID NO: 10887 - DNA, 22 bp, Homo sapiens
ggggctgaacctggaggtggtc

SEQ ID NO: 10888 - DNA, 22 bp, Homo sapiens
tcttagaaattccccagtggct

SEQ ID NO: 10889 - DNA, 22 bp, Homo sapiens
tgctccatgcgctcggccggcg

SEQ ID NO: 10890 - DNA, 22 bp, Homo sapiens
gtttctctgtctgttacattgg

SEQ ID NO: 10891 - DNA, 19 bp, Homo sapiens
cgcctggcaggccctgcgc

SEQ ID NO: 10892 - DNA, 22 bp, Homo sapiens
aaggagcgcttagggggcagaa

SEQ ID NO: 10893 - DNA, 22 bp, Homo sapiens
tccaccatgtaacaagctctgt

SEQ ID NO: 10894 - DNA, 22 bp, Homo sapiens
ggctcactgcaagctccgcctc

SEQ ID NO: 10895 - DNA, 22 bp, Homo sapiens
acccgatgttggtgctctagta

SEQ ID NO: 10896 - DNA, 22 bp, Homo sapiens
gtgtcaggccctgcattatgtg

SEQ ID NO: 10897 - DNA, 22 bp, Homo sapiens
ggccagaagttggaaaagagcc

SEQ ID NO: 10898 - DNA, 22 bp, Homo sapiens
tctgtgagaaccagtgccaggg

SEQ ID NO: 10899 - DNA, 22 bp, Homo sapiens
tcctgggatcaagtgatcctcc

SEQ ID NO: 10900 - DNA, 22 bp, Homo sapiens
ctaaagtgccaggaatacaggt

SEQ ID NO: 10901 - DNA, 22 bp, Homo sapiens
tgaccacattgatttctcatcc

SEQ ID NO: 10902 - DNA, 22 bp, Homo sapiens
tcgcccaggctggaagtgcagt

SEQ ID NO: 10903 - DNA, 22 bp, Homo sapiens
ttaaactgcttgaattgggttt

SEQ ID NO: 10904 - DNA, 22 bp, Homo sapiens
gaagccttgaactgcaaacccc

SEQ ID NO: 10905 - DNA, 22 bp, Homo sapiens
ctccagttggccccagttggtt

SEQ ID NO: 10906 - DNA, 22 bp, Homo sapiens
ataaagctattcctctcttttt

SEQ ID NO: 10907 - DNA, 22 bp, Homo sapiens
actcaagtggccttgatggctt

SEQ ID NO: 10908 - DNA, 21 bp, Homo sapiens
gaacccagcagcagtgctctg

SEQ ID NO: 10909 - DNA, 20 bp, Homo sapiens
gaaatgtacacattaccaca

SEQ ID NO: 10910 - DNA, 22 bp, Homo sapiens
cctcaagtcattccggagacct

SEQ ID NO: 10911 - DNA, 22 bp, Homo sapiens
tggtacacatgtccaaggtcag

SEQ ID NO: 10912 - DNA, 22 bp, Homo sapiens
gctaagggataggctgcctcct

SEQ ID NO: 10913 - DNA, 22 bp, Homo sapiens
gtcttagatttcaccgataatg

SEQ ID NO: 10914 - DNA, 22 bp, Homo sapiens
ttggtggacctcatcagaaccg

SEQ ID NO: 10915 - DNA, 22 bp, Homo sapiens
tcttcacgccaagtgcccctca

SEQ ID NO: 10916 - DNA, 22 bp, Homo sapiens
cccattcatcctcgcttccttc

SEQ ID NO: 10917 - DNA, 22 bp, Homo sapiens
cagatcaaacaaaatgggttag

SEQ ID NO: 10918 - DNA, 22 bp, Homo sapiens
cactaggctggagtgcagtggc

SEQ ID NO: 10919 - DNA, 22 bp, Homo sapiens
cagtggctggttagggacagga

SEQ ID NO: 10920 - DNA, 22 bp, Homo sapiens
tgcaatctcggcactttgggag

SEQ ID NO: 10921 - DNA, 17 bp, Homo sapiens
ccctcactcctgccggg

SEQ ID NO: 10922 - DNA, 21 bp, Homo sapiens
gcccacagtgaggaggatccc

SEQ ID NO: 10923 - DNA, 22 bp, Homo sapiens
gcccagtagttcaaggttgcag

SEQ ID NO: 10924 - DNA, 22 bp, Homo sapiens
caagaatcaacattatttagtg

SEQ ID NO: 10925 - DNA, 22 bp, Homo sapiens
gcttggccagcagccgggatgc

SEQ ID NO: 10926 - DNA, 22 bp, Homo sapiens
acaattctgatggtttcccagt

SEQ ID NO: 10927 - DNA, 22 bp, Homo sapiens
gaacactgctgttgggttctga

SEQ ID NO: 10928 - DNA, 22 bp, Homo sapiens
aacttgatcctgctgggtacta

SEQ ID NO: 10929 - DNA, 22 bp, Homo sapiens
aggaaataagggacaagacaaa

SEQ ID NO: 10930 - DNA, 22 bp, Homo sapiens
gtctgaatacgtacttgtgaag

SEQ ID NO: 10931 - DNA, 22 bp, Homo sapiens
tacactgtttgaactgtggtcg

SEQ ID NO: 10932 - DNA, 19 bp, Homo sapiens
tccaaagaagttcacattt

SEQ ID NO: 10933 - DNA, 22 bp, Homo sapiens
tttattctgtgctacatgaaga

SEQ ID NO: 10934 - DNA, 22 bp, Homo sapiens
tgaagaaacgcagagaggtagg

SEQ ID NO: 10935 - DNA, 22 bp, Homo sapiens
ggctcagatggtttgttctaga

SEQ ID NO: 10936 - DNA, 22 bp, Homo sapiens
agctcaagctacacacagagtc

SEQ ID NO: 10937 - DNA, 22 bp, Homo sapiens
tctgcaggtaagcgttcttgga

SEQ ID NO: 10938 - DNA, 22 bp, Homo sapiens
cttgtcagccaattgtggattt

SEQ ID NO: 10939 - DNA, 22 bp, Homo sapiens
attgtaacagacacatcagatt

SEQ ID NO: 10940 - DNA, 22 bp, Homo sapiens
gcagaagcacaggtgacgggcc

SEQ ID NO: 10941 - DNA, 22 bp, Homo sapiens
atcatcatgcccacttgagact

SEQ ID NO: 10942 - DNA, 22 bp, Homo sapiens
ggccaattccaggagccggcgg

SEQ ID NO: 10943 - DNA, 22 bp, Homo sapiens
ccacagtcctggcttctgtctg

SEQ ID NO: 10944 - DNA, 22 bp, Homo sapiens
tctgctttcttactaaaaatga

SEQ ID NO: 10945 - DNA, 22 bp, Homo sapiens
gaccttgtgatccccctgcctt

SEQ ID NO: 10946 - DNA, 22 bp, Homo sapiens
cgccgtaaatgcaagcctgtag

SEQ ID NO: 10947 - DNA, 18 bp, Homo sapiens
tcatgagaatagcagggg

SEQ ID NO: 10948 - DNA, 17 bp, Homo sapiens
gagcccctttccaagtt

SEQ ID NO: 10949 - DNA, 19 bp, Homo sapiens
ccctcttgcacaaagcaaa

SEQ ID NO: 10950 - DNA, 22 bp, Homo sapiens
ctctcgccagcggggctgcgct

SEQ ID NO: 10951 - DNA, 22 bp, Homo sapiens
tgggggtgtcctggtgcacaca

SEQ ID NO: 10952 - DNA, 22 bp, Homo sapiens
agagcggggatagttaatattc

SEQ ID NO: 10953 - DNA, 23 bp, Homo sapiens
acagtcgtaggtatccttttcct

SEQ ID NO: 10954 - DNA, 22 bp, Homo sapiens
accctactaaatgtggtatgtc

SEQ ID NO: 10955 - DNA, 22 bp, Homo sapiens
tgtgaccctctccgatgggcag

SEQ ID NO: 10956 - DNA, 17 bp, Homo sapiens
tgtatttatcatgtcag

SEQ ID NO: 10957 - DNA, 22 bp, Homo sapiens
gcaggatgagtgagtacattta

SEQ ID NO: 10958 - DNA, 22 bp, Homo sapiens
atcatcctagaaggaagctagg

SEQ ID NO: 10959 - DNA, 22 bp, Homo sapiens
tgtgtgattgcaggagatgtgg

SEQ ID NO: 10960 - DNA, 22 bp, Homo sapiens
cctcccctcagacagagactgg

SEQ ID NO: 10961 - DNA, 22 bp, Homo sapiens
gaggagctgcccgtgtgtctgc

SEQ ID NO: 10962 - DNA, 22 bp, Homo sapiens
gggttaaagagcccaatgtatg

SEQ ID NO: 10963 - DNA, 22 bp, Homo sapiens
aacagctttgtatacagtaact

SEQ ID NO: 10964 - DNA, 22 bp, Homo sapiens
ggagtgagagagtttaaggtca

SEQ ID NO: 10965 - DNA, 22 bp, Homo sapiens
gttccaggtggtcacagagctc

SEQ ID NO: 10966 - DNA, 22 bp, Homo sapiens
tatcactacacctggctaatta

SEQ ID NO: 10967 - DNA, 22 bp, Homo sapiens
cctggaagttggaggttgcagt

SEQ ID NO: 10968 - DNA, 22 bp, Homo sapiens
gcttggcccattgatcagctgg

SEQ ID NO: 10969 - DNA, 22 bp, Homo sapiens
gcagcctcaaactccccagctc

SEQ ID NO: 10970 - DNA, 22 bp, Homo sapiens
gattccacagcttcgaggtctt

SEQ ID NO: 10971 - DNA, 22 bp, Homo sapiens
taggaatggtgctcagcagaaa

SEQ ID NO: 10972 - DNA, 22 bp, Homo sapiens
actagaaagaagttttttgaga

SEQ ID NO: 10973 - DNA, 20 bp, Homo sapiens
tgctggaaattgttctagga

SEQ ID NO: 10974 - DNA, 22 bp, Homo sapiens
acaccatactcatgttggttcc

SEQ ID NO: 10975 - DNA, 22 bp, Homo sapiens
tgcctgtgtcagcaggtggaag

SEQ ID NO: 10976 - DNA, 22 bp, Homo sapiens
tttttagtagaggtgggtttca

SEQ ID NO: 10977 - DNA, 22 bp, Homo sapiens
gagaaatgcatgcatgtcatca

SEQ ID NO: 10978 - DNA, 22 bp, Homo sapiens
gctttatccgcttgacccttac

SEQ ID NO: 10979 - DNA, 22 bp, Homo sapiens
tgggcaggggccctgcttccgt

SEQ ID NO: 10980 - DNA, 23 bp, Homo sapiens
agagcaaggaaatgaggtgtgat

SEQ ID NO: 10981 - DNA, 22 bp, Homo sapiens
atatacacatctttttaaatat

SEQ ID NO: 10982 - DNA, 22 bp, Homo sapiens
gaggagggagctggaagctctt

SEQ ID NO: 10983 - DNA, 22 bp, Homo sapiens
agtccgcctgctgccgtggcag

SEQ ID NO: 10984 - DNA, 22 bp, Homo sapiens
agatgctgctccacaggccagg

SEQ ID NO: 10985 - DNA, 22 bp, Homo sapiens
atagaatatgacttttagatcc

SEQ ID NO: 10986 - DNA, 22 bp, Homo sapiens
tcccattgcccaggtagtgtac

SEQ ID NO: 10987 - DNA, 22 bp, Homo sapiens
tgtacacatggtgtacactccc

SEQ ID NO: 10988 - DNA, 22 bp, Homo sapiens
agttcagaggcaggagaaggct

SEQ ID NO: 10989 - DNA, 22 bp, Homo sapiens
tgtctcctcggctgtccagcca

SEQ ID NO: 10990 - DNA, 22 bp, Homo sapiens
acccatccagtgtccctgctag

SEQ ID NO: 10991 - DNA, 22 bp, Homo sapiens
ataaaagatcccttctgagctc

SEQ ID NO: 10992 - DNA, 22 bp, Homo sapiens
cgcgctgcagacagcggaggcc

SEQ ID NO: 10993 - DNA, 22 bp, Homo sapiens
gaagcctcaacatctctgcgtc

SEQ ID NO: 10994 - DNA, 22 bp, Homo sapiens
ccacccttgggttcggaggccg

SEQ ID NO: 10995 - DNA, 22 bp, Homo sapiens
ggcctgtggtgcgctatttcag

SEQ ID NO: 10996 - DNA, 22 bp, Homo sapiens
aacccaggaggcagatgttgtg

SEQ ID NO: 10997 - DNA, 22 bp, Homo sapiens
gcctgtgtctgggtggccagag

SEQ ID NO: 10998 - DNA, 22 bp, Homo sapiens
accctcaagatggaagcagttt

SEQ ID NO: 10999 - DNA, 22 bp, Homo sapiens
agtgactggtgtgaagttaaat

SEQ ID NO: 11000 - DNA, 22 bp, Homo sapiens
cccacgtcgaacttgctccaga

SEQ ID NO: 11001 - DNA, 22 bp, Homo sapiens
tctatgcttgagacagatgggg

SEQ ID NO: 11002 - DNA, 22 bp, Homo sapiens
tgaacgcaggtccacatggctc

SEQ ID NO: 11003 - DNA, 22 bp, Homo sapiens
ctgtaatcccagctacctggga

SEQ ID NO: 11004 - DNA, 22 bp, Homo sapiens
ggaggagcatgagagggtagtg

SEQ ID NO: 11005 - DNA, 22 bp, Homo sapiens
gaatgacgccctgtggtcactt

SEQ ID NO: 11006 - DNA, 22 bp, Homo sapiens
aggcgcctgcgggatccttgcc

SEQ ID NO: 11007 - DNA, 21 bp, Homo sapiens
gttcaaatcctgacactacac

SEQ ID NO: 11008 - DNA, 22 bp, Homo sapiens
aataaaatggtcagttttctca

SEQ ID NO: 11009 - DNA, 22 bp, Homo sapiens
ttctcttacattttctcagcct

SEQ ID NO: 11010 - DNA, 22 bp, Homo sapiens
ttgggctcaggagtttgagacc

SEQ ID NO: 11011 - DNA, 22 bp, Homo sapiens
ggtgacggggcccaggtttcct

SEQ ID NO: 11012 - DNA, 22 bp, Homo sapiens
gtggagacctcctaggatgtgt

SEQ ID NO: 11013 - DNA, 22 bp, Homo sapiens
gagggccctggctggctccagc

SEQ ID NO: 11014 - DNA, 22 bp, Homo sapiens
tgtcagtgtctatgaagaattt

SEQ ID NO: 11015 - DNA, 22 bp, Homo sapiens
ggggaccctcaggactgcgtct

SEQ ID NO: 11016 - DNA, 22 bp, Homo sapiens
ggctttctgtctgcgtctgtgt

SEQ ID NO: 11017 - DNA, 22 bp, Homo sapiens
atgtgagtgctatgatagacag

SEQ ID NO: 11018 - DNA, 22 bp, Homo sapiens
gtgcgggcctgggggtttctct

SEQ ID NO: 11019 - DNA, 19 bp, Homo sapiens
cccaggaagcggaggttgc

SEQ ID NO: 11020 - DNA, 22 bp, Homo sapiens
cagaggctggcggccgccccga

SEQ ID NO: 11021 - DNA, 22 bp, Homo sapiens
tcactgcgcttcagcctgggtg

SEQ ID NO: 11022 - DNA, 22 bp, Homo sapiens
acaagcatgggctttgacatca

SEQ ID NO: 11023 - DNA, 22 bp, Homo sapiens
cacagacagtgtccctttgttg

SEQ ID NO: 11024 - DNA, 22 bp, Homo sapiens
tgggcggactcgggcatggaat

SEQ ID NO: 11025 - DNA, 22 bp, Homo sapiens
tctgcgcgctgctggtaccgaa

SEQ ID NO: 11026 - DNA, 22 bp, Homo sapiens
acagagcaataacagggagagg

SEQ ID NO: 11027 - DNA, 22 bp, Homo sapiens
ggcaatagttgtgggttcttta

SEQ ID NO: 11028 - DNA, 22 bp, Homo sapiens
cccaggaggtggagttcacagt

SEQ ID NO: 11029 - DNA, 22 bp, Homo sapiens
gctggaggatggactggaagaa

SEQ ID NO: 11030 - DNA, 23 bp, Homo sapiens
tcaagtaatactcccatcttggc

SEQ ID NO: 11031 - DNA, 22 bp, Homo sapiens
ggcaagagggcagatggagtgc

SEQ ID NO: 11032 - DNA, 22 bp, Homo sapiens
acccgccgcacgtccaggctga

SEQ ID NO: 11033 - DNA, 22 bp, Homo sapiens
tgatgggaggtgctgcaggacc

SEQ ID NO: 11034 - DNA, 22 bp, Homo sapiens
aggaggaagggaagacaagtaa

SEQ ID NO: 11035 - DNA, 23 bp, Homo sapiens
aggtaggttattgctgctacctg

SEQ ID NO: 11036 - DNA, 22 bp, Homo sapiens
gggacttaatgcagagagggac

SEQ ID NO: 11037 - DNA, 22 bp, Homo sapiens
ctgggggtcttgaaagggagag

SEQ ID NO: 11038 - DNA, 22 bp, Homo sapiens
aggtcaagagtaaatttgggta

SEQ ID NO: 11039 - DNA, 22 bp, Homo sapiens
cctctgtgtctccaagaggcct

SEQ ID NO: 11040 - DNA, 22 bp, Homo sapiens
gtggggtagatctttctcagga

SEQ ID NO: 11041 - DNA, 22 bp, Homo sapiens
aagcctggcacattggagtctg

SEQ ID NO: 11042 - DNA, 22 bp, Homo sapiens
agacggctggcagtgagcggct

SEQ ID NO: 11043 - DNA, 22 bp, Homo sapiens
tttgttttcaatgtgtcattca

SEQ ID NO: 11044 - DNA, 22 bp, Homo sapiens
gctgtgtccaggtgggggtgac

SEQ ID NO: 11045 - DNA, 21 bp, Homo sapiens
aaactgaccttgcctgagaca

SEQ ID NO: 11046 - DNA, 22 bp, Homo sapiens
cactgcagcctcaaattcctgg

SEQ ID NO: 11047 - DNA, 22 bp, Homo sapiens
tgagtagagaattcagctaagg

SEQ ID NO: 11048 - DNA, 22 bp, Homo sapiens
cagtgcacgggccagtcctgcc

SEQ ID NO: 11049 - DNA, 22 bp, Homo sapiens
gagaaatatggctcagttccac

SEQ ID NO: 11050 - DNA, 21 bp, Homo sapiens
tgctgggtttgcccatcaggc

SEQ ID NO: 11051 - DNA, 22 bp, Homo sapiens
ttcatagtgtttccttccagtg

SEQ ID NO: 11052 - DNA, 22 bp, Homo sapiens
ttgctctgactggagtgcagtg

SEQ ID NO: 11053 - DNA, 22 bp, Homo sapiens
cagagactggagtgcagtggcg

SEQ ID NO: 11054 - DNA, 23 bp, Homo sapiens
ctgagcaaagggggaagctgctt

SEQ ID NO: 11055 - DNA, 22 bp, Homo sapiens
ctggctggagtgcaggtgagtg

SEQ ID NO: 11056 - DNA, 22 bp, Homo sapiens
ttgtgtgtactggttatgggca

SEQ ID NO: 11057 - DNA, 22 bp, Homo sapiens
tggagggcatgctgtccatggg

SEQ ID NO: 11058 - DNA, 21 bp, Homo sapiens
taaacataaccttgtatggct

SEQ ID NO: 11059 - DNA, 22 bp, Homo sapiens
tctgacattttgagaatgacat

SEQ ID NO: 11060 - DNA, 22 bp, Homo sapiens
tggaggcgagagcgcgcgggct

SEQ ID NO: 11061 - DNA, 22 bp, Homo sapiens
ttattaggaactcaggattttt

SEQ ID NO: 11062 - DNA, 22 bp, Homo sapiens
gtgagccgagtatagttcatag

SEQ ID NO: 11063 - DNA, 22 bp, Homo sapiens
tgatatgcatgtaagggagaca

SEQ ID NO: 11064 - DNA, 22 bp, Homo sapiens
aggggaatgggtagactgttga

SEQ ID NO: 11065 - DNA, 22 bp, Homo sapiens
tggacaggcaagcaagacatac

SEQ ID NO: 11066 - DNA, 21 bp, Homo sapiens
tgactgaggcttcttcacaca

SEQ ID NO: 11067 - DNA, 22 bp, Homo sapiens
gactgtgacttctgaagcaata

SEQ ID NO: 11068 - DNA, 22 bp, Homo sapiens
aggtggagaagagatgggcagt

SEQ ID NO: 11069 - DNA, 22 bp, Homo sapiens
ctgctttgcatagctgccagag

SEQ ID NO: 11070 - DNA, 22 bp, Homo sapiens
atacagggacatccagtttttc

SEQ ID NO: 11071 - DNA, 23 bp, Homo sapiens
aaactacaacgccaggcactgag

SEQ ID NO: 11072 - DNA, 22 bp, Homo sapiens
gcgccccatctacagtactttt

SEQ ID NO: 11073 - DNA, 22 bp, Homo sapiens
ggggtgtggacggctgtgccag

SEQ ID NO: 11074 - DNA, 22 bp, Homo sapiens
taatggtgtttttctgtaattt

SEQ ID NO: 11075 - DNA, 22 bp, Homo sapiens
cactgcaacctccacctcctgg

SEQ ID NO: 11076 - DNA, 22 bp, Homo sapiens
agctcattgcaacctccgcctc

SEQ ID NO: 11077 - DNA, 22 bp, Homo sapiens
cagggtttcaccatgttagcag

SEQ ID NO: 11078 - DNA, 20 bp, Homo sapiens
ggtcactgtggctgcaggat

SEQ ID NO: 11079 - DNA, 22 bp, Homo sapiens
tttgagaagcatggctgtattc

SEQ ID NO: 11080 - DNA, 22 bp, Homo sapiens
atctacaagaggttctcctctc

SEQ ID NO: 11081 - DNA, 22 bp, Homo sapiens
ttgaggtccccagtacccactg

SEQ ID NO: 11082 - DNA, 22 bp, Homo sapiens
attaaagctatccagtcatgaa

SEQ ID NO: 11083 - DNA, 22 bp, Homo sapiens
gccatgggcaaatgcagagctg

SEQ ID NO: 11084 - DNA, 22 bp, Homo sapiens
atacaaaatatatactggagac

SEQ ID NO: 11085 - DNA, 22 bp, Homo sapiens
aggagcagaccgtagtcctgca

SEQ ID NO: 11086 - DNA, 22 bp, Homo sapiens
cagccccacacggtctagctct

SEQ ID NO: 11087 - DNA, 18 bp, Homo sapiens
ctgtacttcagcctgggt

SEQ ID NO: 11088 - DNA, 22 bp, Homo sapiens
aagacactcattatcactggtt

SEQ ID NO: 11089 - DNA, 22 bp, Homo sapiens
tattgtccaataggatgttcct

SEQ ID NO: 11090 - DNA, 19 bp, Homo sapiens
tggctctgtcgaaggcaca

SEQ ID NO: 11091 - DNA, 22 bp, Homo sapiens
tgtccagctcgagacactatct

SEQ ID NO: 11092 - DNA, 22 bp, Homo sapiens
ttgtaacaggtactaaataact

SEQ ID NO: 11093 - DNA, 22 bp, Homo sapiens
agaatccctggggagctgcagc

SEQ ID NO: 11094 - DNA, 23 bp, Homo sapiens
gggtccagccaattccaaggaaa

SEQ ID NO: 11095 - DNA, 22 bp, Homo sapiens
tcactgcaacctccacctcccg

SEQ ID NO: 11096 - DNA, 21 bp, Homo sapiens
tggcggggacttgtggctgcc

SEQ ID NO: 11097 - DNA, 22 bp, Homo sapiens
tatcttaaaaatcgaagcagat

SEQ ID NO: 11098 - DNA, 22 bp, Homo sapiens
gatgcactgcagtatatactgt

SEQ ID NO: 11099 - DNA, 22 bp, Homo sapiens
tctgagaaatttctttgtgatg

SEQ ID NO: 11100 - DNA, 22 bp, Homo sapiens
tgcactactgtgatacacagcc

SEQ ID NO: 11101 - DNA, 22 bp, Homo sapiens
gatataggttcatagtgttaca

SEQ ID NO: 11102 - DNA, 22 bp, Homo sapiens
tataccatgtgtgcacactccc

SEQ ID NO: 11103 - DNA, 22 bp, Homo sapiens
cctcagctcccatgagatctgc

SEQ ID NO: 11104 - DNA, 22 bp, Homo sapiens
agcagcagtatccttccccggc

SEQ ID NO: 11105 - DNA, 22 bp, Homo sapiens
acatggcaaaaccccgtttcta

SEQ ID NO: 11106 - DNA, 22 bp, Homo sapiens
ggggcaggagcccttcttcagc

SEQ ID NO: 11107 - DNA, 22 bp, Homo sapiens
gagcaggaaggccagaagggtc

SEQ ID NO: 11108 - DNA, 22 bp, Homo sapiens
ttgcatttggttctgcctggta

SEQ ID NO: 11109 - DNA, 22 bp, Homo sapiens
tgtggcacatacacaggagggc

SEQ ID NO: 11110 - DNA, 22 bp, Homo sapiens
aagcactttatgtcaatgtcct

SEQ ID NO: 11111 - DNA, 22 bp, Homo sapiens
ctgaagagaaagggagctcttc

SEQ ID NO: 11112 - DNA, 22 bp, Homo sapiens
tgtgcattaactccacaagcag

SEQ ID NO: 11113 - DNA, 22 bp, Homo sapiens
gtcaccagtgctaagaggtgga

SEQ ID NO: 11114 - DNA, 22 bp, Homo sapiens
tccagctgaggtggcctctgtg

SEQ ID NO: 11115 - DNA, 22 bp, Homo sapiens
ggttccccaggcggcccttgga

SEQ ID NO: 11116 - DNA, 22 bp, Homo sapiens
ttcctttctctggactgcagcc

SEQ ID NO: 11117 - DNA, 22 bp, Homo sapiens
agggaagaaaatccatcgctgc

SEQ ID NO: 11118 - DNA, 22 bp, Homo sapiens
cttccccaggacctctgctaaa

SEQ ID NO: 11119 - DNA, 19 bp, Homo sapiens
ggggcctgtgatggtcaca

SEQ ID NO: 11120 - DNA, 22 bp, Homo sapiens
tcagagagcagaacttttttac

SEQ ID NO: 11121 - DNA, 22 bp, Homo sapiens
tcagtgatttctggggtgaggg

SEQ ID NO: 11122 - DNA, 17 bp, Homo sapiens
cagtcgaggaggacctg

SEQ ID NO: 11123 - DNA, 22 bp, Homo sapiens
aagcccggttgggaacgtggtg

SEQ ID NO: 11124 - DNA, 22 bp, Homo sapiens
cgcccaggctggagagcagtgg

SEQ ID NO: 11125 - DNA, 22 bp, Homo sapiens
aggtggaaatggctttcctagg

SEQ ID NO: 11126 - DNA, 22 bp, Homo sapiens
ccaggagttggaggttgcagtg

SEQ ID NO: 11127 - DNA, 22 bp, Homo sapiens
ggagtgaagtggcgcgatctcg

SEQ ID NO: 11128 - DNA, 22 bp, Homo sapiens
ctcactgcaagttccacctacc

SEQ ID NO: 11129 - DNA, 22 bp, Homo sapiens
gtgccgcgacgcagtcggtgcc

SEQ ID NO: 11130 - DNA, 22 bp, Homo sapiens
tcagaacctcctagcagtgttc

SEQ ID NO: 11131 - DNA, 22 bp, Homo sapiens
ctggtctggctacccagcgaat

SEQ ID NO: 11132 - DNA, 22 bp, Homo sapiens
tgctttgtgacagattagtttt

SEQ ID NO: 11133 - DNA, 22 bp, Homo sapiens
ggccttggagtcagccttgagc

SEQ ID NO: 11134 - DNA, 22 bp, Homo sapiens
agcaggaaggggatgatgggca

SEQ ID NO: 11135 - DNA, 22 bp, Homo sapiens
agccctcttccagccagcacag

SEQ ID NO: 11136 - DNA, 22 bp, Homo sapiens
cagtggaggccttgggaccttt

SEQ ID NO: 11137 - DNA, 22 bp, Homo sapiens
ggctttgacatgctgaattaaa

SEQ ID NO: 11138 - DNA, 22 bp, Homo sapiens
tctgttgactcctagcagccat

SEQ ID NO: 11139 - DNA, 22 bp, Homo sapiens
ggggcattgtgtctgggttcct

SEQ ID NO: 11140 - DNA, 22 bp, Homo sapiens
gggacctcgcatgcacgaagcc

SEQ ID NO: 11141 - DNA, 20 bp, Homo sapiens
gctgaggtggaggaaggaga

SEQ ID NO: 11142 - DNA, 22 bp, Homo sapiens
agcccgcatctcgctaaagata

SEQ ID NO: 11143 - DNA, 22 bp, Homo sapiens
ctcattgcagctgcattactgt

SEQ ID NO: 11144 - DNA, 22 bp, Homo sapiens
ggggttaacagtattgctcatg

SEQ ID NO: 11145 - DNA, 22 bp, Homo sapiens
gggacatctttctagtcagggt

SEQ ID NO: 11146 - DNA, 22 bp, Homo sapiens
gcacagccacgtaatgtggtca

SEQ ID NO: 11147 - DNA, 22 bp, Homo sapiens
cagaccagaaggaagccgacaa

SEQ ID NO: 11148 - DNA, 22 bp, Homo sapiens
agtggtgataaccactatcata

SEQ ID NO: 11149 - DNA, 22 bp, Homo sapiens
acctttcagtgccctttctgtc

SEQ ID NO: 11150 - DNA, 22 bp, Homo sapiens
agtcttagaactacagtgccta

SEQ ID NO: 11151 - DNA, 22 bp, Homo sapiens
ccctctcgcggggcagcggagg

SEQ ID NO: 11152 - DNA, 22 bp, Homo sapiens
caggcgctgtggctcccacctg

SEQ ID NO: 11153 - DNA, 21 bp, Homo sapiens
acctgagctccacctcctgcc

SEQ ID NO: 11154 - DNA, 22 bp, Homo sapiens
aggtattattagcatctctatt

SEQ ID NO: 11155 - DNA, 22 bp, Homo sapiens
atgccactgcactccagcctgg

SEQ ID NO: 11156 - DNA, 20 bp, Homo sapiens
tcagccttgaatgcttgaaa

SEQ ID NO: 11157 - DNA, 22 bp, Homo sapiens
agtgtggagcatcgagggcaga

SEQ ID NO: 11158 - DNA, 22 bp, Homo sapiens
agcctattccaggatgagctca

SEQ ID NO: 11159 - DNA, 22 bp, Homo sapiens
tggcatgcatctgttgtcctag

SEQ ID NO: 11160 - DNA, 22 bp, Homo sapiens
ttctcctttcattccctgtaga

SEQ ID NO: 11161 - DNA, 22 bp, Homo sapiens
ggtcgctgtgtaggttcagcta

SEQ ID NO: 11162 - DNA, 22 bp, Homo sapiens
tagtgtctcttcctgtttgaaa

SEQ ID NO: 11163 - DNA, 22 bp, Homo sapiens
gtgtgtctcccaagaaggccca

SEQ ID NO: 11164 - DNA, 21 bp, Homo sapiens
ggccgccgccttgtgctctgc

SEQ ID NO: 11165 - DNA, 22 bp, Homo sapiens
cttctcaaagttgtgaatcagg

SEQ ID NO: 11166 - DNA, 22 bp, Homo sapiens
gcctccagggatgattccttcc

SEQ ID NO: 11167 - DNA, 22 bp, Homo sapiens
acaaacagagttgaaaaatagg

SEQ ID NO: 11168 - DNA, 22 bp, Homo sapiens
acccaggctggagtgcagtggc

SEQ ID NO: 11169 - DNA, 22 bp, Homo sapiens
tcaccgaggctggagtgcagtg

SEQ ID NO: 11170 - DNA, 21 bp, Homo sapiens
agctgcctccacttctgaggc

SEQ ID NO: 11171 - DNA, 22 bp, Homo sapiens
cctgtggcgggggccagtgcct

SEQ ID NO: 11172 - DNA, 22 bp, Homo sapiens
ctcttagtaatgccatgaagca

SEQ ID NO: 11173 - DNA, 22 bp, Homo sapiens
aggccagcctcaggcagggacc

SEQ ID NO: 11174 - DNA, 22 bp, Homo sapiens
tagatacctgctggacctcatt

SEQ ID NO: 11175 - DNA, 22 bp, Homo sapiens
ggcgtgggcgaggtgctctatc

SEQ ID NO: 11176 - DNA, 22 bp, Homo sapiens
cccagagcatgtgctgcctttg

SEQ ID NO: 11177 - DNA, 22 bp, Homo sapiens
tgtaggacatgtacttgtaaca

SEQ ID NO: 11178 - DNA, 22 bp, Homo sapiens
aacccgagggccccaggctcgg

SEQ ID NO: 11179 - DNA, 22 bp, Homo sapiens
tcttcccagaggaggtgccagc

SEQ ID NO: 11180 - DNA, 22 bp, Homo sapiens
aacctgggcttgaacagtgcct

SEQ ID NO: 11181 - DNA, 22 bp, Homo sapiens
gggtaattggggccttgcagtg

SEQ ID NO: 11182 - DNA, 22 bp, Homo sapiens
cttagatgaagtcacagaaccc

SEQ ID NO: 11183 - DNA, 22 bp, Homo sapiens
tgcaaatgtgttttaaaccaaa

SEQ ID NO: 11184 - DNA, 22 bp, Homo sapiens
tcacatgtgtacagtcctccca

SEQ ID NO: 11185 - DNA, 22 bp, Homo sapiens
tgctgctccccagcacacagca

SEQ ID NO: 11186 - DNA, 22 bp, Homo sapiens
tagctttgtttatcaaggggca

SEQ ID NO: 11187 - DNA, 17 bp, Homo sapiens
cgggcatggagggcagg

SEQ ID NO: 11188 - DNA, 22 bp, Homo sapiens
ctggaaggcagaggttgcagtg

SEQ ID NO: 11189 - DNA, 22 bp, Homo sapiens
tcacttagatggggatcatcac

SEQ ID NO: 11190 - DNA, 22 bp, Homo sapiens
agtttgggtggaacagagtcgt

SEQ ID NO: 11191 - DNA, 23 bp, Homo sapiens
catctagcatccagtgagtagtg

SEQ ID NO: 11192 - DNA, 22 bp, Homo sapiens
tctgaggaactggcaaagatgg

SEQ ID NO: 11193 - DNA, 22 bp, Homo sapiens
gacccaggggcagggagaaagt

SEQ ID NO: 11194 - DNA, 19 bp, Homo sapiens
ctctgggcaagtcacttaa

SEQ ID NO: 11195 - DNA, 22 bp, Homo sapiens
tgagaaattacttcagtgatgg

SEQ ID NO: 11196 - DNA, 22 bp, Homo sapiens
tgttatctgagcaacgtcgacg

SEQ ID NO: 11197 - DNA, 22 bp, Homo sapiens
actctccttttgatcttcagaa

SEQ ID NO: 11198 - DNA, 22 bp, Homo sapiens
gtctcgtcaatggcaggttccc

SEQ ID NO: 11199 - DNA, 22 bp, Homo sapiens
gcagagatctgagaaggctgcc

SEQ ID NO: 11200 - DNA, 22 bp, Homo sapiens
aagctctttccactaaaccact

SEQ ID NO: 11201 - DNA, 22 bp, Homo sapiens
taggtttactgaattagtggaa

SEQ ID NO: 11202 - DNA, 22 bp, Homo sapiens
ggaggtgggctaaggactctct

SEQ ID NO: 11203 - DNA, 22 bp, Homo sapiens
atataatttttggttagctcaa

SEQ ID NO: 11204 - DNA, 22 bp, Homo sapiens
atgaaatgctattttggctaga

SEQ ID NO: 11205 - DNA, 22 bp, Homo sapiens
ctcactgcaagctcagcctccc

SEQ ID NO: 11206 - DNA, 22 bp, Homo sapiens
ctttggagaaaagttcttgggc

SEQ ID NO: 11207 - DNA, 22 bp, Homo sapiens
gagtctctgaccagggtgccaa

SEQ ID NO: 11208 - DNA, 22 bp, Homo sapiens
tctgcgtgaaactagatggcag

SEQ ID NO: 11209 - DNA, 20 bp, Homo sapiens
gctgaggggtctatggcata

SEQ ID NO: 11210 - DNA, 20 bp, Homo sapiens
attagctcaggtgaggtcat

SEQ ID NO: 11211 - DNA, 22 bp, Homo sapiens
caggcgggcaggtgcggcccct

SEQ ID NO: 11212 - DNA, 22 bp, Homo sapiens
ggccgccctttccacggtttct

SEQ ID NO: 11213 - DNA, 22 bp, Homo sapiens
tgggggacaccagtctctctct

SEQ ID NO: 11214 - DNA, 22 bp, Homo sapiens
gccagccagaaacgtcacactg

SEQ ID NO: 11215 - DNA, 22 bp, Homo sapiens
agagcacagggttttgtgccgg

SEQ ID NO: 11216 - DNA, 22 bp, Homo sapiens
cagtggcgtgatctctgctcac

SEQ ID NO: 11217 - DNA, 22 bp, Homo sapiens
ggcgggcagcgtcttgctggcc

SEQ ID NO: 11218 - DNA, 22 bp, Homo sapiens
tctcagctcatggcagccttga

SEQ ID NO: 11219 - DNA, 22 bp, Homo sapiens
ccaggtagccaaggggtctggg

SEQ ID NO: 11220 - DNA, 22 bp, Homo sapiens
attgagcacatactgtgggcca

SEQ ID NO: 11221 - DNA, 22 bp, Homo sapiens
gctgctgggatcctgggtctca

SEQ ID NO: 11222 - DNA, 22 bp, Homo sapiens
tgggaggccgaggcaggtggat

SEQ ID NO: 11223 - DNA, 22 bp, Homo sapiens
tgagcacatttcacatgacagg

SEQ ID NO: 11224 - DNA, 22 bp, Homo sapiens
tcattgagttgcacttttacta

SEQ ID NO: 11225 - DNA, 22 bp, Homo sapiens
atgcacctgaactccatcagct

SEQ ID NO: 11226 - DNA, 20 bp, Homo sapiens
tgggatcgaatcaagtctgt

SEQ ID NO: 11227 - DNA, 22 bp, Homo sapiens
tccagggccatctccatgaggc

SEQ ID NO: 11228 - DNA, 22 bp, Homo sapiens
ctcactgcaacctccgcctcct

SEQ ID NO: 11229 - DNA, 22 bp, Homo sapiens
tatccgtgatgtttataaacca

SEQ ID NO: 11230 - DNA, 22 bp, Homo sapiens
aatattatacagtcaacctctt

SEQ ID NO: 11231 - DNA, 22 bp, Homo sapiens
tgattcatcagaataggagttt

SEQ ID NO: 11232 - DNA, 22 bp, Homo sapiens
gtgcacttgatctagacagatt

SEQ ID NO: 11233 - DNA, 22 bp, Homo sapiens
caatagtgtctgcttgtttcta

SEQ ID NO: 11234 - DNA, 22 bp, Homo sapiens
aggtttctttatgctgctagaa

SEQ ID NO: 11235 - DNA, 22 bp, Homo sapiens
ttcccaggaagcctctccaagc

SEQ ID NO: 11236 - DNA, 22 bp, Homo sapiens
gaagaaagatcaaatagtttcc

SEQ ID NO: 11237 - DNA, 22 bp, Homo sapiens
gtttgagatgggttattgctct

SEQ ID NO: 11238 - DNA, 22 bp, Homo sapiens
gtgaggtggtacaatattaact

SEQ ID NO: 11239 - DNA, 22 bp, Homo sapiens
ctggggtccttgccatgtgtca

SEQ ID NO: 11240 - DNA, 22 bp, Homo sapiens
tgtcaccatgcgaggctaattt

SEQ ID NO: 11241 - DNA, 22 bp, Homo sapiens
attgtaaatagtgccacaataa

SEQ ID NO: 11242 - DNA, 22 bp, Homo sapiens
atggcagaatatctgcatcgca

SEQ ID NO: 11243 - DNA, 22 bp, Homo sapiens
aacctcaaactcttgggcttaa

SEQ ID NO: 11244 - DNA, 22 bp, Homo sapiens
gagagtgagatcctcctgggga

SEQ ID NO: 11245 - DNA, 22 bp, Homo sapiens
cttcctcctccatctcgaaggc

SEQ ID NO: 11246 - DNA, 22 bp, Homo sapiens
accagcacttccagaggtcagg

SEQ ID NO: 11247 - DNA, 19 bp, Homo sapiens
atctgccttagtgctgctg

SEQ ID NO: 11248 - DNA, 22 bp, Homo sapiens
agtgaagctggagaaaggcagt

SEQ ID NO: 11249 - DNA, 22 bp, Homo sapiens
tgaggcaggaggttgagaactg

SEQ ID NO: 11250 - DNA, 22 bp, Homo sapiens
gcctcaaatgtggagcactatt

SEQ ID NO: 11251 - DNA, 22 bp, Homo sapiens
tgtcacagtttgtactttatag

SEQ ID NO: 11252 - DNA, 22 bp, Homo sapiens
atccatttgacataatttcagc

SEQ ID NO: 11253 - DNA, 22 bp, Homo sapiens
gtgcccagcagcagcgtccccg

SEQ ID NO: 11254 - DNA, 22 bp, Homo sapiens
cactgcacttcagcctgggcga

SEQ ID NO: 11255 - DNA, 22 bp, Homo sapiens
ctgcagtctacctggattttta

SEQ ID NO: 11256 - DNA, 22 bp, Homo sapiens
cttgacactgtcactcaggcca

SEQ ID NO: 11257 - DNA, 22 bp, Homo sapiens
cactgcacttcagcctgggcaa

SEQ ID NO: 11258 - DNA, 17 bp, Homo sapiens
tctgagaatgctggagg

SEQ ID NO: 11259 - DNA, 22 bp, Homo sapiens
ttggcataccttagtggtggag

SEQ ID NO: 11260 - DNA, 22 bp, Homo sapiens
gggccaccccactgcccacgct

SEQ ID NO: 11261 - DNA, 23 bp, Homo sapiens
ttctgggctgtggaagcctcggg

SEQ ID NO: 11262 - DNA, 22 bp, Homo sapiens
ggaggtggagctggaagttcca

SEQ ID NO: 11263 - DNA, 22 bp, Homo sapiens
gattcagcctctgcttccctga

SEQ ID NO: 11264 - DNA, 22 bp, Homo sapiens
tgtgaagatagctgttacatct

SEQ ID NO: 11265 - DNA, 22 bp, Homo sapiens
tctgagctgggtcttgacagct

SEQ ID NO: 11266 - DNA, 22 bp, Homo sapiens
cataaaaggtagcagtttgaaa

SEQ ID NO: 11267 - DNA, 22 bp, Homo sapiens
aaaaagtattggccatggttga

SEQ ID NO: 11268 - DNA, 22 bp, Homo sapiens
tcctgccttgcctgggacatca

SEQ ID NO: 11269 - DNA, 22 bp, Homo sapiens
atctggttttggctgtgtccct

SEQ ID NO: 11270 - DNA, 22 bp, Homo sapiens
tagcccaggctggagtgcaggg

SEQ ID NO: 11271 - DNA, 22 bp, Homo sapiens
ccaggcagcctgctccattctg

SEQ ID NO: 11272 - DNA, 22 bp, Homo sapiens
tgtcctgtaggaggcagaacaa

SEQ ID NO: 11273 - DNA, 22 bp, Homo sapiens
cttcagctgcagttatgtttag

SEQ ID NO: 11274 - DNA, 22 bp, Homo sapiens
ccagcagccaccttctcgaaat

SEQ ID NO: 11275 - DNA, 22 bp, Homo sapiens
atggaccagagcctcattctgt

SEQ ID NO: 11276 - DNA, 22 bp, Homo sapiens
agggttgcaccatgttggtcag

SEQ ID NO: 11277 - DNA, 22 bp, Homo sapiens
gccatcctgatgacaggccact

SEQ ID NO: 11278 - DNA, 22 bp, Homo sapiens
cgtcacttcttagtctattttc

SEQ ID NO: 11279 - DNA, 22 bp, Homo sapiens
aggacagagggaccagagccca

SEQ ID NO: 11280 - DNA, 21 bp, Homo sapiens
tcctgtaagcttgggtggctc

SEQ ID NO: 11281 - DNA, 22 bp, Homo sapiens
tttgctcagtttgataatttga

SEQ ID NO: 11282 - DNA, 22 bp, Homo sapiens
cagctgttcattgttgccaccc

SEQ ID NO: 11283 - DNA, 22 bp, Homo sapiens
tcagtgcagggtgggagagaga

SEQ ID NO: 11284 - DNA, 23 bp, Homo sapiens
ggagtgcaatggcgccatctcgg

SEQ ID NO: 11285 - DNA, 22 bp, Homo sapiens
aggccaggaatccttgtcccag

SEQ ID NO: 11286 - DNA, 22 bp, Homo sapiens
cagccctcctaccctgccaggc

SEQ ID NO: 11287 - DNA, 22 bp, Homo sapiens
caggtgtcggtcaggcggtttt

SEQ ID NO: 11288 - DNA, 22 bp, Homo sapiens
gacaggtgctaagggacctggc

SEQ ID NO: 11289 - DNA, 22 bp, Homo sapiens
tcactcaggctggagtgcagtg

SEQ ID NO: 11290 - DNA, 22 bp, Homo sapiens
ctgcaccgtgtctcgggctgcc

SEQ ID NO: 11291 - DNA, 22 bp, Homo sapiens
tgatattttatgagctttcata

SEQ ID NO: 11292 - DNA, 22 bp, Homo sapiens
gaaatgctcaggggttttccag

SEQ ID NO: 11293 - DNA, 18 bp, Homo sapiens
ccatcaccctaactagtg

SEQ ID NO: 11294 - DNA, 22 bp, Homo sapiens
cttggggcagcccaggctgagc

SEQ ID NO: 11295 - DNA, 22 bp, Homo sapiens
cggagcctgcttgttgcagctg

SEQ ID NO: 11296 - DNA, 16 bp, Homo sapiens
atgctgctattagagg

SEQ ID NO: 11297 - DNA, 22 bp, Homo sapiens
caggctgtccaggctcctttgg

SEQ ID NO: 11298 - DNA, 22 bp, Homo sapiens
gggaggcagtgctggaggctgg

SEQ ID NO: 11299 - DNA, 23 bp, Homo sapiens
ccaagactgttaggagtggggag

SEQ ID NO: 11300 - DNA, 22 bp, Homo sapiens
tgggaaagctgcagaaattctc

SEQ ID NO: 11301 - DNA, 22 bp, Homo sapiens
aggcctgaggaccagataaatg

SEQ ID NO: 11302 - DNA, 19 bp, Homo sapiens
tcctgcccaccagccaggg

SEQ ID NO: 11303 - DNA, 22 bp, Homo sapiens
ctggcaagaaatatatatctta

SEQ ID NO: 11304 - DNA, 22 bp, Homo sapiens
gttaaggctgagcaggacactg

SEQ ID NO: 11305 - DNA, 22 bp, Homo sapiens
ctgtaatcccagctactcggga

SEQ ID NO: 11306 - DNA, 22 bp, Homo sapiens
ttcacagcttaataaggctcag

SEQ ID NO: 11307 - DNA, 19 bp, Homo sapiens
gactccaactttaagcatg

SEQ ID NO: 11308 - DNA, 22 bp, Homo sapiens
tcaccggtgaccctcggctcgc

SEQ ID NO: 11309 - DNA, 22 bp, Homo sapiens
gatggcctcatggctgcaggcc

SEQ ID NO: 11310 - DNA, 22 bp, Homo sapiens
catgagatttgggaggggccag

SEQ ID NO: 11311 - DNA, 22 bp, Homo sapiens
cagctgcccctccagggctggg

SEQ ID NO: 11312 - DNA, 22 bp, Homo sapiens
gggagtgggtttggcctaggcc

SEQ ID NO: 11313 - DNA, 22 bp, Homo sapiens
gaaaaggcagagttccggggaa

SEQ ID NO: 11314 - DNA, 22 bp, Homo sapiens
gggttggcatcagggttctgtg

SEQ ID NO: 11315 - DNA, 22 bp, Homo sapiens
ctgccctggggggcctccttgc

SEQ ID NO: 11316 - DNA, 22 bp, Homo sapiens
ggctagggatctagaccaggac

SEQ ID NO: 11317 - DNA, 22 bp, Homo sapiens
gcacatccaatgattgttttga

SEQ ID NO: 11318 - DNA, 22 bp, Homo sapiens
tccgggagctgaacgtcttgcg

SEQ ID NO: 11319 - DNA, 22 bp, Homo sapiens
cacccaggctggagagcagtgg

SEQ ID NO: 11320 - DNA, 22 bp, Homo sapiens
gcagttctcagccaggcggcag

SEQ ID NO: 11321 - DNA, 22 bp, Homo sapiens
gtccacagctctgaggtctccc

SEQ ID NO: 11322 - DNA, 22 bp, Homo sapiens
ttaggctgttcttgtgttgtta

SEQ ID NO: 11323 - DNA, 22 bp, Homo sapiens
tgatctggtcctactgtgggca

SEQ ID NO: 11324 - DNA, 22 bp, Homo sapiens
atatgggggggcgtgcagagga

SEQ ID NO: 11325 - DNA, 22 bp, Homo sapiens
gactacaggtgtgtgccaccat

SEQ ID NO: 11326 - DNA, 22 bp, Homo sapiens
ccagtgtgcattatcatgtgtc

SEQ ID NO: 11327 - DNA, 18 bp, Homo sapiens
ccctcttgcacaaagcaa

SEQ ID NO: 11328 - DNA, 20 bp, Homo sapiens
tgaggcccagcagagtcggg

SEQ ID NO: 11329 - DNA, 22 bp, Homo sapiens
tgcatattatgtgtatctgtct

SEQ ID NO: 11330 - DNA, 22 bp, Homo sapiens
tcactgcaacctccacctcctg

SEQ ID NO: 11331 - DNA, 22 bp, Homo sapiens
tcccagattcctgctcttatat

SEQ ID NO: 11332 - DNA, 22 bp, Homo sapiens
gccaccccataggtgttaggtg

SEQ ID NO: 11333 - DNA, 22 bp, Homo sapiens
ggaggcggaagttgcagtgagc

SEQ ID NO: 11334 - DNA, 22 bp, Homo sapiens
tctcccaagcctggcaggggca

SEQ ID NO: 11335 - DNA, 22 bp, Homo sapiens
gtttgtcttaattaggcatcga

SEQ ID NO: 11336 - DNA, 22 bp, Homo sapiens
tggtggctcacacctgtaatcc

SEQ ID NO: 11337 - DNA, 22 bp, Homo sapiens
ctgggaggcagaggttgtagtg

SEQ ID NO: 11338 - DNA, 23 bp, Homo sapiens
tgaggcaggcggatcacgaggtc

SEQ ID NO: 11339 - DNA, 22 bp, Homo sapiens
attcttcctcatcaatctgtag

SEQ ID NO: 11340 - DNA, 22 bp, Homo sapiens
ggcaggactgatcagtgggatg

SEQ ID NO: 11341 - DNA, 22 bp, Homo sapiens
tgaagcaaattgtttagcctga

SEQ ID NO: 11342 - DNA, 22 bp, Homo sapiens
ccaatgatggtgcccacgatga

SEQ ID NO: 11343 - DNA, 17 bp, Homo sapiens
tggtccaggtggagcca

SEQ ID NO: 11344 - DNA, 22 bp, Homo sapiens
aggagatggagctcagtgggca

SEQ ID NO: 11345 - DNA, 22 bp, Homo sapiens
gcagggcacaaggacgcacagg

SEQ ID NO: 11346 - DNA, 22 bp, Homo sapiens
gaaacactcaatttagtaattc

SEQ ID NO: 11347 - DNA, 22 bp, Homo sapiens
ggtgtgtctgccaggaactgca

SEQ ID NO: 11348 - DNA, 22 bp, Homo sapiens
tcccagaaacgcatatgttcat

SEQ ID NO: 11349 - DNA, 22 bp, Homo sapiens
tggagccagagcgcagcctggg

SEQ ID NO: 11350 - DNA, 22 bp, Homo sapiens
ccctctacagggaagcgctttc

SEQ ID NO: 11351 - DNA, 22 bp, Homo sapiens
tttgaagactactgggagtgaa

SEQ ID NO: 11352 - DNA, 22 bp, Homo sapiens
aaagtgctaggattacaagcgt

SEQ ID NO: 11353 - DNA, 22 bp, Homo sapiens
gcccaggaggcagaggttgtgg

SEQ ID NO: 11354 - DNA, 22 bp, Homo sapiens
agcccttagtacatttctcaag

SEQ ID NO: 11355 - DNA, 22 bp, Homo sapiens
ctgctcagtaatagtcctatct

SEQ ID NO: 11356 - DNA, 22 bp, Homo sapiens
tcattaatcccggggtccaggg

SEQ ID NO: 11357 - DNA, 22 bp, Homo sapiens
attctaatggcagagactcctg

SEQ ID NO: 11358 - DNA, 22 bp, Homo sapiens
cccaggaagtggaggttgcagt

SEQ ID NO: 11359 - DNA, 22 bp, Homo sapiens
gctgacccctacaggttgtgtt

SEQ ID NO: 11360 - DNA, 22 bp, Homo sapiens
agagcccctgggtcacacagcc

SEQ ID NO: 11361 - DNA, 22 bp, Homo sapiens
atatattttttgagacagagtc

SEQ ID NO: 11362 - DNA, 22 bp, Homo sapiens
acccgggaggcaggagtcatag

SEQ ID NO: 11363 - DNA, 22 bp, Homo sapiens
cccaggaggcagaagttgcagt

SEQ ID NO: 11364 - DNA, 22 bp, Homo sapiens
gggtggagagaaagaaacgtga

SEQ ID NO: 11365 - DNA, 22 bp, Homo sapiens
ctgatattctattttgcttgct

SEQ ID NO: 11366 - DNA, 22 bp, Homo sapiens
cagcctggtccccggctcaccc

SEQ ID NO: 11367 - DNA, 22 bp, Homo sapiens
tgagtggacacctgcttcttta

SEQ ID NO: 11368 - DNA, 22 bp, Homo sapiens
ccttttgctctcccatccagaa

SEQ ID NO: 11369 - DNA, 20 bp, Homo sapiens
ctgtggaattttaccatgcg

SEQ ID NO: 11370 - DNA, 22 bp, Homo sapiens
tcacccaggctggagtgcagtg

SEQ ID NO: 11371 - DNA, 22 bp, Homo sapiens
tctcccaggcaggagtgcagtg

SEQ ID NO: 11372 - DNA, 22 bp, Homo sapiens
ggaggtcccaggcctggcagca

SEQ ID NO: 11373 - DNA, 22 bp, Homo sapiens
taaaatttgtccctgagtgttg

SEQ ID NO: 11374 - DNA, 22 bp, Homo sapiens
gcctgtgtggatgcgccggtgc

SEQ ID NO: 11375 - DNA, 22 bp, Homo sapiens
gtgggggcaggcagtgctagga

SEQ ID NO: 11376 - DNA, 22 bp, Homo sapiens
aagcagcacagcaatgactcta

SEQ ID NO: 11377 - DNA, 22 bp, Homo sapiens
tgagccatgggactccaaggga

SEQ ID NO: 11378 - DNA, 20 bp, Homo sapiens
gggcagagccagccagtccc

SEQ ID NO: 11379 - DNA, 22 bp, Homo sapiens
atgttctacagatggaaagggg

SEQ ID NO: 11380 - DNA, 22 bp, Homo sapiens
tatgacttttcccaattcagga

SEQ ID NO: 11381 - DNA, 22 bp, Homo sapiens
aacagcgacgtcctccccaaca

SEQ ID NO: 11382 - DNA, 22 bp, Homo sapiens
atagggcctaaaaagtattgct

SEQ ID NO: 11383 - DNA, 22 bp, Homo sapiens
aaggtggaggttgcagtgagct

SEQ ID NO: 11384 - DNA, 22 bp, Homo sapiens
cattctgcgatcctcaagcaca

SEQ ID NO: 11385 - DNA, 22 bp, Homo sapiens
ctgtcctgccagtcctggactc

SEQ ID NO: 11386 - DNA, 22 bp, Homo sapiens
ctcaggagttggaggctacagt

SEQ ID NO: 11387 - DNA, 22 bp, Homo sapiens
agtggactcttcccagtgcttg

SEQ ID NO: 11388 - DNA, 22 bp, Homo sapiens
gttggtcctttgagcaagatcc

SEQ ID NO: 11389 - DNA, 22 bp, Homo sapiens
ggctttagtgtaggtttctgtt

SEQ ID NO: 11390 - DNA, 22 bp, Homo sapiens
agacgcggtggtgcatgcctgt

SEQ ID NO: 11391 - DNA, 22 bp, Homo sapiens
ctcactgcaagctccacctctt

SEQ ID NO: 11392 - DNA, 22 bp, Homo sapiens
ggccactgacctacatctgggg

SEQ ID NO: 11393 - DNA, 22 bp, Homo sapiens
ccaggaggttgaggctgcagtg

SEQ ID NO: 11394 - DNA, 22 bp, Homo sapiens
tggagacacaggaccagactgc

SEQ ID NO: 11395 - DNA, 22 bp, Homo sapiens
aaaactacatttgacattttgt

SEQ ID NO: 11396 - DNA, 21 bp, Homo sapiens
gggcagaggggcctcctgggt

SEQ ID NO: 11397 - DNA, 22 bp, Homo sapiens
tacaacaatttccacattagaa

SEQ ID NO: 11398 - DNA, 22 bp, Homo sapiens
aaggtagggatgtattcagctt

SEQ ID NO: 11399 - DNA, 22 bp, Homo sapiens
ccactgcactccagcctgccaa

SEQ ID NO: 11400 - DNA, 22 bp, Homo sapiens
tcagcctgctccaagtgctgcc

SEQ ID NO: 11401 - DNA, 23 bp, Homo sapiens
ggggcctgcaccggtctgcgcgg

SEQ ID NO: 11402 - DNA, 22 bp, Homo sapiens
gacactctttcctcttctggaa

SEQ ID NO: 11403 - DNA, 22 bp, Homo sapiens
aggaatgtgaaacaggtggctg

SEQ ID NO: 11404 - DNA, 22 bp, Homo sapiens
cgatcaccgtggccactttgag

SEQ ID NO: 11405 - DNA, 22 bp, Homo sapiens
agaaaacataggagacaggaaa

SEQ ID NO: 11406 - DNA, 22 bp, Homo sapiens
ggtcccaggttgacagggagac

SEQ ID NO: 11407 - DNA, 20 bp, Homo sapiens
caaatccctgctctgtgctg

SEQ ID NO: 11408 - DNA, 22 bp, Homo sapiens
gacaggaggcagagctcaggtg

SEQ ID NO: 11409 - DNA, 22 bp, Homo sapiens
actgggcctacccagattggca

SEQ ID NO: 11410 - DNA, 22 bp, Homo sapiens
tttgaagggcacgacaatagtt

SEQ ID NO: 11411 - DNA, 23 bp, Homo sapiens
ctcctggtgctgctatcaggggt

SEQ ID NO: 11412 - DNA, 22 bp, Homo sapiens
gacccttagaatgtgatcttat

SEQ ID NO: 11413 - DNA, 22 bp, Homo sapiens
ggctgtggagctgcagagttgg

SEQ ID NO: 11414 - DNA, 22 bp, Homo sapiens
gttaggtagaagtttactttga

SEQ ID NO: 11415 - DNA, 22 bp, Homo sapiens
gaagatgttatggagagctcag

SEQ ID NO: 11416 - DNA, 22 bp, Homo sapiens
gctggccacagatccccaggga

SEQ ID NO: 11417 - DNA, 22 bp, Homo sapiens
cagagggttgatgtgaggctta

SEQ ID NO: 11418 - DNA, 22 bp, Homo sapiens
caggctggagtgcagtggcgct

SEQ ID NO: 11419 - DNA, 22 bp, Homo sapiens
ctcactgcaagctccgcctccc

SEQ ID NO: 11420 - DNA, 22 bp, Homo sapiens
tcatctgaagattgctgttcaa

SEQ ID NO: 11421 - DNA, 22 bp, Homo sapiens
ggctagcaaggtagcagaatgc

SEQ ID NO: 11422 - DNA, 22 bp, Homo sapiens
aaggggtgagcagaggcttcgc

SEQ ID NO: 11423 - DNA, 22 bp, Homo sapiens
agttgcagacgcagagatgttg

SEQ ID NO: 11424 - DNA, 22 bp, Homo sapiens
ttcctgcaggccatagagcctg

SEQ ID NO: 11425 - DNA, 22 bp, Homo sapiens
tctctcaggctggagtgcagtg

SEQ ID NO: 11426 - DNA, 22 bp, Homo sapiens
tcatgctatgagcgagggcctg

SEQ ID NO: 11427 - DNA, 22 bp, Homo sapiens
tttataatagatttggggcggc

SEQ ID NO: 11428 - DNA, 22 bp, Homo sapiens
aaatgcacaaagattttgcact

SEQ ID NO: 11429 - DNA, 22 bp, Homo sapiens
agaggccgggtgcctgctcaga

SEQ ID NO: 11430 - DNA, 22 bp, Homo sapiens
caaagtgctgggattacaggtg

SEQ ID NO: 11431 - DNA, 19 bp, Homo sapiens
acccagcccaggagtggca

SEQ ID NO: 11432 - DNA, 22 bp, Homo sapiens
acccagtctggagtgcagtgac

SEQ ID NO: 11433 - DNA, 22 bp, Homo sapiens
tgctgaataagacgtggcttgt

SEQ ID NO: 11434 - DNA, 22 bp, Homo sapiens
gcaccactacactccagcctgg

SEQ ID NO: 11435 - DNA, 22 bp, Homo sapiens
ccagagctgattcctgggactt

SEQ ID NO: 11436 - DNA, 19 bp, Homo sapiens
ccagagagctaggtacaga

SEQ ID NO: 11437 - DNA, 18 bp, Homo sapiens
acacttcctggtggtgtg

SEQ ID NO: 11438 - DNA, 22 bp, Homo sapiens
tatactctgagaaacgtgtcac

SEQ ID NO: 11439 - DNA, 22 bp, Homo sapiens
gggctgcactagggcaaggtga

SEQ ID NO: 11440 - DNA, 22 bp, Homo sapiens
ttcagcccaggagttggaggct

SEQ ID NO: 11441 - DNA, 22 bp, Homo sapiens
gggaagagggagctggaatgat

SEQ ID NO: 11442 - DNA, 22 bp, Homo sapiens
agtcccaacagcttacaaggaa

SEQ ID NO: 11443 - DNA, 22 bp, Homo sapiens
ttcccacagtgactccagagaa

SEQ ID NO: 11444 - DNA, 22 bp, Homo sapiens
atgtttaaagggttgagaaata

SEQ ID NO: 11445 - DNA, 22 bp, Homo sapiens
gcgcactgggcgcacgcgtagg

SEQ ID NO: 11446 - DNA, 22 bp, Homo sapiens
gaaatcatattctcagtccttc

SEQ ID NO: 11447 - DNA, 22 bp, Homo sapiens
atcattatcctcctatttgcct

SEQ ID NO: 11448 - DNA, 22 bp, Homo sapiens
ttccaactttgtcatatattat

SEQ ID NO: 11449 - DNA, 22 bp, Homo sapiens
cgtcccgggttcacgccattct

SEQ ID NO: 11450 - DNA, 22 bp, Homo sapiens
agcctggcggtcgtcggtcagg

SEQ ID NO: 11451 - DNA, 22 bp, Homo sapiens
gctcccaggatgaggagccagg

SEQ ID NO: 11452 - DNA, 22 bp, Homo sapiens
ggcagggagtggagactcccta

SEQ ID NO: 11453 - DNA, 22 bp, Homo sapiens
tattctcatcatcactggagct

SEQ ID NO: 11454 - DNA, 22 bp, Homo sapiens
gtatgtgaggttggtttccagg

SEQ ID NO: 11455 - DNA, 22 bp, Homo sapiens
atgcgagtgatgcagagtggct

SEQ ID NO: 11456 - DNA, 22 bp, Homo sapiens
agcccttggtattttccgatcc

SEQ ID NO: 11457 - DNA, 22 bp, Homo sapiens
atgccactgcgctccagcctgg

SEQ ID NO: 11458 - DNA, 22 bp, Homo sapiens
gaggccaaggtgggcagatcac

SEQ ID NO: 11459 - DNA, 22 bp, Homo sapiens
cactgcactccagcctgggcaa

SEQ ID NO: 11460 - DNA, 22 bp, Homo sapiens
tgagtgtggggaatgtcatgag

SEQ ID NO: 11461 - DNA, 22 bp, Homo sapiens
actgagctccaagcctggaatc

SEQ ID NO: 11462 - DNA, 20 bp, Homo sapiens
tgatatggtttggctgtgtt

SEQ ID NO: 11463 - DNA, 22 bp, Homo sapiens
tacatgctccttatgagaatct

SEQ ID NO: 11464 - DNA, 22 bp, Homo sapiens
gggaagtgatggagccaggatt

SEQ ID NO: 11465 - DNA, 22 bp, Homo sapiens
ctgctttggacaactattcttg

SEQ ID NO: 11466 - DNA, 22 bp, Homo sapiens
tggtggggccagacttcagctc

SEQ ID NO: 11467 - DNA, 22 bp, Homo sapiens
agagctaagaaacagaattgct

SEQ ID NO: 11468 - DNA, 22 bp, Homo sapiens
ctgggaggcagaggttgcagtg

SEQ ID NO: 11469 - DNA, 22 bp, Homo sapiens
ttgcactccagtctgggaacaa

SEQ ID NO: 11470 - DNA, 22 bp, Homo sapiens
cttaatctcacctgcaaagtcc

SEQ ID NO: 11471 - DNA, 22 bp, Homo sapiens
atggagttctgccagcgctgct

SEQ ID NO: 11472 - DNA, 22 bp, Homo sapiens
ttaggatttgaaaaggggcaga

SEQ ID NO: 11473 - DNA, 22 bp, Homo sapiens
caggtgagaggcggtcctgcat

SEQ ID NO: 11474 - DNA, 22 bp, Homo sapiens
caaccgcggggcccagcggttc

SEQ ID NO: 11475 - DNA, 22 bp, Homo sapiens
gagggtggtggcttaaggtgct

SEQ ID NO: 11476 - DNA, 22 bp, Homo sapiens
gggctctcccacaacgtgccag

SEQ ID NO: 11477 - DNA, 22 bp, Homo sapiens
ccaggagttggaggctgcagtg

SEQ ID NO: 11478 - DNA, 22 bp, Homo sapiens
cccacacacatttatgatagga

SEQ ID NO: 11479 - DNA, 23 bp, Homo sapiens
atgggccaagcaagacccatgac

SEQ ID NO: 11480 - DNA, 22 bp, Homo sapiens
ttagctcagaaaatttaaactt

SEQ ID NO: 11481 - DNA, 22 bp, Homo sapiens
tgtcttcgctacaatgaaaagg

SEQ ID NO: 11482 - DNA, 22 bp, Homo sapiens
cacatttttactgccaacttaa

SEQ ID NO: 11483 - DNA, 22 bp, Homo sapiens
ttccgagggctcggcggccgcc

SEQ ID NO: 11484 - DNA, 22 bp, Homo sapiens
cccaggcttttctcttgcccca

SEQ ID NO: 11485 - DNA, 22 bp, Homo sapiens
ccaggagtgcagggatggtatc

SEQ ID NO: 11486 - DNA, 23 bp, Homo sapiens
tctacaaagctgtgtcaggaccc

SEQ ID NO: 11487 - DNA, 21 bp, Homo sapiens
tggtacaccttgcctgtcaga

SEQ ID NO: 11488 - DNA, 18 bp, Homo sapiens
gcagtgaagaaagagctt

SEQ ID NO: 11489 - DNA, 22 bp, Homo sapiens
gaggcagaggttgttgcagtga

SEQ ID NO: 11490 - DNA, 22 bp, Homo sapiens
ggctgagttgagaggattactt

SEQ ID NO: 11491 - DNA, 22 bp, Homo sapiens
aggctgaggcaagaggatcact

SEQ ID NO: 11492 - DNA, 22 bp, Homo sapiens
aaccaggtgactcatggtgagc

SEQ ID NO: 11493 - DNA, 22 bp, Homo sapiens
cagggatggcgctggctgcccg

SEQ ID NO: 11494 - DNA, 22 bp, Homo sapiens
cacccaggcaaggattctgcaa

SEQ ID NO: 11495 - DNA, 22 bp, Homo sapiens
gggacaatggaggcctctctcc

SEQ ID NO: 11496 - DNA, 19 bp, Homo sapiens
ggagccgccgcccttcatt

SEQ ID NO: 11497 - DNA, 22 bp, Homo sapiens
ggctccctgcaacctccgcctc

SEQ ID NO: 11498 - DNA, 22 bp, Homo sapiens
aggctggagtgcagtggtgtga

SEQ ID NO: 11499 - DNA, 22 bp, Homo sapiens
gggcagagagctggaactcctt

SEQ ID NO: 11500 - DNA, 21 bp, Homo sapiens
tactgtagccttgcactgtag

SEQ ID NO: 11501 - DNA, 22 bp, Homo sapiens
aggctcagatccttgtgtcctg

SEQ ID NO: 11502 - DNA, 22 bp, Homo sapiens
cagatcacttgaagccaggagt

SEQ ID NO: 11503 - DNA, 22 bp, Homo sapiens
caggcagggagctggaaaggat

SEQ ID NO: 11504 - DNA, 22 bp, Homo sapiens
agctggggctgtggttgtgatt

SEQ ID NO: 11505 - DNA, 22 bp, Homo sapiens
tcctgaagaaggcagatatttg

SEQ ID NO: 11506 - DNA, 17 bp, Homo sapiens
tgtagcttctccttctc

SEQ ID NO: 11507 - DNA, 22 bp, Homo sapiens
tgacaggcaggacagaggtgtg

SEQ ID NO: 11508 - DNA, 22 bp, Homo sapiens
tccgggttttacactcacatca

SEQ ID NO: 11509 - DNA, 22 bp, Homo sapiens
gtgtatgttctacttaatatta

SEQ ID NO: 11510 - DNA, 22 bp, Homo sapiens
gtattagtttcctgttgctgct

SEQ ID NO: 11511 - DNA, 22 bp, Homo sapiens
ccagagctgcaggtaaaatgct

SEQ ID NO: 11512 - DNA, 22 bp, Homo sapiens
actttatttcctattgcatcca

SEQ ID NO: 11513 - DNA, 22 bp, Homo sapiens
tggcaccagggaacaagcattt

SEQ ID NO: 11514 - DNA, 22 bp, Homo sapiens
actgcaacacctcctgggttca

SEQ ID NO: 11515 - DNA, 22 bp, Homo sapiens
ttatgggagcaattggggaggt

SEQ ID NO: 11516 - DNA, 22 bp, Homo sapiens
ccaggaggtggaggttgcggtg

SEQ ID NO: 11517 - DNA, 22 bp, Homo sapiens
tccttgtaacgttgggctgggg

SEQ ID NO: 11518 - DNA, 22 bp, Homo sapiens
gaccttgtgatctgcctgcctt

SEQ ID NO: 11519 - DNA, 22 bp, Homo sapiens
atggctgcctgggcgctggccg

SEQ ID NO: 11520 - DNA, 23 bp, Homo sapiens
ctcaccaagcgccgccgctgtgt

SEQ ID NO: 11521 - DNA, 22 bp, Homo sapiens
tatgttaacatgttaggaactg

SEQ ID NO: 11522 - DNA, 22 bp, Homo sapiens
cccagccaaaagcaagtttacc

SEQ ID NO: 11523 - DNA, 22 bp, Homo sapiens
gaggtggctgcttgctgggaaa

SEQ ID NO: 11524 - DNA, 22 bp, Homo sapiens
tgtctattcccccacctccgtt

SEQ ID NO: 11525 - DNA, 22 bp, Homo sapiens
attgttgggtctcactcctaga

SEQ ID NO: 11526 - DNA, 22 bp, Homo sapiens
atctggttcttcttaggcatca

SEQ ID NO: 11527 - DNA, 22 bp, Homo sapiens
tgccgctccaggtctcgcggtg

SEQ ID NO: 11528 - DNA, 22 bp, Homo sapiens
ctgcgtgcatgtctgcgtgcat

SEQ ID NO: 11529 - DNA, 22 bp, Homo sapiens
tttatagtagcatgatttataa

SEQ ID NO: 11530 - DNA, 22 bp, Homo sapiens
ctcactgcaacctctgcctccc

SEQ ID NO: 11531 - DNA, 22 bp, Homo sapiens
gacccacctcaccaagcatgtg

SEQ ID NO: 11532 - DNA, 22 bp, Homo sapiens
tttggagaatgttttggtcaga

SEQ ID NO: 11533 - DNA, 22 bp, Homo sapiens
attgacctgattgttcctggaa

SEQ ID NO: 11534 - DNA, 22 bp, Homo sapiens
tctgccttctatcttttgtctg

SEQ ID NO: 11535 - DNA, 22 bp, Homo sapiens
aaaagagcttggttgattttgc

SEQ ID NO: 11536 - DNA, 23 bp, Homo sapiens
cccagaccttgtgctgcccttgg

SEQ ID NO: 11537 - DNA, 22 bp, Homo sapiens
tagatagattctcctatagagt

SEQ ID NO: 11538 - DNA, 20 bp, Homo sapiens
tatttctgggcaaccattta

SEQ ID NO: 11539 - DNA, 22 bp, Homo sapiens
gcaggcagaggtggaggagaca

SEQ ID NO: 11540 - DNA, 19 bp, Homo sapiens
gagtattttccaacttggt

SEQ ID NO: 11541 - DNA, 22 bp, Homo sapiens
cctccccacagcccaggagact

SEQ ID NO: 11542 - DNA, 22 bp, Homo sapiens
catggggcccatgtgctccaag

SEQ ID NO: 11543 - DNA, 22 bp, Homo sapiens
ctgtgggatcccatgactttcc

SEQ ID NO: 11544 - DNA, 22 bp, Homo sapiens
cttctacacgtggctgtgccaa

SEQ ID NO: 11545 - DNA, 22 bp, Homo sapiens
gctgctttggaaagcatggaaa

SEQ ID NO: 11546 - DNA, 22 bp, Homo sapiens
tgtgttgtgacattcttggatg

SEQ ID NO: 11547 - DNA, 20 bp, Homo sapiens
tttgagaccagtctgcccaa

SEQ ID NO: 11548 - DNA, 21 bp, Homo sapiens
tgtaagtttcatctgaattgg

SEQ ID NO: 11549 - DNA, 22 bp, Homo sapiens
ccacgacgagtcatcagggcga

SEQ ID NO: 11550 - DNA, 22 bp, Homo sapiens
gaccacacttttcccctgctag

SEQ ID NO: 11551 - DNA, 22 bp, Homo sapiens
ctctgcctcagtgatttcttta

SEQ ID NO: 11552 - DNA, 22 bp, Homo sapiens
ggaggagacagtaaaaagcacg

SEQ ID NO: 11553 - DNA, 22 bp, Homo sapiens
attcacctttccccaaaatgag

SEQ ID NO: 11554 - DNA, 18 bp, Homo sapiens
ccctgccagctcccagca

SEQ ID NO: 11555 - DNA, 22 bp, Homo sapiens
gcaggtggatcaccacgtcagg

SEQ ID NO: 11556 - DNA, 22 bp, Homo sapiens
gtgcgccagctcaaggggaggc

SEQ ID NO: 11557 - DNA, 22 bp, Homo sapiens
acgatgatgaaagagaacattc

SEQ ID NO: 11558 - DNA, 22 bp, Homo sapiens
cagccacttgtgatgctgggga

SEQ ID NO: 11559 - DNA, 22 bp, Homo sapiens
ccacactccccgcaggcgtagg

SEQ ID NO: 11560 - DNA, 22 bp, Homo sapiens
tcaccaggctagagtgcagtgg

SEQ ID NO: 11561 - DNA, 22 bp, Homo sapiens
tgggcagggagctggaaccaca

SEQ ID NO: 11562 - DNA, 22 bp, Homo sapiens
ggctgggctccgggagcatgcg

SEQ ID NO: 11563 - DNA, 22 bp, Homo sapiens
ttttcagaattagcataccatt

SEQ ID NO: 11564 - DNA, 22 bp, Homo sapiens
caggccggggcggcgccatctt

SEQ ID NO: 11565 - DNA, 22 bp, Homo sapiens
tttgtagcagcatgatttataa

SEQ ID NO: 11566 - DNA, 22 bp, Homo sapiens
gtactagagatgtgtgcgggta

SEQ ID NO: 11567 - DNA, 22 bp, Homo sapiens
gagatgggcgagaaggtggact

SEQ ID NO: 11568 - DNA, 22 bp, Homo sapiens
catgctgtgtgttttagctcca

SEQ ID NO: 11569 - DNA, 22 bp, Homo sapiens
agccacacagcttaatgacaga

SEQ ID NO: 11570 - DNA, 22 bp, Homo sapiens
tctctcttttttgaacccgctc

SEQ ID NO: 11571 - DNA, 22 bp, Homo sapiens
aggtacatggggtgtgtgcacg

SEQ ID NO: 11572 - DNA, 22 bp, Homo sapiens
tagaggttgacagtgactgtga

SEQ ID NO: 11573 - DNA, 22 bp, Homo sapiens
ctgcatccatgttgctgcaaag

SEQ ID NO: 11574 - DNA, 22 bp, Homo sapiens
gatgcagtgcttaaatcatttg

SEQ ID NO: 11575 - DNA, 22 bp, Homo sapiens
atcatgttttaattagcaaact

SEQ ID NO: 11576 - DNA, 22 bp, Homo sapiens
ctggcctcggcagcaggaacag

SEQ ID NO: 11577 - DNA, 22 bp, Homo sapiens
tggcccagtatgtataatctta

SEQ ID NO: 11578 - DNA, 22 bp, Homo sapiens
gagagcaggaggcagcgggacg

SEQ ID NO: 11579 - DNA, 22 bp, Homo sapiens
cactgcactccatcctgggaaa

SEQ ID NO: 11580 - DNA, 22 bp, Homo sapiens
tataaagagtctcaaagaagtt

SEQ ID NO: 11581 - DNA, 22 bp, Homo sapiens
tcttggccactaccacctggag

SEQ ID NO: 11582 - DNA, 22 bp, Homo sapiens
taacctctctgtgcctcagttt

SEQ ID NO: 11583 - DNA, 22 bp, Homo sapiens
tgagcccagagatctgagctat

SEQ ID NO: 11584 - DNA, 22 bp, Homo sapiens
cacctctcatttctacagattc

SEQ ID NO: 11585 - DNA, 22 bp, Homo sapiens
atgctttctcttagttcattga

SEQ ID NO: 11586 - DNA, 22 bp, Homo sapiens
aaatatcttaggagtatatgag

SEQ ID NO: 11587 - DNA, 22 bp, Homo sapiens
aggcttttctccagaatgtact

SEQ ID NO: 11588 - DNA, 23 bp, Homo sapiens
agctctgctcgggcatgccctgc

SEQ ID NO: 11589 - DNA, 22 bp, Homo sapiens
aagcatttcaggtagagatatt

SEQ ID NO: 11590 - DNA, 22 bp, Homo sapiens
gtgcaattcactgttatgtctg

SEQ ID NO: 11591 - DNA, 22 bp, Homo sapiens
ccagccgcggtgagggtggctg

SEQ ID NO: 11592 - DNA, 22 bp, Homo sapiens
ctgcagtcatctgaagattttg

SEQ ID NO: 11593 - DNA, 22 bp, Homo sapiens
gagaaagctaaataagttgatt

SEQ ID NO: 11594 - DNA, 22 bp, Homo sapiens
tgcttctgactaagctgcatga

SEQ ID NO: 11595 - DNA, 22 bp, Homo sapiens
cccagctcttcaagtcaccccc

SEQ ID NO: 11596 - DNA, 22 bp, Homo sapiens
tttaggttttttcacgtggcta

SEQ ID NO: 11597 - DNA, 22 bp, Homo sapiens
taccaccatttgcctgctgtat

SEQ ID NO: 11598 - DNA, 22 bp, Homo sapiens
taatatctacttcatagagttt

SEQ ID NO: 11599 - DNA, 22 bp, Homo sapiens
ccacagtctatgcaacaaggtc

SEQ ID NO: 11600 - DNA, 22 bp, Homo sapiens
ttagtttataattcatttctgt

SEQ ID NO: 11601 - DNA, 22 bp, Homo sapiens
cgtctctggcccggcccctggg

SEQ ID NO: 11602 - DNA, 22 bp, Homo sapiens
tgagcctgagttcaaggctgca

SEQ ID NO: 11603 - DNA, 22 bp, Homo sapiens
agggaaatctcagctctaaaat

SEQ ID NO: 11604 - DNA, 22 bp, Homo sapiens
tgtctttgttattgtggacagg

SEQ ID NO: 11605 - DNA, 22 bp, Homo sapiens
ctgcgggctgtcaggcgtgcca

SEQ ID NO: 11606 - DNA, 22 bp, Homo sapiens
ttttgagatggtgtctcgctcc

SEQ ID NO: 11607 - DNA, 22 bp, Homo sapiens
aaaggctttaaaatgtacatat

SEQ ID NO: 11608 - DNA, 22 bp, Homo sapiens
ctcggagggcaacagaagtgct

SEQ ID NO: 11609 - DNA, 17 bp, Homo sapiens
cactagtagtctctggc

SEQ ID NO: 11610 - DNA, 22 bp, Homo sapiens
caggagctcagatgacatctca

SEQ ID NO: 11611 - DNA, 22 bp, Homo sapiens
caggctggagtgcaatgacgcc

SEQ ID NO: 11612 - DNA, 22 bp, Homo sapiens
gctgggttttcttccgggccta

SEQ ID NO: 11613 - DNA, 22 bp, Homo sapiens
gagccaggttggaggctgcagt

SEQ ID NO: 11614 - DNA, 22 bp, Homo sapiens
tgagcctgtcattattcagaga

SEQ ID NO: 11615 - DNA, 22 bp, Homo sapiens
tctgcatattgttaatggaatg

SEQ ID NO: 11616 - DNA, 19 bp, Homo sapiens
gctggatggatcctggagt

SEQ ID NO: 11617 - DNA, 22 bp, Homo sapiens
cattacagaatatgtaatgatc

SEQ ID NO: 11618 - DNA, 22 bp, Homo sapiens
tgacagtgcgggtacatcatag

SEQ ID NO: 11619 - DNA, 18 bp, Homo sapiens
ccgggctttggtgacaca

SEQ ID NO: 11620 - DNA, 22 bp, Homo sapiens
caggaagctgtgaaggagacgg

SEQ ID NO: 11621 - DNA, 22 bp, Homo sapiens
gataccagacagggagggagaa

SEQ ID NO: 11622 - DNA, 22 bp, Homo sapiens
gtgcaaaagtaattgtggtttt

SEQ ID NO: 11623 - DNA, 19 bp, Homo sapiens
gccttcccaccacccgtcc

SEQ ID NO: 11624 - DNA, 22 bp, Homo sapiens
ggactgggaatcagggagatgc

SEQ ID NO: 11625 - DNA, 22 bp, Homo sapiens
tttgtcttatccaatctctcag

SEQ ID NO: 11626 - DNA, 19 bp, Homo sapiens
aggctaaagagtcttgcgt

SEQ ID NO: 11627 - DNA, 22 bp, Homo sapiens
gtctcccagcctacatctttct

SEQ ID NO: 11628 - DNA, 22 bp, Homo sapiens
aactatgttaataagtttcatt

SEQ ID NO: 11629 - DNA, 22 bp, Homo sapiens
tggttaagtccagaaaggaagc

SEQ ID NO: 11630 - DNA, 22 bp, Homo sapiens
cctgccctgctcactgtcggta

SEQ ID NO: 11631 - DNA, 22 bp, Homo sapiens
tggccgggaagggacagtgtgg

SEQ ID NO: 11632 - DNA, 22 bp, Homo sapiens
tgcctcaagccctccactgcac

SEQ ID NO: 11633 - DNA, 22 bp, Homo sapiens
tgttatcctcagctcacctcta

SEQ ID NO: 11634 - DNA, 22 bp, Homo sapiens
agaaagtgcttccctttggact

SEQ ID NO: 11635 - DNA, 22 bp, Homo sapiens
tggatctcggcaatgcgggact

SEQ ID NO: 11636 - DNA, 22 bp, Homo sapiens
ggcatgcacccggtgaccatga

SEQ ID NO: 11637 - DNA, 22 bp, Homo sapiens
ttgggcctctcaaagtgctggg

SEQ ID NO: 11638 - DNA, 22 bp, Homo sapiens
tgggccgtggagcactctgaga

SEQ ID NO: 11639 - DNA, 22 bp, Homo sapiens
gcgtctgagttgcgggggctca

SEQ ID NO: 11640 - DNA, 22 bp, Homo sapiens
ttcctagggcagagccgctggg

SEQ ID NO: 11641 - DNA, 22 bp, Homo sapiens
acctcctggcctcaagcaatcc

SEQ ID NO: 11642 - DNA, 22 bp, Homo sapiens
tgggaaggggagctggaaagga

SEQ ID NO: 11643 - DNA, 22 bp, Homo sapiens
aagcccttggcgcacaccgggc

SEQ ID NO: 11644 - DNA, 22 bp, Homo sapiens
cagagctggtgtgtcctggcat

SEQ ID NO: 11645 - DNA, 22 bp, Homo sapiens
atttgtgggactataatgcagg

SEQ ID NO: 11646 - DNA, 22 bp, Homo sapiens
ggccctggcagccacgaaagcc

SEQ ID NO: 11647 - DNA, 22 bp, Homo sapiens
ccaggggttggaggttgcagtg

SEQ ID NO: 11648 - DNA, 19 bp, Homo sapiens
gcagacaggtccagagagg

SEQ ID NO: 11649 - DNA, 22 bp, Homo sapiens
gcggcccgagcaggacgggtgg

SEQ ID NO: 11650 - DNA, 22 bp, Homo sapiens
cactaggcgccgggtggctgtg

SEQ ID NO: 11651 - DNA, 21 bp, Homo sapiens
ccaccaggtcttctgctcggg

SEQ ID NO: 11652 - DNA, 22 bp, Homo sapiens
tctgcgttgctcacgctgggag

SEQ ID NO: 11653 - DNA, 22 bp, Homo sapiens
ctctcctattgtgtggtaagga

SEQ ID NO: 11654 - DNA, 22 bp, Homo sapiens
gcctccccaagcagcagggatt

SEQ ID NO: 11655 - DNA, 22 bp, Homo sapiens
agggccagcactcctggcagga

SEQ ID NO: 11656 - DNA, 22 bp, Homo sapiens
tccccatgtctgcagggagggt

SEQ ID NO: 11657 - DNA, 18 bp, Homo sapiens
gaaagatgaacttttttc

SEQ ID NO: 11658 - DNA, 21 bp, Homo sapiens
ttcagcttgctgactgcggca

SEQ ID NO: 11659 - DNA, 22 bp, Homo sapiens
atagttttaaaacctcaggaag

SEQ ID NO: 11660 - DNA, 22 bp, Homo sapiens
cacagggcttctcatggggtgc

SEQ ID NO: 11661 - DNA, 22 bp, Homo sapiens
gggctagcctcttccctgctcc

SEQ ID NO: 11662 - DNA, 22 bp, Homo sapiens
ttgcatagtgctgaggttcggg

SEQ ID NO: 11663 - DNA, 22 bp, Homo sapiens
tccattatacttctgattcaaa

SEQ ID NO: 11664 - DNA, 22 bp, Homo sapiens
tctcaagcttgttggtatgttt

SEQ ID NO: 11665 - DNA, 22 bp, Homo sapiens
tcgcccaggatggagtgcagta

SEQ ID NO: 11666 - DNA, 22 bp, Homo sapiens
tgtgacagcacggttcaactgc

SEQ ID NO: 11667 - DNA, 18 bp, Homo sapiens
tctgtgggatcagtgagg

SEQ ID NO: 11668 - DNA, 22 bp, Homo sapiens
aggcgagaggcttgggctagta

SEQ ID NO: 11669 - DNA, 22 bp, Homo sapiens
tgaactgtacatccctaaccta

SEQ ID NO: 11670 - DNA, 22 bp, Homo sapiens
ggtgaagtaatgaaacagggag

SEQ ID NO: 11671 - DNA, 22 bp, Homo sapiens
gcggcggagacagcaggaagcc

SEQ ID NO: 11672 - DNA, 22 bp, Homo sapiens
cccatgcaccctctaagaagga

SEQ ID NO: 11673 - DNA, 22 bp, Homo sapiens
tgggtgctctgcgaccgtaggg

SEQ ID NO: 11674 - DNA, 22 bp, Homo sapiens
tggccttggccgtgctggggtc

SEQ ID NO: 11675 - DNA, 22 bp, Homo sapiens
caggctggagttcagtggtgtg

SEQ ID NO: 11676 - DNA, 22 bp, Homo sapiens
tcaggtactgcagggcacgcag

SEQ ID NO: 11677 - DNA, 22 bp, Homo sapiens
agaacagaggccttatgtttca

SEQ ID NO: 11678 - DNA, 22 bp, Homo sapiens
atatgcagtctcttgcccttct

SEQ ID NO: 11679 - DNA, 21 bp, Homo sapiens
ggtgacacgtggccccgctct

SEQ ID NO: 11680 - DNA, 23 bp, Homo sapiens
ccactagcacctgttcaacttct

SEQ ID NO: 11681 - DNA, 22 bp, Homo sapiens
gttattgaggtggagtctcact

SEQ ID NO: 11682 - DNA, 21 bp, Homo sapiens
ggagtttttctggaagggact

SEQ ID NO: 11683 - DNA, 22 bp, Homo sapiens
attgattttcagactatgcgag

SEQ ID NO: 11684 - DNA, 22 bp, Homo sapiens
tgaatgtgatgctaaacatatg

SEQ ID NO: 11685 - DNA, 22 bp, Homo sapiens
ttctggaaggatgtttctatct

SEQ ID NO: 11686 - DNA, 19 bp, Homo sapiens
ctgtccttggctgcactgt

SEQ ID NO: 11687 - DNA, 22 bp, Homo sapiens
ctagttctagatccctgaggaa

SEQ ID NO: 11688 - DNA, 20 bp, Homo sapiens
agagatggggtatcaccgta

SEQ ID NO: 11689 - DNA, 22 bp, Homo sapiens
atttggcagtataaattctggc

SEQ ID NO: 11690 - DNA, 22 bp, Homo sapiens
agatacattgcacgatgcagat

SEQ ID NO: 11691 - DNA, 22 bp, Homo sapiens
ttcctggtctatttagaattgc

SEQ ID NO: 11692 - DNA, 22 bp, Homo sapiens
atggcagcggagctggaaatga

SEQ ID NO: 11693 - DNA, 22 bp, Homo sapiens
tttaagaagttatgttataaat

SEQ ID NO: 11694 - DNA, 22 bp, Homo sapiens
cgggcaccaccctggtgtgtcc

SEQ ID NO: 11695 - DNA, 22 bp, Homo sapiens
gtaggtcagacataagaggaca

SEQ ID NO: 11696 - DNA, 22 bp, Homo sapiens
tctctatttgcctaggcttgtg

SEQ ID NO: 11697 - DNA, 22 bp, Homo sapiens
aaggtccttttgcagtgtgatc

SEQ ID NO: 11698 - DNA, 22 bp, Homo sapiens
taaattgagattattagggtaa

SEQ ID NO: 11699 - DNA, 22 bp, Homo sapiens
tttcccaggctggaatgcagtg

SEQ ID NO: 11700 - DNA, 23 bp, Homo sapiens
gggggccgtcctggggattatag

SEQ ID NO: 11701 - DNA, 22 bp, Homo sapiens
ggctccccaggtccaggagctg

SEQ ID NO: 11702 - DNA, 22 bp, Homo sapiens
ttctatttttgtggaactgtag

SEQ ID NO: 11703 - DNA, 23 bp, Homo sapiens
tgaatgtttattctcggtgcaga

SEQ ID NO: 11704 - DNA, 22 bp, Homo sapiens
tttaatgtagcgtgaaatgatt

SEQ ID NO: 11705 - DNA, 22 bp, Homo sapiens
atgccactgcacttcagcctgg

SEQ ID NO: 11706 - DNA, 22 bp, Homo sapiens
ttattagagtgctttgagaaag

SEQ ID NO: 11707 - DNA, 22 bp, Homo sapiens
agaaagtgcttccctttggtga

SEQ ID NO: 11708 - DNA, 22 bp, Homo sapiens
gaggctgaggttgcagtgagcc

SEQ ID NO: 11709 - DNA, 22 bp, Homo sapiens
cgcccaggctggagtgcagtgg

SEQ ID NO: 11710 - DNA, 22 bp, Homo sapiens
cattgcaacttcaaactcctgg

SEQ ID NO: 11711 - DNA, 22 bp, Homo sapiens
aggaagatgtgcaaagttggaa

SEQ ID NO: 11712 - DNA, 22 bp, Homo sapiens
aagtggcagttcaggaagcaga

SEQ ID NO: 11713 - DNA, 22 bp, Homo sapiens
aataaacaaaggacaaggaggt

SEQ ID NO: 11714 - DNA, 22 bp, Homo sapiens
ctcactgcaagctctgcctcca

SEQ ID NO: 11715 - DNA, 22 bp, Homo sapiens
tcaactaactctattatttgaa

SEQ ID NO: 11716 - DNA, 22 bp, Homo sapiens
acactctagagggaagcgcttt

SEQ ID NO: 11717 - DNA, 22 bp, Homo sapiens
cttgatgagtcagaactgaagg

SEQ ID NO: 11718 - DNA, 22 bp, Homo sapiens
acatctagactcttgccctctt

SEQ ID NO: 11719 - DNA, 22 bp, Homo sapiens
gtgagcagagatcgcgtgattg

SEQ ID NO: 11720 - DNA, 22 bp, Homo sapiens
cacagagctggaaaggctgggc

SEQ ID NO: 11721 - DNA, 19 bp, Homo sapiens
ttctggtctggaatcaagg

SEQ ID NO: 11722 - DNA, 22 bp, Homo sapiens
aaagaggcaatcaatgtagcaa

SEQ ID NO: 11723 - DNA, 22 bp, Homo sapiens
agtggcctggagccccgcctgg

SEQ ID NO: 11724 - DNA, 22 bp, Homo sapiens
ctgcagggagaggggacagcct

SEQ ID NO: 11725 - DNA, 22 bp, Homo sapiens
ccatgaattcactccatgctag

SEQ ID NO: 11726 - DNA, 22 bp, Homo sapiens
aaggaggcctggcagatgaaga

SEQ ID NO: 11727 - DNA, 22 bp, Homo sapiens
acatggcgggagtttcagatac

SEQ ID NO: 11728 - DNA, 22 bp, Homo sapiens
atgtgcacggtgtcaaacgggg

SEQ ID NO: 11729 - DNA, 22 bp, Homo sapiens
aaggagcacacaatctagaacc

SEQ ID NO: 11730 - DNA, 22 bp, Homo sapiens
taggattccagaacagtgctgc

SEQ ID NO: 11731 - DNA, 22 bp, Homo sapiens
tctgtagtaggttgtagttctt

SEQ ID NO: 11732 - DNA, 22 bp, Homo sapiens
tctagcaagctcgtgctcaagg

SEQ ID NO: 11733 - DNA, 22 bp, Homo sapiens
aatactgcctgtgaggtaactc

SEQ ID NO: 11734 - DNA, 22 bp, Homo sapiens
tccttaggaaaatgatgagggg

SEQ ID NO: 11735 - DNA, 22 bp, Homo sapiens
gcccagcacctctctcagggtt

SEQ ID NO: 11736 - DNA, 22 bp, Homo sapiens
tcagccagccagctacaggctt

SEQ ID NO: 11737 - DNA, 22 bp, Homo sapiens
ttaatgaaaggcagtttggaac

SEQ ID NO: 11738 - DNA, 22 bp, Homo sapiens
tcaggctcaggttaggggccaa

SEQ ID NO: 11739 - DNA, 22 bp, Homo sapiens
tttagcgtagctgacagctaat

SEQ ID NO: 11740 - DNA, 22 bp, Homo sapiens
attctggacaaggcaagctcct

SEQ ID NO: 11741 - DNA, 22 bp, Homo sapiens
ttaagtgcaaaaatgaaagtat

SEQ ID NO: 11742 - DNA, 22 bp, Homo sapiens
aggaggggttctcgggtgctga

SEQ ID NO: 11743 - DNA, 22 bp, Homo sapiens
ttatttaatgtgatctgaagag

SEQ ID NO: 11744 - DNA, 22 bp, Homo sapiens
ttagacatgatggtgcagagag

SEQ ID NO: 11745 - DNA, 22 bp, Homo sapiens
cagccagtgtgaccgaggagga

SEQ ID NO: 11746 - DNA, 22 bp, Homo sapiens
ccactgcacttcagcctgggtg

SEQ ID NO: 11747 - DNA, 22 bp, Homo sapiens
accttcaggtgagcacacagat

SEQ ID NO: 11748 - DNA, 19 bp, Homo sapiens
gcataaatacactattgtc

SEQ ID NO: 11749 - DNA, 22 bp, Homo sapiens
gcacagagagggaaggtaactt

SEQ ID NO: 11750 - DNA, 22 bp, Homo sapiens
tgagctgtagcagatgctgttg

SEQ ID NO: 11751 - DNA, 22 bp, Homo sapiens
tgctgagcccagaacggcctgg

SEQ ID NO: 11752 - DNA, 22 bp, Homo sapiens
acattacctggcatttgatctt

SEQ ID NO: 11753 - DNA, 22 bp, Homo sapiens
gagaacagaagcattcctaatt

SEQ ID NO: 11754 - DNA, 22 bp, Homo sapiens
aggtcacccgtttgactatcca

SEQ ID NO: 11755 - DNA, 21 bp, Homo sapiens
cagagctgtccaaaccctgac

SEQ ID NO: 11756 - DNA, 22 bp, Homo sapiens
ctgtcctgtgctttttactgtc

SEQ ID NO: 11757 - DNA, 22 bp, Homo sapiens
tggcacagactgggccaaggaa

SEQ ID NO: 11758 - DNA, 23 bp, Homo sapiens
ttgtcctctggatcggtttggtt

SEQ ID NO: 11759 - DNA, 22 bp, Homo sapiens
tggccttgagagatcaaaaggt

SEQ ID NO: 11760 - DNA, 22 bp, Homo sapiens
cagcctttgggtcagaagattc

SEQ ID NO: 11761 - DNA, 22 bp, Homo sapiens
gaggctgaggcaggaggatcac

SEQ ID NO: 11762 - DNA, 22 bp, Homo sapiens
tccacagtggttgaactagttt

SEQ ID NO: 11763 - DNA, 22 bp, Homo sapiens
agctcttacatttaggtctatg

SEQ ID NO: 11764 - DNA, 22 bp, Homo sapiens
agtatgtcagagtgaaaatggt

SEQ ID NO: 11765 - DNA, 22 bp, Homo sapiens
gcagcctgggcaacagagtgag

SEQ ID NO: 11766 - DNA, 22 bp, Homo sapiens
agtaaaactcacaaaaggatgg

SEQ ID NO: 11767 - DNA, 21 bp, Homo sapiens
ccagagcctgagaggattatg

SEQ ID NO: 11768 - DNA, 22 bp, Homo sapiens
tgtgtggattcatctcaaagag

SEQ ID NO: 11769 - DNA, 22 bp, Homo sapiens
cgcggtggcggcctccagcgcc

SEQ ID NO: 11770 - DNA, 22 bp, Homo sapiens
gtggctcacgtctgtcatctca

SEQ ID NO: 11771 - DNA, 22 bp, Homo sapiens
cactgcactccagcctggcctg

SEQ ID NO: 11772 - DNA, 22 bp, Homo sapiens
ttttcatttttgtagatgcaag

SEQ ID NO: 11773 - DNA, 22 bp, Homo sapiens
aggagagctggtgtctggaatc

SEQ ID NO: 11774 - DNA, 22 bp, Homo sapiens
ttgagactgagtctcgccctgt

SEQ ID NO: 11775 - DNA, 22 bp, Homo sapiens
gaccttgtgatctgcccacctt

SEQ ID NO: 11776 - DNA, 22 bp, Homo sapiens
gctgtatgtgaggccacagtga

SEQ ID NO: 11777 - DNA, 22 bp, Homo sapiens
agcccaggttgaggctgcagtg

SEQ ID NO: 11778 - DNA, 22 bp, Homo sapiens
aaaaaattatcatagttcctga

SEQ ID NO: 11779 - DNA, 22 bp, Homo sapiens
tcacctctactcagcctagttc

SEQ ID NO: 11780 - DNA, 22 bp, Homo sapiens
tccgaggccaaagctgtgaata

SEQ ID NO: 11781 - DNA, 22 bp, Homo sapiens
gggcagccgcgtgacctgccag

SEQ ID NO: 11782 - DNA, 22 bp, Homo sapiens
ttggagaggcagtcttgctctg

SEQ ID NO: 11783 - DNA, 22 bp, Homo sapiens
cttctcttcctttgtcaactga

SEQ ID NO: 11784 - DNA, 22 bp, Homo sapiens
caggctgctgcctagaatgaca

SEQ ID NO: 11785 - DNA, 22 bp, Homo sapiens
gggaggaggaatgttttgtgta

SEQ ID NO: 11786 - DNA, 22 bp, Homo sapiens
gagagaagggggatatgagcct

SEQ ID NO: 11787 - DNA, 22 bp, Homo sapiens
tcaaagatcagatggttgtagg

SEQ ID NO: 11788 - DNA, 22 bp, Homo sapiens
gacagctgcatcctcagacaca

SEQ ID NO: 11789 - DNA, 22 bp, Homo sapiens
cctgttttattctgttgtatct

SEQ ID NO: 11790 - DNA, 22 bp, Homo sapiens
agtgtgttgtaggctcaaatgg

SEQ ID NO: 11791 - DNA, 21 bp, Homo sapiens
cgggaaggaggttctgaccct

SEQ ID NO: 11792 - DNA, 22 bp, Homo sapiens
cactgcactccagcctgggtga

SEQ ID NO: 11793 - DNA, 22 bp, Homo sapiens
aggtagaaggaccagaatttat

SEQ ID NO: 11794 - DNA, 22 bp, Homo sapiens
tggctcactgtagccttgacct

SEQ ID NO: 11795 - DNA, 22 bp, Homo sapiens
ctcagtgaattggaggatggcc

SEQ ID NO: 11796 - DNA, 22 bp, Homo sapiens
ggctcttccgccaccagccaca

SEQ ID NO: 11797 - DNA, 22 bp, Homo sapiens
ctttatgaaaacctgaattatg

SEQ ID NO: 11798 - DNA, 22 bp, Homo sapiens
ctctgtggtggagtgggtcacc

SEQ ID NO: 11799 - DNA, 22 bp, Homo sapiens
aagccaatgctagcccacatgc

SEQ ID NO: 11800 - DNA, 23 bp, Homo sapiens
cagtctgcagcccacttgggcag

SEQ ID NO: 11801 - DNA, 22 bp, Homo sapiens
gtggttcacttgaggtcaggag

SEQ ID NO: 11802 - DNA, 22 bp, Homo sapiens
aatgaattgcagtactgacttg

SEQ ID NO: 11803 - DNA, 22 bp, Homo sapiens
ctgaggcctctcccactccagc

SEQ ID NO: 11804 - DNA, 22 bp, Homo sapiens
agccatttcaacaaccggctgc

SEQ ID NO: 11805 - DNA, 22 bp, Homo sapiens
cccaactactctcaggcagctt

SEQ ID NO: 11806 - DNA, 22 bp, Homo sapiens
tcactgccattagttggttaat

SEQ ID NO: 11807 - DNA, 22 bp, Homo sapiens
cagccccatggtgtgctccagc

SEQ ID NO: 11808 - DNA, 22 bp, Homo sapiens
ttcttcatgggttcttttagga

SEQ ID NO: 11809 - DNA, 22 bp, Homo sapiens
ggcctctcttgggacagctgtc

SEQ ID NO: 11810 - DNA, 22 bp, Homo sapiens
agggagcaaaggtttcagggtt

SEQ ID NO: 11811 - DNA, 22 bp, Homo sapiens
ggggtactggctggagccccac

SEQ ID NO: 11812 - DNA, 22 bp, Homo sapiens
gaccaaggaagaggggagccag

SEQ ID NO: 11813 - DNA, 22 bp, Homo sapiens
tcgtgaggctctgcatcgcaca

SEQ ID NO: 11814 - DNA, 19 bp, Homo sapiens
agggaatccggctgaggga

SEQ ID NO: 11815 - DNA, 22 bp, Homo sapiens
tggacaacatagtgagacctca

SEQ ID NO: 11816 - DNA, 22 bp, Homo sapiens
taagcctgcatgaaccatgaga

SEQ ID NO: 11817 - DNA, 22 bp, Homo sapiens
ctttaattgtagctcccataat

SEQ ID NO: 11818 - DNA, 19 bp, Homo sapiens
atcctttcccacatacttt

SEQ ID NO: 11819 - DNA, 22 bp, Homo sapiens
tcgctgaggctgcacggctgcc

SEQ ID NO: 11820 - DNA, 22 bp, Homo sapiens
gtgtgcacagagctccagtgtt

SEQ ID NO: 11821 - DNA, 22 bp, Homo sapiens
ggtattgttctagctttaaagg

SEQ ID NO: 11822 - DNA, 22 bp, Homo sapiens
attaagtatgcaatggtgcagt

SEQ ID NO: 11823 - DNA, 22 bp, Homo sapiens
ttcctccagccatgattgtaaa

SEQ ID NO: 11824 - DNA, 22 bp, Homo sapiens
tagtggatgttcagagatttga

SEQ ID NO: 11825 - DNA, 22 bp, Homo sapiens
gtagctctgtttaaagttcttt

SEQ ID NO: 11826 - DNA, 22 bp, Homo sapiens
atgtatatgcatgcattcaaag

SEQ ID NO: 11827 - DNA, 22 bp, Homo sapiens
gggttcagtccctcttgctact

SEQ ID NO: 11828 - DNA, 22 bp, Homo sapiens
aaggctccagtgaatgctggca

SEQ ID NO: 11829 - DNA, 21 bp, Homo sapiens
agcgtcaatatcgtcaacagg

SEQ ID NO: 11830 - DNA, 22 bp, Homo sapiens
tgcacgtgggctctctgctctt

SEQ ID NO: 11831 - DNA, 22 bp, Homo sapiens
gctgatagactgaatgttggga

SEQ ID NO: 11832 - DNA, 18 bp, Homo sapiens
gaggtagataagattttc

SEQ ID NO: 11833 - DNA, 22 bp, Homo sapiens
cctgggccctcaccgccggtgg

SEQ ID NO: 11834 - DNA, 20 bp, Homo sapiens
tcccagtctttggtctgagc

SEQ ID NO: 11835 - DNA, 22 bp, Homo sapiens
gcctcagtctcccgagtagctg

SEQ ID NO: 11836 - DNA, 22 bp, Homo sapiens
agaggtgagtcattacctagtg

SEQ ID NO: 11837 - DNA, 22 bp, Homo sapiens
atgcccaatgtcacaatttttg

SEQ ID NO: 11838 - DNA, 22 bp, Homo sapiens
gctggctgacagatttggggtg

SEQ ID NO: 11839 - DNA, 22 bp, Homo sapiens
acatagtgttttgagagacagc

SEQ ID NO: 11840 - DNA, 22 bp, Homo sapiens
gtcacccgtttgactatccacc

SEQ ID NO: 11841 - DNA, 22 bp, Homo sapiens
tccacttccacgtgtgcagaat

SEQ ID NO: 11842 - DNA, 22 bp, Homo sapiens
ctggcctaaaaatacagaacaa

SEQ ID NO: 11843 - DNA, 22 bp, Homo sapiens
ccaggaggcggaaggtacagtg

SEQ ID NO: 11844 - DNA, 23 bp, Homo sapiens
agaaagtcatggccaggtttgat

SEQ ID NO: 11845 - DNA, 22 bp, Homo sapiens
tgagatggagtctcgctctgtt

SEQ ID NO: 11846 - DNA, 18 bp, Homo sapiens
agagtatacagacaacaa

SEQ ID NO: 11847 - DNA, 22 bp, Homo sapiens
ccaagggcgcctccgttccccc

SEQ ID NO: 11848 - DNA, 22 bp, Homo sapiens
gtgtgggctgcagaggcacagc

SEQ ID NO: 11849 - DNA, 22 bp, Homo sapiens
cccttggggtggaggttgcagt

SEQ ID NO: 11850 - DNA, 22 bp, Homo sapiens
gggaatgtagcaaatctgcaat

SEQ ID NO: 11851 - DNA, 22 bp, Homo sapiens
ggggtggatttcaggcggtgtc

SEQ ID NO: 11852 - DNA, 22 bp, Homo sapiens
ttcttctaaatgtgcttattaa

SEQ ID NO: 11853 - DNA, 22 bp, Homo sapiens
ttcacagtggtagtgcatttag

SEQ ID NO: 11854 - DNA, 22 bp, Homo sapiens
tgatatgtaactactccttata

SEQ ID NO: 11855 - DNA, 21 bp, Homo sapiens
agtggctctcagcttgctaag

SEQ ID NO: 11856 - DNA, 22 bp, Homo sapiens
agggaattcactggaacgccct

SEQ ID NO: 11857 - DNA, 22 bp, Homo sapiens
cccaggaggcgcaggttgcggt

SEQ ID NO: 11858 - DNA, 22 bp, Homo sapiens
cttgtattaggaagaatgcttt

SEQ ID NO: 11859 - DNA, 22 bp, Homo sapiens
ctttttcctcgtagagcctaat

SEQ ID NO: 11860 - DNA, 22 bp, Homo sapiens
agtctagtaggatctctgggct

SEQ ID NO: 11861 - DNA, 22 bp, Homo sapiens
tgatatgtccctcgacatcagg

SEQ ID NO: 11862 - DNA, 19 bp, Homo sapiens
ttcacattggaagaagtag

SEQ ID NO: 11863 - DNA, 22 bp, Homo sapiens
agccagatgaagaggtccttaa

SEQ ID NO: 11864 - DNA, 22 bp, Homo sapiens
accccactcacacatggacctg

SEQ ID NO: 11865 - DNA, 22 bp, Homo sapiens
ctgttaggttaaggaatggcaa

SEQ ID NO: 11866 - DNA, 22 bp, Homo sapiens
tcaccaggctggagtgcagtgg

SEQ ID NO: 11867 - DNA, 22 bp, Homo sapiens
tgcctaggctggagtgtagtgg

SEQ ID NO: 11868 - DNA, 22 bp, Homo sapiens
ggcgccccatgatgagggctag

SEQ ID NO: 11869 - DNA, 22 bp, Homo sapiens
gctgtcttgctcactcttgcag

SEQ ID NO: 11870 - DNA, 22 bp, Homo sapiens
tagcataacaggtaagagtgag

SEQ ID NO: 11871 - DNA, 22 bp, Homo sapiens
agccccttgtgggcgcacagca

SEQ ID NO: 11872 - DNA, 22 bp, Homo sapiens
tgtccttatctccaaacaatca

SEQ ID NO: 11873 - DNA, 22 bp, Homo sapiens
gtcactgtatccaggttccagc

SEQ ID NO: 11874 - DNA, 22 bp, Homo sapiens
tacagcctggcactaccctggg

SEQ ID NO: 11875 - DNA, 22 bp, Homo sapiens
aaacccagggttttgtcttccc

SEQ ID NO: 11876 - DNA, 22 bp, Homo sapiens
ttgtggttaaccgcacattttt

SEQ ID NO: 11877 - DNA, 22 bp, Homo sapiens
tgtgtctttgttccaggtacga

SEQ ID NO: 11878 - DNA, 22 bp, Homo sapiens
tggagaagattggtcaccattc

SEQ ID NO: 11879 - DNA, 22 bp, Homo sapiens
agtgaggggcagctgagtgggc

SEQ ID NO: 11880 - DNA, 22 bp, Homo sapiens
actgcactccagcctgggtgat

SEQ ID NO: 11881 - DNA, 22 bp, Homo sapiens
gcccagtggtaaaagcaggcct

SEQ ID NO: 11882 - DNA, 23 bp, Homo sapiens
gacagagtgagaccttgtcttac

SEQ ID NO: 11883 - DNA, 22 bp, Homo sapiens
ccaagctacttaggagtctgag

SEQ ID NO: 11884 - DNA, 22 bp, Homo sapiens
ggctgagctccaagtattccat

SEQ ID NO: 11885 - DNA, 22 bp, Homo sapiens
ccagaccctccattcaagctcc

SEQ ID NO: 11886 - DNA, 22 bp, Homo sapiens
tttcttggggctcctgcgccat

SEQ ID NO: 11887 - DNA, 22 bp, Homo sapiens
atgatggctaggctggttttga

SEQ ID NO: 11888 - DNA, 22 bp, Homo sapiens
agtggccagcagcctagcctag

SEQ ID NO: 11889 - DNA, 22 bp, Homo sapiens
tggcatctttgtcccagaagct

SEQ ID NO: 11890 - DNA, 22 bp, Homo sapiens
gaggaccactgcttagtaagat

SEQ ID NO: 11891 - DNA, 22 bp, Homo sapiens
actgattgcattcatagggttt

SEQ ID NO: 11892 - DNA, 22 bp, Homo sapiens
atgggatgatcacctgagctca

SEQ ID NO: 11893 - DNA, 22 bp, Homo sapiens
ccccacaactcatgttgaaact

SEQ ID NO: 11894 - DNA, 22 bp, Homo sapiens
tcttgcacttcatgaatatgtt

SEQ ID NO: 11895 - DNA, 22 bp, Homo sapiens
ctacaaaagtaattgtggtttt

SEQ ID NO: 11896 - DNA, 22 bp, Homo sapiens
agggtgaatctcacaactctta

SEQ ID NO: 11897 - DNA, 22 bp, Homo sapiens
aaggaggttatcccagtggact

SEQ ID NO: 11898 - DNA, 22 bp, Homo sapiens
ttgtgctctgtgttatttaagg

SEQ ID NO: 11899 - DNA, 22 bp, Homo sapiens
ctgccgtgtttttcatgttaaa

SEQ ID NO: 11900 - DNA, 20 bp, Homo sapiens
agcggctggcggaggacacg

SEQ ID NO: 11901 - DNA, 22 bp, Homo sapiens
tatggctaattctttactgacc

SEQ ID NO: 11902 - DNA, 22 bp, Homo sapiens
tgccaggcgtggtggtgcgcac

SEQ ID NO: 11903 - DNA, 22 bp, Homo sapiens
tatgccactgctctccatccta

SEQ ID NO: 11904 - DNA, 22 bp, Homo sapiens
ccggagtgtctggcctgctggg

SEQ ID NO: 11905 - DNA, 22 bp, Homo sapiens
tctcgtgcaggccttgctcgga

SEQ ID NO: 11906 - DNA, 22 bp, Homo sapiens
tacgggcacgcaccacgatgcc

SEQ ID NO: 11907 - DNA, 22 bp, Homo sapiens
cgctgcgaggcgcccttgttgc

SEQ ID NO: 11908 - DNA, 22 bp, Homo sapiens
ggcctcacccatcggtgccttt

SEQ ID NO: 11909 - DNA, 22 bp, Homo sapiens
ctacccttaagtttctgtgggg

SEQ ID NO: 11910 - DNA, 22 bp, Homo sapiens
aacccaggaggcggaggttgtg

SEQ ID NO: 11911 - DNA, 22 bp, Homo sapiens
tcctggtgctgacacccatagc

SEQ ID NO: 11912 - DNA, 22 bp, Homo sapiens
aagtgattgttccgttgagtgt

SEQ ID NO: 11913 - DNA, 22 bp, Homo sapiens
tgccgtggggctgaggctggag

SEQ ID NO: 11914 - DNA, 22 bp, Homo sapiens
acaatgctccctgtagtcagga

SEQ ID NO: 11915 - DNA, 22 bp, Homo sapiens
gccaggctgaggctctggaaga

SEQ ID NO: 11916 - DNA, 22 bp, Homo sapiens
aataaacaaatccttccttccc

SEQ ID NO: 11917 - DNA, 22 bp, Homo sapiens
aggggagagttaatgtgaatgt

SEQ ID NO: 11918 - DNA, 22 bp, Homo sapiens
gggggaagaaagaacatggcat

SEQ ID NO: 11919 - DNA, 21 bp, Homo sapiens
tcttttctcagctttgtggtt

SEQ ID NO: 11920 - DNA, 22 bp, Homo sapiens
ctcctgcttcacgggcaccgcc

SEQ ID NO: 11921 - DNA, 21 bp, Homo sapiens
acagcctccatctcctgggct

SEQ ID NO: 11922 - DNA, 17 bp, Homo sapiens
aatgtccttggaccaca

SEQ ID NO: 11923 - DNA, 22 bp, Homo sapiens
ctggggaacgcagcgagcagcg

SEQ ID NO: 11924 - DNA, 22 bp, Homo sapiens
ggctcctgggggtgctcctgcc

SEQ ID NO: 11925 - DNA, 22 bp, Homo sapiens
cagcgtctcgttgtgggcctcg

SEQ ID NO: 11926 - DNA, 22 bp, Homo sapiens
cctgcgggctgtgctgaagcct

SEQ ID NO: 11927 - DNA, 22 bp, Homo sapiens
tgtcttcaggagtaaatatcat

SEQ ID NO: 11928 - DNA, 22 bp, Homo sapiens
ttgaggcctgctggaaggtgtt

SEQ ID NO: 11929 - DNA, 22 bp, Homo sapiens
aggaatggtgctcagcagaaat

SEQ ID NO: 11930 - DNA, 22 bp, Homo sapiens
aacccaggagttggaggctgtg

SEQ ID NO: 11931 - DNA, 22 bp, Homo sapiens
catggcggtcaggatgtaggtg

SEQ ID NO: 11932 - DNA, 22 bp, Homo sapiens
taattataacatgctttctggc

SEQ ID NO: 11933 - DNA, 22 bp, Homo sapiens
cctggaggcggaggttgcagtg

SEQ ID NO: 11934 - DNA, 22 bp, Homo sapiens
tggaatgcagtgggagcttacc

SEQ ID NO: 11935 - DNA, 20 bp, Homo sapiens
tgtttgtgtggggccttggc

SEQ ID NO: 11936 - DNA, 22 bp, Homo sapiens
caagggaattgtgtgtgagagg

SEQ ID NO: 11937 - DNA, 22 bp, Homo sapiens
ggcgtggggccttctgcccgct

SEQ ID NO: 11938 - DNA, 22 bp, Homo sapiens
gcagaccctgaactgggcatgg

SEQ ID NO: 11939 - DNA, 22 bp, Homo sapiens
tgccatagcaatggtaagctga

SEQ ID NO: 11940 - DNA, 22 bp, Homo sapiens
ggttttatcctacccacacagc

SEQ ID NO: 11941 - DNA, 22 bp, Homo sapiens
cacatgaaggctggggtcgtga

SEQ ID NO: 11942 - DNA, 22 bp, Homo sapiens
aaaagtcttggggaaggccagg

SEQ ID NO: 11943 - DNA, 17 bp, Homo sapiens
agttggcagccgttgct

SEQ ID NO: 11944 - DNA, 18 bp, Homo sapiens
cttttcccctttggactc

SEQ ID NO: 11945 - DNA, 22 bp, Homo sapiens
aacactctctgttggtaaggct

SEQ ID NO: 11946 - DNA, 22 bp, Homo sapiens
ggagagtggattccagctgtat

SEQ ID NO: 11947 - DNA, 22 bp, Homo sapiens
aatgttgcagagtgattgtcca

SEQ ID NO: 11948 - DNA, 22 bp, Homo sapiens
ggcggtctcagcaccctcttgg

SEQ ID NO: 11949 - DNA, 22 bp, Homo sapiens
ggtgggaggactgtttgaggca

SEQ ID NO: 11950 - DNA, 22 bp, Homo sapiens
cactccagcctcagtgacagag

SEQ ID NO: 11951 - DNA, 20 bp, Homo sapiens
ggcctcggacttcatcgtag

SEQ ID NO: 11952 - DNA, 22 bp, Homo sapiens
tttctcttcactgtgtgcctca

SEQ ID NO: 11953 - DNA, 22 bp, Homo sapiens
tgccctggctcttcttgttcca

SEQ ID NO: 11954 - DNA, 22 bp, Homo sapiens
tgggcttggtttctaggtaggt

SEQ ID NO: 11955 - DNA, 22 bp, Homo sapiens
gccaggcgggtctcaaactcct

SEQ ID NO: 11956 - DNA, 22 bp, Homo sapiens
aagtggactaatacaaggacta

SEQ ID NO: 11957 - DNA, 21 bp, Homo sapiens
gtggttctagagaaacagaat

SEQ ID NO: 11958 - DNA, 22 bp, Homo sapiens
tttcttaggctctaaaatgact

SEQ ID NO: 11959 - DNA, 22 bp, Homo sapiens
gctggtgagcaaaggagaagga

SEQ ID NO: 11960 - DNA, 22 bp, Homo sapiens
gctgatggaaggacaggcgccg

SEQ ID NO: 11961 - DNA, 22 bp, Homo sapiens
ttcccacattctttacattcat

SEQ ID NO: 11962 - DNA, 22 bp, Homo sapiens
gtccttccacatggccaacttc

SEQ ID NO: 11963 - DNA, 22 bp, Homo sapiens
tgttgagtatatacctacaagt

SEQ ID NO: 11964 - DNA, 22 bp, Homo sapiens
ctgctgaggtggagattgcagt

SEQ ID NO: 11965 - DNA, 23 bp, Homo sapiens
tgctggagaagcaaagttctgag

SEQ ID NO: 11966 - DNA, 22 bp, Homo sapiens
accaggcccgctgctatggtgg

SEQ ID NO: 11967 - DNA, 22 bp, Homo sapiens
aggtctcttgctgtctctgggc

SEQ ID NO: 11968 - DNA, 22 bp, Homo sapiens
atcaacatgtcataaagtgaaa

SEQ ID NO: 11969 - DNA, 22 bp, Homo sapiens
cagttccctccgccagcacttc

SEQ ID NO: 11970 - DNA, 16 bp, Homo sapiens
ggcaggcgcggagccc

SEQ ID NO: 11971 - DNA, 22 bp, Homo sapiens
tgaactcctgacctcatgatcc

SEQ ID NO: 11972 - DNA, 22 bp, Homo sapiens
tagtcagtgcacagacacttgt

SEQ ID NO: 11973 - DNA, 22 bp, Homo sapiens
gatttttatataaagtgagaaa

SEQ ID NO: 11974 - DNA, 22 bp, Homo sapiens
gggctgtgaggtgagaacttac

SEQ ID NO: 11975 - DNA, 22 bp, Homo sapiens
gagctactgaaatattgatttt

SEQ ID NO: 11976 - DNA, 22 bp, Homo sapiens
ctctgcaagtccagcccctggc

SEQ ID NO: 11977 - DNA, 22 bp, Homo sapiens
ccttttatagatcagtgtgtta

SEQ ID NO: 11978 - DNA, 22 bp, Homo sapiens
tctttctacatcatttgcttct

SEQ ID NO: 11979 - DNA, 22 bp, Homo sapiens
gccctcctggcaggcagtgatg

SEQ ID NO: 11980 - DNA, 18 bp, Homo sapiens
gatatggaaggccatgcc

SEQ ID NO: 11981 - DNA, 22 bp, Homo sapiens
tcgtctgtgaaattgggataag

SEQ ID NO: 11982 - DNA, 22 bp, Homo sapiens
aaggcaggatgggaaaagattt

SEQ ID NO: 11983 - DNA, 22 bp, Homo sapiens
gctgctttgtctgtaaaatgga

SEQ ID NO: 11984 - DNA, 22 bp, Homo sapiens
tcctcattcttggtgcatcaaa

SEQ ID NO: 11985 - DNA, 22 bp, Homo sapiens
agatacattgttctaagcattg

SEQ ID NO: 11986 - DNA, 22 bp, Homo sapiens
ttgtgaatggtgccgcaataaa

SEQ ID NO: 11987 - DNA, 22 bp, Homo sapiens
atggatcagaatcccgggaggg

SEQ ID NO: 11988 - DNA, 22 bp, Homo sapiens
tctgccgtgcgaggtcccacca

SEQ ID NO: 11989 - DNA, 22 bp, Homo sapiens
tgagggaatattgatagatccg

SEQ ID NO: 11990 - DNA, 22 bp, Homo sapiens
atgttggagtcgtaaggcatgg

SEQ ID NO: 11991 - DNA, 22 bp, Homo sapiens
agtttccatcccacacttgctt

SEQ ID NO: 11992 - DNA, 22 bp, Homo sapiens
tgggggagctcagtccagccca

SEQ ID NO: 11993 - DNA, 22 bp, Homo sapiens
agaagcagaaactgggcttgtg

SEQ ID NO: 11994 - DNA, 22 bp, Homo sapiens
catcatcaaaagtgacagagaa

SEQ ID NO: 11995 - DNA, 22 bp, Homo sapiens
tgaggaaacttacaaggcagaa

SEQ ID NO: 11996 - DNA, 22 bp, Homo sapiens
ctgctaaacctctctgagagct

SEQ ID NO: 11997 - DNA, 23 bp, Homo sapiens
caccccaccctgaggaggaggga

SEQ ID NO: 11998 - DNA, 21 bp, Homo sapiens
tctgccagctgaagaggtgga

SEQ ID NO: 11999 - DNA, 22 bp, Homo sapiens
tgcagagtgaagacatcacccc

SEQ ID NO: 12000 - DNA, 22 bp, Homo sapiens
cagctggcgactctcctcgatg

SEQ ID NO: 12001 - DNA, 22 bp, Homo sapiens
tgacctattagatttccttgcc

SEQ ID NO: 12002 - DNA, 22 bp, Homo sapiens
taggtagctttggcgtttcttg

SEQ ID NO: 12003 - DNA, 22 bp, Homo sapiens
gtggctcacgcctgtaatccca

SEQ ID NO: 12004 - DNA, 23 bp, Homo sapiens
acctgtctgcctcccaccatcaa

SEQ ID NO: 12005 - DNA, 22 bp, Homo sapiens
tgctcatcaacatgatgatcat

SEQ ID NO: 12006 - DNA, 22 bp, Homo sapiens
agcaggcctgccacctcggggt

SEQ ID NO: 12007 - DNA, 22 bp, Homo sapiens
tagatgatgtgactctcttgca

SEQ ID NO: 12008 - DNA, 22 bp, Homo sapiens
gagtgtgtcggtcagcgtggcg

SEQ ID NO: 12009 - DNA, 22 bp, Homo sapiens
atcacagttttaccatttggta

SEQ ID NO: 12010 - DNA, 22 bp, Homo sapiens
ggagtgactctcggggccacta

SEQ ID NO: 12011 - DNA, 22 bp, Homo sapiens
gaaactctcgcatcctgggaac

SEQ ID NO: 12012 - DNA, 22 bp, Homo sapiens
ctgggaggcggaggttgtagtg

SEQ ID NO: 12013 - DNA, 22 bp, Homo sapiens
gagcactgatttatttttgtct

SEQ ID NO: 12014 - DNA, 22 bp, Homo sapiens
ggaggacaggggctgcagcaca

SEQ ID NO: 12015 - DNA, 22 bp, Homo sapiens
cggggttcatccatgctgtggc

SEQ ID NO: 12016 - DNA, 18 bp, Homo sapiens
catgggtgacaggtggat

SEQ ID NO: 12017 - DNA, 22 bp, Homo sapiens
acggagcccgtgtcaggtggga

SEQ ID NO: 12018 - DNA, 22 bp, Homo sapiens
acacttctttgtcacctgcttc

SEQ ID NO: 12019 - DNA, 22 bp, Homo sapiens
gggcactcagctgtagagcagg

SEQ ID NO: 12020 - DNA, 22 bp, Homo sapiens
ttgctcttgaaaattgatgctg

SEQ ID NO: 12021 - DNA, 22 bp, Homo sapiens
gcagccagagggggtgtgatca

SEQ ID NO: 12022 - DNA, 22 bp, Homo sapiens
aaagtaattgcagtttctgcca

SEQ ID NO: 12023 - DNA, 22 bp, Homo sapiens
gaggcacagagtaggtgcacac

SEQ ID NO: 12024 - DNA, 22 bp, Homo sapiens
tgcccagggtggagtgcagtgg

SEQ ID NO: 12025 - DNA, 22 bp, Homo sapiens
ccttcccacattccttacatgc

SEQ ID NO: 12026 - DNA, 22 bp, Homo sapiens
caatgcattattctcccacttc

SEQ ID NO: 12027 - DNA, 22 bp, Homo sapiens
ttgatgagaccattgccgcgtc

SEQ ID NO: 12028 - DNA, 22 bp, Homo sapiens
atgccacttcattccagcctcg

SEQ ID NO: 12029 - DNA, 22 bp, Homo sapiens
agatttggtgtctggttgatat

SEQ ID NO: 12030 - DNA, 22 bp, Homo sapiens
agtggctgagtgactgtgactc

SEQ ID NO: 12031 - DNA, 22 bp, Homo sapiens
gaagtattactctgaatgtatt

SEQ ID NO: 12032 - DNA, 22 bp, Homo sapiens
aaggtcagagtgagctgtggcc

SEQ ID NO: 12033 - DNA, 22 bp, Homo sapiens
agcctgggccctgcctcttctc

SEQ ID NO: 12034 - DNA, 22 bp, Homo sapiens
ttggtttccttaacagcctaaa

SEQ ID NO: 12035 - DNA, 22 bp, Homo sapiens
acccaggctggcgtgcagtggc

SEQ ID NO: 12036 - DNA, 22 bp, Homo sapiens
ggggccttggatctgtgccccg

SEQ ID NO: 12037 - DNA, 22 bp, Homo sapiens
caggagtgtctccacacagcaa

SEQ ID NO: 12038 - DNA, 22 bp, Homo sapiens
agtgctgggctatctactgcta

SEQ ID NO: 12039 - DNA, 22 bp, Homo sapiens
tgaggcaggaggattgcaggat

SEQ ID NO: 12040 - DNA, 22 bp, Homo sapiens
cgggcaaggcgagactaggccc

SEQ ID NO: 12041 - DNA, 22 bp, Homo sapiens
gcaaagaatgcagatttgcctc

SEQ ID NO: 12042 - DNA, 22 bp, Homo sapiens
aaagatcacgtcccaggactcg

SEQ ID NO: 12043 - DNA, 22 bp, Homo sapiens
ccacagaattctgtctccagga

SEQ ID NO: 12044 - DNA, 22 bp, Homo sapiens
gattcactcatattttacgttt

SEQ ID NO: 12045 - DNA, 22 bp, Homo sapiens
gaggcctcatgaggtgagcatt

SEQ ID NO: 12046 - DNA, 22 bp, Homo sapiens
cgcagggccgcgagcgggacca

SEQ ID NO: 12047 - DNA, 22 bp, Homo sapiens
ccaaagaaacccaagctcaggg

SEQ ID NO: 12048 - DNA, 22 bp, Homo sapiens
aaagcagaggttgcagtgagct

SEQ ID NO: 12049 - DNA, 22 bp, Homo sapiens
ctctctgggcccagttggcacc

SEQ ID NO: 12050 - DNA, 22 bp, Homo sapiens
tcgcaccattgcactccagcca

SEQ ID NO: 12051 - DNA, 22 bp, Homo sapiens
agcaacctgccagtcactcagt

SEQ ID NO: 12052 - DNA, 22 bp, Homo sapiens
tcagggattaaggtcaaaggtg

SEQ ID NO: 12053 - DNA, 22 bp, Homo sapiens
aagtgtgtgagcctgtcaggct

SEQ ID NO: 12054 - DNA, 22 bp, Homo sapiens
gaggtggccaagcgaggaaggg

SEQ ID NO: 12055 - DNA, 22 bp, Homo sapiens
atgaggcaggagtgcagtggca

SEQ ID NO: 12056 - DNA, 22 bp, Homo sapiens
taaagattgctcaaaactgtga

SEQ ID NO: 12057 - DNA, 22 bp, Homo sapiens
tgcctccctggcaagtctctcc

SEQ ID NO: 12058 - DNA, 22 bp, Homo sapiens
acaggcacctgccaccacatct

SEQ ID NO: 12059 - DNA, 22 bp, Homo sapiens
actctgctctgtatttcactgt

SEQ ID NO: 12060 - DNA, 22 bp, Homo sapiens
cttccgtgtcagttccaggtgg

SEQ ID NO: 12061 - DNA, 22 bp, Homo sapiens
atcatccaagcgtagttcttct

SEQ ID NO: 12062 - DNA, 22 bp, Homo sapiens
aattatggtcactgttcctggg

SEQ ID NO: 12063 - DNA, 22 bp, Homo sapiens
gaatgcttggaacctgaagttc

SEQ ID NO: 12064 - DNA, 22 bp, Homo sapiens
catataaatacaacatgtgtta

SEQ ID NO: 12065 - DNA, 22 bp, Homo sapiens
gactacaggccggcatcagaga

SEQ ID NO: 12066 - DNA, 19 bp, Homo sapiens
catggtgaaaccccgtctc

SEQ ID NO: 12067 - DNA, 22 bp, Homo sapiens
gaactctctcatctgtcagttg

SEQ ID NO: 12068 - DNA, 22 bp, Homo sapiens
cttgcagtttaggtcctctgtg

SEQ ID NO: 12069 - DNA, 22 bp, Homo sapiens
attctacatgatagaagggaga

SEQ ID NO: 12070 - DNA, 22 bp, Homo sapiens
cggcatgggcgtccccctcact

SEQ ID NO: 12071 - DNA, 22 bp, Homo sapiens
ctgctgagagccccagctgaga

SEQ ID NO: 12072 - DNA, 22 bp, Homo sapiens
ctggtgtggactccgcgcggag

SEQ ID NO: 12073 - DNA, 22 bp, Homo sapiens
agatgtgtttctagttcctgca

SEQ ID NO: 12074 - DNA, 21 bp, Homo sapiens
tggttcagttcgttacgtgtg

SEQ ID NO: 12075 - DNA, 22 bp, Homo sapiens
cttccctctgctccttggtcca

SEQ ID NO: 12076 - DNA, 22 bp, Homo sapiens
ggagacagggttgaaccacgca

SEQ ID NO: 12077 - DNA, 22 bp, Homo sapiens
ccgccgtgtcgacaggccctgg

SEQ ID NO: 12078 - DNA, 22 bp, Homo sapiens
caagcgtggctgctctgatgga

SEQ ID NO: 12079 - DNA, 22 bp, Homo sapiens
tagtatagattgaagcagatca

SEQ ID NO: 12080 - DNA, 22 bp, Homo sapiens
agctgctgagccaggctgatgt

SEQ ID NO: 12081 - DNA, 22 bp, Homo sapiens
tgggagaaagaaccctgagtga

SEQ ID NO: 12082 - DNA, 22 bp, Homo sapiens
acagttaataagtagtaagtca

SEQ ID NO: 12083 - DNA, 22 bp, Homo sapiens
agccagggtctctcgctctgtt

SEQ ID NO: 12084 - DNA, 22 bp, Homo sapiens
tacttagtgttcttgtattgac

SEQ ID NO: 12085 - DNA, 22 bp, Homo sapiens
gccctagcgccagctcagcacc

SEQ ID NO: 12086 - DNA, 22 bp, Homo sapiens
taggctgggggtaggaattgag

SEQ ID NO: 12087 - DNA, 22 bp, Homo sapiens
aagatacagacagagccaaaat

SEQ ID NO: 12088 - DNA, 22 bp, Homo sapiens
ttggcctggcgcggtggctcac

SEQ ID NO: 12089 - DNA, 22 bp, Homo sapiens
gcacggctaatttttgtatttt

SEQ ID NO: 12090 - DNA, 22 bp, Homo sapiens
tcacttcccagacggggtggca

SEQ ID NO: 12091 - DNA, 22 bp, Homo sapiens
agacactgttctcacatgcttg

SEQ ID NO: 12092 - DNA, 22 bp, Homo sapiens
tacaggcatgtagcatggtgat

SEQ ID NO: 12093 - DNA, 22 bp, Homo sapiens
tgtgttaaggtgcatctagtgc

SEQ ID NO: 12094 - DNA, 22 bp, Homo sapiens
aacccaggagccggaggttgtg

SEQ ID NO: 12095 - DNA, 22 bp, Homo sapiens
atcagagtgtaagttctttcct

SEQ ID NO: 12096 - DNA, 22 bp, Homo sapiens
agaaacgcctgtgaaattatct

SEQ ID NO: 12097 - DNA, 22 bp, Homo sapiens
tcacagagttaaaagtttcttt

SEQ ID NO: 12098 - DNA, 22 bp, Homo sapiens
caggctgaagtgcagtggtgtg

SEQ ID NO: 12099 - DNA, 22 bp, Homo sapiens
tcaatactaatcttgctggaag

SEQ ID NO: 12100 - DNA, 22 bp, Homo sapiens
ttaaggttcagaaatcaatacc

SEQ ID NO: 12101 - DNA, 22 bp, Homo sapiens
tctgtgctaggcagcctggccc

SEQ ID NO: 12102 - DNA, 22 bp, Homo sapiens
ctatgaccccagcatgaataag

SEQ ID NO: 12103 - DNA, 18 bp, Homo sapiens
cagggctgtggggtcact

SEQ ID NO: 12104 - DNA, 22 bp, Homo sapiens
actcccttggtggagaatgcaa

SEQ ID NO: 12105 - DNA, 22 bp, Homo sapiens
aagagagtcagtctgagcacca

SEQ ID NO: 12106 - DNA, 22 bp, Homo sapiens
tgcctgttgcccacctgataaa

SEQ ID NO: 12107 - DNA, 22 bp, Homo sapiens
cactgggagcagctccaacatt

SEQ ID NO: 12108 - DNA, 22 bp, Homo sapiens
catggcattgcataacggggct

SEQ ID NO: 12109 - DNA, 22 bp, Homo sapiens
aagggggcggcagccagtggaa

SEQ ID NO: 12110 - DNA, 22 bp, Homo sapiens
gaatccctaagatttttataaa

SEQ ID NO: 12111 - DNA, 22 bp, Homo sapiens
acaatgaagctccactgagctt

SEQ ID NO: 12112 - DNA, 22 bp, Homo sapiens
gaggggctgccctggtgtcagg

SEQ ID NO: 12113 - DNA, 22 bp, Homo sapiens
aagatattcaaagatttattag

SEQ ID NO: 12114 - DNA, 22 bp, Homo sapiens
cctcctgcacctccaggaactc

SEQ ID NO: 12115 - DNA, 22 bp, Homo sapiens
cagaaaccaaatgggatgggga

SEQ ID NO: 12116 - DNA, 22 bp, Homo sapiens
tgggccacacacagaagaatca

SEQ ID NO: 12117 - DNA, 22 bp, Homo sapiens
catagacagatggtaagaagct

SEQ ID NO: 12118 - DNA, 22 bp, Homo sapiens
caggctggagtgcagtggtgcc

SEQ ID NO: 12119 - DNA, 22 bp, Homo sapiens
agtcaaagatgaccgagttcct

SEQ ID NO: 12120 - DNA, 22 bp, Homo sapiens
tcatcataatatggaatcttgt

SEQ ID NO: 12121 - DNA, 22 bp, Homo sapiens
ttaggtattttgttatgtcagc

SEQ ID NO: 12122 - DNA, 22 bp, Homo sapiens
tgcagtcttccagctgcacaaa

SEQ ID NO: 12123 - DNA, 22 bp, Homo sapiens
aggggtgacacatatcagtgca

SEQ ID NO: 12124 - DNA, 22 bp, Homo sapiens
gaaagcatccgcctggaggtgg

SEQ ID NO: 12125 - DNA, 22 bp, Homo sapiens
gactttggttcagggctcagag

SEQ ID NO: 12126 - DNA, 22 bp, Homo sapiens
agaaagagatgaatgctttaag

SEQ ID NO: 12127 - DNA, 22 bp, Homo sapiens
agtccaaagcagatgagggcca

SEQ ID NO: 12128 - DNA, 22 bp, Homo sapiens
caagccattctcctgcctcagc

SEQ ID NO: 12129 - DNA, 18 bp, Homo sapiens
tcactgggtgtatgtggc

SEQ ID NO: 12130 - DNA, 22 bp, Homo sapiens
ggggccgaccgcggttcaggcc

SEQ ID NO: 12131 - DNA, 22 bp, Homo sapiens
gtgaccatcatctcagctagtt

SEQ ID NO: 12132 - DNA, 22 bp, Homo sapiens
acaactccttcttgggtcctgg

SEQ ID NO: 12133 - DNA, 22 bp, Homo sapiens
tcctgccgtcctccggggcctc

SEQ ID NO: 12134 - DNA, 22 bp, Homo sapiens
gtccaggcctgcctctgaggag

SEQ ID NO: 12135 - DNA, 22 bp, Homo sapiens
agcattccacactgaagtctgc

SEQ ID NO: 12136 - DNA, 19 bp, Homo sapiens
agtcctggcctgggggacc

SEQ ID NO: 12137 - DNA, 22 bp, Homo sapiens
ctgtccagcgactaggggatgg

SEQ ID NO: 12138 - DNA, 22 bp, Homo sapiens
agcatggccatctgggccgtcc

SEQ ID NO: 12139 - DNA, 20 bp, Homo sapiens
cttctggctggtcaaggact

SEQ ID NO: 12140 - DNA, 20 bp, Homo sapiens
ttgagcttttagtacagaca

SEQ ID NO: 12141 - DNA, 22 bp, Homo sapiens
gagctcattcattcattgcctg

SEQ ID NO: 12142 - DNA, 22 bp, Homo sapiens
taccagggaacagggatattaa

SEQ ID NO: 12143 - DNA, 22 bp, Homo sapiens
ttagggttacaccagcctcctg

SEQ ID NO: 12144 - DNA, 22 bp, Homo sapiens
cctgggacttggtctggggttt

SEQ ID NO: 12145 - DNA, 22 bp, Homo sapiens
tgagtgaggctgggcagtccct

SEQ ID NO: 12146 - DNA, 22 bp, Homo sapiens
gtgttggacagcttctactgtg

SEQ ID NO: 12147 - DNA, 19 bp, Homo sapiens
agccccttggtactgtcct

SEQ ID NO: 12148 - DNA, 23 bp, Homo sapiens
aaaacagcttcctccagtggctc

SEQ ID NO: 12149 - DNA, 22 bp, Homo sapiens
atgtccttcctgagatccctgt

SEQ ID NO: 12150 - DNA, 22 bp, Homo sapiens
gcgcaccacctccaggtggccg

SEQ ID NO: 12151 - DNA, 22 bp, Homo sapiens
gcgctaggcaagtcctttcaac

SEQ ID NO: 12152 - DNA, 22 bp, Homo sapiens
ggaggcccagaaggaagcccag

SEQ ID NO: 12153 - DNA, 22 bp, Homo sapiens
ctgatccctccatagggcacag

SEQ ID NO: 12154 - DNA, 22 bp, Homo sapiens
ggggaaagccagccctgcttcc

SEQ ID NO: 12155 - DNA, 22 bp, Homo sapiens
ggcgggacggggcgtgcacaga

SEQ ID NO: 12156 - DNA, 22 bp, Homo sapiens
atgtacataaaatgtataatga

SEQ ID NO: 12157 - DNA, 20 bp, Homo sapiens
gccaacgcgctggggctgcc

SEQ ID NO: 12158 - DNA, 22 bp, Homo sapiens
ggtgaattaccaaaggggcaga

SEQ ID NO: 12159 - DNA, 22 bp, Homo sapiens
tcaatcacgtgttccatgttct

SEQ ID NO: 12160 - DNA, 22 bp, Homo sapiens
gcgggccaccttggagagcgct

SEQ ID NO: 12161 - DNA, 22 bp, Homo sapiens
gagcctcagggttttgttgaca

SEQ ID NO: 12162 - DNA, 18 bp, Homo sapiens
acggatccgcgggaccgc

SEQ ID NO: 12163 - DNA, 22 bp, Homo sapiens
cagctggtgtcaggcactgcag

SEQ ID NO: 12164 - DNA, 22 bp, Homo sapiens
tctgtagcttcttgagaggcca

SEQ ID NO: 12165 - DNA, 22 bp, Homo sapiens
acactgtgtgacttctgagact

SEQ ID NO: 12166 - DNA, 22 bp, Homo sapiens
aaaatatgtataactcttctgc

SEQ ID NO: 12167 - DNA, 22 bp, Homo sapiens
gggaagatagtgttgagggccc

SEQ ID NO: 12168 - DNA, 22 bp, Homo sapiens
tggggccatctcacccactgtt

SEQ ID NO: 12169 - DNA, 22 bp, Homo sapiens
tagcccctgcctttgaacctgg

SEQ ID NO: 12170 - DNA, 22 bp, Homo sapiens
ggaatcgttaggtaagcaggga

SEQ ID NO: 12171 - DNA, 21 bp, Homo sapiens
agtagtttagcacagggtttg

SEQ ID NO: 12172 - DNA, 21 bp, Homo sapiens
ggcctcccggaccgcagcgcc

SEQ ID NO: 12173 - DNA, 22 bp, Homo sapiens
accaggttggtgtccttctggc

SEQ ID NO: 12174 - DNA, 22 bp, Homo sapiens
ggcctgcctcacagtcagcacc

SEQ ID NO: 12175 - DNA, 22 bp, Homo sapiens
catccaccgcgtgcacctctac

SEQ ID NO: 12176 - DNA, 22 bp, Homo sapiens
tttatagtagcatgatttatag

SEQ ID NO: 12177 - DNA, 23 bp, Homo sapiens
gtgtggccccagggcctcctcgc

SEQ ID NO: 12178 - DNA, 22 bp, Homo sapiens
ggaggcggaggctgcagtgagc

SEQ ID NO: 12179 - DNA, 22 bp, Homo sapiens
ggctgtggcagctggaagtggt

SEQ ID NO: 12180 - DNA, 22 bp, Homo sapiens
cggggcgagcagacggcggcaa

SEQ ID NO: 12181 - DNA, 23 bp, Homo sapiens
tcagaacagttcttggtgcatag

SEQ ID NO: 12182 - DNA, 22 bp, Homo sapiens
tcatggggccacagctgccagc

SEQ ID NO: 12183 - DNA, 22 bp, Homo sapiens
ggtggcagtagcactgggcctg

SEQ ID NO: 12184 - DNA, 22 bp, Homo sapiens
ggcctcgcggcttctggtggct

SEQ ID NO: 12185 - DNA, 22 bp, Homo sapiens
cctaggagttcgaagctgcagt

SEQ ID NO: 12186 - DNA, 22 bp, Homo sapiens
tcactgcactccagcctggtga

SEQ ID NO: 12187 - DNA, 22 bp, Homo sapiens
ctgctcctgtccagcagggcca

SEQ ID NO: 12188 - DNA, 22 bp, Homo sapiens
agagagcccgggccagggcaca

SEQ ID NO: 12189 - DNA, 22 bp, Homo sapiens
ttccacattccttacattcata

SEQ ID NO: 12190 - DNA, 22 bp, Homo sapiens
tcttgagctttatccagtttct

SEQ ID NO: 12191 - DNA, 22 bp, Homo sapiens
tgctggtaccgcgcctccgcca

SEQ ID NO: 12192 - DNA, 22 bp, Homo sapiens
cctggtgcaggtgtgttgccag

SEQ ID NO: 12193 - DNA, 22 bp, Homo sapiens
ccggaaggcggaacgtgcagtg

SEQ ID NO: 12194 - DNA, 22 bp, Homo sapiens
ccaattttattcttctgcaagt

SEQ ID NO: 12195 - DNA, 22 bp, Homo sapiens
gcccaggaggagaggctgcagt

SEQ ID NO: 12196 - DNA, 22 bp, Homo sapiens
tccagcccaggctggagtgtag

SEQ ID NO: 12197 - DNA, 22 bp, Homo sapiens
tgggaagctgcattttaacaag

SEQ ID NO: 12198 - DNA, 22 bp, Homo sapiens
ggaggggatttagtagatgcta

SEQ ID NO: 12199 - DNA, 22 bp, Homo sapiens
tggggtcccaactctgattgat

SEQ ID NO: 12200 - DNA, 22 bp, Homo sapiens
agtctacaaagggaagcccttt

SEQ ID NO: 12201 - DNA, 22 bp, Homo sapiens
tgacatttcctagtgctttgtg

SEQ ID NO: 12202 - DNA, 22 bp, Homo sapiens
tcctgagccctactctagacga

SEQ ID NO: 12203 - DNA, 22 bp, Homo sapiens
taaatacttagttttgtgtcta

SEQ ID NO: 12204 - DNA, 22 bp, Homo sapiens
ttcaatatgatattagctgtgg

SEQ ID NO: 12205 - DNA, 22 bp, Homo sapiens
gagatgcagaaccctcaggagc

SEQ ID NO: 12206 - DNA, 22 bp, Homo sapiens
actgggaagtcagagagaggct

SEQ ID NO: 12207 - DNA, 22 bp, Homo sapiens
tcccgtaggttgctgtagtcgg

SEQ ID NO: 12208 - DNA, 22 bp, Homo sapiens
gcccttacagggtggtcagcca

SEQ ID NO: 12209 - DNA, 22 bp, Homo sapiens
agcgctgtgggcgtgcgaggag

SEQ ID NO: 12210 - DNA, 22 bp, Homo sapiens
tctttggtttctgtctctgtaa

SEQ ID NO: 12211 - DNA, 22 bp, Homo sapiens
gtaggccatggtggttgtctct

SEQ ID NO: 12212 - DNA, 20 bp, Homo sapiens
gggtgtgtgcagggcctggt

SEQ ID NO: 12213 - DNA, 22 bp, Homo sapiens
agctggtgtgccagttccagtt

SEQ ID NO: 12214 - DNA, 22 bp, Homo sapiens
gtagaccatttatctggggagt

SEQ ID NO: 12215 - DNA, 22 bp, Homo sapiens
tgtgactaggcctgagctcttg

SEQ ID NO: 12216 - DNA, 22 bp, Homo sapiens
aaggccttgccgaaggatgcca

SEQ ID NO: 12217 - DNA, 22 bp, Homo sapiens
ggagaggcttccagagtcgtgc

SEQ ID NO: 12218 - DNA, 16 bp, Homo sapiens
gtagccgtggccgctg

SEQ ID NO: 12219 - DNA, 22 bp, Homo sapiens
acggtgaccaagcatcaccgag

SEQ ID NO: 12220 - DNA, 22 bp, Homo sapiens
ggatgttctggggttctcttgt

SEQ ID NO: 12221 - DNA, 22 bp, Homo sapiens
ctcagctcattgtggatccggt

SEQ ID NO: 12222 - DNA, 22 bp, Homo sapiens
gccttattacctgcactttgaa

SEQ ID NO: 12223 - DNA, 22 bp, Homo sapiens
cagcagcccacgcgtgctgtcc

SEQ ID NO: 12224 - DNA, 22 bp, Homo sapiens
catgctgggtaaaggtggtgaa

SEQ ID NO: 12225 - DNA, 22 bp, Homo sapiens
tggcctcggcatccagcaagag

SEQ ID NO: 12226 - DNA, 22 bp, Homo sapiens
cgccccggacgtctgaccaaac

SEQ ID NO: 12227 - DNA, 16 bp, Homo sapiens
ccacctgcagctctca

SEQ ID NO: 12228 - DNA, 22 bp, Homo sapiens
tagatttgtttccttctctcca

SEQ ID NO: 12229 - DNA, 22 bp, Homo sapiens
tcacattttcaaaagctggtgc

SEQ ID NO: 12230 - DNA, 22 bp, Homo sapiens
tacaaaggaggtgcatagaaca

SEQ ID NO: 12231 - DNA, 22 bp, Homo sapiens
agcctagggttctgatgtcact

SEQ ID NO: 12232 - DNA, 22 bp, Homo sapiens
ttgtgctcctatgagaatctaa

SEQ ID NO: 12233 - DNA, 22 bp, Homo sapiens
cctacagttatattcttgattg

SEQ ID NO: 12234 - DNA, 22 bp, Homo sapiens
gtgggtggacggtgcttttgtt

SEQ ID NO: 12235 - DNA, 23 bp, Homo sapiens
tgtcttcgactcctgcgtgcttc

SEQ ID NO: 12236 - DNA, 22 bp, Homo sapiens
atatatttgagaatattcatga

SEQ ID NO: 12237 - DNA, 22 bp, Homo sapiens
gggatgcagactacagggctta

SEQ ID NO: 12238 - DNA, 22 bp, Homo sapiens
atacctgtgtatccacaagcgt

SEQ ID NO: 12239 - DNA, 20 bp, Homo sapiens
atcggcttgcctggaaacaa

SEQ ID NO: 12240 - DNA, 22 bp, Homo sapiens
agatcggctttgcagacctcat

SEQ ID NO: 12241 - DNA, 22 bp, Homo sapiens
cactgcactccagcctgcgcaa

SEQ ID NO: 12242 - DNA, 22 bp, Homo sapiens
cagtgcagccaaggacaggcac

SEQ ID NO: 12243 - DNA, 22 bp, Homo sapiens
tgtgaatggacaattaaatcta

SEQ ID NO: 12244 - DNA, 22 bp, Homo sapiens
tgatttacagtagtgtctaaac

SEQ ID NO: 12245 - DNA, 22 bp, Homo sapiens
agtgcattcctggggaagaagc

SEQ ID NO: 12246 - DNA, 22 bp, Homo sapiens
ccacaccatcgtttttacctta

SEQ ID NO: 12247 - DNA, 22 bp, Homo sapiens
attagtcttcacctctctttgg

SEQ ID NO: 12248 - DNA, 22 bp, Homo sapiens
ctgggcctggggctgttgagag

SEQ ID NO: 12249 - DNA, 22 bp, Homo sapiens
ccagaaaaatcctcccttgtcc

SEQ ID NO: 12250 - DNA, 22 bp, Homo sapiens
ttcaaatgatggcagtcctggc

SEQ ID NO: 12251 - DNA, 22 bp, Homo sapiens
atggaaggctttatgactcaaa

SEQ ID NO: 12252 - DNA, 19 bp, Homo sapiens
gctgaggtggaggaaggag

SEQ ID NO: 12253 - DNA, 17 bp, Homo sapiens
gcgtgtccccgcgtctc

SEQ ID NO: 12254 - DNA, 22 bp, Homo sapiens
gtgtgtcccttggaacctcagc

SEQ ID NO: 12255 - DNA, 22 bp, Homo sapiens
cagcttggaggaggatctaaga

SEQ ID NO: 12256 - DNA, 22 bp, Homo sapiens
tctccccagtatggattctctg

SEQ ID NO: 12257 - DNA, 16 bp, Homo sapiens
tggggatggggaagag

SEQ ID NO: 12258 - DNA, 22 bp, Homo sapiens
aggaaaatggaccagagttgtt

SEQ ID NO: 12259 - DNA, 22 bp, Homo sapiens
cctggagagctcgggccaggca

SEQ ID NO: 12260 - DNA, 22 bp, Homo sapiens
cctgacgaaaggcgtgctggag

SEQ ID NO: 12261 - DNA, 22 bp, Homo sapiens
tgagatggagtctcactctgtt

SEQ ID NO: 12262 - DNA, 22 bp, Homo sapiens
aaaacctaagccagtagctccc

SEQ ID NO: 12263 - DNA, 22 bp, Homo sapiens
agcagctttcacctccccgcct

SEQ ID NO: 12264 - DNA, 22 bp, Homo sapiens
actgcaaagggaagccctttct

SEQ ID NO: 12265 - DNA, 22 bp, Homo sapiens
tggttttagggaatcaatctat

SEQ ID NO: 12266 - DNA, 17 bp, Homo sapiens
tggctctgtcctcagct

SEQ ID NO: 12267 - DNA, 22 bp, Homo sapiens
gccttgagctgcacggccaggt

SEQ ID NO: 12268 - DNA, 22 bp, Homo sapiens
acatacttctttacattccata

SEQ ID NO: 12269 - DNA, 22 bp, Homo sapiens
ctgtatttcttggacagttgct

SEQ ID NO: 12270 - DNA, 22 bp, Homo sapiens
gatggaggagatggcagggtgc

SEQ ID NO: 12271 - DNA, 22 bp, Homo sapiens
tacagaagcttttgaaaagatg

SEQ ID NO: 12272 - DNA, 22 bp, Homo sapiens
acagagacacggaagctaaaga

SEQ ID NO: 12273 - DNA, 22 bp, Homo sapiens
agtgcaggccccaggccaggcc

SEQ ID NO: 12274 - DNA, 22 bp, Homo sapiens
caagaggattattaataaataa

SEQ ID NO: 12275 - DNA, 22 bp, Homo sapiens
tttcttcctgctttgtcccatg

SEQ ID NO: 12276 - DNA, 22 bp, Homo sapiens
ttcaccatgttggccaggctgg

SEQ ID NO: 12277 - DNA, 22 bp, Homo sapiens
cggagcgctgggggactctgca

SEQ ID NO: 12278 - DNA, 22 bp, Homo sapiens
caagtctgacctctgggtgaag

SEQ ID NO: 12279 - DNA, 22 bp, Homo sapiens
cttgcctttgtcttcaaaggct

SEQ ID NO: 12280 - DNA, 22 bp, Homo sapiens
gggcagagactcagaaacagaa

SEQ ID NO: 12281 - DNA, 22 bp, Homo sapiens
gggttggatcctggtggctgcc

SEQ ID NO: 12282 - DNA, 22 bp, Homo sapiens
gagcctggagctggaacgaagc

SEQ ID NO: 12283 - DNA, 22 bp, Homo sapiens
agttcgagatctgctgatgaga

SEQ ID NO: 12284 - DNA, 22 bp, Homo sapiens
agccagggacgctgcaggctac

SEQ ID NO: 12285 - DNA, 21 bp, Homo sapiens
ttgaccaagggtgcgtgctcc

SEQ ID NO: 12286 - DNA, 22 bp, Homo sapiens
actgggcctgattgggtcggag

SEQ ID NO: 12287 - DNA, 22 bp, Homo sapiens
actgggccaggtgtgggtgagt

SEQ ID NO: 12288 - DNA, 22 bp, Homo sapiens
agcatgcgcttgatcagctcca

SEQ ID NO: 12289 - DNA, 22 bp, Homo sapiens
gatcagagccagagatgataac

SEQ ID NO: 12290 - DNA, 22 bp, Homo sapiens
gtgacacccgcatgccactgtg

SEQ ID NO: 12291 - DNA, 22 bp, Homo sapiens
tggcacagcctccatgtcgtcc

SEQ ID NO: 12292 - DNA, 22 bp, Homo sapiens
caagatcttcctcaatagacct

SEQ ID NO: 12293 - DNA, 20 bp, Homo sapiens
aggggcacctgcgacggggc

SEQ ID NO: 12294 - DNA, 20 bp, Homo sapiens
gccactgggcaccagcaggg

SEQ ID NO: 12295 - DNA, 22 bp, Homo sapiens
cgtcctctagagggaagcactt

SEQ ID NO: 12296 - DNA, 22 bp, Homo sapiens
caaagtgctggaattacaggtg

SEQ ID NO: 12297 - DNA, 22 bp, Homo sapiens
gctctagtaggaatgtccctct

SEQ ID NO: 12298 - DNA, 21 bp, Homo sapiens
ctgtggtacagctgggacgga

SEQ ID NO: 12299 - DNA, 22 bp, Homo sapiens
ctgggaggcggaggttgcagtg

SEQ ID NO: 12300 - DNA, 22 bp, Homo sapiens
gcgctcagaaaagattttcttc

SEQ ID NO: 12301 - DNA, 22 bp, Homo sapiens
gagagtctaggaacctcatata

SEQ ID NO: 12302 - DNA, 22 bp, Homo sapiens
tagaaaagccccagctggaggg

SEQ ID NO: 12303 - DNA, 22 bp, Homo sapiens
tcccagctactctagaggctga

SEQ ID NO: 12304 - DNA, 20 bp, Homo sapiens
acgtggccaccagtggctta

SEQ ID NO: 12305 - DNA, 22 bp, Homo sapiens
agagctccagggttttgtagtg

SEQ ID NO: 12306 - DNA, 22 bp, Homo sapiens
tggcacaggatctcagcggcca

SEQ ID NO: 12307 - DNA, 22 bp, Homo sapiens
ctccggccgcggtgcccagcgc

SEQ ID NO: 12308 - DNA, 22 bp, Homo sapiens
attggtggtgaggacatgccag

SEQ ID NO: 12309 - DNA, 22 bp, Homo sapiens
tggcaatgtggaatggtccagg

SEQ ID NO: 12310 - DNA, 22 bp, Homo sapiens
atcccgaacctctacttctttc

SEQ ID NO: 12311 - DNA, 19 bp, Homo sapiens
tgtccgtggccttctggat

SEQ ID NO: 12312 - DNA, 22 bp, Homo sapiens
caggtgcctcaggatgagacaa

SEQ ID NO: 12313 - DNA, 22 bp, Homo sapiens
cccaggaggcctgcctggccgg

SEQ ID NO: 12314 - DNA, 22 bp, Homo sapiens
ggtgaggggctcctctgcccgg

SEQ ID NO: 12315 - DNA, 22 bp, Homo sapiens
gctcccaccttaaccttcacat

SEQ ID NO: 12316 - DNA, 22 bp, Homo sapiens
acccaggctggagtgcagtgat

SEQ ID NO: 12317 - DNA, 20 bp, Homo sapiens
ggcagagggcctgggagaag

SEQ ID NO: 12318 - DNA, 22 bp, Homo sapiens
gggccctgggattcagagcaag

SEQ ID NO: 12319 - DNA, 23 bp, Homo sapiens
cagagctggcttcatgggtgtgc

SEQ ID NO: 12320 - DNA, 19 bp, Homo sapiens
catctggatgattctcctg

SEQ ID NO: 12321 - DNA, 22 bp, Homo sapiens
tcaacagtggcaaagaggcacg

SEQ ID NO: 12322 - DNA, 22 bp, Homo sapiens
ggagaagaggagctggaagcct

SEQ ID NO: 12323 - DNA, 22 bp, Homo sapiens
agagggtgggcacgtgatggat

SEQ ID NO: 12324 - DNA, 22 bp, Homo sapiens
ataaaaactgacccatcctttg

SEQ ID NO: 12325 - DNA, 20 bp, Homo sapiens
tgcagcacgggccctttcca

SEQ ID NO: 12326 - DNA, 22 bp, Homo sapiens
tccagctctgctgtgcgccggt

SEQ ID NO: 12327 - DNA, 22 bp, Homo sapiens
ggcatgcatgttgttttaggtg

SEQ ID NO: 12328 - DNA, 22 bp, Homo sapiens
ctgaggggtcgtgggagcccag

SEQ ID NO: 12329 - DNA, 22 bp, Homo sapiens
ttatatgtttctgtttggaggc

SEQ ID NO: 12330 - DNA, 22 bp, Homo sapiens
gggactggagtagaggccggtg

SEQ ID NO: 12331 - DNA, 22 bp, Homo sapiens
ttatttaaaagtggtaagattc

SEQ ID NO: 12332 - DNA, 22 bp, Homo sapiens
cctgaggatgccagcatgggtg

SEQ ID NO: 12333 - DNA, 22 bp, Homo sapiens
tactttgtccatttgcaggcag

SEQ ID NO: 12334 - DNA, 22 bp, Homo sapiens
gaggtggatgttgcagtgagct

SEQ ID NO: 12335 - DNA, 22 bp, Homo sapiens
cccaggagttggaggctgcagt

SEQ ID NO: 12336 - DNA, 22 bp, Homo sapiens
agacaaagaaaccgtagaagca

SEQ ID NO: 12337 - DNA, 22 bp, Homo sapiens
cttatagtatgatgttgagaat

SEQ ID NO: 12338 - DNA, 22 bp, Homo sapiens
caggcagaagaagtggaaggac

SEQ ID NO: 12339 - DNA, 18 bp, Homo sapiens
tctgccccagccgcactg

SEQ ID NO: 12340 - DNA, 22 bp, Homo sapiens
gcactgcaggtgggtggagagg

SEQ ID NO: 12341 - DNA, 22 bp, Homo sapiens
ttactttaagggtgtcttatta

SEQ ID NO: 12342 - DNA, 22 bp, Homo sapiens
tgttttaagggtcaactgtcac

SEQ ID NO: 12343 - DNA, 22 bp, Homo sapiens
ccgggcgggggctctcgtcacc

SEQ ID NO: 12344 - DNA, 22 bp, Homo sapiens
cttcccaccaaagcccttgttg

SEQ ID NO: 12345 - DNA, 22 bp, Homo sapiens
tgttcagaacaaaggtaaatga

SEQ ID NO: 12346 - DNA, 22 bp, Homo sapiens
aacccaggaggtggaggttgtg

SEQ ID NO: 12347 - DNA, 22 bp, Homo sapiens
aggtgcatctcgtagctcttct

SEQ ID NO: 12348 - DNA, 18 bp, Homo sapiens
cccacggtgctgtagggc

SEQ ID NO: 12349 - DNA, 20 bp, Homo sapiens
aactcctagcctcaagtgat

SEQ ID NO: 12350 - DNA, 22 bp, Homo sapiens
cacctgtacagggccgggctgg

SEQ ID NO: 12351 - DNA, 22 bp, Homo sapiens
gctgctaagcgtttctgttcca

SEQ ID NO: 12352 - DNA, 22 bp, Homo sapiens
ctggcaggtggaggttgcagtg

SEQ ID NO: 12353 - DNA, 22 bp, Homo sapiens
aactcctctctggtggttcgtc

SEQ ID NO: 12354 - DNA, 22 bp, Homo sapiens
ggagagtgggagcaactgttgc

SEQ ID NO: 12355 - DNA, 19 bp, Homo sapiens
tctcacagctctactatgt

SEQ ID NO: 12356 - DNA, 22 bp, Homo sapiens
tgcctccaacagcccatcctag

SEQ ID NO: 12357 - DNA, 21 bp, Homo sapiens
cccgcacagcggtaggccgcc

SEQ ID NO: 12358 - DNA, 22 bp, Homo sapiens
gggccatgagaggttcatcaac

SEQ ID NO: 12359 - DNA, 22 bp, Homo sapiens
agaggcaggaggttgacttgag

SEQ ID NO: 12360 - DNA, 22 bp, Homo sapiens
cgagagatgggttggcaggggc

SEQ ID NO: 12361 - DNA, 22 bp, Homo sapiens
tcttggattttaatggatcaaa

SEQ ID NO: 12362 - DNA, 16 bp, Homo sapiens
gcaggcagatcacatg

SEQ ID NO: 12363 - DNA, 22 bp, Homo sapiens
attggccatttgcatgtattat

SEQ ID NO: 12364 - DNA, 22 bp, Homo sapiens
aaagaaatagatggcatttaaa

SEQ ID NO: 12365 - DNA, 22 bp, Homo sapiens
ggagaacatatctcccacattg

SEQ ID NO: 12366 - DNA, 22 bp, Homo sapiens
tctgagaatggtggatgtggtg

SEQ ID NO: 12367 - DNA, 22 bp, Homo sapiens
acatttatataactcactagga

SEQ ID NO: 12368 - DNA, 22 bp, Homo sapiens
cccaggggttctgagcagcagc

SEQ ID NO: 12369 - DNA, 22 bp, Homo sapiens
ttgtgttaaggtgcatctagtg

SEQ ID NO: 12370 - DNA, 22 bp, Homo sapiens
aggaaataggaccagacaaagc

SEQ ID NO: 12371 - DNA, 22 bp, Homo sapiens
atacaaagtattaatcctggat

SEQ ID NO: 12372 - DNA, 22 bp, Homo sapiens
aggcaagggggcgccaccttcc

SEQ ID NO: 12373 - DNA, 22 bp, Homo sapiens
aggactgggtgcagagggcatc

SEQ ID NO: 12374 - DNA, 22 bp, Homo sapiens
actgatcaagggtttaatttta

SEQ ID NO: 12375 - DNA, 18 bp, Homo sapiens
gaattgtgctaaggtgat

SEQ ID NO: 12376 - DNA, 22 bp, Homo sapiens
tgccgcagtgcggggagggccc

SEQ ID NO: 12377 - DNA, 22 bp, Homo sapiens
tacttttagcctatttgattct

SEQ ID NO: 12378 - DNA, 22 bp, Homo sapiens
ctgccttttaaagccagtgtta

SEQ ID NO: 12379 - DNA, 22 bp, Homo sapiens
tgtctggatagagcctaggccc

SEQ ID NO: 12380 - DNA, 22 bp, Homo sapiens
tcccacacagcccgctcaccgg

SEQ ID NO: 12381 - DNA, 22 bp, Homo sapiens
gttgcagatgtggaactcgtgc

SEQ ID NO: 12382 - DNA, 22 bp, Homo sapiens
aggtgggcggattcatgaggtc

SEQ ID NO: 12383 - DNA, 22 bp, Homo sapiens
agccacacttgccaggggaagg

SEQ ID NO: 12384 - DNA, 22 bp, Homo sapiens
tctgccttttactagctggatg

SEQ ID NO: 12385 - DNA, 22 bp, Homo sapiens
caaatcctcacctcatcatgaa

SEQ ID NO: 12386 - DNA, 22 bp, Homo sapiens
aattacagtcggagcagcactg

SEQ ID NO: 12387 - DNA, 22 bp, Homo sapiens
caaagggaaaagccatgtgggc

SEQ ID NO: 12388 - DNA, 22 bp, Homo sapiens
tgtctgggagactgatcacccg

SEQ ID NO: 12389 - DNA, 22 bp, Homo sapiens
tgcgccatgtgctctcggccct

SEQ ID NO: 12390 - DNA, 22 bp, Homo sapiens
acatatgcgatcataggatgca

SEQ ID NO: 12391 - DNA, 22 bp, Homo sapiens
ttgatcaaatcagctactgagg

SEQ ID NO: 12392 - DNA, 22 bp, Homo sapiens
tgtggactcgcatggctgaggc

SEQ ID NO: 12393 - DNA, 21 bp, Homo sapiens
ggtgtgggatggactgaacca

SEQ ID NO: 12394 - DNA, 22 bp, Homo sapiens
ctcgggcttgaggctgtttacc

SEQ ID NO: 12395 - DNA, 22 bp, Homo sapiens
tgggaagggtcaacagctggaa

SEQ ID NO: 12396 - DNA, 22 bp, Homo sapiens
catttctgggagacatgctaga

SEQ ID NO: 12397 - DNA, 23 bp, Homo sapiens
gcagaggagcaagctggacacca

SEQ ID NO: 12398 - DNA, 22 bp, Homo sapiens
gaaggtggcgagcggattgctg

SEQ ID NO: 12399 - DNA, 22 bp, Homo sapiens
ctcgggcaccctggttctggtg

SEQ ID NO: 12400 - DNA, 22 bp, Homo sapiens
gtgtggaatggagtttttgccc

SEQ ID NO: 12401 - DNA, 20 bp, Homo sapiens
atcctctcctgattaattca

SEQ ID NO: 12402 - DNA, 22 bp, Homo sapiens
ccaggctggagtgcaatggcat

SEQ ID NO: 12403 - DNA, 22 bp, Homo sapiens
tgctgctgaggctaaagtatag

SEQ ID NO: 12404 - DNA, 22 bp, Homo sapiens
tgctgagcgcatccggcggccg

SEQ ID NO: 12405 - DNA, 22 bp, Homo sapiens
ctgctccccagcctgcgccttt

SEQ ID NO: 12406 - DNA, 22 bp, Homo sapiens
tggcatggagtggatggcccca

SEQ ID NO: 12407 - DNA, 22 bp, Homo sapiens
atgattagttaccttgatttaa

SEQ ID NO: 12408 - DNA, 22 bp, Homo sapiens
ctgtcatggtttgaatgctcgc

SEQ ID NO: 12409 - DNA, 22 bp, Homo sapiens
tgtctcatctcttaaccccact

SEQ ID NO: 12410 - DNA, 22 bp, Homo sapiens
gcccaggagttcaagtctagtg

SEQ ID NO: 12411 - DNA, 22 bp, Homo sapiens
gcccagcccagaaaggttcgga

SEQ ID NO: 12412 - DNA, 22 bp, Homo sapiens
atgcagccccctggtgcccggg

SEQ ID NO: 12413 - DNA, 20 bp, Homo sapiens
agcagagtgcccatcccgga

SEQ ID NO: 12414 - DNA, 22 bp, Homo sapiens
gggaaggccttgtcagcggatt

SEQ ID NO: 12415 - DNA, 22 bp, Homo sapiens
tgggaggccaaggcaggcggat

SEQ ID NO: 12416 - DNA, 22 bp, Homo sapiens
gacagctccagctcctccaggc

SEQ ID NO: 12417 - DNA, 22 bp, Homo sapiens
ccagaggagttgaggctttggg

SEQ ID NO: 12418 - DNA, 22 bp, Homo sapiens
ctcgtgatccgcccacctcagc

SEQ ID NO: 12419 - DNA, 22 bp, Homo sapiens
gatgcgggcccgctccactgcc

SEQ ID NO: 12420 - DNA, 22 bp, Homo sapiens
gaccagtcattactcatgccct

SEQ ID NO: 12421 - DNA, 22 bp, Homo sapiens
gttttagataaagctgtccttg

SEQ ID NO: 12422 - DNA, 23 bp, Homo sapiens
gcagccatgttcccgtctcagct

SEQ ID NO: 12423 - DNA, 20 bp, Homo sapiens
ttgttagaggaatgccatag

SEQ ID NO: 12424 - DNA, 22 bp, Homo sapiens
cttgagtcatataaagacagag

SEQ ID NO: 12425 - DNA, 22 bp, Homo sapiens
ggctcactgcaacttccgcctc

SEQ ID NO: 12426 - DNA, 22 bp, Homo sapiens
accagcctggccaacatggtga

SEQ ID NO: 12427 - DNA, 22 bp, Homo sapiens
ggtgatccaccagcctcggcct

SEQ ID NO: 12428 - DNA, 22 bp, Homo sapiens
aacattgaacttggcacaccca

SEQ ID NO: 12429 - DNA, 22 bp, Homo sapiens
agggtggcactggtggctctat

SEQ ID NO: 12430 - DNA, 22 bp, Homo sapiens
atattagtttggagactacaat

SEQ ID NO: 12431 - DNA, 22 bp, Homo sapiens
agaggggcccggttctccgtct

SEQ ID NO: 12432 - DNA, 22 bp, Homo sapiens
attaatgaaactttggttaagc

SEQ ID NO: 12433 - DNA, 22 bp, Homo sapiens
cccccagctctgctgggtcccg

SEQ ID NO: 12434 - DNA, 22 bp, Homo sapiens
agacccaggattggggctgccg

SEQ ID NO: 12435 - DNA, 22 bp, Homo sapiens
gatatcatgggaaggtgtactt

SEQ ID NO: 12436 - DNA, 22 bp, Homo sapiens
gctgaggctcctcgggaggaca

SEQ ID NO: 12437 - DNA, 22 bp, Homo sapiens
aggattgtgcctccagtcagaa

SEQ ID NO: 12438 - DNA, 22 bp, Homo sapiens
ttttctaacatctagtaatttg

SEQ ID NO: 12439 - DNA, 22 bp, Homo sapiens
tctgcaacattcctctccccac

SEQ ID NO: 12440 - DNA, 22 bp, Homo sapiens
ggaggcggaggttgcagtgagc

SEQ ID NO: 12441 - DNA, 22 bp, Homo sapiens
tcttggtatacgcatggcattg

SEQ ID NO: 12442 - DNA, 22 bp, Homo sapiens
gcggtatttgtgtgggtgtcga

SEQ ID NO: 12443 - DNA, 22 bp, Homo sapiens
cctcttctaggacgtccttgtg

SEQ ID NO: 12444 - DNA, 22 bp, Homo sapiens
gtagggttggagagcacaacca

SEQ ID NO: 12445 - DNA, 22 bp, Homo sapiens
taggtgcagtggctcatgcctg

SEQ ID NO: 12446 - DNA, 22 bp, Homo sapiens
tgttttaagctctagaagggga

SEQ ID NO: 12447 - DNA, 22 bp, Homo sapiens
cccagcagtagagctcatatgg

SEQ ID NO: 12448 - DNA, 22 bp, Homo sapiens
ttaccacagtgcctgtctaatg

SEQ ID NO: 12449 - DNA, 22 bp, Homo sapiens
tgagaaacttgccaagcatctc

SEQ ID NO: 12450 - DNA, 22 bp, Homo sapiens
agtgggtgacagtgaacacgta

SEQ ID NO: 12451 - DNA, 22 bp, Homo sapiens
gagcctcgtggcggccactgcg

SEQ ID NO: 12452 - DNA, 22 bp, Homo sapiens
gcggggggaggaacatcttgca

SEQ ID NO: 12453 - DNA, 17 bp, Homo sapiens
gtaaggcttgcagatgc

SEQ ID NO: 12454 - DNA, 22 bp, Homo sapiens
tgaggctccttgtagagagtgg

SEQ ID NO: 12455 - DNA, 22 bp, Homo sapiens
aagccctggcgggtggagggcc

SEQ ID NO: 12456 - DNA, 22 bp, Homo sapiens
ttggccatctaagcccagccac

SEQ ID NO: 12457 - DNA, 22 bp, Homo sapiens
ccagagtcccttgcagctcagt

SEQ ID NO: 12458 - DNA, 22 bp, Homo sapiens
ggaaaggcctgggtgtcctggg

SEQ ID NO: 12459 - DNA, 22 bp, Homo sapiens
tctttgttattgtgaatagggt

SEQ ID NO: 12460 - DNA, 19 bp, Homo sapiens
gagaaagcaggcacagcac

SEQ ID NO: 12461 - DNA, 22 bp, Homo sapiens
gggcggatcacctgaggtcagg

SEQ ID NO: 12462 - DNA, 22 bp, Homo sapiens
cgtggcctctatggctcccgcc

SEQ ID NO: 12463 - DNA, 22 bp, Homo sapiens
tgagccaagttcacaccattgc

SEQ ID NO: 12464 - DNA, 22 bp, Homo sapiens
catagcggtattccacgtggtt

SEQ ID NO: 12465 - DNA, 22 bp, Homo sapiens
tccaggctttggggcaggagcg

SEQ ID NO: 12466 - DNA, 22 bp, Homo sapiens
aaggaatttgaggctgcagtga

SEQ ID NO: 12467 - DNA, 22 bp, Homo sapiens
agcgacaccgcctgcaggccat

SEQ ID NO: 12468 - DNA, 22 bp, Homo sapiens
caaagtggaggctctggggcca

SEQ ID NO: 12469 - DNA, 22 bp, Homo sapiens
agaaaatgtgaacttgtgaatt

SEQ ID NO: 12470 - DNA, 22 bp, Homo sapiens
tcacaatatttatcttccaatt

SEQ ID NO: 12471 - DNA, 22 bp, Homo sapiens
caatttgattaataccatactt

SEQ ID NO: 12472 - DNA, 22 bp, Homo sapiens
caggctggagtacaattgtgtg

SEQ ID NO: 12473 - DNA, 23 bp, Homo sapiens
tgagtgtgaaaatcctggagatg

SEQ ID NO: 12474 - DNA, 22 bp, Homo sapiens
ttgtgctgtgagaatgctcatt

SEQ ID NO: 12475 - DNA, 21 bp, Homo sapiens
tgctccaggagggggcagtcc

SEQ ID NO: 12476 - DNA, 22 bp, Homo sapiens
tggcaagaaccgcaattacttt

SEQ ID NO: 12477 - DNA, 22 bp, Homo sapiens
ttgcaaatcagaagtatagatt

SEQ ID NO: 12478 - DNA, 22 bp, Homo sapiens
acaggggacctaggaccctcgg

SEQ ID NO: 12479 - DNA, 22 bp, Homo sapiens
tcagtcttgaacagccccctgt

SEQ ID NO: 12480 - DNA, 22 bp, Homo sapiens
gttgctcaggcaggagtacagt

SEQ ID NO: 12481 - DNA, 22 bp, Homo sapiens
tatctattatgttctatgtgtc

SEQ ID NO: 12482 - DNA, 22 bp, Homo sapiens
atacaaagtattgatcctgagt

SEQ ID NO: 12483 - DNA, 21 bp, Homo sapiens
gggcctggctgcgcaggacgg

SEQ ID NO: 12484 - DNA, 22 bp, Homo sapiens
gctgaaggcccggaggacaggg

SEQ ID NO: 12485 - DNA, 22 bp, Homo sapiens
gagccaagattgtgtccctgca

SEQ ID NO: 12486 - DNA, 22 bp, Homo sapiens
accacctcatcaagctggattg

SEQ ID NO: 12487 - DNA, 22 bp, Homo sapiens
ttctcaaagtgtgctccctgga

SEQ ID NO: 12488 - DNA, 22 bp, Homo sapiens
tattgacagtgactattggtag

SEQ ID NO: 12489 - DNA, 22 bp, Homo sapiens
aagtgatgctacgactttgaca

SEQ ID NO: 12490 - DNA, 22 bp, Homo sapiens
cacggtggcccacaggtgcaag

SEQ ID NO: 12491 - DNA, 22 bp, Homo sapiens
aatggctctgatgttgttgtga

SEQ ID NO: 12492 - DNA, 18 bp, Homo sapiens
ttcacaagggcttggttt

SEQ ID NO: 12493 - DNA, 22 bp, Homo sapiens
gttcatcactcagagacctccc

SEQ ID NO: 12494 - DNA, 22 bp, Homo sapiens
ttgagcccaggaggcctgggtg

SEQ ID NO: 12495 - DNA, 22 bp, Homo sapiens
atgttgagagctgagatcagcc

SEQ ID NO: 12496 - DNA, 22 bp, Homo sapiens
ttgttgtcattgtagaggattt

SEQ ID NO: 12497 - DNA, 22 bp, Homo sapiens
ctggtaggggtgactgttatcg

SEQ ID NO: 12498 - DNA, 23 bp, Homo sapiens
ttaaacactagttcgagtagcat

SEQ ID NO: 12499 - DNA, 22 bp, Homo sapiens
tatgaggtaggtattatactta

SEQ ID NO: 12500 - DNA, 22 bp, Homo sapiens
ttgatacccaagtgttatgggt

SEQ ID NO: 12501 - DNA, 22 bp, Homo sapiens
ctcctggaggatagtgactggg

SEQ ID NO: 12502 - DNA, 19 bp, Homo sapiens
gatttaaacgtggctctat

SEQ ID NO: 12503 - DNA, 22 bp, Homo sapiens
acagaactgggaaatgcacata

SEQ ID NO: 12504 - DNA, 22 bp, Homo sapiens
gctctgccagcccaaggcgcag

SEQ ID NO: 12505 - DNA, 22 bp, Homo sapiens
acacttggagcaacacttatgg

SEQ ID NO: 12506 - DNA, 22 bp, Homo sapiens
tagcaaaggatgactatgtacc

SEQ ID NO: 12507 - DNA, 22 bp, Homo sapiens
caccaggctggagtgcagtggc

SEQ ID NO: 12508 - DNA, 22 bp, Homo sapiens
gcccagagttcaaggctgcagt

SEQ ID NO: 12509 - DNA, 22 bp, Homo sapiens
cctggaaagagaatgaatgagc

SEQ ID NO: 12510 - DNA, 22 bp, Homo sapiens
gagctctgactgctgggtgaca

SEQ ID NO: 12511 - DNA, 22 bp, Homo sapiens
ccccagtggaggtgagggtcct

SEQ ID NO: 12512 - DNA, 22 bp, Homo sapiens
gaggccactgtccctgccttcc

SEQ ID NO: 12513 - DNA, 22 bp, Homo sapiens
agccaccaccactgaaaggtta

SEQ ID NO: 12514 - DNA, 22 bp, Homo sapiens
ttgcatcagaattacttggagg

SEQ ID NO: 12515 - DNA, 22 bp, Homo sapiens
cctggctcctacgggtattttg

SEQ ID NO: 12516 - DNA, 22 bp, Homo sapiens
aaagtgctgggattacaagcgt

SEQ ID NO: 12517 - DNA, 22 bp, Homo sapiens
gctcactgcaagctctgcctcc

SEQ ID NO: 12518 - DNA, 22 bp, Homo sapiens
aactaatacattaatacatgtg

SEQ ID NO: 12519 - DNA, 22 bp, Homo sapiens
tcctccccaaagcccagcctgg

SEQ ID NO: 12520 - DNA, 22 bp, Homo sapiens
tctgctctgtggcttcagctaa

SEQ ID NO: 12521 - DNA, 22 bp, Homo sapiens
tggaggccagaggtactgggac

SEQ ID NO: 12522 - DNA, 22 bp, Homo sapiens
gggaagtgagctggaatcaagg

SEQ ID NO: 12523 - DNA, 22 bp, Homo sapiens
catgtgtcttgctgccctccat

SEQ ID NO: 12524 - DNA, 20 bp, Homo sapiens
ttcatgggagcaaagaggcc

SEQ ID NO: 12525 - DNA, 22 bp, Homo sapiens
ctgctgggatagaagtatctca

SEQ ID NO: 12526 - DNA, 22 bp, Homo sapiens
ctgagcatcatggcagaatctt

SEQ ID NO: 12527 - DNA, 17 bp, Homo sapiens
gaggccaaggcaggcgg

SEQ ID NO: 12528 - DNA, 21 bp, Homo sapiens
gttcttgcaggatttccttcc

SEQ ID NO: 12529 - DNA, 22 bp, Homo sapiens
agggagatcgaccgtgttatat

SEQ ID NO: 12530 - DNA, 22 bp, Homo sapiens
actgcaacctccacctcctggg

SEQ ID NO: 12531 - DNA, 22 bp, Homo sapiens
tcacaaatgtttgcatgtgtct

SEQ ID NO: 12532 - DNA, 22 bp, Homo sapiens
ttttaagttggattgctaagta

SEQ ID NO: 12533 - DNA, 22 bp, Homo sapiens
ctggctctcaggctggtcccca

SEQ ID NO: 12534 - DNA, 22 bp, Homo sapiens
ttgcagttttgacagaccaaat

SEQ ID NO: 12535 - DNA, 22 bp, Homo sapiens
gaattttattactagtcaactg

SEQ ID NO: 12536 - DNA, 22 bp, Homo sapiens
tgtagtagcattcacgaagtgt

SEQ ID NO: 12537 - DNA, 22 bp, Homo sapiens
aaccattcactgaacagttcaa

SEQ ID NO: 12538 - DNA, 22 bp, Homo sapiens
tgagcctgggagatggaggctg

SEQ ID NO: 12539 - DNA, 22 bp, Homo sapiens
gcttaattctggctcagtttcc

SEQ ID NO: 12540 - DNA, 22 bp, Homo sapiens
ggcttgaagggaggaaagcagg

SEQ ID NO: 12541 - DNA, 22 bp, Homo sapiens
gttgacagtgaccctgaaagca

SEQ ID NO: 12542 - DNA, 22 bp, Homo sapiens
tgagctgtctgaatggtgagga

SEQ ID NO: 12543 - DNA, 22 bp, Homo sapiens
agggctgcccagtgtgagagct

SEQ ID NO: 12544 - DNA, 22 bp, Homo sapiens
gtggcttggaccagtcacagtg

SEQ ID NO: 12545 - DNA, 22 bp, Homo sapiens
caccagcagcggtgtgagggtg

SEQ ID NO: 12546 - DNA, 22 bp, Homo sapiens
tgggaagaggggtataaagaag

SEQ ID NO: 12547 - DNA, 23 bp, Homo sapiens
tcatcttcctcatttctccaggg

SEQ ID NO: 12548 - DNA, 22 bp, Homo sapiens
actttcttggtcccatgtttga

SEQ ID NO: 12549 - DNA, 22 bp, Homo sapiens
actgcactcctgcctgggtaac

SEQ ID NO: 12550 - DNA, 22 bp, Homo sapiens
atgtgtattacctcgattgtga

SEQ ID NO: 12551 - DNA, 22 bp, Homo sapiens
tgcagtggtacaatttcggctc

SEQ ID NO: 12552 - DNA, 22 bp, Homo sapiens
acacagggctgcgcctgacccc

SEQ ID NO: 12553 - DNA, 23 bp, Homo sapiens
tgagctgggcctgcaggggtctc

SEQ ID NO: 12554 - DNA, 22 bp, Homo sapiens
ggaggcagaatagagtgtgggt

SEQ ID NO: 12555 - DNA, 22 bp, Homo sapiens
gggggagagacgagcggctctg

SEQ ID NO: 12556 - DNA, 22 bp, Homo sapiens
ataaaatttgctactgttaaat

SEQ ID NO: 12557 - DNA, 22 bp, Homo sapiens
gcttcttgcctgtgtagagaat

SEQ ID NO: 12558 - DNA, 22 bp, Homo sapiens
cctgctggctctgttgctcggc

SEQ ID NO: 12559 - DNA, 23 bp, Homo sapiens
aggatgtaggatgtatggcagag

SEQ ID NO: 12560 - DNA, 22 bp, Homo sapiens
tgtagctctccagccagcaagg

SEQ ID NO: 12561 - DNA, 22 bp, Homo sapiens
cgttaataggtgcaaggtaagg

SEQ ID NO: 12562 - DNA, 22 bp, Homo sapiens
ggagagcagggaggctgctctg

SEQ ID NO: 12563 - DNA, 22 bp, Homo sapiens
aattgaaaatattgtagaccat

SEQ ID NO: 12564 - DNA, 22 bp, Homo sapiens
tgcactccaggctgggtgacag

SEQ ID NO: 12565 - DNA, 22 bp, Homo sapiens
ctgggagtggtgacagctctcg

SEQ ID NO: 12566 - DNA, 22 bp, Homo sapiens
ccctggctggctctgcccggac

SEQ ID NO: 12567 - DNA, 22 bp, Homo sapiens
atggggaagcaattggatttcc

SEQ ID NO: 12568 - DNA, 22 bp, Homo sapiens
agggctggagccacagctggga

SEQ ID NO: 12569 - DNA, 22 bp, Homo sapiens
ctcagcactgacccaggagatg

SEQ ID NO: 12570 - DNA, 22 bp, Homo sapiens
aaggctgaggcagtgaggcaga

SEQ ID NO: 12571 - DNA, 22 bp, Homo sapiens
cttagagatgggttttacttag

SEQ ID NO: 12572 - DNA, 22 bp, Homo sapiens
ctgactgggttaagttcatgta

SEQ ID NO: 12573 - DNA, 22 bp, Homo sapiens
ccggtcccaggtgccccggtga

SEQ ID NO: 12574 - DNA, 22 bp, Homo sapiens
gcctacatttcccagttgaatg

SEQ ID NO: 12575 - DNA, 22 bp, Homo sapiens
gtacccagtgattccttcttca

SEQ ID NO: 12576 - DNA, 22 bp, Homo sapiens
tttacacagaggacactgggct

SEQ ID NO: 12577 - DNA, 22 bp, Homo sapiens
cacagctgaagtagccatgtgg

SEQ ID NO: 12578 - DNA, 22 bp, Homo sapiens
cagcaggaggtgagtagcaggt

SEQ ID NO: 12579 - DNA, 22 bp, Homo sapiens
ggtgtagctctgtgtcccactg

SEQ ID NO: 12580 - DNA, 22 bp, Homo sapiens
acactgcagatgaaagcataag

SEQ ID NO: 12581 - DNA, 22 bp, Homo sapiens
ctaaactgctctggggttctaa

SEQ ID NO: 12582 - DNA, 22 bp, Homo sapiens
ctttaaggtgatgagagatgct

SEQ ID NO: 12583 - DNA, 22 bp, Homo sapiens
attcatcagctaatggacattt

SEQ ID NO: 12584 - DNA, 22 bp, Homo sapiens
ggcaggaggtgagtggcgggtg

SEQ ID NO: 12585 - DNA, 22 bp, Homo sapiens
ctgcatgtttacatttttgaga

SEQ ID NO: 12586 - DNA, 22 bp, Homo sapiens
acagattcactgcactggccat

SEQ ID NO: 12587 - DNA, 22 bp, Homo sapiens
tctagggtgtataaggaagcct

SEQ ID NO: 12588 - DNA, 22 bp, Homo sapiens
cccacaggtgtgagcttgctgg

SEQ ID NO: 12589 - DNA, 22 bp, Homo sapiens
agagcactttcgagagccggag

SEQ ID NO: 12590 - DNA, 22 bp, Homo sapiens
cagcagcagtggctgcagaaca

SEQ ID NO: 12591 - DNA, 22 bp, Homo sapiens
gtgtttggtcagacgtccgggg

SEQ ID NO: 12592 - DNA, 22 bp, Homo sapiens
actgcactccagcctgggtgac

SEQ ID NO: 12593 - DNA, 22 bp, Homo sapiens
tccgtggggcctgtggcttccg

SEQ ID NO: 12594 - DNA, 22 bp, Homo sapiens
atgaattgaggaaaacagtcgt

SEQ ID NO: 12595 - DNA, 19 bp, Homo sapiens
gggtcccaaaagatgtgct

SEQ ID NO: 12596 - DNA, 22 bp, Homo sapiens
ctcactgcaagctctgcctccc

SEQ ID NO: 12597 - DNA, 22 bp, Homo sapiens
caggagtgttgattgctcagga

SEQ ID NO: 12598 - DNA, 22 bp, Homo sapiens
ggctcaatgcaacttctgcctc

SEQ ID NO: 12599 - DNA, 22 bp, Homo sapiens
ctgtcctggggaaagccagccc

SEQ ID NO: 12600 - DNA, 22 bp, Homo sapiens
aggcaatcccctgaggatactt

SEQ ID NO: 12601 - DNA, 22 bp, Homo sapiens
gacctcgtgatccgccctcctt

SEQ ID NO: 12602 - DNA, 22 bp, Homo sapiens
gctgaggtggaggaaggagacc

SEQ ID NO: 12603 - DNA, 22 bp, Homo sapiens
gctgctctccaagcctccttga

SEQ ID NO: 12604 - DNA, 22 bp, Homo sapiens
gtagggctcagtaaatactttg

SEQ ID NO: 12605 - DNA, 22 bp, Homo sapiens
atcccaggcggcacaggttgca

SEQ ID NO: 12606 - DNA, 22 bp, Homo sapiens
ggtctcatctttcagcgtcgag

SEQ ID NO: 12607 - DNA, 22 bp, Homo sapiens
tgtctggtgggttgacaggcag

SEQ ID NO: 12608 - DNA, 22 bp, Homo sapiens
actgccaatggtagtttgatgg

SEQ ID NO: 12609 - DNA, 22 bp, Homo sapiens
ccattgtaaattctgtggaagt

SEQ ID NO: 12610 - DNA, 22 bp, Homo sapiens
gaggtgggcggatcacaaggtc

SEQ ID NO: 12611 - DNA, 22 bp, Homo sapiens
gccagtggtcactgaggaagaa

SEQ ID NO: 12612 - DNA, 22 bp, Homo sapiens
ggaggtgactggatcatgggca

SEQ ID NO: 12613 - DNA, 19 bp, Homo sapiens
ggggcccggggtctgcgag

SEQ ID NO: 12614 - DNA, 22 bp, Homo sapiens
gtgctttgttaagtctgaaatt

SEQ ID NO: 12615 - DNA, 22 bp, Homo sapiens
tcttgggggactttggcatgga

SEQ ID NO: 12616 - DNA, 22 bp, Homo sapiens
catgaaattgtattggcctcaa

SEQ ID NO: 12617 - DNA, 17 bp, Homo sapiens
caggtgttctgtttttc

SEQ ID NO: 12618 - DNA, 22 bp, Homo sapiens
actcagtacatctggagttggc

SEQ ID NO: 12619 - DNA, 22 bp, Homo sapiens
ttgtgggatctccctgttgctc

SEQ ID NO: 12620 - DNA, 22 bp, Homo sapiens
ataatggtagatgtccacgcag

SEQ ID NO: 12621 - DNA, 22 bp, Homo sapiens
ctggagtagccggacgggtctg

SEQ ID NO: 12622 - DNA, 22 bp, Homo sapiens
gtgcagttgtggacatgacaac

SEQ ID NO: 12623 - DNA, 22 bp, Homo sapiens
gtggcccaggttggagtgcagt

SEQ ID NO: 12624 - DNA, 22 bp, Homo sapiens
gtctttcttaaacaacagaaca

SEQ ID NO: 12625 - DNA, 22 bp, Homo sapiens
tcaggaggtccgcccgggaggg

SEQ ID NO: 12626 - DNA, 22 bp, Homo sapiens
ctctggagtgtctggccagggt

SEQ ID NO: 12627 - DNA, 22 bp, Homo sapiens
tctggcttcgcagctcccagcc

SEQ ID NO: 12628 - DNA, 23 bp, Homo sapiens
aattatctatttcaaatttagca

SEQ ID NO: 12629 - DNA, 21 bp, Homo sapiens
tcacgtggtcacatgagcttt

SEQ ID NO: 12630 - DNA, 22 bp, Homo sapiens
gcagtggcatgatgtgggctca

SEQ ID NO: 12631 - DNA, 21 bp, Homo sapiens
tgggtcagagggaaagtgtat

SEQ ID NO: 12632 - DNA, 22 bp, Homo sapiens
gatagtcacctcccttaacttt

SEQ ID NO: 12633 - DNA, 22 bp, Homo sapiens
acattcccaccaacagtgtaaa

SEQ ID NO: 12634 - DNA, 22 bp, Homo sapiens
cgcggctctgcgggccgctgag

SEQ ID NO: 12635 - DNA, 22 bp, Homo sapiens
ttgagggtctggatctgctgct

SEQ ID NO: 12636 - DNA, 22 bp, Homo sapiens
gcaaatgctaaagtgtagagac

SEQ ID NO: 12637 - DNA, 21 bp, Homo sapiens
ccgtgctcggctatggaccac

SEQ ID NO: 12638 - DNA, 22 bp, Homo sapiens
tctgcaggaagctggcggctga

SEQ ID NO: 12639 - DNA, 23 bp, Homo sapiens
agcttttaggtggaaatggcact

SEQ ID NO: 12640 - DNA, 22 bp, Homo sapiens
agagtccctcttcccaggaggc

SEQ ID NO: 12641 - DNA, 22 bp, Homo sapiens
aaggcggggggatcacgaggtc

SEQ ID NO: 12642 - DNA, 22 bp, Homo sapiens
ttctccgctaagttctctgcag

SEQ ID NO: 12643 - DNA, 22 bp, Homo sapiens
ctatacagcagcttactagtta

SEQ ID NO: 12644 - DNA, 22 bp, Homo sapiens
tgtgcgtcctgtgcgcacactg

SEQ ID NO: 12645 - DNA, 22 bp, Homo sapiens
gttgtgattgtagctaaactag

SEQ ID NO: 12646 - DNA, 22 bp, Homo sapiens
ccctgccttgtctgggctaggt

SEQ ID NO: 12647 - DNA, 22 bp, Homo sapiens
acgggctgggacggggaagctc

SEQ ID NO: 12648 - DNA, 22 bp, Homo sapiens
aagaagagaactggcatcctaa

SEQ ID NO: 12649 - DNA, 22 bp, Homo sapiens
caggaggacatactggctcaca

SEQ ID NO: 12650 - DNA, 22 bp, Homo sapiens
aaacatctactgtaggctggag

SEQ ID NO: 12651 - DNA, 23 bp, Homo sapiens
aaacttgctatggctgaaatcat

SEQ ID NO: 12652 - DNA, 22 bp, Homo sapiens
gaaggagccgagctcttcccca

SEQ ID NO: 12653 - DNA, 22 bp, Homo sapiens
ctagggtcaggggcctgcgtcg

SEQ ID NO: 12654 - DNA, 22 bp, Homo sapiens
tttcaccatcttggccaggctg

SEQ ID NO: 12655 - DNA, 22 bp, Homo sapiens
tgggcgacagagcaagactccg

SEQ ID NO: 12656 - DNA, 22 bp, Homo sapiens
gtctttatttgagattgtcatt

SEQ ID NO: 12657 - DNA, 22 bp, Homo sapiens
tctttgctattgtgaatagtgc

SEQ ID NO: 12658 - DNA, 22 bp, Homo sapiens
cactgcactccagcctgggtca

SEQ ID NO: 12659 - DNA, 22 bp, Homo sapiens
aagttgttgttgaggtgggtaa

SEQ ID NO: 12660 - DNA, 22 bp, Homo sapiens
aagccaggttccatggaggagc

SEQ ID NO: 12661 - DNA, 22 bp, Homo sapiens
gcagatggatgtggacggcgcc

SEQ ID NO: 12662 - DNA, 22 bp, Homo sapiens
tcactgcactccagcctgggca

SEQ ID NO: 12663 - DNA, 22 bp, Homo sapiens
aacggctgtggctggcggcagc

SEQ ID NO: 12664 - DNA, 20 bp, Homo sapiens
aagcagtgaggtgaggagtg

SEQ ID NO: 12665 - DNA, 22 bp, Homo sapiens
gccccgcgcctggctccaggtg

SEQ ID NO: 12666 - DNA, 22 bp, Homo sapiens
ccgaggctggagtgcagtggcg

SEQ ID NO: 12667 - DNA, 22 bp, Homo sapiens
agccggccatgtggtcttgtgc

SEQ ID NO: 12668 - DNA, 22 bp, Homo sapiens
tccccagcttgctacttctgct

SEQ ID NO: 12669 - DNA, 22 bp, Homo sapiens
tgaaatcttcactaagtctctt

SEQ ID NO: 12670 - DNA, 16 bp, Homo sapiens
gcgcctcctcggcctc

SEQ ID NO: 12671 - DNA, 18 bp, Homo sapiens
actctgcggaggccccag

SEQ ID NO: 12672 - DNA, 22 bp, Homo sapiens
atcacaaaggtctcagagcaca

SEQ ID NO: 12673 - DNA, 22 bp, Homo sapiens
ggctgcaggttggttggcagct

SEQ ID NO: 12674 - DNA, 22 bp, Homo sapiens
tgtgcacctcatccaccagacc

SEQ ID NO: 12675 - DNA, 22 bp, Homo sapiens
ggagcagggaattacagcgcag

SEQ ID NO: 12676 - DNA, 22 bp, Homo sapiens
gattgggggtcaggctcaggtc

SEQ ID NO: 12677 - DNA, 22 bp, Homo sapiens
gtagaagagattttattcctta

SEQ ID NO: 12678 - DNA, 19 bp, Homo sapiens
gttctttcatagtaagagc

SEQ ID NO: 12679 - DNA, 22 bp, Homo sapiens
gctctgagtcacactgccctgt

SEQ ID NO: 12680 - DNA, 22 bp, Homo sapiens
ttcccagtcaaacgaaggactt

SEQ ID NO: 12681 - DNA, 22 bp, Homo sapiens
catgtgaattccaaagctaggt

SEQ ID NO: 12682 - DNA, 22 bp, Homo sapiens
atttactttgctgagatccatc

SEQ ID NO: 12683 - DNA, 22 bp, Homo sapiens
tttggactgcatgatgatctgg

SEQ ID NO: 12684 - DNA, 22 bp, Homo sapiens
gaccatcctggccaacgtggta

SEQ ID NO: 12685 - DNA, 22 bp, Homo sapiens
gtgggccactgggaggcaaggg

SEQ ID NO: 12686 - DNA, 22 bp, Homo sapiens
gtgcacatcgtgcaggtttgtt

SEQ ID NO: 12687 - DNA, 22 bp, Homo sapiens
ttctgccttggcagggtggtcc

SEQ ID NO: 12688 - DNA, 22 bp, Homo sapiens
ttattgaaggaactgaaataaa

SEQ ID NO: 12689 - DNA, 22 bp, Homo sapiens
caccttactccctctggatgcc

SEQ ID NO: 12690 - DNA, 22 bp, Homo sapiens
atgaagcgttcgagataggtag

SEQ ID NO: 12691 - DNA, 22 bp, Homo sapiens
ccctggctgcgtgatggatgaa

SEQ ID NO: 12692 - DNA, 22 bp, Homo sapiens
gcagttaaaaataaaccttcat

SEQ ID NO: 12693 - DNA, 22 bp, Homo sapiens
ccagttccagtgctcacatcca

SEQ ID NO: 12694 - DNA, 22 bp, Homo sapiens
tggggaaaatgcttgtagtcag

SEQ ID NO: 12695 - DNA, 18 bp, Homo sapiens
agtgtcagctgcagctca

SEQ ID NO: 12696 - DNA, 22 bp, Homo sapiens
ttttatctgtgacatctggcag

SEQ ID NO: 12697 - DNA, 22 bp, Homo sapiens
tgtgtcagaaggcaatggggat

SEQ ID NO: 12698 - DNA, 22 bp, Homo sapiens
ttcagcactgactgagtggtta

SEQ ID NO: 12699 - DNA, 22 bp, Homo sapiens
atcacccaggctggagtgcagt

SEQ ID NO: 12700 - DNA, 22 bp, Homo sapiens
tgatgaccgccaacgtttaggt

SEQ ID NO: 12701 - DNA, 22 bp, Homo sapiens
aggctggagtgcagttgcatga

SEQ ID NO: 12702 - DNA, 22 bp, Homo sapiens
tagatgtgttgcctggagttgt

SEQ ID NO: 12703 - DNA, 19 bp, Homo sapiens
ctccttgccatttcttttc

SEQ ID NO: 12704 - DNA, 22 bp, Homo sapiens
aagaggttgtctgtgatgagtt

SEQ ID NO: 12705 - DNA, 22 bp, Homo sapiens
ttgtcagccagctcgcactctt

SEQ ID NO: 12706 - DNA, 22 bp, Homo sapiens
accccaggaagtggaggtcatg

SEQ ID NO: 12707 - DNA, 22 bp, Homo sapiens
ttctgattgctgatgaggccca

SEQ ID NO: 12708 - DNA, 22 bp, Homo sapiens
agagcgcactgtctgcaggcaa

SEQ ID NO: 12709 - DNA, 22 bp, Homo sapiens
atctagattaggtataagagct

SEQ ID NO: 12710 - DNA, 22 bp, Homo sapiens
tagcacagggctcctcaaccca

SEQ ID NO: 12711 - DNA, 20 bp, Homo sapiens
cattggacttggcttcatgg

SEQ ID NO: 12712 - DNA, 22 bp, Homo sapiens
gaagctgagctgaggcatgttg

SEQ ID NO: 12713 - DNA, 22 bp, Homo sapiens
aagaataagaggatttagaaca

SEQ ID NO: 12714 - DNA, 22 bp, Homo sapiens
ctgcgttctgcctggcggccta

SEQ ID NO: 12715 - DNA, 22 bp, Homo sapiens
atttacaggtagaattttaagt

SEQ ID NO: 12716 - DNA, 22 bp, Homo sapiens
tgtcaatatgtaataactgaat

SEQ ID NO: 12717 - DNA, 22 bp, Homo sapiens
ggtgtccgcgctgtagaaggtc

SEQ ID NO: 12718 - DNA, 22 bp, Homo sapiens
ttggagagtgatattcagatgc

SEQ ID NO: 12719 - DNA, 22 bp, Homo sapiens
gagcagtaggagaaccctgagc

SEQ ID NO: 12720 - DNA, 22 bp, Homo sapiens
caattgacaatgacagtgtcaa

SEQ ID NO: 12721 - DNA, 22 bp, Homo sapiens
tgaagctttaggatgggttcat

SEQ ID NO: 12722 - DNA, 22 bp, Homo sapiens
attggtagttttgtatttctct

SEQ ID NO: 12723 - DNA, 22 bp, Homo sapiens
gctgtagtgaatggccgcgttc

SEQ ID NO: 12724 - DNA, 22 bp, Homo sapiens
agcacctccagagcttgaagct

SEQ ID NO: 12725 - DNA, 19 bp, Homo sapiens
gataggcagccatgagccc

SEQ ID NO: 12726 - DNA, 19 bp, Homo sapiens
gggaatgatggaagacttc

SEQ ID NO: 12727 - DNA, 22 bp, Homo sapiens
agggcactgcaagggttgaagg

SEQ ID NO: 12728 - DNA, 20 bp, Homo sapiens
catgtgtcagttctcaccca

SEQ ID NO: 12729 - DNA, 22 bp, Homo sapiens
gagaactttctgtgtttttatc

SEQ ID NO: 12730 - DNA, 22 bp, Homo sapiens
gcctcactgcagccccaggaag

SEQ ID NO: 12731 - DNA, 22 bp, Homo sapiens
tggccggggctgatggacagtg

SEQ ID NO: 12732 - DNA, 22 bp, Homo sapiens
cgctccttgagcgtgtcggcct

SEQ ID NO: 12733 - DNA, 22 bp, Homo sapiens
tagctgggactactggccctgc

SEQ ID NO: 12734 - DNA, 22 bp, Homo sapiens
aacagcttgctgcaccttaata

SEQ ID NO: 12735 - DNA, 22 bp, Homo sapiens
gaccaagatacagcatcataga

SEQ ID NO: 12736 - DNA, 22 bp, Homo sapiens
attgttcaatgtaataattttg

SEQ ID NO: 12737 - DNA, 22 bp, Homo sapiens
cttggtgccacagcagcttgcg

SEQ ID NO: 12738 - DNA, 22 bp, Homo sapiens
tcttgaattgtactcccataag

SEQ ID NO: 12739 - DNA, 22 bp, Homo sapiens
tctagttctagatccctgagga

SEQ ID NO: 12740 - DNA, 22 bp, Homo sapiens
ggctcacgcaattatcccggcc

SEQ ID NO: 12741 - DNA, 22 bp, Homo sapiens
tgccatcagctgactccaaggt

SEQ ID NO: 12742 - DNA, 22 bp, Homo sapiens
aagattttcagtgcctaaaaca

SEQ ID NO: 12743 - DNA, 22 bp, Homo sapiens
ttccatacgactgaggtctcgg

SEQ ID NO: 12744 - DNA, 22 bp, Homo sapiens
tggtattacttctagacacaag

SEQ ID NO: 12745 - DNA, 22 bp, Homo sapiens
tttaatcataagaaggaaaata

SEQ ID NO: 12746 - DNA, 22 bp, Homo sapiens
gcccagccacagtcactttcat

SEQ ID NO: 12747 - DNA, 23 bp, Homo sapiens
tcggtgggcgtggaggccgaggc

SEQ ID NO: 12748 - DNA, 22 bp, Homo sapiens
atgttatgtctgggaaggggta

SEQ ID NO: 12749 - DNA, 22 bp, Homo sapiens
gaggctgaggcggatggatcac

SEQ ID NO: 12750 - DNA, 22 bp, Homo sapiens
gagcacagtaaagcagtgtcac

SEQ ID NO: 12751 - DNA, 22 bp, Homo sapiens
gagctgggcctgcgagtgctgc

SEQ ID NO: 12752 - DNA, 22 bp, Homo sapiens
atgagaaagttaatcatcatga

SEQ ID NO: 12753 - DNA, 22 bp, Homo sapiens
gccatcatatcccctgtgacct

SEQ ID NO: 12754 - DNA, 23 bp, Homo sapiens
cttcacaggttcaggggattaag

SEQ ID NO: 12755 - DNA, 22 bp, Homo sapiens
ctcggcaggtggaggttgtagt

SEQ ID NO: 12756 - DNA, 22 bp, Homo sapiens
ctgggtggcagagcctgcagtg

SEQ ID NO: 12757 - DNA, 22 bp, Homo sapiens
actatagatgctggcgaggctg

SEQ ID NO: 12758 - DNA, 22 bp, Homo sapiens
tgtggccattcttgaggtcgac

SEQ ID NO: 12759 - DNA, 22 bp, Homo sapiens
tggtgccatcatagctcactgc

SEQ ID NO: 12760 - DNA, 22 bp, Homo sapiens
agcgccactgcactccagcctg

SEQ ID NO: 12761 - DNA, 22 bp, Homo sapiens
cacactgtctttcagaatggtt

SEQ ID NO: 12762 - DNA, 22 bp, Homo sapiens
ctgtctgcaggatagtaccctc

SEQ ID NO: 12763 - DNA, 22 bp, Homo sapiens
acccaggctggagtgcagtggg

SEQ ID NO: 12764 - DNA, 22 bp, Homo sapiens
actgcactccagcccgggtgac

SEQ ID NO: 12765 - DNA, 22 bp, Homo sapiens
tccttgtgctgagggtgttgct

SEQ ID NO: 12766 - DNA, 22 bp, Homo sapiens
cctgggaatcggtgcgttgagg

SEQ ID NO: 12767 - DNA, 20 bp, Homo sapiens
aggccccaggtggacactag

SEQ ID NO: 12768 - DNA, 22 bp, Homo sapiens
agaggctgcacttgctcatgat

SEQ ID NO: 12769 - DNA, 22 bp, Homo sapiens
tcctgggccctccggatcaggt

SEQ ID NO: 12770 - DNA, 22 bp, Homo sapiens
gattgagtctgaggatgctgca

SEQ ID NO: 12771 - DNA, 22 bp, Homo sapiens
ctgggctcaagtgatccaccca

SEQ ID NO: 12772 - DNA, 22 bp, Homo sapiens
ctacattaaattggcttactta

SEQ ID NO: 12773 - DNA, 22 bp, Homo sapiens
actcaaatagcaacggtgagaa

SEQ ID NO: 12774 - DNA, 22 bp, Homo sapiens
cccaggaggtcaaggctgcagt

SEQ ID NO: 12775 - DNA, 22 bp, Homo sapiens
ctgaacttattgagtgcttgct

SEQ ID NO: 12776 - DNA, 22 bp, Homo sapiens
actgttttctgtaaagggccag

SEQ ID NO: 12777 - DNA, 22 bp, Homo sapiens
caggctgatcagggctgggatg

SEQ ID NO: 12778 - DNA, 22 bp, Homo sapiens
atccccagaaagaccgatgtac

SEQ ID NO: 12779 - DNA, 22 bp, Homo sapiens
ctggagagaatgtggaatgatt

SEQ ID NO: 12780 - DNA, 22 bp, Homo sapiens
gctgatcacatttccaaaaccc

SEQ ID NO: 12781 - DNA, 22 bp, Homo sapiens
taatttcagtgcaagctcacgg

SEQ ID NO: 12782 - DNA, 22 bp, Homo sapiens
cctgggggccaggaaggtgtga

SEQ ID NO: 12783 - DNA, 22 bp, Homo sapiens
aaattgtaatgacttcacttga

SEQ ID NO: 12784 - DNA, 22 bp, Homo sapiens
gtcaaaagctaatttgttattt

SEQ ID NO: 12785 - DNA, 22 bp, Homo sapiens
tcgggctcgctctcctagcgga

SEQ ID NO: 12786 - DNA, 22 bp, Homo sapiens
ctgatagacaatcaccatggga

SEQ ID NO: 12787 - DNA, 22 bp, Homo sapiens
gacggagctggttgctgcggct

SEQ ID NO: 12788 - DNA, 18 bp, Homo sapiens
actctttctgcccacagg

SEQ ID NO: 12789 - DNA, 22 bp, Homo sapiens
tattcatagtaaacaaaagtgg

SEQ ID NO: 12790 - DNA, 22 bp, Homo sapiens
aaaggacacacaggaggtgtct

SEQ ID NO: 12791 - DNA, 22 bp, Homo sapiens
caatgctaaaaattctgtacat

SEQ ID NO: 12792 - DNA, 22 bp, Homo sapiens
tagagcattatgacaaccccat

SEQ ID NO: 12793 - DNA, 22 bp, Homo sapiens
ttttccttcatatcccttatgt

SEQ ID NO: 12794 - DNA, 22 bp, Homo sapiens
ctgctctgctgatcagtgtctc

SEQ ID NO: 12795 - DNA, 22 bp, Homo sapiens
gaccctgtttctacaaataatt

SEQ ID NO: 12796 - DNA, 22 bp, Homo sapiens
aagcagatctgatagggccctg

SEQ ID NO: 12797 - DNA, 22 bp, Homo sapiens
tgaggatgtctgtattttgcct

SEQ ID NO: 12798 - DNA, 22 bp, Homo sapiens
tttttccacataccctaggcca

SEQ ID NO: 12799 - DNA, 22 bp, Homo sapiens
tgatgcctaatatacttcaatt

SEQ ID NO: 12800 - DNA, 22 bp, Homo sapiens
tcctgtgatattgtttgttata

SEQ ID NO: 12801 - DNA, 22 bp, Homo sapiens
gtctgctcatgctaccgcgggc

SEQ ID NO: 12802 - DNA, 22 bp, Homo sapiens
cccaggccccagggcttgtcag

SEQ ID NO: 12803 - DNA, 22 bp, Homo sapiens
gctgggacaacaggtgagcacc

SEQ ID NO: 12804 - DNA, 22 bp, Homo sapiens
aatggcactttataaatgttaa

SEQ ID NO: 12805 - DNA, 22 bp, Homo sapiens
ctgtccgccgacttggccaggc

SEQ ID NO: 12806 - DNA, 22 bp, Homo sapiens
aaagcgcttccctttggagcgt

SEQ ID NO: 12807 - DNA, 22 bp, Homo sapiens
acagcagagcctggtacttact

SEQ ID NO: 12808 - DNA, 22 bp, Homo sapiens
caggggcgggtaaaaggcctcc

SEQ ID NO: 12809 - DNA, 22 bp, Homo sapiens
tccaaggagcagtcttcaacct

SEQ ID NO: 12810 - DNA, 22 bp, Homo sapiens
aagcagagaatctgggagcgag

SEQ ID NO: 12811 - DNA, 19 bp, Homo sapiens
caccaagatggctctagtc

SEQ ID NO: 12812 - DNA, 22 bp, Homo sapiens
ttttctcttccctctggacctg

SEQ ID NO: 12813 - DNA, 22 bp, Homo sapiens
tttctggcagcgggacaggggt

SEQ ID NO: 12814 - DNA, 22 bp, Homo sapiens
ggacaagcctgtgagtgggttt

SEQ ID NO: 12815 - DNA, 22 bp, Homo sapiens
gtcttgggacccgcactgtggg

SEQ ID NO: 12816 - DNA, 22 bp, Homo sapiens
aatttgtataaaatggtgtttt

SEQ ID NO: 12817 - DNA, 22 bp, Homo sapiens
gagaggtggaggttgcagtgag

SEQ ID NO: 12818 - DNA, 22 bp, Homo sapiens
tgcagtggcgccatctcagctc

SEQ ID NO: 12819 - DNA, 22 bp, Homo sapiens
acacggcactttaggaaggggc

SEQ ID NO: 12820 - DNA, 22 bp, Homo sapiens
tggtgggctgagtctcatcgga

SEQ ID NO: 12821 - DNA, 22 bp, Homo sapiens
gaccttgtgctccgaggcgggc

SEQ ID NO: 12822 - DNA, 22 bp, Homo sapiens
agaggaggctctgggatcgtcc

SEQ ID NO: 12823 - DNA, 22 bp, Homo sapiens
gccctgccctctcggcactcgc

SEQ ID NO: 12824 - DNA, 22 bp, Homo sapiens
ccggctcggcgaccaggctgaa

SEQ ID NO: 12825 - DNA, 17 bp, Homo sapiens
ggctgcagtccaggagg

SEQ ID NO: 12826 - DNA, 19 bp, Homo sapiens
tcctggggaggggcatggc

SEQ ID NO: 12827 - DNA, 22 bp, Homo sapiens
gcggggttccgtgccccagagt

SEQ ID NO: 12828 - DNA, 21 bp, Homo sapiens
cccagaagttccatggggggc

SEQ ID NO: 12829 - DNA, 22 bp, Homo sapiens
gtacatccccaaagccacgccc

SEQ ID NO: 12830 - DNA, 22 bp, Homo sapiens
catttacatttaaggttaatat

SEQ ID NO: 12831 - DNA, 22 bp, Homo sapiens
gaggtaacactgttcagtgggc

SEQ ID NO: 12832 - DNA, 22 bp, Homo sapiens
ttctcatgaaactcgcttcctc

SEQ ID NO: 12833 - DNA, 22 bp, Homo sapiens
ctgaaattctttggagttttct

SEQ ID NO: 12834 - DNA, 22 bp, Homo sapiens
tgcctgcctaggaagctgtgaa

SEQ ID NO: 12835 - DNA, 22 bp, Homo sapiens
cactgggcgtgtcctgggtgag

SEQ ID NO: 12836 - DNA, 22 bp, Homo sapiens
tgatctttggtaatctggcaca

SEQ ID NO: 12837 - DNA, 22 bp, Homo sapiens
caacaacatgggattcatttct

SEQ ID NO: 12838 - DNA, 22 bp, Homo sapiens
actttaaaactgatcatcagag

SEQ ID NO: 12839 - DNA, 22 bp, Homo sapiens
ttttgagatggagtcttgctct

SEQ ID NO: 12840 - DNA, 22 bp, Homo sapiens
ctaggtgatccactgctctctt

SEQ ID NO: 12841 - DNA, 22 bp, Homo sapiens
tttcggccaactcttttcagtt

SEQ ID NO: 12842 - DNA, 22 bp, Homo sapiens
ctgtccctgagcaactcctgtt

SEQ ID NO: 12843 - DNA, 22 bp, Homo sapiens
ctgggaagaagggacaacagcg

SEQ ID NO: 12844 - DNA, 19 bp, Homo sapiens
tctcaattctccccactgc

SEQ ID NO: 12845 - DNA, 22 bp, Homo sapiens
tgtcatctgcgggtggcactgc

SEQ ID NO: 12846 - DNA, 22 bp, Homo sapiens
gggcgccgtgggaaacagccgg

SEQ ID NO: 12847 - DNA, 22 bp, Homo sapiens
ggctcactgcaaactgtgcctc

SEQ ID NO: 12848 - DNA, 22 bp, Homo sapiens
gtctatatattgcttgaataat

SEQ ID NO: 12849 - DNA, 22 bp, Homo sapiens
tgttgcccaggttctctcctgc

SEQ ID NO: 12850 - DNA, 18 bp, Homo sapiens
cccggctaatttttggta

SEQ ID NO: 12851 - DNA, 17 bp, Homo sapiens
aggcgagaggaacatag

SEQ ID NO: 12852 - DNA, 22 bp, Homo sapiens
gtggcagaccttcccttctcct

SEQ ID NO: 12853 - DNA, 22 bp, Homo sapiens
aagaggagaaaggctggctttg

SEQ ID NO: 12854 - DNA, 22 bp, Homo sapiens
tagtaacccacacaacagtaga

SEQ ID NO: 12855 - DNA, 22 bp, Homo sapiens
gaagaggttcaacgtggtcatc

SEQ ID NO: 12856 - DNA, 22 bp, Homo sapiens
gggagctggagctggaagactc

SEQ ID NO: 12857 - DNA, 22 bp, Homo sapiens
acttttaaatgagtttcagttg

SEQ ID NO: 12858 - DNA, 22 bp, Homo sapiens
gtctatgatattttgttatagc

SEQ ID NO: 12859 - DNA, 22 bp, Homo sapiens
tagtttcatctccaccctgccc

SEQ ID NO: 12860 - DNA, 22 bp, Homo sapiens
ttgtctaatgagctccacttca

SEQ ID NO: 12861 - DNA, 22 bp, Homo sapiens
ctggcaggttatagagctgccc

SEQ ID NO: 12862 - DNA, 22 bp, Homo sapiens
aggtgacaggacaggagctggt

SEQ ID NO: 12863 - DNA, 22 bp, Homo sapiens
attgtgaatagtgccgcagtaa

SEQ ID NO: 12864 - DNA, 22 bp, Homo sapiens
gtggagagagataagcctggtc

SEQ ID NO: 12865 - DNA, 22 bp, Homo sapiens
agtccgtggccagactcaagag

SEQ ID NO: 12866 - DNA, 22 bp, Homo sapiens
gaaagtgctctctctatacaca

SEQ ID NO: 12867 - DNA, 22 bp, Homo sapiens
gtagttctgcagtgtcacctga

SEQ ID NO: 12868 - DNA, 22 bp, Homo sapiens
tttgtttgccacacaaaacagt

SEQ ID NO: 12869 - DNA, 22 bp, Homo sapiens
actctgtcttcatatttgcatt

SEQ ID NO: 12870 - DNA, 22 bp, Homo sapiens
ggagagcttggagtgcgatttt

SEQ ID NO: 12871 - DNA, 22 bp, Homo sapiens
ctggaggccactgtacagattg

SEQ ID NO: 12872 - DNA, 21 bp, Homo sapiens
cactccacttagaacagggtt

SEQ ID NO: 12873 - DNA, 22 bp, Homo sapiens
acgtgcaggatctggttggcga

SEQ ID NO: 12874 - DNA, 18 bp, Homo sapiens
ggcgggtgttttattcac

SEQ ID NO: 12875 - DNA, 22 bp, Homo sapiens
agtggagacaggacagtcgata

SEQ ID NO: 12876 - DNA, 22 bp, Homo sapiens
gatgatcatctgtaaagttaga

SEQ ID NO: 12877 - DNA, 22 bp, Homo sapiens
tgcagcactgttcacaatagcc

SEQ ID NO: 12878 - DNA, 22 bp, Homo sapiens
accagctagggtagcacatctc

SEQ ID NO: 12879 - DNA, 22 bp, Homo sapiens
tggaaacacccacgcatgcata

SEQ ID NO: 12880 - DNA, 22 bp, Homo sapiens
tcagtgccatgggcagacaggc

SEQ ID NO: 12881 - DNA, 22 bp, Homo sapiens
gggcgcatcacctgaggtcagg

SEQ ID NO: 12882 - DNA, 22 bp, Homo sapiens
aagcacctgcaccggtcgcctt

SEQ ID NO: 12883 - DNA, 20 bp, Homo sapiens
tcccccactgtttctgctac

SEQ ID NO: 12884 - DNA, 22 bp, Homo sapiens
agcctgggcaacagagcaaaac

SEQ ID NO: 12885 - DNA, 22 bp, Homo sapiens
gcctccagcccacgcaggcctg

SEQ ID NO: 12886 - DNA, 21 bp, Homo sapiens
cgcagagcgaacttgcggcgc

SEQ ID NO: 12887 - DNA, 22 bp, Homo sapiens
gctcccagtctgatggaggaga

SEQ ID NO: 12888 - DNA, 22 bp, Homo sapiens
caactccctgtggggtactggg

SEQ ID NO: 12889 - DNA, 22 bp, Homo sapiens
ggcggtcagcgtgggagaggct

SEQ ID NO: 12890 - DNA, 22 bp, Homo sapiens
tcgggctgctcgctgcggaact

SEQ ID NO: 12891 - DNA, 22 bp, Homo sapiens
gaggactgaaacttacaggaaa

SEQ ID NO: 12892 - DNA, 22 bp, Homo sapiens
tgatctaggttggcttcaactg

SEQ ID NO: 12893 - DNA, 22 bp, Homo sapiens
tgagatggagccactgcactct

SEQ ID NO: 12894 - DNA, 22 bp, Homo sapiens
gtccacttctgcctttctggat

SEQ ID NO: 12895 - DNA, 22 bp, Homo sapiens
agaggcagtatacaatccgagc

SEQ ID NO: 12896 - DNA, 22 bp, Homo sapiens
acggcttcttgactgtgggttg

SEQ ID NO: 12897 - DNA, 22 bp, Homo sapiens
atttagaactttgtttgccaat

SEQ ID NO: 12898 - DNA, 22 bp, Homo sapiens
gggaacagcttgggctctgcca

SEQ ID NO: 12899 - DNA, 22 bp, Homo sapiens
cccagacccagagggaggcagg

SEQ ID NO: 12900 - DNA, 20 bp, Homo sapiens
ataaaataactgccacaaga

SEQ ID NO: 12901 - DNA, 21 bp, Homo sapiens
aggagcattgttgtggtggag

SEQ ID NO: 12902 - DNA, 22 bp, Homo sapiens
gcagcgaggtgatgaaatagct

SEQ ID NO: 12903 - DNA, 22 bp, Homo sapiens
tccacaaggcagctcctccagg

SEQ ID NO: 12904 - DNA, 20 bp, Homo sapiens
gggcaaggaaacagccccca

SEQ ID NO: 12905 - DNA, 22 bp, Homo sapiens
tcaggcaccttcctcttatctg

SEQ ID NO: 12906 - DNA, 23 bp, Homo sapiens
gtcacagtgggtggtgcctacat

SEQ ID NO: 12907 - DNA, 22 bp, Homo sapiens
gccttgccgctcagcagtgggg

SEQ ID NO: 12908 - DNA, 22 bp, Homo sapiens
tcaggcaatctgacagctggag

SEQ ID NO: 12909 - DNA, 22 bp, Homo sapiens
gcctgacttgtgtattttacat

SEQ ID NO: 12910 - DNA, 22 bp, Homo sapiens
gcgggttgaagggcgcatcgaa

SEQ ID NO: 12911 - DNA, 22 bp, Homo sapiens
gcaggagaacaaagcaagctgc

SEQ ID NO: 12912 - DNA, 22 bp, Homo sapiens
cacccaggttggagtgcagtgg

SEQ ID NO: 12913 - DNA, 22 bp, Homo sapiens
gggtccagtagttggtggccgt

SEQ ID NO: 12914 - DNA, 22 bp, Homo sapiens
ccagatatcactgccgtgttgt

SEQ ID NO: 12915 - DNA, 22 bp, Homo sapiens
ctgtggctctcagaggctgctg

SEQ ID NO: 12916 - DNA, 22 bp, Homo sapiens
gagggaaaggttaatacatgat

SEQ ID NO: 12917 - DNA, 19 bp, Homo sapiens
ggcgaagcgcttggagtag

SEQ ID NO: 12918 - DNA, 22 bp, Homo sapiens
ccagggtggcgtagatgctggg

SEQ ID NO: 12919 - DNA, 22 bp, Homo sapiens
aaggcaaaagaggtgtcatcac

SEQ ID NO: 12920 - DNA, 22 bp, Homo sapiens
tcctttgcttctgtcattctcc

SEQ ID NO: 12921 - DNA, 22 bp, Homo sapiens
cactgcactccagcttgggcaa

SEQ ID NO: 12922 - DNA, 22 bp, Homo sapiens
ctcgcatgccctgcctcatcca

SEQ ID NO: 12923 - DNA, 22 bp, Homo sapiens
tgtgtctgtgtatacacggcat

SEQ ID NO: 12924 - DNA, 22 bp, Homo sapiens
tgggatgccctgaccctctgga

SEQ ID NO: 12925 - DNA, 18 bp, Homo sapiens
gacatagctcagagctca

SEQ ID NO: 12926 - DNA, 22 bp, Homo sapiens
aggacgctctcgctgaacttct

SEQ ID NO: 12927 - DNA, 22 bp, Homo sapiens
gcatatgatcacgtgtgtcggt

SEQ ID NO: 12928 - DNA, 22 bp, Homo sapiens
tgacaagaaagcgtcttctttt

SEQ ID NO: 12929 - DNA, 22 bp, Homo sapiens
gcccaggctggagtgcagtggc

SEQ ID NO: 12930 - DNA, 22 bp, Homo sapiens
ggggtgggcgtgcagggacacc

SEQ ID NO: 12931 - DNA, 22 bp, Homo sapiens
ggctgtgtggccgtgggctcta

SEQ ID NO: 12932 - DNA, 22 bp, Homo sapiens
atgagtatatgatatggtttgg

SEQ ID NO: 12933 - DNA, 22 bp, Homo sapiens
ttcatatttctttaaggacttt

SEQ ID NO: 12934 - DNA, 22 bp, Homo sapiens
cttctcggggttcccgcgccct

SEQ ID NO: 12935 - DNA, 22 bp, Homo sapiens
cgcggaggaggtcaggaggtga

SEQ ID NO: 12936 - DNA, 22 bp, Homo sapiens
aggggatggagctggaaggcag

SEQ ID NO: 12937 - DNA, 22 bp, Homo sapiens
ggccttggttccaaagcaggca

SEQ ID NO: 12938 - DNA, 22 bp, Homo sapiens
caaagtgctaggattacaggcc

SEQ ID NO: 12939 - DNA, 22 bp, Homo sapiens
tattactgtcaatatcacagaa

SEQ ID NO: 12940 - DNA, 22 bp, Homo sapiens
tatgccgcagccggatttcccc

SEQ ID NO: 12941 - DNA, 22 bp, Homo sapiens
cggaggttgaggctgcagtgag

SEQ ID NO: 12942 - DNA, 22 bp, Homo sapiens
gggaaatctcgtcctctattta

SEQ ID NO: 12943 - DNA, 22 bp, Homo sapiens
aggagctcagctaagttggaga

SEQ ID NO: 12944 - DNA, 22 bp, Homo sapiens
acccagggctcaagcgtaggca

SEQ ID NO: 12945 - DNA, 22 bp, Homo sapiens
tcgtgatctgtccacctcggcc

SEQ ID NO: 12946 - DNA, 22 bp, Homo sapiens
cactgcactccagcactccagc

SEQ ID NO: 12947 - DNA, 21 bp, Homo sapiens
cgtgactgggtccgtctggct

SEQ ID NO: 12948 - DNA, 22 bp, Homo sapiens
tgcctctgaggaagattgtgtt

SEQ ID NO: 12949 - DNA, 19 bp, Homo sapiens
ccacagcctgctgtcttcc

SEQ ID NO: 12950 - DNA, 22 bp, Homo sapiens
gtacagaggttgctggaggctc

SEQ ID NO: 12951 - DNA, 21 bp, Homo sapiens
ctctgtttgcctgctgccatc

SEQ ID NO: 12952 - DNA, 19 bp, Homo sapiens
tcctgcctggggccgcctg

SEQ ID NO: 12953 - DNA, 22 bp, Homo sapiens
caaagtgctaggattataggtg

SEQ ID NO: 12954 - DNA, 22 bp, Homo sapiens
ttgtgaatagtgccgctataaa

SEQ ID NO: 12955 - DNA, 22 bp, Homo sapiens
acagcccagctctttctctgca

SEQ ID NO: 12956 - DNA, 22 bp, Homo sapiens
cggcatccccacttcctcctgc

SEQ ID NO: 12957 - DNA, 22 bp, Homo sapiens
actcatgtaagcggaatgtagt

SEQ ID NO: 12958 - DNA, 22 bp, Homo sapiens
gggtggtggccagcagtgggca

SEQ ID NO: 12959 - DNA, 22 bp, Homo sapiens
ccaccgccatggcgttgtacag

SEQ ID NO: 12960 - DNA, 22 bp, Homo sapiens
acttgccccagaattgctgctg

SEQ ID NO: 12961 - DNA, 18 bp, Homo sapiens
tgagaggctattttttgc

SEQ ID NO: 12962 - DNA, 22 bp, Homo sapiens
tcacccaggctggactgcagtg

SEQ ID NO: 12963 - DNA, 22 bp, Homo sapiens
gtcccataagtagtgcaacttg

SEQ ID NO: 12964 - DNA, 19 bp, Homo sapiens
tctgaagaattagagagca

SEQ ID NO: 12965 - DNA, 22 bp, Homo sapiens
attaagtgactaaagtaatgct

SEQ ID NO: 12966 - DNA, 22 bp, Homo sapiens
atgattgaaaatgacattgcca

SEQ ID NO: 12967 - DNA, 22 bp, Homo sapiens
aaaagcaattgcagttcttgcc

SEQ ID NO: 12968 - DNA, 22 bp, Homo sapiens
ataagattgtcatagtatggac

SEQ ID NO: 12969 - DNA, 22 bp, Homo sapiens
ctgggcgcgtcccctgaggcgg

SEQ ID NO: 12970 - DNA, 22 bp, Homo sapiens
gagcaacacgcagtagtatacg

SEQ ID NO: 12971 - DNA, 22 bp, Homo sapiens
tggatatccttgttaactttct

SEQ ID NO: 12972 - DNA, 22 bp, Homo sapiens
gccgtggggagagagggtgcgt

SEQ ID NO: 12973 - DNA, 22 bp, Homo sapiens
ccttctagcaaatcaacataaa

SEQ ID NO: 12974 - DNA, 22 bp, Homo sapiens
tccgggcaactgaagggaggtt

SEQ ID NO: 12975 - DNA, 22 bp, Homo sapiens
cccaggatggggctgcagttat

SEQ ID NO: 12976 - DNA, 22 bp, Homo sapiens
ctgggctagaaggaccaggatg

SEQ ID NO: 12977 - DNA, 22 bp, Homo sapiens
ctctccattccctacagttttc

SEQ ID NO: 12978 - DNA, 22 bp, Homo sapiens
ttgagagttctgaatgagtaac

SEQ ID NO: 12979 - DNA, 22 bp, Homo sapiens
gagtccaccacagctcaaagag

SEQ ID NO: 12980 - DNA, 22 bp, Homo sapiens
tctttgctccacactctagaga

SEQ ID NO: 12981 - DNA, 22 bp, Homo sapiens
tcaggagtgccagtaccttttg

SEQ ID NO: 12982 - DNA, 22 bp, Homo sapiens
gaggggtccaggaggcacttac

SEQ ID NO: 12983 - DNA, 19 bp, Homo sapiens
gggcttggggctgaagcct

SEQ ID NO: 12984 - DNA, 22 bp, Homo sapiens
acatccgcaggttataaagccc

SEQ ID NO: 12985 - DNA, 22 bp, Homo sapiens
caggccagggttgagaagagaa

SEQ ID NO: 12986 - DNA, 22 bp, Homo sapiens
ctcagcagtatactctgaagat

SEQ ID NO: 12987 - DNA, 22 bp, Homo sapiens
ttccactctacacactgctggc

SEQ ID NO: 12988 - DNA, 22 bp, Homo sapiens
cagggggctcaaaggagagtgc

SEQ ID NO: 12989 - DNA, 22 bp, Homo sapiens
gaagaaggtggcccaggggtag

SEQ ID NO: 12990 - DNA, 22 bp, Homo sapiens
ctgagcagatgaccagccccag

SEQ ID NO: 12991 - DNA, 22 bp, Homo sapiens
ggaggctctgaccatttaccca

SEQ ID NO: 12992 - DNA, 21 bp, Homo sapiens
ggccccgcagacccagcacgt

SEQ ID NO: 12993 - DNA, 22 bp, Homo sapiens
gcaggcggaggttgcagtgagc

SEQ ID NO: 12994 - DNA, 22 bp, Homo sapiens
cagtgcttttaaaacaacatca

SEQ ID NO: 12995 - DNA, 22 bp, Homo sapiens
gaggcagaggttgcagtgagct

SEQ ID NO: 12996 - DNA, 22 bp, Homo sapiens
tcagcctccgaaagtgctggga

SEQ ID NO: 12997 - DNA, 22 bp, Homo sapiens
tagggggctttgctgcttgaca

SEQ ID NO: 12998 - DNA, 22 bp, Homo sapiens
ggcagagcttgcagtgagccga

SEQ ID NO: 12999 - DNA, 22 bp, Homo sapiens
agttggagtgaacatgagattg

SEQ ID NO: 13000 - DNA, 22 bp, Homo sapiens
accattgccccctagtgtctgt

SEQ ID NO: 13001 - DNA, 22 bp, Homo sapiens
gggagcttaagacagttccaat

SEQ ID NO: 13002 - DNA, 22 bp, Homo sapiens
ctgtatctgtgttggatgagtt

SEQ ID NO: 13003 - DNA, 23 bp, Homo sapiens
caggagatggctgctgtgtcagc

SEQ ID NO: 13004 - DNA, 22 bp, Homo sapiens
actgctggggctcattcatctc

SEQ ID NO: 13005 - DNA, 22 bp, Homo sapiens
gactggaaagcctgtcctcaga

SEQ ID NO: 13006 - DNA, 22 bp, Homo sapiens
tctaattttggcattttaacct

SEQ ID NO: 13007 - DNA, 22 bp, Homo sapiens
atgcctgtaatcccagcacttt

SEQ ID NO: 13008 - DNA, 22 bp, Homo sapiens
cctgcagacacttgtccagcaa

SEQ ID NO: 13009 - DNA, 22 bp, Homo sapiens
ggtggttcacgcctataatccc

SEQ ID NO: 13010 - DNA, 22 bp, Homo sapiens
cataatttctaccagggccata

SEQ ID NO: 13011 - DNA, 22 bp, Homo sapiens
acagcacttgggttttcctgtt

SEQ ID NO: 13012 - DNA, 22 bp, Homo sapiens
attttctctttgtatatgctag

SEQ ID NO: 13013 - DNA, 23 bp, Homo sapiens
tgcatgtgattcatagagtccag

SEQ ID NO: 13014 - DNA, 22 bp, Homo sapiens
ttgcaattgctatggagagcgt

SEQ ID NO: 13015 - DNA, 22 bp, Homo sapiens
cccagggaggcccaggctctgc

SEQ ID NO: 13016 - DNA, 22 bp, Homo sapiens
tcggggtctttgacacgctctg

SEQ ID NO: 13017 - DNA, 22 bp, Homo sapiens
tctctggactcgagcttactca

SEQ ID NO: 13018 - DNA, 22 bp, Homo sapiens
agcctggcctgggcaggcacat

SEQ ID NO: 13019 - DNA, 22 bp, Homo sapiens
ggcagacctctccagccccaca

SEQ ID NO: 13020 - DNA, 22 bp, Homo sapiens
taagggttcagaatgcagtggt

SEQ ID NO: 13021 - DNA, 22 bp, Homo sapiens
aaggtgggtggatcacgaggtc

SEQ ID NO: 13022 - DNA, 22 bp, Homo sapiens
caggaagaccagggctgtggct

SEQ ID NO: 13023 - DNA, 21 bp, Homo sapiens
tacaatgcacaggagagcctc

SEQ ID NO: 13024 - DNA, 22 bp, Homo sapiens
gaggcgggcagatcacctgagg

SEQ ID NO: 13025 - DNA, 22 bp, Homo sapiens
aagtcacactagacaactgagg

SEQ ID NO: 13026 - DNA, 22 bp, Homo sapiens
gaatgcagatggctggtgtatg

SEQ ID NO: 13027 - DNA, 22 bp, Homo sapiens
ccctggaggcggagcttgcagt

SEQ ID NO: 13028 - DNA, 22 bp, Homo sapiens
atgatactctaggtgatttaca

SEQ ID NO: 13029 - DNA, 22 bp, Homo sapiens
ggtggcctgttttcaggtttgc

SEQ ID NO: 13030 - DNA, 22 bp, Homo sapiens
tggggacttgccttgttgctca

SEQ ID NO: 13031 - DNA, 20 bp, Homo sapiens
cagcctgcatcatctgcagc

SEQ ID NO: 13032 - DNA, 22 bp, Homo sapiens
cccaaaggttgaggctgcagtg

SEQ ID NO: 13033 - DNA, 22 bp, Homo sapiens
ctgagcctcctgcttctatttc

SEQ ID NO: 13034 - DNA, 22 bp, Homo sapiens
tctgctggaaaaccagggaatt

SEQ ID NO: 13035 - DNA, 22 bp, Homo sapiens
cccagcaggtcggtgctgcctg

SEQ ID NO: 13036 - DNA, 22 bp, Homo sapiens
gctcaagccttctgcccacctc

SEQ ID NO: 13037 - DNA, 22 bp, Homo sapiens
cctcgtccacaatccttgcaca

SEQ ID NO: 13038 - DNA, 22 bp, Homo sapiens
tgagtcatgtaataatgctgct

SEQ ID NO: 13039 - DNA, 22 bp, Homo sapiens
gtggattacaagacagttgaga

SEQ ID NO: 13040 - DNA, 22 bp, Homo sapiens
atgcattgtcaggcaatttcat

SEQ ID NO: 13041 - DNA, 22 bp, Homo sapiens
tacctcaagttccaggaaagcg

SEQ ID NO: 13042 - DNA, 22 bp, Homo sapiens
gttctgggagatcttgagcttc

SEQ ID NO: 13043 - DNA, 22 bp, Homo sapiens
tcactgcactccagcctgggtg

SEQ ID NO: 13044 - DNA, 22 bp, Homo sapiens
aggtggcagatgggggtgctcg

SEQ ID NO: 13045 - DNA, 22 bp, Homo sapiens
gccagaagcacatgagaggtga

SEQ ID NO: 13046 - DNA, 22 bp, Homo sapiens
aaagcctcccaggttatgagta

SEQ ID NO: 13047 - DNA, 22 bp, Homo sapiens
ttgaagactaatttagataatg

SEQ ID NO: 13048 - DNA, 22 bp, Homo sapiens
tctcctggagcccagatgctgg

SEQ ID NO: 13049 - DNA, 18 bp, Homo sapiens
tgtagagccaggtttgcc

SEQ ID NO: 13050 - DNA, 22 bp, Homo sapiens
ggccatttgctttattcacttc

SEQ ID NO: 13051 - DNA, 22 bp, Homo sapiens
accctgctttatgccgtcctct

SEQ ID NO: 13052 - DNA, 22 bp, Homo sapiens
gatggcacacagacatccccgc

SEQ ID NO: 13053 - DNA, 22 bp, Homo sapiens
aaagtgctgcgacatttgagcg

SEQ ID NO: 13054 - DNA, 22 bp, Homo sapiens
ttgtgggggctgccctgtacgg

SEQ ID NO: 13055 - DNA, 22 bp, Homo sapiens
ccaggaggcagaagttgcagtg

SEQ ID NO: 13056 - DNA, 22 bp, Homo sapiens
ttggagttctgggcacagctgc

SEQ ID NO: 13057 - DNA, 22 bp, Homo sapiens
cacactgtctttatgagctgta

SEQ ID NO: 13058 - DNA, 23 bp, Homo sapiens
actcgtggaattctctgcgatcg

SEQ ID NO: 13059 - DNA, 22 bp, Homo sapiens
ggctcaggcctgtaatcctagc

SEQ ID NO: 13060 - DNA, 22 bp, Homo sapiens
gcgggcgggggttcccaggtct

SEQ ID NO: 13061 - DNA, 20 bp, Homo sapiens
gttaggaggttggacatgga

SEQ ID NO: 13062 - DNA, 19 bp, Homo sapiens
aggaatggaattaattctg

SEQ ID NO: 13063 - DNA, 22 bp, Homo sapiens
tcctccactttgtctagcaaca

SEQ ID NO: 13064 - DNA, 22 bp, Homo sapiens
actgtgaacggactgaagccca

SEQ ID NO: 13065 - DNA, 22 bp, Homo sapiens
tgctgtgaggttgagaaggaag

SEQ ID NO: 13066 - DNA, 22 bp, Homo sapiens
aaatggaagctatttatgattc

SEQ ID NO: 13067 - DNA, 22 bp, Homo sapiens
gaggaggcttccgggaggcacg

SEQ ID NO: 13068 - DNA, 23 bp, Homo sapiens
ggaagctcacgtagtcctgcact

SEQ ID NO: 13069 - DNA, 22 bp, Homo sapiens
aggaaggactccatggtccgtc

SEQ ID NO: 13070 - DNA, 22 bp, Homo sapiens
ttagatttgtagtgagttcaga

SEQ ID NO: 13071 - DNA, 22 bp, Homo sapiens
tccgggaggcagaggttgcagt

SEQ ID NO: 13072 - DNA, 22 bp, Homo sapiens
gctcactgcaacctccacctcc

SEQ ID NO: 13073 - DNA, 22 bp, Homo sapiens
atgtgggccgtgcgggtgtcct

SEQ ID NO: 13074 - DNA, 22 bp, Homo sapiens
tactgacaggattgacagtaaa

SEQ ID NO: 13075 - DNA, 22 bp, Homo sapiens
tgtgaacttactgtccccacag

SEQ ID NO: 13076 - DNA, 22 bp, Homo sapiens
tggatgctgtaggacacgctct

SEQ ID NO: 13077 - DNA, 22 bp, Homo sapiens
gcaccgccttggaccgcccgct

SEQ ID NO: 13078 - DNA, 22 bp, Homo sapiens
tccaggtgggctgcacccaggc

SEQ ID NO: 13079 - DNA, 22 bp, Homo sapiens
cttttcattgtttgtacatgca

SEQ ID NO: 13080 - DNA, 22 bp, Homo sapiens
gcagggtctgaggccacagagg

SEQ ID NO: 13081 - DNA, 22 bp, Homo sapiens
tttcttctatgtgtgatatttt

SEQ ID NO: 13082 - DNA, 22 bp, Homo sapiens
gtgccactgataaatcagaatg

SEQ ID NO: 13083 - DNA, 22 bp, Homo sapiens
cgtcatcacggcaagcatctcc

SEQ ID NO: 13084 - DNA, 22 bp, Homo sapiens
aagaaggcggaccagaagggag

SEQ ID NO: 13085 - DNA, 22 bp, Homo sapiens
taggccacagagaggagatttc

SEQ ID NO: 13086 - DNA, 22 bp, Homo sapiens
ccttacctgattgctggcatcc

SEQ ID NO: 13087 - DNA, 22 bp, Homo sapiens
gccagcagcttcttctcatcct

SEQ ID NO: 13088 - DNA, 22 bp, Homo sapiens
tgggattcaccatgggcttcag

SEQ ID NO: 13089 - DNA, 22 bp, Homo sapiens
ctcctgggaaaggctggacaca

SEQ ID NO: 13090 - DNA, 22 bp, Homo sapiens
tatgtaagttgcaaatgaagga

SEQ ID NO: 13091 - DNA, 22 bp, Homo sapiens
attgcactccagccctgctgac

SEQ ID NO: 13092 - DNA, 22 bp, Homo sapiens
agaagcattggaccaggggccc

SEQ ID NO: 13093 - DNA, 22 bp, Homo sapiens
agagtgcaaccgaaacaagcag

SEQ ID NO: 13094 - DNA, 22 bp, Homo sapiens
tctgtgttgagaaggatcatga

SEQ ID NO: 13095 - DNA, 22 bp, Homo sapiens
ccctggaggttgaggctgcagt

SEQ ID NO: 13096 - DNA, 22 bp, Homo sapiens
accatgttggccaagctggtct

SEQ ID NO: 13097 - DNA, 22 bp, Homo sapiens
ttaaacatttatggaggcagca

SEQ ID NO: 13098 - DNA, 22 bp, Homo sapiens
ggcccagacccaagagtggtgg

SEQ ID NO: 13099 - DNA, 22 bp, Homo sapiens
ttctcccatctcagtcttacat

SEQ ID NO: 13100 - DNA, 22 bp, Homo sapiens
atgccactgacatggacaattt

SEQ ID NO: 13101 - DNA, 19 bp, Homo sapiens
actgtagcactgcagtata

SEQ ID NO: 13102 - DNA, 22 bp, Homo sapiens
gagagtctagtgcacctagttt

SEQ ID NO: 13103 - DNA, 22 bp, Homo sapiens
cgaggaggaaacgcggagaact

SEQ ID NO: 13104 - DNA, 15 bp, Homo sapiens
gcaggcaggtcacct

SEQ ID NO: 13105 - DNA, 22 bp, Homo sapiens
agtgcactggcaccatctcagc

SEQ ID NO: 13106 - DNA, 22 bp, Homo sapiens
taaaggtagtgtgacatattgt

SEQ ID NO: 13107 - DNA, 22 bp, Homo sapiens
tgacagaactcattctcaccaa

SEQ ID NO: 13108 - DNA, 22 bp, Homo sapiens
tctctttgcctgctgccatcca

SEQ ID NO: 13109 - DNA, 22 bp, Homo sapiens
cccagcaggaggaggttgcagt

SEQ ID NO: 13110 - DNA, 22 bp, Homo sapiens
cactgcactccagctgggtgac

SEQ ID NO: 13111 - DNA, 22 bp, Homo sapiens
gccctgggcaaggttctggcca

SEQ ID NO: 13112 - DNA, 22 bp, Homo sapiens
taatactgtatactgcaaattt

SEQ ID NO: 13113 - DNA, 22 bp, Homo sapiens
cactgcccaccaagtggctggt

SEQ ID NO: 13114 - DNA, 22 bp, Homo sapiens
gtataggtgagggacttgatca

SEQ ID NO: 13115 - DNA, 22 bp, Homo sapiens
ctctggcaattgctgctgactc

SEQ ID NO: 13116 - DNA, 18 bp, Homo sapiens
gatcgggggcgccccaag

SEQ ID NO: 13117 - DNA, 22 bp, Homo sapiens
agaaatatgctgattagatgaa

SEQ ID NO: 13118 - DNA, 22 bp, Homo sapiens
tatttccttgagacggagtctc

SEQ ID NO: 13119 - DNA, 22 bp, Homo sapiens
gggcggggggagctggaatgaa

SEQ ID NO: 13120 - DNA, 22 bp, Homo sapiens
ccaggagctggagggtgcagtg

SEQ ID NO: 13121 - DNA, 22 bp, Homo sapiens
ttgggctgaaccctgcagctga

SEQ ID NO: 13122 - DNA, 22 bp, Homo sapiens
aattgcactttagcaatggtga

SEQ ID NO: 13123 - DNA, 20 bp, Homo sapiens
agagtgagactccatctcag

SEQ ID NO: 13124 - DNA, 22 bp, Homo sapiens
acaaggcactttatgaagagga

SEQ ID NO: 13125 - DNA, 22 bp, Homo sapiens
taacatttaaatttttcacata

SEQ ID NO: 13126 - DNA, 22 bp, Homo sapiens
ccaggggggcgtagatgctggg

SEQ ID NO: 13127 - DNA, 22 bp, Homo sapiens
cccaggaattggaggctgcagt

SEQ ID NO: 13128 - DNA, 22 bp, Homo sapiens
ccctcccaggagtggccagaga

SEQ ID NO: 13129 - DNA, 22 bp, Homo sapiens
tgagagcctgtgttcaaatgcc

SEQ ID NO: 13130 - DNA, 22 bp, Homo sapiens
agcccaggtccagttcactgca

SEQ ID NO: 13131 - DNA, 22 bp, Homo sapiens
gttgaggtgatgccagccctgc

SEQ ID NO: 13132 - DNA, 22 bp, Homo sapiens
caggaacagggtgtcctggcag

SEQ ID NO: 13133 - DNA, 22 bp, Homo sapiens
gggagctgagctggaagagaat

SEQ ID NO: 13134 - DNA, 22 bp, Homo sapiens
gcttccacctactaaatgccac

SEQ ID NO: 13135 - DNA, 22 bp, Homo sapiens
gaggttggggctgcagtgagct

SEQ ID NO: 13136 - DNA, 22 bp, Homo sapiens
gggagaagaatgtgtcaattgt

SEQ ID NO: 13137 - DNA, 22 bp, Homo sapiens
ggaaaagtgttaaggtgttgat

SEQ ID NO: 13138 - DNA, 22 bp, Homo sapiens
ggggagatgcttaggtccgggg

SEQ ID NO: 13139 - DNA, 22 bp, Homo sapiens
agacacttcatgtaagtggaat

SEQ ID NO: 13140 - DNA, 22 bp, Homo sapiens
cagtctctaaatcaatctgaat

SEQ ID NO: 13141 - DNA, 22 bp, Homo sapiens
gaggttggttccaaccctccca

SEQ ID NO: 13142 - DNA, 17 bp, Homo sapiens
ttgaatgcattacttgg

SEQ ID NO: 13143 - DNA, 22 bp, Homo sapiens
ggacctgaacataaaacgaggc

SEQ ID NO: 13144 - DNA, 22 bp, Homo sapiens
tgtgtttctgagaatcccacct

SEQ ID NO: 13145 - DNA, 19 bp, Homo sapiens
gttggcactgaaaatggct

SEQ ID NO: 13146 - DNA, 22 bp, Homo sapiens
tggagccagcggcctgctgagg

SEQ ID NO: 13147 - DNA, 18 bp, Homo sapiens
gtcaggcatgaatctggg

SEQ ID NO: 13148 - DNA, 22 bp, Homo sapiens
caaagcccagaggcctcacttt

SEQ ID NO: 13149 - DNA, 22 bp, Homo sapiens
ttccatttggcacttcactgag

SEQ ID NO: 13150 - DNA, 22 bp, Homo sapiens
tgcgcctgtaagtccagagtcc

SEQ ID NO: 13151 - DNA, 15 bp, Homo sapiens
tggcccacccgttga

SEQ ID NO: 13152 - DNA, 22 bp, Homo sapiens
gagccaggtcgggccgcggcga

SEQ ID NO: 13153 - DNA, 22 bp, Homo sapiens
aatcacacaaaggcaacttttg

SEQ ID NO: 13154 - DNA, 21 bp, Homo sapiens
ctctgaatcctgcttctcagt

SEQ ID NO: 13155 - DNA, 22 bp, Homo sapiens
tcaaaaagttgaagagttgggg

SEQ ID NO: 13156 - DNA, 22 bp, Homo sapiens
gaaggaccctctggggtctcag

SEQ ID NO: 13157 - DNA, 23 bp, Homo sapiens
tctgtgtctccacccaaatctca

SEQ ID NO: 13158 - DNA, 22 bp, Homo sapiens
tggtctgctgaacagccgtatc

SEQ ID NO: 13159 - DNA, 22 bp, Homo sapiens
gcagctggaagtgacactctgt

SEQ ID NO: 13160 - DNA, 22 bp, Homo sapiens
agctggaattacaggcacgcac

SEQ ID NO: 13161 - DNA, 22 bp, Homo sapiens
ctcactgcaacctccgtctccc

SEQ ID NO: 13162 - DNA, 22 bp, Homo sapiens
cagggtgctgcaccatccctca

SEQ ID NO: 13163 - DNA, 21 bp, Homo sapiens
agatcctggggtctggggagg

SEQ ID NO: 13164 - DNA, 22 bp, Homo sapiens
agtgggtgacagttaacaggtt

SEQ ID NO: 13165 - DNA, 22 bp, Homo sapiens
ggagtgactcacagctgggaca

SEQ ID NO: 13166 - DNA, 22 bp, Homo sapiens
attggccagacttatccttcag

SEQ ID NO: 13167 - DNA, 22 bp, Homo sapiens
ttaaattttagaaacagactct

SEQ ID NO: 13168 - DNA, 22 bp, Homo sapiens
aatggaatacctaggtggccca

SEQ ID NO: 13169 - DNA, 22 bp, Homo sapiens
cggtcaggtgcagcgttggcac

SEQ ID NO: 13170 - DNA, 22 bp, Homo sapiens
aaccccgctcaggctgggtgag

SEQ ID NO: 13171 - DNA, 22 bp, Homo sapiens
tgggaaagtctttatttctctt

SEQ ID NO: 13172 - DNA, 22 bp, Homo sapiens
cttgtagacccctggactcacg

SEQ ID NO: 13173 - DNA, 22 bp, Homo sapiens
gctgccttgccctcttcccata

SEQ ID NO: 13174 - DNA, 22 bp, Homo sapiens
tctcctggtacccttcctagca

SEQ ID NO: 13175 - DNA, 22 bp, Homo sapiens
tggtggacgatgcccagctgga

SEQ ID NO: 13176 - DNA, 22 bp, Homo sapiens
tggtggcgggcagggccgtcac

SEQ ID NO: 13177 - DNA, 22 bp, Homo sapiens
tagggcaatatttcccagaaaa

SEQ ID NO: 13178 - DNA, 22 bp, Homo sapiens
agaatgggggctacaggccaca

SEQ ID NO: 13179 - DNA, 22 bp, Homo sapiens
tcagaacatgtttgagtaagac

SEQ ID NO: 13180 - DNA, 22 bp, Homo sapiens
taatgcacatagaagtacttag

SEQ ID NO: 13181 - DNA, 22 bp, Homo sapiens
tgccagtcagttggtgtgggac

SEQ ID NO: 13182 - DNA, 22 bp, Homo sapiens
cctggctctgccacttactgcc

SEQ ID NO: 13183 - DNA, 18 bp, Homo sapiens
tctggaacaacttcatgt

SEQ ID NO: 13184 - DNA, 22 bp, Homo sapiens
ttctttgcccatgtttcctaag

SEQ ID NO: 13185 - DNA, 22 bp, Homo sapiens
cagtggccaacttcctgcctct

SEQ ID NO: 13186 - DNA, 22 bp, Homo sapiens
gccctgagaagaagtcggaggg

SEQ ID NO: 13187 - DNA, 22 bp, Homo sapiens
cagcagcattgctctggattcc

SEQ ID NO: 13188 - DNA, 22 bp, Homo sapiens
tttgaaatatgtgtcttttgaa

SEQ ID NO: 13189 - DNA, 22 bp, Homo sapiens
gggggactggaccgtcctgggt

SEQ ID NO: 13190 - DNA, 22 bp, Homo sapiens
gggccctgcgactcgcggcgga

SEQ ID NO: 13191 - DNA, 22 bp, Homo sapiens
tgacacccatctgtgccagtcc

SEQ ID NO: 13192 - DNA, 22 bp, Homo sapiens
cctgggctctgtcagaattggg

SEQ ID NO: 13193 - DNA, 22 bp, Homo sapiens
tggaatgtcagctacaagaggg

SEQ ID NO: 13194 - DNA, 22 bp, Homo sapiens
gttcaagaccagcctggccaac

SEQ ID NO: 13195 - DNA, 22 bp, Homo sapiens
tgttattctagtggatcacgtc

SEQ ID NO: 13196 - DNA, 22 bp, Homo sapiens
tggctgttggagctggaagatg

SEQ ID NO: 13197 - DNA, 22 bp, Homo sapiens
aggtggggaggagtgtctcttt

SEQ ID NO: 13198 - DNA, 22 bp, Homo sapiens
tcactgtatcatgttgcactta

SEQ ID NO: 13199 - DNA, 22 bp, Homo sapiens
gcagagctcatgcctgcacctc

SEQ ID NO: 13200 - DNA, 22 bp, Homo sapiens
cgccaggcttggtagctcatgc

SEQ ID NO: 13201 - DNA, 22 bp, Homo sapiens
ggtgccagatgaggcccgcgat

SEQ ID NO: 13202 - DNA, 17 bp, Homo sapiens
ttaaggtggatcagcac

SEQ ID NO: 13203 - DNA, 20 bp, Homo sapiens
aggaaaaatggaaactggag

SEQ ID NO: 13204 - DNA, 22 bp, Homo sapiens
tcctcagaatcacctggcagct

SEQ ID NO: 13205 - DNA, 22 bp, Homo sapiens
agctgattccactttttcccca

SEQ ID NO: 13206 - DNA, 22 bp, Homo sapiens
cgcaggtgaaagaggctgggca

SEQ ID NO: 13207 - DNA, 22 bp, Homo sapiens
gggtggaaagtatttggggacc

SEQ ID NO: 13208 - DNA, 22 bp, Homo sapiens
tgcctaggctggagtgcagtga

SEQ ID NO: 13209 - DNA, 22 bp, Homo sapiens
atggcctgcagtgctgccacag

SEQ ID NO: 13210 - DNA, 22 bp, Homo sapiens
aaaagcaattgcgggttttgcc

SEQ ID NO: 13211 - DNA, 22 bp, Homo sapiens
ggcatctggatctgcttctccc

SEQ ID NO: 13212 - DNA, 23 bp, Homo sapiens
ggctgggagctccgggtgcacgt

SEQ ID NO: 13213 - DNA, 22 bp, Homo sapiens
ctccttctgggcctggcagtgg

SEQ ID NO: 13214 - DNA, 22 bp, Homo sapiens
gctgcgccggatcccacgttcc

SEQ ID NO: 13215 - DNA, 23 bp, Homo sapiens
tcatgcccaggctccagatgtca

SEQ ID NO: 13216 - DNA, 22 bp, Homo sapiens
tgggtggcagcttcagcatgtt

SEQ ID NO: 13217 - DNA, 22 bp, Homo sapiens
ccttctcagccccagctcccgc

SEQ ID NO: 13218 - DNA, 22 bp, Homo sapiens
ttgagactgccttgtcgtctgc

SEQ ID NO: 13219 - DNA, 22 bp, Homo sapiens
ttgcactccagcccgagcaaca

SEQ ID NO: 13220 - DNA, 22 bp, Homo sapiens
aaaagtaattgtggttttggcc

SEQ ID NO: 13221 - DNA, 22 bp, Homo sapiens
aactcaaagatgcatgacgctt

SEQ ID NO: 13222 - DNA, 22 bp, Homo sapiens
aggccccctccacccattctgg

SEQ ID NO: 13223 - DNA, 22 bp, Homo sapiens
attgaaaataaggccagaaaca

SEQ ID NO: 13224 - DNA, 22 bp, Homo sapiens
tttctaatctgattctcctacc

SEQ ID NO: 13225 - DNA, 22 bp, Homo sapiens
ggcttagcaactcctgaggctc

SEQ ID NO: 13226 - DNA, 22 bp, Homo sapiens
ttattttaccttcctctgagct

SEQ ID NO: 13227 - DNA, 22 bp, Homo sapiens
ggggccttttctgaatgtggaa

SEQ ID NO: 13228 - DNA, 22 bp, Homo sapiens
aggctctgtcaggcggagcagc

SEQ ID NO: 13229 - DNA, 22 bp, Homo sapiens
acaaagccagattctggagcac

SEQ ID NO: 13230 - DNA, 22 bp, Homo sapiens
tatcacagtaaatctgggtgca

SEQ ID NO: 13231 - DNA, 22 bp, Homo sapiens
gcacctgcctgggactgaagat

SEQ ID NO: 13232 - DNA, 22 bp, Homo sapiens
cccaggagttagaggttgtggt

SEQ ID NO: 13233 - DNA, 22 bp, Homo sapiens
atgaggcaggtggaggctgcca

SEQ ID NO: 13234 - DNA, 22 bp, Homo sapiens
acaagaagtaaaggtcggatgc

SEQ ID NO: 13235 - DNA, 22 bp, Homo sapiens
ttggatccatctcaggcatagg

SEQ ID NO: 13236 - DNA, 22 bp, Homo sapiens
tcatcagggatattggcctgaa

SEQ ID NO: 13237 - DNA, 22 bp, Homo sapiens
gaggtgtcatcaggcagctctg

SEQ ID NO: 13238 - DNA, 22 bp, Homo sapiens
cggatcctcagtcgtgcgggag

SEQ ID NO: 13239 - DNA, 22 bp, Homo sapiens
ggttgtagttggaggttgtata

SEQ ID NO: 13240 - DNA, 22 bp, Homo sapiens
gcctcctgtcccaggctgagga

SEQ ID NO: 13241 - DNA, 22 bp, Homo sapiens
tgccacagacaggacagaacag

SEQ ID NO: 13242 - DNA, 22 bp, Homo sapiens
accgggctaatttttgtatctt

SEQ ID NO: 13243 - DNA, 22 bp, Homo sapiens
ggctcactacaacctccgcctt

SEQ ID NO: 13244 - DNA, 17 bp, Homo sapiens
aatctgtttacagtcag

SEQ ID NO: 13245 - DNA, 22 bp, Homo sapiens
gaccttgtgatccgcccgcctt

SEQ ID NO: 13246 - DNA, 22 bp, Homo sapiens
atggtactggggtcccggagtt

SEQ ID NO: 13247 - DNA, 22 bp, Homo sapiens
gatctggaatctgaaggctgag

SEQ ID NO: 13248 - DNA, 22 bp, Homo sapiens
tgcagtttaaacttggcaactt

SEQ ID NO: 13249 - DNA, 22 bp, Homo sapiens
gatggtgcaggtgaagtgctgg

SEQ ID NO: 13250 - DNA, 22 bp, Homo sapiens
tcccctctttctggaaacacaa

SEQ ID NO: 13251 - DNA, 22 bp, Homo sapiens
aaagtgctgagattacaagcgt

SEQ ID NO: 13252 - DNA, 22 bp, Homo sapiens
ggtcgagtcacttgttgccttt

SEQ ID NO: 13253 - DNA, 22 bp, Homo sapiens
tgccttgtccttcgtcagggct

SEQ ID NO: 13254 - DNA, 22 bp, Homo sapiens
ttagattttaagaagggaggta

SEQ ID NO: 13255 - DNA, 22 bp, Homo sapiens
cgcgctctccttctggcaccca

SEQ ID NO: 13256 - DNA, 22 bp, Homo sapiens
tgatcagcatcttcccagctcg

SEQ ID NO: 13257 - DNA, 22 bp, Homo sapiens
tgtgactggttgtcccgctttc

SEQ ID NO: 13258 - DNA, 22 bp, Homo sapiens
gccaggttgctgacgacgatct

SEQ ID NO: 13259 - DNA, 22 bp, Homo sapiens
catctgctgttccttggactca

SEQ ID NO: 13260 - DNA, 22 bp, Homo sapiens
gggccggagctgggtcccgcgc

SEQ ID NO: 13261 - DNA, 22 bp, Homo sapiens
acaaagtgctgacattacaggc

SEQ ID NO: 13262 - DNA, 22 bp, Homo sapiens
gtggggcctgtggcttccgtgg

SEQ ID NO: 13263 - DNA, 22 bp, Homo sapiens
gaggcaggaggattgcttgagc

SEQ ID NO: 13264 - DNA, 21 bp, Homo sapiens
ggcaagaaacacaatcaagta

SEQ ID NO: 13265 - DNA, 22 bp, Homo sapiens
atcacagggtgaggattagacc

SEQ ID NO: 13266 - DNA, 22 bp, Homo sapiens
gctccggcttggtgtgcagggt

SEQ ID NO: 13267 - DNA, 22 bp, Homo sapiens
actgcgctccagcctgggtgac

SEQ ID NO: 13268 - DNA, 22 bp, Homo sapiens
tactgtactgcagttctgcaaa

SEQ ID NO: 13269 - DNA, 22 bp, Homo sapiens
gggagagtagctggaaggttct

SEQ ID NO: 13270 - DNA, 22 bp, Homo sapiens
tctcgatctcctgaccttgtga

SEQ ID NO: 13271 - DNA, 22 bp, Homo sapiens
cgtgtggtcccggcaaggcaag

SEQ ID NO: 13272 - DNA, 22 bp, Homo sapiens
gcctggagaaaggaaggtggga

SEQ ID NO: 13273 - DNA, 22 bp, Homo sapiens
ttagcttttgagaatgatttct

SEQ ID NO: 13274 - DNA, 22 bp, Homo sapiens
gggaggttgaggctgcagtgag

SEQ ID NO: 13275 - DNA, 22 bp, Homo sapiens
tagcgaggtgtttctaggactg

SEQ ID NO: 13276 - DNA, 22 bp, Homo sapiens
tgggcttaggtcggaggcggcc

SEQ ID NO: 13277 - DNA, 22 bp, Homo sapiens
tgctggaggccagaagtctgag

SEQ ID NO: 13278 - DNA, 22 bp, Homo sapiens
ccagcctggttcagaattggct

SEQ ID NO: 13279 - DNA, 22 bp, Homo sapiens
cagctttgccaagtaaggtctt

SEQ ID NO: 13280 - DNA, 22 bp, Homo sapiens
agaaggggcccaaggatgtcag

SEQ ID NO: 13281 - DNA, 22 bp, Homo sapiens
cccaggccctggcagagcttgt

SEQ ID NO: 13282 - DNA, 23 bp, Homo sapiens
tactatggttattatccctctcc

SEQ ID NO: 13283 - DNA, 22 bp, Homo sapiens
aaagtgcttctctttggtgggt

SEQ ID NO: 13284 - DNA, 22 bp, Homo sapiens
cagctacaaatacttttgtatg

SEQ ID NO: 13285 - DNA, 22 bp, Homo sapiens
gctgtggcctggcgcagagctg

SEQ ID NO: 13286 - DNA, 22 bp, Homo sapiens
cccccaaagtttgcacggataa

SEQ ID NO: 13287 - DNA, 22 bp, Homo sapiens
cccaggaggtggagcttgcagt

SEQ ID NO: 13288 - DNA, 22 bp, Homo sapiens
cagtcctgaatactggacggtg

SEQ ID NO: 13289 - DNA, 22 bp, Homo sapiens
ggccctggtcctaggggtggaa

SEQ ID NO: 13290 - DNA, 22 bp, Homo sapiens
acatcctcccgatctactggct

SEQ ID NO: 13291 - DNA, 22 bp, Homo sapiens
atagcagggatgtcagcaagta

SEQ ID NO: 13292 - DNA, 22 bp, Homo sapiens
atgcagtggcttcagtgtcagt

SEQ ID NO: 13293 - DNA, 22 bp, Homo sapiens
gaatgaacaaatgtggtggaga

SEQ ID NO: 13294 - DNA, 22 bp, Homo sapiens
gaagatacaaatttcttagatg

SEQ ID NO: 13295 - DNA, 22 bp, Homo sapiens
tggctccacaggccagggtgtg

SEQ ID NO: 13296 - DNA, 22 bp, Homo sapiens
ggcagcactgcagcttgttggg

SEQ ID NO: 13297 - DNA, 22 bp, Homo sapiens
tctgttgcaatgtgcatggtga

SEQ ID NO: 13298 - DNA, 22 bp, Homo sapiens
gggtaaatctcttttcatggct

SEQ ID NO: 13299 - DNA, 21 bp, Homo sapiens
aggattccagcacactgcttc

SEQ ID NO: 13300 - DNA, 22 bp, Homo sapiens
tagaagaaagtgaagctgggga

SEQ ID NO: 13301 - DNA, 22 bp, Homo sapiens
ggtttattgttaataagtttga

SEQ ID NO: 13302 - DNA, 22 bp, Homo sapiens
gggctgtaggagctggaatggg

SEQ ID NO: 13303 - DNA, 22 bp, Homo sapiens
aaagtaattgtggttcttgcca

SEQ ID NO: 13304 - DNA, 22 bp, Homo sapiens
tcaccagatctctctgtaatgg

SEQ ID NO: 13305 - DNA, 22 bp, Homo sapiens
ggggtcggggcatagccactta

SEQ ID NO: 13306 - DNA, 22 bp, Homo sapiens
aaaatcctgctgactcgagatg

SEQ ID NO: 13307 - DNA, 22 bp, Homo sapiens
caggaggattgcttgaggccag

SEQ ID NO: 13308 - DNA, 22 bp, Homo sapiens
atacaaaaattagccgggagta

SEQ ID NO: 13309 - DNA, 22 bp, Homo sapiens
tcccagaaccctgccaggtcct

SEQ ID NO: 13310 - DNA, 22 bp, Homo sapiens
tctggtgtcagtattctttgaa

SEQ ID NO: 13311 - DNA, 23 bp, Homo sapiens
ttttgcaataagtcactggaata

SEQ ID NO: 13312 - DNA, 22 bp, Homo sapiens
tgggcaaggctggagcctgcag

SEQ ID NO: 13313 - DNA, 22 bp, Homo sapiens
ggtgggccacggcataacgggc

SEQ ID NO: 13314 - DNA, 21 bp, Homo sapiens
ctacttaagtaggggattagg

SEQ ID NO: 13315 - DNA, 22 bp, Homo sapiens
tgcctgtggaaaggctggtgct

SEQ ID NO: 13316 - DNA, 22 bp, Homo sapiens
tcaccttgtgatctccctgcct

SEQ ID NO: 13317 - DNA, 22 bp, Homo sapiens
ccctcccagatgggcttgaggt

SEQ ID NO: 13318 - DNA, 22 bp, Homo sapiens
tctgccacttgaggtcattggc

SEQ ID NO: 13319 - DNA, 22 bp, Homo sapiens
tgtgggagaaggaagcaagctg

SEQ ID NO: 13320 - DNA, 22 bp, Homo sapiens
aacccgggaggcggaggttgtg

SEQ ID NO: 13321 - DNA, 22 bp, Homo sapiens
gaatttcctctaaacccctgag

SEQ ID NO: 13322 - DNA, 22 bp, Homo sapiens
taattataacagttacatctta

SEQ ID NO: 13323 - DNA, 22 bp, Homo sapiens
actccacatttgaacacagttc

SEQ ID NO: 13324 - DNA, 22 bp, Homo sapiens
gtgacaggccactgcggctctg

SEQ ID NO: 13325 - DNA, 22 bp, Homo sapiens
acaggggcaagggctcacggcc

SEQ ID NO: 13326 - DNA, 22 bp, Homo sapiens
gggcaggggtcagtggccccaa

SEQ ID NO: 13327 - DNA, 22 bp, Homo sapiens
gatgtagacacttggaggctta

SEQ ID NO: 13328 - DNA, 22 bp, Homo sapiens
caattcccagctgccgggctgc

SEQ ID NO: 13329 - DNA, 22 bp, Homo sapiens
aggaattcaagaccagctgggc

SEQ ID NO: 13330 - DNA, 22 bp, Homo sapiens
atctgagtcaaatatttcattt

SEQ ID NO: 13331 - DNA, 22 bp, Homo sapiens
catgagataatttttctccagt

SEQ ID NO: 13332 - DNA, 22 bp, Homo sapiens
tgtaccgcaaatgctgctgcct

SEQ ID NO: 13333 - DNA, 22 bp, Homo sapiens
tggattccacgcctgctcctgt

SEQ ID NO: 13334 - DNA, 22 bp, Homo sapiens
cccattgtggttgttgaggata

SEQ ID NO: 13335 - DNA, 22 bp, Homo sapiens
ctggaaggagcccgggcggatc

SEQ ID NO: 13336 - DNA, 22 bp, Homo sapiens
gcttggctttactagggggaca

SEQ ID NO: 13337 - DNA, 22 bp, Homo sapiens
atagtatttaatagttagctca

SEQ ID NO: 13338 - DNA, 22 bp, Homo sapiens
atattgttagtaatatttcgaa

SEQ ID NO: 13339 - DNA, 19 bp, Homo sapiens
caggcctcttaccctctct

SEQ ID NO: 13340 - DNA, 22 bp, Homo sapiens
cccagggagagcgcggaggcgg

SEQ ID NO: 13341 - DNA, 22 bp, Homo sapiens
cagcagcagtgttctagaatct

SEQ ID NO: 13342 - DNA, 22 bp, Homo sapiens
acaggtgcatgctaccatgtct

SEQ ID NO: 13343 - DNA, 22 bp, Homo sapiens
gggcttcagttctgaccatctt

SEQ ID NO: 13344 - DNA, 22 bp, Homo sapiens
ccttcccatgcagcctgtctga

SEQ ID NO: 13345 - DNA, 22 bp, Homo sapiens
gaggggcacagtaaagggtccc

SEQ ID NO: 13346 - DNA, 22 bp, Homo sapiens
ccctggctgataccggaaaggc

SEQ ID NO: 13347 - DNA, 22 bp, Homo sapiens
ccccatgaagtagggtctctga

SEQ ID NO: 13348 - DNA, 22 bp, Homo sapiens
ctggaggtgcttcgctggccac

SEQ ID NO: 13349 - DNA, 22 bp, Homo sapiens
ttgccgccgtctgctcgccccg

SEQ ID NO: 13350 - DNA, 22 bp, Homo sapiens
cctgcaccacaaggcttcagag

SEQ ID NO: 13351 - DNA, 22 bp, Homo sapiens
tttggtgtgcaccttgcggtgc

SEQ ID NO: 13352 - DNA, 22 bp, Homo sapiens
ctcctctttagccccagctgga

SEQ ID NO: 13353 - DNA, 22 bp, Homo sapiens
gtacaaatgcaggtttgttaca

SEQ ID NO: 13354 - DNA, 22 bp, Homo sapiens
accctaataatcacagactagt

SEQ ID NO: 13355 - DNA, 22 bp, Homo sapiens
tgggtactcctattagttcagt

SEQ ID NO: 13356 - DNA, 22 bp, Homo sapiens
ttaggcaattttgtcattgtgt

SEQ ID NO: 13357 - DNA, 22 bp, Homo sapiens
gtggaggagaggcgccttgcgg

SEQ ID NO: 13358 - DNA, 22 bp, Homo sapiens
tcttgagctgagtcagttcctg

SEQ ID NO: 13359 - DNA, 22 bp, Homo sapiens
gcccatttttagtagatttagt

SEQ ID NO: 13360 - DNA, 22 bp, Homo sapiens
ctgggcacagcgttgggctctt

SEQ ID NO: 13361 - DNA, 22 bp, Homo sapiens
ttccagttcactccatttctgg

SEQ ID NO: 13362 - DNA, 16 bp, Homo sapiens
aggctcagaggctgga

SEQ ID NO: 13363 - DNA, 22 bp, Homo sapiens
aaagactcactttcagctctgg

SEQ ID NO: 13364 - DNA, 22 bp, Homo sapiens
tgcccaggctggagtacagtgg

SEQ ID NO: 13365 - DNA, 22 bp, Homo sapiens
ttgtatagcccagagagtgaga

SEQ ID NO: 13366 - DNA, 22 bp, Homo sapiens
agagaagagtcttgtcaaatta

SEQ ID NO: 13367 - DNA, 22 bp, Homo sapiens
gggcggatcatttgaggtcagg

SEQ ID NO: 13368 - DNA, 18 bp, Homo sapiens
acctgattggcgcagccc

SEQ ID NO: 13369 - DNA, 19 bp, Homo sapiens
agggttacccgctgccacc

SEQ ID NO: 13370 - DNA, 22 bp, Homo sapiens
atgccactgcactccagcctag

SEQ ID NO: 13371 - DNA, 22 bp, Homo sapiens
tagcagtgtctaggtaggccat

SEQ ID NO: 13372 - DNA, 22 bp, Homo sapiens
taggcatgcaaataaatgtgca

SEQ ID NO: 13373 - DNA, 22 bp, Homo sapiens
agccaagcactcaactcctgga

SEQ ID NO: 13374 - DNA, 22 bp, Homo sapiens
cggccaagccggggccccgaag

SEQ ID NO: 13375 - DNA, 22 bp, Homo sapiens
gtcagtgtcttaacagagatta

SEQ ID NO: 13376 - DNA, 22 bp, Homo sapiens
gtctcccaaactctgatggtcc

SEQ ID NO: 13377 - DNA, 22 bp, Homo sapiens
taatcctgtcttgaccatcagg

SEQ ID NO: 13378 - DNA, 22 bp, Homo sapiens
ctctagctcccagggagcgtct

SEQ ID NO: 13379 - DNA, 22 bp, Homo sapiens
gagtttcttcatggtgcagagg

SEQ ID NO: 13380 - DNA, 20 bp, Homo sapiens
ttgagcagcagtgctgtgtc

SEQ ID NO: 13381 - DNA, 19 bp, Homo sapiens
agagtattgaatttgccct

SEQ ID NO: 13382 - DNA, 22 bp, Homo sapiens
ttcttgggaatttttccaacac

SEQ ID NO: 13383 - DNA, 22 bp, Homo sapiens
ggctctgcttgaggccagcctg

SEQ ID NO: 13384 - DNA, 22 bp, Homo sapiens
taccatgctctgcatctcacaa

SEQ ID NO: 13385 - DNA, 22 bp, Homo sapiens
tgacagaggagctggaatgatt

SEQ ID NO: 13386 - DNA, 22 bp, Homo sapiens
gcaagacatgtctaaggtttaa

SEQ ID NO: 13387 - DNA, 22 bp, Homo sapiens
ccaggctagaaactgaggcaca

SEQ ID NO: 13388 - DNA, 22 bp, Homo sapiens
gaggggagcccccatcctccag

SEQ ID NO: 13389 - DNA, 20 bp, Homo sapiens
tgttgattggtgtcatctca

SEQ ID NO: 13390 - DNA, 22 bp, Homo sapiens
acttgctggctccttgcttcta

SEQ ID NO: 13391 - DNA, 22 bp, Homo sapiens
ttgagcatctgaggattttcct

SEQ ID NO: 13392 - DNA, 22 bp, Homo sapiens
gttgagtgggttaggatgctga

SEQ ID NO: 13393 - DNA, 19 bp, Homo sapiens
gccgggcccgggttggccg

SEQ ID NO: 13394 - DNA, 22 bp, Homo sapiens
ttgtcttttgtgggaaatatgg

SEQ ID NO: 13395 - DNA, 22 bp, Homo sapiens
aggcaaggtgctacagacagtg

SEQ ID NO: 13396 - DNA, 22 bp, Homo sapiens
acagtctgtcccccaggtgcta

SEQ ID NO: 13397 - DNA, 22 bp, Homo sapiens
cagaagactgcagggaagggac

SEQ ID NO: 13398 - DNA, 22 bp, Homo sapiens
caaatgaatatttccatgggtt

SEQ ID NO: 13399 - DNA, 22 bp, Homo sapiens
tggggagtgatgcctcggataa

SEQ ID NO: 13400 - DNA, 22 bp, Homo sapiens
gacctggtccttgtactttgaa

SEQ ID NO: 13401 - DNA, 22 bp, Homo sapiens
ggcctggcagagcgcgcggctg

SEQ ID NO: 13402 - DNA, 22 bp, Homo sapiens
catgttggtgtgctgcacccgt

SEQ ID NO: 13403 - DNA, 20 bp, Homo sapiens
tagcatgggtgagggtagag

SEQ ID NO: 13404 - DNA, 22 bp, Homo sapiens
taagtcgtggatgattcttcgg

SEQ ID NO: 13405 - DNA, 22 bp, Homo sapiens
atgtttttggaaatgggaacat

SEQ ID NO: 13406 - DNA, 22 bp, Homo sapiens
aagacttgaccaggttgaaggc

SEQ ID NO: 13407 - DNA, 22 bp, Homo sapiens
cccaggggttcaaggctgcagt

SEQ ID NO: 13408 - DNA, 19 bp, Homo sapiens
ttgacgttgtggaattaac

SEQ ID NO: 13409 - DNA, 22 bp, Homo sapiens
ctgattgagaaggaaggggatc

SEQ ID NO: 13410 - DNA, 22 bp, Homo sapiens
aaggatacttttagagcctgag

SEQ ID NO: 13411 - DNA, 22 bp, Homo sapiens
ttcctggaaattatgctcacct

SEQ ID NO: 13412 - DNA, 21 bp, Homo sapiens
aggcttggatctagacaggcc

SEQ ID NO: 13413 - DNA, 22 bp, Homo sapiens
ttcagacaggcagctgggctgg

SEQ ID NO: 13414 - DNA, 22 bp, Homo sapiens
gaacgggtgcagccatgggccc

SEQ ID NO: 13415 - DNA, 22 bp, Homo sapiens
atagaataatggttgtcaggag

SEQ ID NO: 13416 - DNA, 22 bp, Homo sapiens
ccaggagttggaagctgccatg

SEQ ID NO: 13417 - DNA, 22 bp, Homo sapiens
tcctagttctctgccagtcgct

SEQ ID NO: 13418 - DNA, 22 bp, Homo sapiens
aagaaatgctgatgttggatgg

SEQ ID NO: 13419 - DNA, 22 bp, Homo sapiens
tgcgatggcgtagacaaatccc

SEQ ID NO: 13420 - DNA, 22 bp, Homo sapiens
tccacaggtccggcatgaacag

SEQ ID NO: 13421 - DNA, 22 bp, Homo sapiens
tggtttgtctaaatgagtaata

SEQ ID NO: 13422 - DNA, 22 bp, Homo sapiens
gggaaatagagctggaaccttg

SEQ ID NO: 13423 - DNA, 22 bp, Homo sapiens
agggaagaggaccagagtctct

SEQ ID NO: 13424 - DNA, 22 bp, Homo sapiens
gtatcacttttgagagtgagaa

SEQ ID NO: 13425 - DNA, 22 bp, Homo sapiens
gcaaatacatgttgagcaccta

SEQ ID NO: 13426 - DNA, 22 bp, Homo sapiens
tctaaacttgtaaacaagcata

SEQ ID NO: 13427 - DNA, 22 bp, Homo sapiens
tcagtggagagcttccaggatt

SEQ ID NO: 13428 - DNA, 22 bp, Homo sapiens
ttccgagtctccaaggggttgt

SEQ ID NO: 13429 - DNA, 22 bp, Homo sapiens
acttcttcttcagctgggggat

SEQ ID NO: 13430 - DNA, 22 bp, Homo sapiens
tccatgaggaccaaattcgtag

SEQ ID NO: 13431 - DNA, 22 bp, Homo sapiens
gaactttataactgtaaatgtc

SEQ ID NO: 13432 - DNA, 22 bp, Homo sapiens
ctgctcttcacactacacccgt

SEQ ID NO: 13433 - DNA, 22 bp, Homo sapiens
gattgtggaagtcagtggttct

SEQ ID NO: 13434 - DNA, 22 bp, Homo sapiens
caaatgtataaatgtactttct

SEQ ID NO: 13435 - DNA, 22 bp, Homo sapiens
taacaatacccattctaattac

SEQ ID NO: 13436 - DNA, 22 bp, Homo sapiens
tggattcacaccattctcctgc

SEQ ID NO: 13437 - DNA, 22 bp, Homo sapiens
gtccaagagtcaagaagggggc

SEQ ID NO: 13438 - DNA, 22 bp, Homo sapiens
tagcatgtcagtcgccacacgt

SEQ ID NO: 13439 - DNA, 22 bp, Homo sapiens
caggctggagtgcagtggggcg

SEQ ID NO: 13440 - DNA, 22 bp, Homo sapiens
cttttgattgagcagtttcaaa

SEQ ID NO: 13441 - DNA, 22 bp, Homo sapiens
ggaggctgagaggtcgcagtgg

SEQ ID NO: 13442 - DNA, 22 bp, Homo sapiens
aagtaaatatctgtagtcttta

SEQ ID NO: 13443 - DNA, 22 bp, Homo sapiens
gccgtgcgtgcgcaggtgctgt

SEQ ID NO: 13444 - DNA, 22 bp, Homo sapiens
tagaggctttcagcggtaggtc

SEQ ID NO: 13445 - DNA, 22 bp, Homo sapiens
gctcactgcaacctccgccttc

SEQ ID NO: 13446 - DNA, 22 bp, Homo sapiens
tcaggtccaagatggccatcca

SEQ ID NO: 13447 - DNA, 22 bp, Homo sapiens
cggtctcccgtgtgtgtgcgct

SEQ ID NO: 13448 - DNA, 22 bp, Homo sapiens
gcttggaagtaggattgggaga

SEQ ID NO: 13449 - DNA, 22 bp, Homo sapiens
aagaaatgtgaatattgaatag

SEQ ID NO: 13450 - DNA, 22 bp, Homo sapiens
ttagccaggggagcagcttgtc

SEQ ID NO: 13451 - DNA, 22 bp, Homo sapiens
tttgcattgcattaagtattct

SEQ ID NO: 13452 - DNA, 22 bp, Homo sapiens
gggccgtagaccacgtccgggc

SEQ ID NO: 13453 - DNA, 22 bp, Homo sapiens
agaatccctgcttgtcttcaaa

SEQ ID NO: 13454 - DNA, 22 bp, Homo sapiens
aagcctggactatcgcgtgtgc

SEQ ID NO: 13455 - DNA, 22 bp, Homo sapiens
ttacactttaaatccagcttgt

SEQ ID NO: 13456 - DNA, 22 bp, Homo sapiens
aaagaaggtagggctggtgact

SEQ ID NO: 13457 - DNA, 22 bp, Homo sapiens
cacctagggtttcgcctttctt

SEQ ID NO: 13458 - DNA, 22 bp, Homo sapiens
agagctgggtggacttgtagtt

SEQ ID NO: 13459 - DNA, 22 bp, Homo sapiens
ccttttgtcctgcttggtttcg

SEQ ID NO: 13460 - DNA, 22 bp, Homo sapiens
aaaggtcaaaatcgtgacattg

SEQ ID NO: 13461 - DNA, 22 bp, Homo sapiens
ttacaggtgtgagccaccccac

SEQ ID NO: 13462 - DNA, 22 bp, Homo sapiens
accttgatggggctgttggagt

SEQ ID NO: 13463 - DNA, 22 bp, Homo sapiens
tgcaggcctggactgatgtggt

SEQ ID NO: 13464 - DNA, 20 bp, Homo sapiens
caagggtttgcattggcttt

SEQ ID NO: 13465 - DNA, 22 bp, Homo sapiens
gctcaagacccctctgtgactg

SEQ ID NO: 13466 - DNA, 23 bp, Homo sapiens
aatggtcttcctccacccctctg

SEQ ID NO: 13467 - DNA, 22 bp, Homo sapiens
gaatcccttgcattatcccttt

SEQ ID NO: 13468 - DNA, 22 bp, Homo sapiens
aggggaggtgtccccaaatctc

SEQ ID NO: 13469 - DNA, 22 bp, Homo sapiens
ccgtggtcacctgagctccttg

SEQ ID NO: 13470 - DNA, 22 bp, Homo sapiens
ggctcatatcccggccatcatt

SEQ ID NO: 13471 - DNA, 22 bp, Homo sapiens
tctcatttacttccacaggctg

SEQ ID NO: 13472 - DNA, 16 bp, Homo sapiens
tgggtgggaggagcgg

SEQ ID NO: 13473 - DNA, 22 bp, Homo sapiens
gttacagtcaggagatattttg

SEQ ID NO: 13474 - DNA, 22 bp, Homo sapiens
ggaggcggaggttgcagtgagt

SEQ ID NO: 13475 - DNA, 22 bp, Homo sapiens
ggaggtggaggttgcagtgagc

SEQ ID NO: 13476 - DNA, 22 bp, Homo sapiens
catgtaaagaatttcacacaag

SEQ ID NO: 13477 - DNA, 22 bp, Homo sapiens
tctggagataagcagcaatgaa

SEQ ID NO: 13478 - DNA, 22 bp, Homo sapiens
aggctcccaagcactgacccca

SEQ ID NO: 13479 - DNA, 22 bp, Homo sapiens
cagcctgccgtcagccaggtag

SEQ ID NO: 13480 - DNA, 22 bp, Homo sapiens
acccaggagacggaggtgcagt

SEQ ID NO: 13481 - DNA, 18 bp, Homo sapiens
gcagctagccaggggggc

SEQ ID NO: 13482 - DNA, 22 bp, Homo sapiens
cgagagttagctaggagtcaca

SEQ ID NO: 13483 - DNA, 22 bp, Homo sapiens
tgcctcagctgaggccgctcca

SEQ ID NO: 13484 - DNA, 22 bp, Homo sapiens
tctggctctggagtccacctgc

SEQ ID NO: 13485 - DNA, 22 bp, Homo sapiens
tgaggcaggtggattacaaggt

SEQ ID NO: 13486 - DNA, 22 bp, Homo sapiens
gtgatatcttacaattctcttt

SEQ ID NO: 13487 - DNA, 22 bp, Homo sapiens
tttgaggttagctagcagatca

SEQ ID NO: 13488 - DNA, 22 bp, Homo sapiens
aaggagtctgggccattcagag

SEQ ID NO: 13489 - DNA, 22 bp, Homo sapiens
ggaatgaatttccagctgggtc

SEQ ID NO: 13490 - DNA, 22 bp, Homo sapiens
accagaagctggagcacaagga

SEQ ID NO: 13491 - DNA, 22 bp, Homo sapiens
gctaatcaatgttaaggctgtg

SEQ ID NO: 13492 - DNA, 18 bp, Homo sapiens
ggaaaaggagtgtctagc

SEQ ID NO: 13493 - DNA, 22 bp, Homo sapiens
ggaattgtctagtactcacggc

SEQ ID NO: 13494 - DNA, 21 bp, Homo sapiens
gctcctggtgctgcgtggcgc

SEQ ID NO: 13495 - DNA, 22 bp, Homo sapiens
caactgggataaagagctaaag

SEQ ID NO: 13496 - DNA, 22 bp, Homo sapiens
ctgccgttgtgaagctcttaga

SEQ ID NO: 13497 - DNA, 22 bp, Homo sapiens
tgacttgtctctttgggagaca

SEQ ID NO: 13498 - DNA, 22 bp, Homo sapiens
gggccagtgaacaatgagggaa

SEQ ID NO: 13499 - DNA, 22 bp, Homo sapiens
gaagtgtagtcttgagccccca

SEQ ID NO: 13500 - DNA, 22 bp, Homo sapiens
ccaggaggcggaggttgcagtg

SEQ ID NO: 13501 - DNA, 22 bp, Homo sapiens
tgagccaggagtttgaggctgt

SEQ ID NO: 13502 - DNA, 22 bp, Homo sapiens
tctgcggtccccttctcgccct

SEQ ID NO: 13503 - DNA, 22 bp, Homo sapiens
ttgtgaatagtgccacaataaa

SEQ ID NO: 13504 - DNA, 22 bp, Homo sapiens
ccgcaaggcagaggttgcagtg

SEQ ID NO: 13505 - DNA, 22 bp, Homo sapiens
tactgcactccagcctgggtga

SEQ ID NO: 13506 - DNA, 22 bp, Homo sapiens
gcggcaggagtaaaggaggaag

SEQ ID NO: 13507 - DNA, 22 bp, Homo sapiens
tgaaggggttcagcatgggggt

SEQ ID NO: 13508 - DNA, 20 bp, Homo sapiens
tctcgcactcggagcagccg

SEQ ID NO: 13509 - DNA, 22 bp, Homo sapiens
ctgggcagctgtatcagggagt

SEQ ID NO: 13510 - DNA, 22 bp, Homo sapiens
ttatgatttgccacagattggt

SEQ ID NO: 13511 - DNA, 22 bp, Homo sapiens
gaggctgaggttgcagtgagct

SEQ ID NO: 13512 - DNA, 22 bp, Homo sapiens
tcaccagctctgcctcgccagt

SEQ ID NO: 13513 - DNA, 22 bp, Homo sapiens
accctccccaagaggtcgtgcc

SEQ ID NO: 13514 - DNA, 22 bp, Homo sapiens
tgcgggtcccagggtcacaggc

SEQ ID NO: 13515 - DNA, 22 bp, Homo sapiens
tgtgagcagagacatgaaaagc

SEQ ID NO: 13516 - DNA, 22 bp, Homo sapiens
tctagctctgcttatcatggct

SEQ ID NO: 13517 - DNA, 22 bp, Homo sapiens
tgggagtgtaaattagttcaac

SEQ ID NO: 13518 - DNA, 22 bp, Homo sapiens
cagggtgacaagtggcaaggag

SEQ ID NO: 13519 - DNA, 22 bp, Homo sapiens
agctcctgaaaatccagactgg

SEQ ID NO: 13520 - DNA, 22 bp, Homo sapiens
atggggctgttctctgccctgc

SEQ ID NO: 13521 - DNA, 22 bp, Homo sapiens
ccactgcactccagccttggca

SEQ ID NO: 13522 - DNA, 22 bp, Homo sapiens
aaagcttaccttttcagtcttt

SEQ ID NO: 13523 - DNA, 22 bp, Homo sapiens
tcagtgactccttcttcctgct

SEQ ID NO: 13524 - DNA, 22 bp, Homo sapiens
ctgagcacgtagttagggtcca

SEQ ID NO: 13525 - DNA, 22 bp, Homo sapiens
ggctgggcaggtctgcacaggg

SEQ ID NO: 13526 - DNA, 22 bp, Homo sapiens
ccaggctgctgttggtgtccgc

SEQ ID NO: 13527 - DNA, 22 bp, Homo sapiens
ccaagtgttttataagggacag

SEQ ID NO: 13528 - DNA, 22 bp, Homo sapiens
agctggtgctcggggagctggc

SEQ ID NO: 13529 - DNA, 22 bp, Homo sapiens
aggggatgcctagtggagtctc

SEQ ID NO: 13530 - DNA, 22 bp, Homo sapiens
cacattccttacattcatagag

SEQ ID NO: 13531 - DNA, 22 bp, Homo sapiens
ccaaaaggaactttttgaaggt

SEQ ID NO: 13532 - DNA, 22 bp, Homo sapiens
tcccagcgcggggggaggatcc

SEQ ID NO: 13533 - DNA, 22 bp, Homo sapiens
catgatctggtcctactgtggg

SEQ ID NO: 13534 - DNA, 22 bp, Homo sapiens
taaagttggacctgattttatt

SEQ ID NO: 13535 - DNA, 22 bp, Homo sapiens
ctcttcctagtgtgcagcgtgg

SEQ ID NO: 13536 - DNA, 22 bp, Homo sapiens
tggtggctcacgtctgtaatct

SEQ ID NO: 13537 - DNA, 22 bp, Homo sapiens
aagagggctgcaatcttattgc

SEQ ID NO: 13538 - DNA, 22 bp, Homo sapiens
cacgggagacgtgatcttggac

SEQ ID NO: 13539 - DNA, 22 bp, Homo sapiens
ggcgccgcactcggtgcagccg

SEQ ID NO: 13540 - DNA, 22 bp, Homo sapiens
ccctgggattcaatttcactct

SEQ ID NO: 13541 - DNA, 22 bp, Homo sapiens
ctggccagatgttacgtccaat

SEQ ID NO: 13542 - DNA, 22 bp, Homo sapiens
tggccaccaccaatacttgcct

SEQ ID NO: 13543 - DNA, 22 bp, Homo sapiens
acacccaggctggcgtgcagtg

SEQ ID NO: 13544 - DNA, 22 bp, Homo sapiens
aaatgcctcattttctctcact

SEQ ID NO: 13545 - DNA, 22 bp, Homo sapiens
tggggcatgtgaacctggatgt

SEQ ID NO: 13546 - DNA, 22 bp, Homo sapiens
cggggacacactggcagctcct

SEQ ID NO: 13547 - DNA, 22 bp, Homo sapiens
tacaccattcccaggtggattt

SEQ ID NO: 13548 - DNA, 22 bp, Homo sapiens
tcacagagaaatgtggcacaaa

SEQ ID NO: 13549 - DNA, 22 bp, Homo sapiens
cagagctgtccaaaccctgaca

SEQ ID NO: 13550 - DNA, 22 bp, Homo sapiens
tctacatgcagcgaggggactt

SEQ ID NO: 13551 - DNA, 22 bp, Homo sapiens
agctttgtttgctcacccgccg

SEQ ID NO: 13552 - DNA, 22 bp, Homo sapiens
cttctttcaagaatggattagg

SEQ ID NO: 13553 - DNA, 22 bp, Homo sapiens
aaaaatcacttttataggcagc

SEQ ID NO: 13554 - DNA, 22 bp, Homo sapiens
tgaggcaggacttgcataaagt

SEQ ID NO: 13555 - DNA, 18 bp, Homo sapiens
cttgttcttctcttggcg

SEQ ID NO: 13556 - DNA, 22 bp, Homo sapiens
tacatttataaggcttctctgt

SEQ ID NO: 13557 - DNA, 22 bp, Homo sapiens
tcagtatcaatagcgtcacaat

SEQ ID NO: 13558 - DNA, 22 bp, Homo sapiens
tatccaattcaccattgatggg

SEQ ID NO: 13559 - DNA, 22 bp, Homo sapiens
ccggctactcgggaggctgacg

SEQ ID NO: 13560 - DNA, 22 bp, Homo sapiens
ggaaacttggatgccagcactc

SEQ ID NO: 13561 - DNA, 22 bp, Homo sapiens
actgcgtggggagctgtgacta

SEQ ID NO: 13562 - DNA, 22 bp, Homo sapiens
gtgctgacaggagcctggcggt

SEQ ID NO: 13563 - DNA, 22 bp, Homo sapiens
gctggggaggcagcagagaaca

SEQ ID NO: 13564 - DNA, 23 bp, Homo sapiens
gcctgccgcctggctgagaactg

SEQ ID NO: 13565 - DNA, 22 bp, Homo sapiens
tgagagttctctcttcaggtgg

SEQ ID NO: 13566 - DNA, 20 bp, Homo sapiens
gtgtggccaggagctgcgct

SEQ ID NO: 13567 - DNA, 22 bp, Homo sapiens
cctgtgcttggccagagaggtt

SEQ ID NO: 13568 - DNA, 21 bp, Homo sapiens
cggaaaggactagggctcaga

SEQ ID NO: 13569 - DNA, 16 bp, Homo sapiens
gaggagcccctctgcc

SEQ ID NO: 13570 - DNA, 22 bp, Homo sapiens
ctggctgggagcgagctgctca

SEQ ID NO: 13571 - DNA, 22 bp, Homo sapiens
agggctctgagtgggaaagagg

SEQ ID NO: 13572 - DNA, 22 bp, Homo sapiens
gtgcatgtgtctttatagtagc

SEQ ID NO: 13573 - DNA, 21 bp, Homo sapiens
gccatttcacacagacatttg

SEQ ID NO: 13574 - DNA, 21 bp, Homo sapiens
tctgatggtagatgagatgtg

SEQ ID NO: 13575 - DNA, 22 bp, Homo sapiens
cttccttctcactagcagcgcc

SEQ ID NO: 13576 - DNA, 21 bp, Homo sapiens
gaccccagaccagcagacaca

SEQ ID NO: 13577 - DNA, 19 bp, Homo sapiens
tctagttttgagagacttc

SEQ ID NO: 13578 - DNA, 22 bp, Homo sapiens
cactgcactccagcccgggcaa

SEQ ID NO: 13579 - DNA, 22 bp, Homo sapiens
gtgggccagcttttctcctggg

SEQ ID NO: 13580 - DNA, 22 bp, Homo sapiens
atacatgcgccatgttggtgtg

SEQ ID NO: 13581 - DNA, 16 bp, Homo sapiens
aaactgacggcatctg

SEQ ID NO: 13582 - DNA, 22 bp, Homo sapiens
ggagtgcagtggtgggatctca

SEQ ID NO: 13583 - DNA, 22 bp, Homo sapiens
ggtgacagtggttaaaatttgt

SEQ ID NO: 13584 - DNA, 22 bp, Homo sapiens
cgctgataaacgtcacgttccc

SEQ ID NO: 13585 - DNA, 21 bp, Homo sapiens
ctggaggcaggtggtgccagg

SEQ ID NO: 13586 - DNA, 22 bp, Homo sapiens
ccacaagtttgttgattgaaac

SEQ ID NO: 13587 - DNA, 22 bp, Homo sapiens
atttcatactaaggctcaaaaa

SEQ ID NO: 13588 - DNA, 22 bp, Homo sapiens
ggccaggcgatgacccctccac

SEQ ID NO: 13589 - DNA, 22 bp, Homo sapiens
aatgcaccttggcagggattca

SEQ ID NO: 13590 - DNA, 22 bp, Homo sapiens
ccagctttatagcttcaaagga

SEQ ID NO: 13591 - DNA, 22 bp, Homo sapiens
agccaggatggtctcgatcggc

SEQ ID NO: 13592 - DNA, 22 bp, Homo sapiens
cactgcactccagcctgggcca

SEQ ID NO: 13593 - DNA, 22 bp, Homo sapiens
gctagtgcagggaaatctttgg

SEQ ID NO: 13594 - DNA, 22 bp, Homo sapiens
ttgaaattttaggccttgcaat

SEQ ID NO: 13595 - DNA, 22 bp, Homo sapiens
cccaggctggagtgtaatggtg

SEQ ID NO: 13596 - DNA, 22 bp, Homo sapiens
tcacccaggctggagtgtagtg

SEQ ID NO: 13597 - DNA, 22 bp, Homo sapiens
aattcacatccgaccaggtcaa

SEQ ID NO: 13598 - DNA, 22 bp, Homo sapiens
tggaagggagctggaatttgga

SEQ ID NO: 13599 - DNA, 22 bp, Homo sapiens
agagtggagagaaacaactctg

SEQ ID NO: 13600 - DNA, 22 bp, Homo sapiens
tgaggcaggagaatcacatgaa

SEQ ID NO: 13601 - DNA, 22 bp, Homo sapiens
taggcgacagcttgatggtgcg

SEQ ID NO: 13602 - DNA, 22 bp, Homo sapiens
accctggacatcttgtcatagc

SEQ ID NO: 13603 - DNA, 22 bp, Homo sapiens
tccataaattttatgaacatat

SEQ ID NO: 13604 - DNA, 22 bp, Homo sapiens
aggagggagcttaagccaggca

SEQ ID NO: 13605 - DNA, 22 bp, Homo sapiens
taaaggtctgaacacagtgagg

SEQ ID NO: 13606 - DNA, 21 bp, Homo sapiens
ccaggccaggcctacggggat

SEQ ID NO: 13607 - DNA, 21 bp, Homo sapiens
tgcaatccagcctgggcgaca

SEQ ID NO: 13608 - DNA, 22 bp, Homo sapiens
gagagagctctgtgcctgggat

SEQ ID NO: 13609 - DNA, 22 bp, Homo sapiens
ttagtctctttgcattgccata

SEQ ID NO: 13610 - DNA, 22 bp, Homo sapiens
cccaggaggcagagcttgcagt

SEQ ID NO: 13611 - DNA, 22 bp, Homo sapiens
ccctgctgtgtagcggaggaac

SEQ ID NO: 13612 - DNA, 22 bp, Homo sapiens
tggcaatgttagcaaagcattt

SEQ ID NO: 13613 - DNA, 22 bp, Homo sapiens
tgagaattacaaatgagtcaca

SEQ ID NO: 13614 - DNA, 22 bp, Homo sapiens
tcttcctggatgggggttgatg

SEQ ID NO: 13615 - DNA, 22 bp, Homo sapiens
ggaaggggtgggtgagcctcag

SEQ ID NO: 13616 - DNA, 22 bp, Homo sapiens
cagggccagcgtctcgggctat

SEQ ID NO: 13617 - DNA, 22 bp, Homo sapiens
gtgcatgtcggggtgcatgtca

SEQ ID NO: 13618 - DNA, 22 bp, Homo sapiens
aagctgattccactttttccac

SEQ ID NO: 13619 - DNA, 22 bp, Homo sapiens
ggtaacttagctcatggctgtg

SEQ ID NO: 13620 - DNA, 22 bp, Homo sapiens
attgctaggaacaggttgcacc

SEQ ID NO: 13621 - DNA, 22 bp, Homo sapiens
cgtgattggcttctgcattgga

SEQ ID NO: 13622 - DNA, 22 bp, Homo sapiens
gtgcgtcctgggggctgggtcg

SEQ ID NO: 13623 - DNA, 22 bp, Homo sapiens
agatttatgtggtcacactcag

SEQ ID NO: 13624 - DNA, 22 bp, Homo sapiens
gtacagtgggtgtagggaccag

SEQ ID NO: 13625 - DNA, 22 bp, Homo sapiens
ttggccttagcttcttcttaaa

SEQ ID NO: 13626 - DNA, 22 bp, Homo sapiens
aatgtcctggagggcggccgct

SEQ ID NO: 13627 - DNA, 22 bp, Homo sapiens
tgagatcattgacttgttcctg

SEQ ID NO: 13628 - DNA, 22 bp, Homo sapiens
agcccaggctggagtgcagtgg

SEQ ID NO: 13629 - DNA, 23 bp, Homo sapiens
atgtttgcagtaacccatcctgg

SEQ ID NO: 13630 - DNA, 22 bp, Homo sapiens
aggaattgtgttgtagtggaga

SEQ ID NO: 13631 - DNA, 22 bp, Homo sapiens
tcctgagataaatctcatgtga

SEQ ID NO: 13632 - DNA, 22 bp, Homo sapiens
cacccaggctggagtgcagtgg

SEQ ID NO: 13633 - DNA, 22 bp, Homo sapiens
ccagcagagcatggggaggaag

SEQ ID NO: 13634 - DNA, 22 bp, Homo sapiens
gtgtgtccaaggcacggatgac

SEQ ID NO: 13635 - DNA, 22 bp, Homo sapiens
gccggggctggggagagacatg

SEQ ID NO: 13636 - DNA, 22 bp, Homo sapiens
gcaactgaacatgtgtgtggcc

SEQ ID NO: 13637 - DNA, 22 bp, Homo sapiens
acaggggattgattggaagtct

SEQ ID NO: 13638 - DNA, 20 bp, Homo sapiens
aaactaaaggtgtttggttt

SEQ ID NO: 13639 - DNA, 22 bp, Homo sapiens
ggtcgggcactctccagggctg

SEQ ID NO: 13640 - DNA, 22 bp, Homo sapiens
ctttggcaatgtcattttcaat

SEQ ID NO: 13641 - DNA, 22 bp, Homo sapiens
aggactcatccctgcttgtcag

SEQ ID NO: 13642 - DNA, 18 bp, Homo sapiens
tcaagccattctcctgcc

SEQ ID NO: 13643 - DNA, 22 bp, Homo sapiens
gaggcctgggcaagggggtctg

SEQ ID NO: 13644 - DNA, 22 bp, Homo sapiens
ggggtctgggcttagctggaat

SEQ ID NO: 13645 - DNA, 22 bp, Homo sapiens
ggttgctgggggtggcagagct

SEQ ID NO: 13646 - DNA, 22 bp, Homo sapiens
ccgggccccacggtgacctcag

SEQ ID NO: 13647 - DNA, 22 bp, Homo sapiens
aatctgagggaacttgaactcc

SEQ ID NO: 13648 - DNA, 22 bp, Homo sapiens
atgctctctgtcctgctcagag

SEQ ID NO: 13649 - DNA, 22 bp, Homo sapiens
atttaagggatttggagaccaa

SEQ ID NO: 13650 - DNA, 23 bp, Homo sapiens
ggggtcttggaacaggtggccct

SEQ ID NO: 13651 - DNA, 22 bp, Homo sapiens
agacagggtgatcgcttgagcc

SEQ ID NO: 13652 - DNA, 22 bp, Homo sapiens
ctcaggacccggtccaggtggg

SEQ ID NO: 13653 - DNA, 22 bp, Homo sapiens
tcctgggaggcggaggttgcag

SEQ ID NO: 13654 - DNA, 22 bp, Homo sapiens
tggctaacaaggtgaaaccccg

SEQ ID NO: 13655 - DNA, 22 bp, Homo sapiens
tttctttatcatagcatctttg

SEQ ID NO: 13656 - DNA, 22 bp, Homo sapiens
gcaggcaggcttccttgaactg

SEQ ID NO: 13657 - DNA, 18 bp, Homo sapiens
tgctgatggtccattagt

SEQ ID NO: 13658 - DNA, 22 bp, Homo sapiens
cctcgacctccccaggctcagg

SEQ ID NO: 13659 - DNA, 22 bp, Homo sapiens
accgggaagtcctgcactgggc

SEQ ID NO: 13660 - DNA, 22 bp, Homo sapiens
gcttctggtgaggcctcaggaa

SEQ ID NO: 13661 - DNA, 22 bp, Homo sapiens
gccatgactctccataccaaag

SEQ ID NO: 13662 - DNA, 22 bp, Homo sapiens
ttcctgttcaggaaagttgtgt

SEQ ID NO: 13663 - DNA, 22 bp, Homo sapiens
aaagtgctgggattataggcat

SEQ ID NO: 13664 - DNA, 22 bp, Homo sapiens
gggcagatcacctgaggtcagg

SEQ ID NO: 13665 - DNA, 22 bp, Homo sapiens
atacagttatagtcagggctaa

SEQ ID NO: 13666 - DNA, 22 bp, Homo sapiens
aggagaagccaagttgtgagca

SEQ ID NO: 13667 - DNA, 23 bp, Homo sapiens
aaataggagtatctggatcatga

SEQ ID NO: 13668 - DNA, 22 bp, Homo sapiens
ttgggatacatcttgctgagcc

SEQ ID NO: 13669 - DNA, 19 bp, Homo sapiens
ctctggagtcattgctccc

SEQ ID NO: 13670 - DNA, 22 bp, Homo sapiens
gaaccctagcatgtcctttagg

SEQ ID NO: 13671 - DNA, 22 bp, Homo sapiens
tcacagacccttgctgagctct

SEQ ID NO: 13672 - DNA, 22 bp, Homo sapiens
gggcttggcacatgggctcagc

SEQ ID NO: 13673 - DNA, 22 bp, Homo sapiens
tttctcctcatgactggttgtg

SEQ ID NO: 13674 - DNA, 22 bp, Homo sapiens
agagggaagatggtccaatctt

SEQ ID NO: 13675 - DNA, 22 bp, Homo sapiens
cccagcaaggccagctcagggc

SEQ ID NO: 13676 - DNA, 20 bp, Homo sapiens
gcgtggcctgggatcccaag

SEQ ID NO: 13677 - DNA, 21 bp, Homo sapiens
caaaagagactgattcttgga

SEQ ID NO: 13678 - DNA, 22 bp, Homo sapiens
catcactgtccaaagttcagtt

SEQ ID NO: 13679 - DNA, 22 bp, Homo sapiens
caggagatgacagggaagaacc

SEQ ID NO: 13680 - DNA, 22 bp, Homo sapiens
atagagtgatgtaaggtatgtg

SEQ ID NO: 13681 - DNA, 22 bp, Homo sapiens
attcacagggggagaagggtat

SEQ ID NO: 13682 - DNA, 22 bp, Homo sapiens
ctccccagccctggtattctga

SEQ ID NO: 13683 - DNA, 22 bp, Homo sapiens
agtgagagtattaatgtgaact

SEQ ID NO: 13684 - DNA, 22 bp, Homo sapiens
aatcacttagaacccaggaagt

SEQ ID NO: 13685 - DNA, 22 bp, Homo sapiens
gtggctcacacctgtaatccca

SEQ ID NO: 13686 - DNA, 22 bp, Homo sapiens
atcagagtagttgttgcccaga

SEQ ID NO: 13687 - DNA, 22 bp, Homo sapiens
ggtcaggagcccttggccccct

SEQ ID NO: 13688 - DNA, 22 bp, Homo sapiens
aggagccagtggagttcctgcc

SEQ ID NO: 13689 - DNA, 22 bp, Homo sapiens
tcggagcgtcactggctggagg

SEQ ID NO: 13690 - DNA, 22 bp, Homo sapiens
ctggagggctgcagcgaggctg

SEQ ID NO: 13691 - DNA, 22 bp, Homo sapiens
agaagccaccagctgaggaaga

SEQ ID NO: 13692 - DNA, 22 bp, Homo sapiens
gccacctcggctttctctgctc

SEQ ID NO: 13693 - DNA, 22 bp, Homo sapiens
agtcacagggggcccctgcaac

SEQ ID NO: 13694 - DNA, 22 bp, Homo sapiens
ggcagggcaggaaagtcaggaa

SEQ ID NO: 13695 - DNA, 22 bp, Homo sapiens
aatgcaatgcagcacctccttg

SEQ ID NO: 13696 - DNA, 23 bp, Homo sapiens
acagcaagaggaccagatgtgag

SEQ ID NO: 13697 - DNA, 22 bp, Homo sapiens
tttctcggcagagatgatgggc

SEQ ID NO: 13698 - DNA, 22 bp, Homo sapiens
ctggctcgcattatattttggg

SEQ ID NO: 13699 - DNA, 19 bp, Homo sapiens
gctgaaggaggtgcctgca

SEQ ID NO: 13700 - DNA, 22 bp, Homo sapiens
ggggcccctcggacacgtgcgg

SEQ ID NO: 13701 - DNA, 22 bp, Homo sapiens
ccaggctggagtgcagtggcac

SEQ ID NO: 13702 - DNA, 21 bp, Homo sapiens
ttgctgttttcccaatgcagt

SEQ ID NO: 13703 - DNA, 21 bp, Homo sapiens
tttcttaggctctaaaatgac

SEQ ID NO: 13704 - DNA, 22 bp, Homo sapiens
tgttattgtcgctgcactggga

SEQ ID NO: 13705 - DNA, 22 bp, Homo sapiens
tttaatcaggcaaagcataata

SEQ ID NO: 13706 - DNA, 22 bp, Homo sapiens
tattaagtggtgagtactgcca

SEQ ID NO: 13707 - DNA, 22 bp, Homo sapiens
aatgtgagccaatgcccgtggg

SEQ ID NO: 13708 - DNA, 18 bp, Homo sapiens
acttcccagatgagggga

SEQ ID NO: 13709 - DNA, 23 bp, Homo sapiens
tgttccagatacgccttttcctc

SEQ ID NO: 13710 - DNA, 22 bp, Homo sapiens
tccaagatctacagcagtttag

SEQ ID NO: 13711 - DNA, 22 bp, Homo sapiens
atgagcacactgataagcccct

SEQ ID NO: 13712 - DNA, 22 bp, Homo sapiens
gtgcgcaccctcccggcatccc

SEQ ID NO: 13713 - DNA, 22 bp, Homo sapiens
agctggagatgagtgacgtgcc

SEQ ID NO: 13714 - DNA, 22 bp, Homo sapiens
tctaatccttgctacctgggtg

SEQ ID NO: 13715 - DNA, 22 bp, Homo sapiens
atccccctcttggatggcggca

SEQ ID NO: 13716 - DNA, 22 bp, Homo sapiens
taagtcccccacttgccacagg

SEQ ID NO: 13717 - DNA, 22 bp, Homo sapiens
aaccagctaacatgtggaatga

SEQ ID NO: 13718 - DNA, 22 bp, Homo sapiens
aagtataatcaaagcagggcta

SEQ ID NO: 13719 - DNA, 21 bp, Homo sapiens
atctcgggcttctcgcccagc

SEQ ID NO: 13720 - DNA, 22 bp, Homo sapiens
agggggctccttggtgtgcaga

SEQ ID NO: 13721 - DNA, 20 bp, Homo sapiens
accccagtgtgtgcctcaag

SEQ ID NO: 13722 - DNA, 22 bp, Homo sapiens
cacacctcagccatgtggaggc

SEQ ID NO: 13723 - DNA, 22 bp, Homo sapiens
cacagcggcctccgatgctgat

SEQ ID NO: 13724 - DNA, 22 bp, Homo sapiens
agaaggacccggtgggagatga

SEQ ID NO: 13725 - DNA, 22 bp, Homo sapiens
gctcttgtcaaaaattagttga

SEQ ID NO: 13726 - DNA, 22 bp, Homo sapiens
ttctttcagaacacaagtgatt

SEQ ID NO: 13727 - DNA, 22 bp, Homo sapiens
aggggcgtgctcttccccgacg

SEQ ID NO: 13728 - DNA, 22 bp, Homo sapiens
gcaggaggttgagccaggactg

SEQ ID NO: 13729 - DNA, 22 bp, Homo sapiens
cctgcacatgtgtgcgcctgta

SEQ ID NO: 13730 - DNA, 22 bp, Homo sapiens
ccgggcctcgggacaccgggta

SEQ ID NO: 13731 - DNA, 22 bp, Homo sapiens
acatgtttaagtttgttatatg

SEQ ID NO: 13732 - DNA, 22 bp, Homo sapiens
tagcacagcttcttgatgtcac

SEQ ID NO: 13733 - DNA, 21 bp, Homo sapiens
gggcactgaaagggaatagca

SEQ ID NO: 13734 - DNA, 22 bp, Homo sapiens
ttctcctacttaaggccttcca

SEQ ID NO: 13735 - DNA, 22 bp, Homo sapiens
ggtgagcagctgtctgtatgga

SEQ ID NO: 13736 - DNA, 22 bp, Homo sapiens
agccagtgcagctggaaattca

SEQ ID NO: 13737 - DNA, 22 bp, Homo sapiens
aaacttttttaggttcataggc

SEQ ID NO: 13738 - DNA, 22 bp, Homo sapiens
tctaccctgcggtcttggggca

SEQ ID NO: 13739 - DNA, 22 bp, Homo sapiens
gaattcttttctttctgaaagt

SEQ ID NO: 13740 - DNA, 22 bp, Homo sapiens
attcgcgggcctggagggtggg

SEQ ID NO: 13741 - DNA, 22 bp, Homo sapiens
cagcagagaaattacatatttg

SEQ ID NO: 13742 - DNA, 22 bp, Homo sapiens
tgcctgatgcaggagtatcaga

SEQ ID NO: 13743 - DNA, 22 bp, Homo sapiens
tcagtgcacccaattctctcca

SEQ ID NO: 13744 - DNA, 22 bp, Homo sapiens
ttaaatattatgttgtctgcaa

SEQ ID NO: 13745 - DNA, 22 bp, Homo sapiens
atgcagaagactgaaaagctga

SEQ ID NO: 13746 - DNA, 22 bp, Homo sapiens
aagacccacaaggctgaatgtt

SEQ ID NO: 13747 - DNA, 22 bp, Homo sapiens
tgggagcagttgcatctccagt

SEQ ID NO: 13748 - DNA, 22 bp, Homo sapiens
agggatggagtgcggcccggac

SEQ ID NO: 13749 - DNA, 22 bp, Homo sapiens
ccatcacagtccccatcgtgat

SEQ ID NO: 13750 - DNA, 22 bp, Homo sapiens
tggtggctaccaggtcctgggg

SEQ ID NO: 13751 - DNA, 22 bp, Homo sapiens
taagtcttcatagtctaatgtc

SEQ ID NO: 13752 - DNA, 22 bp, Homo sapiens
ggcctgggctccgggagttact

SEQ ID NO: 13753 - DNA, 22 bp, Homo sapiens
acgtggcggccgccgtgagcgg

SEQ ID NO: 13754 - DNA, 22 bp, Homo sapiens
tgttatcagagagaggtgctgt

SEQ ID NO: 13755 - DNA, 22 bp, Homo sapiens
tagcacagagcttttaaacttc

SEQ ID NO: 13756 - DNA, 22 bp, Homo sapiens
gtggtgagagtaggtgtcctct

SEQ ID NO: 13757 - DNA, 22 bp, Homo sapiens
gtgaataaaacacctgccaaga

SEQ ID NO: 13758 - DNA, 22 bp, Homo sapiens
tcctcctgtctaccagttcctg

SEQ ID NO: 13759 - DNA, 22 bp, Homo sapiens
gcccatgaggtggaggctgcag

SEQ ID NO: 13760 - DNA, 22 bp, Homo sapiens
acctggacacctgctgtcatct

SEQ ID NO: 13761 - DNA, 22 bp, Homo sapiens
tcctgggacaagccgtggaagt

SEQ ID NO: 13762 - DNA, 22 bp, Homo sapiens
gtgggacaggtcaaatcttaaa

SEQ ID NO: 13763 - DNA, 22 bp, Homo sapiens
gttgaagtaaggcagccacagg

SEQ ID NO: 13764 - DNA, 22 bp, Homo sapiens
cacagtggtccccgaagcccct

SEQ ID NO: 13765 - DNA, 22 bp, Homo sapiens
ggcctcttatctggctcctgca

SEQ ID NO: 13766 - DNA, 22 bp, Homo sapiens
ctgcattgatcaggcagaatct

SEQ ID NO: 13767 - DNA, 22 bp, Homo sapiens
gacaattgcttttgccgaataa

SEQ ID NO: 13768 - DNA, 20 bp, Homo sapiens
ccaccctgtccggggcggag

SEQ ID NO: 13769 - DNA, 22 bp, Homo sapiens
gtcttgatctcctgaccttgtg

SEQ ID NO: 13770 - DNA, 22 bp, Homo sapiens
agacgctattttgaggggtcta

SEQ ID NO: 13771 - DNA, 22 bp, Homo sapiens
cggagtcttgctatgttgccca

SEQ ID NO: 13772 - DNA, 22 bp, Homo sapiens
caccaagaatcttcacttttta

SEQ ID NO: 13773 - DNA, 22 bp, Homo sapiens
gtagatgagctcacatgacctt

SEQ ID NO: 13774 - DNA, 22 bp, Homo sapiens
tagaactaagagttatcattta

SEQ ID NO: 13775 - DNA, 22 bp, Homo sapiens
gacctggcaactgtagcttctg

SEQ ID NO: 13776 - DNA, 22 bp, Homo sapiens
taatggattaacgtccctgtcg

SEQ ID NO: 13777 - DNA, 22 bp, Homo sapiens
cagtcacaagcgtacctaattt

SEQ ID NO: 13778 - DNA, 22 bp, Homo sapiens
tataactacttgaagagttcag

SEQ ID NO: 13779 - DNA, 22 bp, Homo sapiens
gggaggcacgaggcgcgcagtg

SEQ ID NO: 13780 - DNA, 22 bp, Homo sapiens
caagcttgtttctcctgggggt

SEQ ID NO: 13781 - DNA, 22 bp, Homo sapiens
cgggttcacgccattctcctgc

SEQ ID NO: 13782 - DNA, 17 bp, Homo sapiens
ggcctgcacctcctgct

SEQ ID NO: 13783 - DNA, 22 bp, Homo sapiens
gggagaggttacccgagcaact

SEQ ID NO: 13784 - DNA, 22 bp, Homo sapiens
gggcaggaacaaatcaaatgat

SEQ ID NO: 13785 - DNA, 22 bp, Homo sapiens
ttcagatgattagaatagtatt

SEQ ID NO: 13786 - DNA, 22 bp, Homo sapiens
ctctggaggtggaggttgcagt

SEQ ID NO: 13787 - DNA, 22 bp, Homo sapiens
ttgaataatatgcttcgttctc

SEQ ID NO: 13788 - DNA, 22 bp, Homo sapiens
gcgaggaggggtgctgggcccc

SEQ ID NO: 13789 - DNA, 22 bp, Homo sapiens
ttacaaagtttaaggtggcact

SEQ ID NO: 13790 - DNA, 22 bp, Homo sapiens
gaggtaggtgtaggaggcctgc

SEQ ID NO: 13791 - DNA, 22 bp, Homo sapiens
ctctcagtcctgcgcgcctctg

SEQ ID NO: 13792 - DNA, 22 bp, Homo sapiens
gacgcatcaggaggcgaggagc

SEQ ID NO: 13793 - DNA, 22 bp, Homo sapiens
ccaggaggtggagattgcagtg

SEQ ID NO: 13794 - DNA, 22 bp, Homo sapiens
gctactgattgaccttggagag

SEQ ID NO: 13795 - DNA, 22 bp, Homo sapiens
gcgtggcttagagtggggtacc

SEQ ID NO: 13796 - DNA, 22 bp, Homo sapiens
ttacctaaaatagctcaattta

SEQ ID NO: 13797 - DNA, 22 bp, Homo sapiens
aaagtgcttcctttttgagggt

SEQ ID NO: 13798 - DNA, 22 bp, Homo sapiens
taggctaggctgaaggttttgg

SEQ ID NO: 13799 - DNA, 22 bp, Homo sapiens
tgtggctctcatgcactcccag

SEQ ID NO: 13800 - DNA, 22 bp, Homo sapiens
tagagcaatgctctactccttg

SEQ ID NO: 13801 - DNA, 22 bp, Homo sapiens
gagtcgagcagaaagccgtcgg

SEQ ID NO: 13802 - DNA, 22 bp, Homo sapiens
aggaggcagtctgtcccttagc

SEQ ID NO: 13803 - DNA, 22 bp, Homo sapiens
ggcgctcagtgttgccccagag

SEQ ID NO: 13804 - DNA, 22 bp, Homo sapiens
aagcagaatagaggcccttccc

SEQ ID NO: 13805 - DNA, 22 bp, Homo sapiens
tgactggattgtcattacgacg

SEQ ID NO: 13806 - DNA, 22 bp, Homo sapiens
ttgtgctgactgcgcccagctc

SEQ ID NO: 13807 - DNA, 22 bp, Homo sapiens
actgggcagcagctcgagccgc

SEQ ID NO: 13808 - DNA, 22 bp, Homo sapiens
cagcatgttcttgtctcactgg

SEQ ID NO: 13809 - DNA, 20 bp, Homo sapiens
acctcctggcgggcatcctc

SEQ ID NO: 13810 - DNA, 22 bp, Homo sapiens
caggcacggtggctcatgcctg

SEQ ID NO: 13811 - DNA, 22 bp, Homo sapiens
ttaataaagtatgaattggaaa

SEQ ID NO: 13812 - DNA, 22 bp, Homo sapiens
gtcctgtgagattcatgctcaa

SEQ ID NO: 13813 - DNA, 22 bp, Homo sapiens
cggctggtgtcgggcacagcaa

SEQ ID NO: 13814 - DNA, 22 bp, Homo sapiens
agagcacagccaccatttacaa

SEQ ID NO: 13815 - DNA, 22 bp, Homo sapiens
ttggaggcaatgggaaggaggc

SEQ ID NO: 13816 - DNA, 22 bp, Homo sapiens
aagtcattggtagcttgatagg

SEQ ID NO: 13817 - DNA, 22 bp, Homo sapiens
gtggatggagctggaagccatt

SEQ ID NO: 13818 - DNA, 22 bp, Homo sapiens
tggagtgcaatagtaataaggt

SEQ ID NO: 13819 - DNA, 22 bp, Homo sapiens
gggctgggattgcttgctgtga

SEQ ID NO: 13820 - DNA, 19 bp, Homo sapiens
gttttgcaggcagagggga

SEQ ID NO: 13821 - DNA, 22 bp, Homo sapiens
tggtcgaccagttggaaagtaa

SEQ ID NO: 13822 - DNA, 22 bp, Homo sapiens
caggtgtgccgggagcagtttg

SEQ ID NO: 13823 - DNA, 22 bp, Homo sapiens
caatagtaaattacggaggaga

SEQ ID NO: 13824 - DNA, 22 bp, Homo sapiens
tttggggatgtctgagttgttg

SEQ ID NO: 13825 - DNA, 22 bp, Homo sapiens
accattgcactctagcctgggc

SEQ ID NO: 13826 - DNA, 22 bp, Homo sapiens
cccaggaggcagagatagcagt

SEQ ID NO: 13827 - DNA, 22 bp, Homo sapiens
ggatattaatctgtgtcatttc

SEQ ID NO: 13828 - DNA, 22 bp, Homo sapiens
tgtgggtggcatcgtcctggcc

SEQ ID NO: 13829 - DNA, 22 bp, Homo sapiens
acctagaatttaaaacattgct

SEQ ID NO: 13830 - DNA, 22 bp, Homo sapiens
ggaggctgaggcaggcggatca

SEQ ID NO: 13831 - DNA, 22 bp, Homo sapiens
gtgggctgcccttgaggtcagc

SEQ ID NO: 13832 - DNA, 22 bp, Homo sapiens
agtactgtcagcagggtgttga

SEQ ID NO: 13833 - DNA, 22 bp, Homo sapiens
tgtgagttattttcaggagttt

SEQ ID NO: 13834 - DNA, 22 bp, Homo sapiens
ccctcaggtgaaaggaaaaatt

SEQ ID NO: 13835 - DNA, 22 bp, Homo sapiens
gctgctctcagagctcatgctg

SEQ ID NO: 13836 - DNA, 22 bp, Homo sapiens
taggcccctagtgccacgtggc

SEQ ID NO: 13837 - DNA, 22 bp, Homo sapiens
ggctgggcctctccctcagctg

SEQ ID NO: 13838 - DNA, 22 bp, Homo sapiens
caggcactgtgctgagctctgc

SEQ ID NO: 13839 - DNA, 22 bp, Homo sapiens
cactctcacatgccctgtcagt

SEQ ID NO: 13840 - DNA, 18 bp, Homo sapiens
gctgtggaagtctttata

SEQ ID NO: 13841 - DNA, 22 bp, Homo sapiens
ggttggacactaggtaggagcg

SEQ ID NO: 13842 - DNA, 22 bp, Homo sapiens
ggttttcacctccagaatgtgc

SEQ ID NO: 13843 - DNA, 22 bp, Homo sapiens
aaggccctggcaggaagcagga

SEQ ID NO: 13844 - DNA, 22 bp, Homo sapiens
atcacccaagctggagtgcagt

SEQ ID NO: 13845 - DNA, 22 bp, Homo sapiens
aaggagaaatggtagatgtgca

SEQ ID NO: 13846 - DNA, 22 bp, Homo sapiens
gagcagtgtttgtggacctgga

SEQ ID NO: 13847 - DNA, 22 bp, Homo sapiens
cctgcacagccggacccctgct

SEQ ID NO: 13848 - DNA, 22 bp, Homo sapiens
tctgtcttagccatctcaggct

SEQ ID NO: 13849 - DNA, 22 bp, Homo sapiens
gtggcagagccaaggctggagc

SEQ ID NO: 13850 - DNA, 22 bp, Homo sapiens
tccagcagtccatgtgagacac

SEQ ID NO: 13851 - DNA, 22 bp, Homo sapiens
ctcactgcaatctccgtctccc

SEQ ID NO: 13852 - DNA, 19 bp, Homo sapiens
ggctgccttctgctcatct

SEQ ID NO: 13853 - DNA, 20 bp, Homo sapiens
attagagctacatggctaca

SEQ ID NO: 13854 - DNA, 22 bp, Homo sapiens
tgtaatattgtagtgacagtac

SEQ ID NO: 13855 - DNA, 22 bp, Homo sapiens
ctgggatgcggaggttgcggtg

SEQ ID NO: 13856 - DNA, 22 bp, Homo sapiens
tatgttgcaccaacctaataat

SEQ ID NO: 13857 - DNA, 22 bp, Homo sapiens
aagaggtaaccatagcaaccac

SEQ ID NO: 13858 - DNA, 22 bp, Homo sapiens
gttttgaatactactagaactt

SEQ ID NO: 13859 - DNA, 22 bp, Homo sapiens
agcccggcttccccggttgcta

SEQ ID NO: 13860 - DNA, 22 bp, Homo sapiens
ggaactcctgctccaagcagct

SEQ ID NO: 13861 - DNA, 22 bp, Homo sapiens
gctgcagggagctggaaggctc

SEQ ID NO: 13862 - DNA, 22 bp, Homo sapiens
gacaggcttccactatgttgcc

SEQ ID NO: 13863 - DNA, 22 bp, Homo sapiens
tggtcttagctggaaggaggga

SEQ ID NO: 13864 - DNA, 22 bp, Homo sapiens
tgatatgggaaaagggctcgga

SEQ ID NO: 13865 - DNA, 22 bp, Homo sapiens
tcgcggggaagtggtgggctaa

SEQ ID NO: 13866 - DNA, 22 bp, Homo sapiens
tatgcacaacatgcaggtttgt

SEQ ID NO: 13867 - DNA, 22 bp, Homo sapiens
agtggagcttttcctatcagag

SEQ ID NO: 13868 - DNA, 22 bp, Homo sapiens
gcttagtcaattataaataggc

SEQ ID NO: 13869 - DNA, 22 bp, Homo sapiens
aagccctggacggcccttcccc

SEQ ID NO: 13870 - DNA, 22 bp, Homo sapiens
tgtgtgcatgcttggggcagca

SEQ ID NO: 13871 - DNA, 22 bp, Homo sapiens
cagtgcatgcacacacatggta

SEQ ID NO: 13872 - DNA, 22 bp, Homo sapiens
cagcctgtagtctggtccaggt

SEQ ID NO: 13873 - DNA, 22 bp, Homo sapiens
ctcagggccaaggatgctgttg

SEQ ID NO: 13874 - DNA, 22 bp, Homo sapiens
tggagaattctatgttgagggg

SEQ ID NO: 13875 - DNA, 21 bp, Homo sapiens
ctcccagggtgactgttcaac

SEQ ID NO: 13876 - DNA, 22 bp, Homo sapiens
cttgatctacatagtgaaaccc

SEQ ID NO: 13877 - DNA, 22 bp, Homo sapiens
gggtattaaaatgaaggagaaa

SEQ ID NO: 13878 - DNA, 22 bp, Homo sapiens
aaggtgggcagatcacaaggtc

SEQ ID NO: 13879 - DNA, 22 bp, Homo sapiens
ctcccagccttcgccagtctga

SEQ ID NO: 13880 - DNA, 22 bp, Homo sapiens
tgttcttgagcctttagaccta

SEQ ID NO: 13881 - DNA, 22 bp, Homo sapiens
caggagttcaaggttgcagtga

SEQ ID NO: 13882 - DNA, 18 bp, Homo sapiens
tccctcagaattatagaa

SEQ ID NO: 13883 - DNA, 22 bp, Homo sapiens
aacgcccgtggttgccaaggta

SEQ ID NO: 13884 - DNA, 22 bp, Homo sapiens
cacggcctgtaaggacccagga

SEQ ID NO: 13885 - DNA, 20 bp, Homo sapiens
tctgccacgtctggtgactg

SEQ ID NO: 13886 - DNA, 22 bp, Homo sapiens
gtttgagaacaaaaggggacct

SEQ ID NO: 13887 - DNA, 22 bp, Homo sapiens
cagctgctgttcagttttgttt

SEQ ID NO: 13888 - DNA, 22 bp, Homo sapiens
cccaggaggcagatgttgcagt

SEQ ID NO: 13889 - DNA, 22 bp, Homo sapiens
cgcccaggctggagtgcagtga

SEQ ID NO: 13890 - DNA, 21 bp, Homo sapiens
tccctgagcccaaggggctcc

SEQ ID NO: 13891 - DNA, 22 bp, Homo sapiens
tgagcttccctcctgcactaca

SEQ ID NO: 13892 - DNA, 22 bp, Homo sapiens
gggaaactttcacaatgtccag

SEQ ID NO: 13893 - DNA, 22 bp, Homo sapiens
gaccactggggtgagggccatc

SEQ ID NO: 13894 - DNA, 22 bp, Homo sapiens
tcccccaggctggagtgcagtg

SEQ ID NO: 13895 - DNA, 22 bp, Homo sapiens
ctgtctgtagacatttttggtt

SEQ ID NO: 13896 - DNA, 22 bp, Homo sapiens
gcccaggctggagttcagtggt

SEQ ID NO: 13897 - DNA, 22 bp, Homo sapiens
cttcctctgtggccagagtgta

SEQ ID NO: 13898 - DNA, 19 bp, Homo sapiens
gctgttaaggaccctcgga

SEQ ID NO: 13899 - DNA, 22 bp, Homo sapiens
tggctccgttgtacaggctgga

SEQ ID NO: 13900 - DNA, 22 bp, Homo sapiens
tgagccagaggaggctgtgtgg

SEQ ID NO: 13901 - DNA, 22 bp, Homo sapiens
ttgcttcttagatattcctctc

SEQ ID NO: 13902 - DNA, 22 bp, Homo sapiens
agtgcagtggttaggagccagg

SEQ ID NO: 13903 - DNA, 22 bp, Homo sapiens
aacccgggaggcagaggttgtg

SEQ ID NO: 13904 - DNA, 22 bp, Homo sapiens
gaatgctaagcatgtgggagtt

SEQ ID NO: 13905 - DNA, 22 bp, Homo sapiens
ttccacatgttagctggttaaa

SEQ ID NO: 13906 - DNA, 18 bp, Homo sapiens
tgtccctgcaaataacat

SEQ ID NO: 13907 - DNA, 22 bp, Homo sapiens
ggaaggcagaggtgtcgtgggg

SEQ ID NO: 13908 - DNA, 22 bp, Homo sapiens
ctgagggtcaacttgattgtat

SEQ ID NO: 13909 - DNA, 22 bp, Homo sapiens
tagattcagatatttaggacaa

SEQ ID NO: 13910 - DNA, 19 bp, Homo sapiens
ccatggcaatgatctgatg

SEQ ID NO: 13911 - DNA, 22 bp, Homo sapiens
agcccagaggctgggcgtgcat

SEQ ID NO: 13912 - DNA, 22 bp, Homo sapiens
ctgctttaaaactgatacatga

SEQ ID NO: 13913 - DNA, 22 bp, Homo sapiens
cagaagatctcttagtggaggg

SEQ ID NO: 13914 - DNA, 22 bp, Homo sapiens
aggggagccagggctgcgagtt

SEQ ID NO: 13915 - DNA, 22 bp, Homo sapiens
tgggtgtgtccatattttgact

SEQ ID NO: 13916 - DNA, 22 bp, Homo sapiens
ttgtgcttgccctggaggtgcg

SEQ ID NO: 13917 - DNA, 22 bp, Homo sapiens
agtgctatcgagttctaatgct

SEQ ID NO: 13918 - DNA, 22 bp, Homo sapiens
tcctccagttccttggtttcag

SEQ ID NO: 13919 - DNA, 22 bp, Homo sapiens
ggagtgtcccgattttccaggt

SEQ ID NO: 13920 - DNA, 22 bp, Homo sapiens
ctggtagtttgcaaaatggtgt

SEQ ID NO: 13921 - DNA, 22 bp, Homo sapiens
aggtcaccatggcatgctccac

SEQ ID NO: 13922 - DNA, 22 bp, Homo sapiens
tcaaatgaagacagttgacttg

SEQ ID NO: 13923 - DNA, 22 bp, Homo sapiens
ttcttctcagggtcccacatgg

SEQ ID NO: 13924 - DNA, 22 bp, Homo sapiens
aaagattaaatcaaattggtca

SEQ ID NO: 13925 - DNA, 22 bp, Homo sapiens
cgtaggtggctcagcacctggg

SEQ ID NO: 13926 - DNA, 22 bp, Homo sapiens
tctgcaacagtgccctgtaaat

SEQ ID NO: 13927 - DNA, 22 bp, Homo sapiens
gcctcctgagtagctgggattg

SEQ ID NO: 13928 - DNA, 22 bp, Homo sapiens
ttggatctcatctaagtgcgtg

SEQ ID NO: 13929 - DNA, 22 bp, Homo sapiens
ggtccccccatggtgagcactg

SEQ ID NO: 13930 - DNA, 22 bp, Homo sapiens
tctcgctctgtcgcccaggctg

SEQ ID NO: 13931 - DNA, 22 bp, Homo sapiens
ttggaatgttttaatataaatt

SEQ ID NO: 13932 - DNA, 20 bp, Homo sapiens
tttcaccatcttggccaggc

SEQ ID NO: 13933 - DNA, 22 bp, Homo sapiens
tgcaccctcatcagtcaaatgg

SEQ ID NO: 13934 - DNA, 22 bp, Homo sapiens
gatgtgtttccaggatttgttt

SEQ ID NO: 13935 - DNA, 22 bp, Homo sapiens
aatgccttggagagcctagagg

SEQ ID NO: 13936 - DNA, 22 bp, Homo sapiens
tctgttttgcataatgttcttt

SEQ ID NO: 13937 - DNA, 22 bp, Homo sapiens
ttgagacacagtttcactctgt

SEQ ID NO: 13938 - DNA, 22 bp, Homo sapiens
gctcgcttagattttcctctga

SEQ ID NO: 13939 - DNA, 22 bp, Homo sapiens
cacaaaccttctgcagcctgta

SEQ ID NO: 13940 - DNA, 21 bp, Homo sapiens
tccttcagtctagatgattgt

SEQ ID NO: 13941 - DNA, 22 bp, Homo sapiens
gagccaggaggcagagactgca

SEQ ID NO: 13942 - DNA, 22 bp, Homo sapiens
atgagctagaaaaccatgtgga

SEQ ID NO: 13943 - DNA, 22 bp, Homo sapiens
aagacacaatgtagcccagcac

SEQ ID NO: 13944 - DNA, 22 bp, Homo sapiens
ggggcagagaataaaaacctaa

SEQ ID NO: 13945 - DNA, 22 bp, Homo sapiens
cccgggttgtccgcgcgtccgg

SEQ ID NO: 13946 - DNA, 22 bp, Homo sapiens
atgtctgtttgctgagcccggc

SEQ ID NO: 13947 - DNA, 22 bp, Homo sapiens
agatggtagactatggaacgta

SEQ ID NO: 13948 - DNA, 22 bp, Homo sapiens
ggacattgaagctggaaaggga

SEQ ID NO: 13949 - DNA, 22 bp, Homo sapiens
gaagtttttgtagagacagggt

SEQ ID NO: 13950 - DNA, 22 bp, Homo sapiens
tgtactgtatcattgcaacttt

SEQ ID NO: 13951 - DNA, 22 bp, Homo sapiens
tggctgagttacgaacagagca

SEQ ID NO: 13952 - DNA, 22 bp, Homo sapiens
gcccgcgccagcctctccatct

SEQ ID NO: 13953 - DNA, 22 bp, Homo sapiens
gcaggtggatcacctgaggtca

SEQ ID NO: 13954 - DNA, 22 bp, Homo sapiens
cctagagctctgctttatctaa

SEQ ID NO: 13955 - DNA, 22 bp, Homo sapiens
tggcacgacaattggcaccaat

SEQ ID NO: 13956 - DNA, 22 bp, Homo sapiens
ctccaacgaggctggggtacaa

SEQ ID NO: 13957 - DNA, 22 bp, Homo sapiens
tcgcccaggctggagtgcagtg

SEQ ID NO: 13958 - DNA, 22 bp, Homo sapiens
caaagtgctgggattataggca

SEQ ID NO: 13959 - DNA, 22 bp, Homo sapiens
ccgaggtcctggacttggccct

SEQ ID NO: 13960 - DNA, 22 bp, Homo sapiens
tgttaaaccagttttgcatcat

SEQ ID NO: 13961 - DNA, 22 bp, Homo sapiens
gggtcgggcaggcgccctcgtc

SEQ ID NO: 13962 - DNA, 22 bp, Homo sapiens
tgcagaaacaagccatcattca

SEQ ID NO: 13963 - DNA, 22 bp, Homo sapiens
gggggtttctgggctgagcaga

SEQ ID NO: 13964 - DNA, 22 bp, Homo sapiens
tcactacaacctccgcctcctg

SEQ ID NO: 13965 - DNA, 22 bp, Homo sapiens
ggccagcctggggctcccagac

SEQ ID NO: 13966 - DNA, 22 bp, Homo sapiens
atttttctctttccactgagat

SEQ ID NO: 13967 - DNA, 22 bp, Homo sapiens
ccgggagcaggcgccaccgcca

SEQ ID NO: 13968 - DNA, 22 bp, Homo sapiens
ctgggaggtggaggttgcattg

SEQ ID NO: 13969 - DNA, 22 bp, Homo sapiens
tgagggctgtctgaagcttggg

SEQ ID NO: 13970 - DNA, 22 bp, Homo sapiens
ttccggaaggttctctagaatt

SEQ ID NO: 13971 - DNA, 22 bp, Homo sapiens
cggccgcagcagtgtcggccca

SEQ ID NO: 13972 - DNA, 22 bp, Homo sapiens
tggaacaagggcgtggcggtcg

SEQ ID NO: 13973 - DNA, 22 bp, Homo sapiens
caggaaggcgcggctgtgcctg

SEQ ID NO: 13974 - DNA, 23 bp, Homo sapiens
cagggccctgctcaatttctcca

SEQ ID NO: 13975 - DNA, 22 bp, Homo sapiens
cttctgagatgttgttttacag

SEQ ID NO: 13976 - DNA, 22 bp, Homo sapiens
aactcactttgtggcttctgaa

SEQ ID NO: 13977 - DNA, 22 bp, Homo sapiens
tggctcatgcctgtaatcttag

SEQ ID NO: 13978 - DNA, 22 bp, Homo sapiens
agtggtcttagcttgctgggct

SEQ ID NO: 13979 - DNA, 22 bp, Homo sapiens
gccactgagcccggccattgtt

SEQ ID NO: 13980 - DNA, 18 bp, Homo sapiens
ctgcactcccgcctgggc

SEQ ID NO: 13981 - DNA, 22 bp, Homo sapiens
actattagcatatcatgaatgg

SEQ ID NO: 13982 - DNA, 22 bp, Homo sapiens
gcccagagtttgaagatacagt

SEQ ID NO: 13983 - DNA, 22 bp, Homo sapiens
tcttgggcatgtgtttgatttc

SEQ ID NO: 13984 - DNA, 22 bp, Homo sapiens
gtggggacgggatggctcactg

SEQ ID NO: 13985 - DNA, 22 bp, Homo sapiens
cgggcagtgtggctccagagtc

SEQ ID NO: 13986 - DNA, 22 bp, Homo sapiens
gcaccaggtgcagccgggcccc

SEQ ID NO: 13987 - DNA, 22 bp, Homo sapiens
ctcattccatgtgtattttgag

SEQ ID NO: 13988 - DNA, 22 bp, Homo sapiens
ggcgggaagttcttgcccactt

SEQ ID NO: 13989 - DNA, 22 bp, Homo sapiens
caggacatctacccagtgtttc

SEQ ID NO: 13990 - DNA, 21 bp, Homo sapiens
gctgctcgagatccagtgctt

SEQ ID NO: 13991 - DNA, 22 bp, Homo sapiens
tgacagagtgacactcttgtct

SEQ ID NO: 13992 - DNA, 22 bp, Homo sapiens
ggcctctgccccgcggggctcg

SEQ ID NO: 13993 - DNA, 22 bp, Homo sapiens
cagcacatgctcatcagggaag

SEQ ID NO: 13994 - DNA, 22 bp, Homo sapiens
cggccaggcacagtggcccacg

SEQ ID NO: 13995 - DNA, 22 bp, Homo sapiens
gttatataagacaaatcagagt

SEQ ID NO: 13996 - DNA, 22 bp, Homo sapiens
agcgcttgccgcactccaagca

SEQ ID NO: 13997 - DNA, 22 bp, Homo sapiens
gagatggagtctttttctgtca

SEQ ID NO: 13998 - DNA, 22 bp, Homo sapiens
gtgacaatattagctcaggggc

SEQ ID NO: 13999 - DNA, 22 bp, Homo sapiens
catggcagctcctccagtgtga

SEQ ID NO: 14000 - DNA, 22 bp, Homo sapiens
tactttaatatatgtgaagttc

SEQ ID NO: 14001 - DNA, 22 bp, Homo sapiens
gaggcagaagttgcagtgagca

SEQ ID NO: 14002 - DNA, 22 bp, Homo sapiens
cgtgccactgcactctagcctg

SEQ ID NO: 14003 - DNA, 21 bp, Homo sapiens
atgtagggtttgccttctcta

SEQ ID NO: 14004 - DNA, 22 bp, Homo sapiens
agaatagaattctcatagaatt

SEQ ID NO: 14005 - DNA, 22 bp, Homo sapiens
ggacagaaaccatatgagtgta

SEQ ID NO: 14006 - DNA, 22 bp, Homo sapiens
tggaatggaaacaaactgagga

SEQ ID NO: 14007 - DNA, 22 bp, Homo sapiens
agcataagttggtacagccact

SEQ ID NO: 14008 - DNA, 22 bp, Homo sapiens
gaccttgtgatccacccgcttt

SEQ ID NO: 14009 - DNA, 22 bp, Homo sapiens
tttgaaatgtatcagtataggt

SEQ ID NO: 14010 - DNA, 22 bp, Homo sapiens
agaggacagagtgctggattta

SEQ ID NO: 14011 - DNA, 22 bp, Homo sapiens
aggcgggttcagggctgccatg

SEQ ID NO: 14012 - DNA, 22 bp, Homo sapiens
agcgagtgggtcagcgttgcag

SEQ ID NO: 14013 - DNA, 22 bp, Homo sapiens
tttcctcttctggcaggcaggg

SEQ ID NO: 14014 - DNA, 22 bp, Homo sapiens
cttgaggctgcactccagggcc

SEQ ID NO: 14015 - DNA, 22 bp, Homo sapiens
ttgtgaatagtgctgcaataaa

SEQ ID NO: 14016 - DNA, 21 bp, Homo sapiens
ttaaagcctccctcataagga

SEQ ID NO: 14017 - DNA, 22 bp, Homo sapiens
agacggattacctgaggtcagg

SEQ ID NO: 14018 - DNA, 22 bp, Homo sapiens
caggaattcatagcattgttct

SEQ ID NO: 14019 - DNA, 22 bp, Homo sapiens
ggctctgcgcctgcggggactt

SEQ ID NO: 14020 - DNA, 22 bp, Homo sapiens
cctggggtcacttgcagccgca

SEQ ID NO: 14021 - DNA, 22 bp, Homo sapiens
gcccagctgcaccctggtgggt

SEQ ID NO: 14022 - DNA, 22 bp, Homo sapiens
cactgcactccagcttgggtga

SEQ ID NO: 14023 - DNA, 19 bp, Homo sapiens
ctgctgccggagactcgtc

SEQ ID NO: 14024 - DNA, 22 bp, Homo sapiens
gcagaggacacaggagggcaag

SEQ ID NO: 14025 - DNA, 22 bp, Homo sapiens
ggtggctgcaatggctaacttc

SEQ ID NO: 14026 - DNA, 22 bp, Homo sapiens
tgtcatagtgtggtagcagtgg

SEQ ID NO: 14027 - DNA, 22 bp, Homo sapiens
actggggctgatgcgttcgtgt

SEQ ID NO: 14028 - DNA, 22 bp, Homo sapiens
tctcatggagtcaggagcagaa

SEQ ID NO: 14029 - DNA, 22 bp, Homo sapiens
gaatgatttagtgttcaaggaa

SEQ ID NO: 14030 - DNA, 22 bp, Homo sapiens
cgtctaggccgtgccctgaggt

SEQ ID NO: 14031 - DNA, 22 bp, Homo sapiens
atcatgacatacttttgagaag

SEQ ID NO: 14032 - DNA, 22 bp, Homo sapiens
gactgtggggaagcagatgcca

SEQ ID NO: 14033 - DNA, 22 bp, Homo sapiens
acaggtcctcaagtcagctggg

SEQ ID NO: 14034 - DNA, 22 bp, Homo sapiens
tggggtacttgtatcaaagcac

SEQ ID NO: 14035 - DNA, 22 bp, Homo sapiens
tgagacgaagtcttgctctgtt

SEQ ID NO: 14036 - DNA, 22 bp, Homo sapiens
gcaggcagatcacctgtcagga

SEQ ID NO: 14037 - DNA, 22 bp, Homo sapiens
tgctgggctggggcctcagacc

SEQ ID NO: 14038 - DNA, 22 bp, Homo sapiens
gtgagaaatgacaaatgtgtcg

SEQ ID NO: 14039 - DNA, 22 bp, Homo sapiens
ggccactgctctccagcctggg

SEQ ID NO: 14040 - DNA, 22 bp, Homo sapiens
tttgggcaggcttttccctaga

SEQ ID NO: 14041 - DNA, 22 bp, Homo sapiens
tcagtgtgaattcaggagccta

SEQ ID NO: 14042 - DNA, 22 bp, Homo sapiens
gctggtagacctcactgcactc

SEQ ID NO: 14043 - DNA, 22 bp, Homo sapiens
gggagctgaaggagccggcggg

SEQ ID NO: 14044 - DNA, 22 bp, Homo sapiens
agggcgacaatggagagcgttt

SEQ ID NO: 14045 - DNA, 22 bp, Homo sapiens
ttttggctctgtctgtatcttt

SEQ ID NO: 14046 - DNA, 22 bp, Homo sapiens
tgcagattcaaatgaaatgcaa

SEQ ID NO: 14047 - DNA, 22 bp, Homo sapiens
agagcagctcgctacctctcta

SEQ ID NO: 14048 - DNA, 22 bp, Homo sapiens
cacccaggctggattgcagtgg

SEQ ID NO: 14049 - DNA, 22 bp, Homo sapiens
atgtttttaaatagacttacag

SEQ ID NO: 14050 - DNA, 21 bp, Homo sapiens
aaccaagccagccagcctctc

SEQ ID NO: 14051 - DNA, 19 bp, Homo sapiens
ttccatctatcttcttact

SEQ ID NO: 14052 - DNA, 22 bp, Homo sapiens
tcctggcttgtcacatctacgt

SEQ ID NO: 14053 - DNA, 22 bp, Homo sapiens
caccctccagctcccgggggct

SEQ ID NO: 14054 - DNA, 22 bp, Homo sapiens
ctgtaacctcctctttccattc

SEQ ID NO: 14055 - DNA, 22 bp, Homo sapiens
tccctgcaggtgtgcaagctga

SEQ ID NO: 14056 - DNA, 22 bp, Homo sapiens
attctcaaaacataacttcact

SEQ ID NO: 14057 - DNA, 22 bp, Homo sapiens
tctaatcctatggtggggaggg

SEQ ID NO: 14058 - DNA, 22 bp, Homo sapiens
cgtgagcaaaatggacactccc

SEQ ID NO: 14059 - DNA, 22 bp, Homo sapiens
cctgcctatgagacgttttgcc

SEQ ID NO: 14060 - DNA, 22 bp, Homo sapiens
cacttcattgggaccagggctg

SEQ ID NO: 14061 - DNA, 22 bp, Homo sapiens
gccgccgctgtgcaatttagca

SEQ ID NO: 14062 - DNA, 22 bp, Homo sapiens
gtggagggtgattgccggctgt

SEQ ID NO: 14063 - DNA, 22 bp, Homo sapiens
acatcatttgtctgtagctgaa

SEQ ID NO: 14064 - DNA, 22 bp, Homo sapiens
ccagatgtccctctcaggtttg

SEQ ID NO: 14065 - DNA, 21 bp, Homo sapiens
taagagcctaacacagaaagg

SEQ ID NO: 14066 - DNA, 22 bp, Homo sapiens
tccagcttataggtagatttaa

SEQ ID NO: 14067 - DNA, 22 bp, Homo sapiens
gtgagagattgattgtagcggc

SEQ ID NO: 14068 - DNA, 22 bp, Homo sapiens
actccacaccacgggggccgcc

SEQ ID NO: 14069 - DNA, 22 bp, Homo sapiens
agaacactgatagctgagggga

SEQ ID NO: 14070 - DNA, 23 bp, Homo sapiens
gctcatcaggcttagagtcaagg

SEQ ID NO: 14071 - DNA, 22 bp, Homo sapiens
ggattgcaacaagctagtttag

SEQ ID NO: 14072 - DNA, 22 bp, Homo sapiens
ctctttggatagaattacaaag

SEQ ID NO: 14073 - DNA, 22 bp, Homo sapiens
atggcaccttccccagagctca

SEQ ID NO: 14074 - DNA, 22 bp, Homo sapiens
tgaagttgttaaggttgccatt

SEQ ID NO: 14075 - DNA, 22 bp, Homo sapiens
ctggcctaggaatggttttccg

SEQ ID NO: 14076 - DNA, 22 bp, Homo sapiens
gggccccaagaacctcctcctg

SEQ ID NO: 14077 - DNA, 22 bp, Homo sapiens
gtgcagagaggaccttggggag

SEQ ID NO: 14078 - DNA, 22 bp, Homo sapiens
agaggaagtaatcaggacctgc

SEQ ID NO: 14079 - DNA, 23 bp, Homo sapiens
gaggtggcaatgagggcagttgg

SEQ ID NO: 14080 - DNA, 22 bp, Homo sapiens
tggttcctcaagcgctggcggc

SEQ ID NO: 14081 - DNA, 22 bp, Homo sapiens
aagctggagtgcagtgcaatgg

SEQ ID NO: 14082 - DNA, 22 bp, Homo sapiens
gtggactgcgcttgagggggcc

SEQ ID NO: 14083 - DNA, 22 bp, Homo sapiens
taatgtataacaaatactcatc

SEQ ID NO: 14084 - DNA, 22 bp, Homo sapiens
taggcctggatctctgggagca

SEQ ID NO: 14085 - DNA, 22 bp, Homo sapiens
tagactggtgaattagggggaa

SEQ ID NO: 14086 - DNA, 22 bp, Homo sapiens
ggctccaccctgcttccagaag

SEQ ID NO: 14087 - DNA, 22 bp, Homo sapiens
attgtgtcctcattgaccttca

SEQ ID NO: 14088 - DNA, 22 bp, Homo sapiens
tgagaaacacaggcatgaatag

SEQ ID NO: 14089 - DNA, 22 bp, Homo sapiens
gctcactgcaacctctgcctcc

SEQ ID NO: 14090 - DNA, 22 bp, Homo sapiens
ggatgttgattgaatggccatt

SEQ ID NO: 14091 - DNA, 20 bp, Homo sapiens
agacagtgtggagattcctt

SEQ ID NO: 14092 - DNA, 22 bp, Homo sapiens
ggagaggggaacttgttgcttg

SEQ ID NO: 14093 - DNA, 22 bp, Homo sapiens
cctccaaccataggtccagggg

SEQ ID NO: 14094 - DNA, 22 bp, Homo sapiens
tgcccagagcctgagaggatta

SEQ ID NO: 14095 - DNA, 22 bp, Homo sapiens
gcagtgagttatgatcatgcca

SEQ ID NO: 14096 - DNA, 22 bp, Homo sapiens
tttatgtagttacggactatca

SEQ ID NO: 14097 - DNA, 22 bp, Homo sapiens
tagagtgtcataacagtgccca

SEQ ID NO: 14098 - DNA, 22 bp, Homo sapiens
ttcaggaagtgctgcctggtgt

SEQ ID NO: 14099 - DNA, 22 bp, Homo sapiens
agcaagattgaggcttcctcag

SEQ ID NO: 14100 - DNA, 22 bp, Homo sapiens
ggaactgaggaacgaactggga

SEQ ID NO: 14101 - DNA, 22 bp, Homo sapiens
gggggcttggcccggtctggtt

SEQ ID NO: 14102 - DNA, 22 bp, Homo sapiens
cactgcactccagcctgggcga

SEQ ID NO: 14103 - DNA, 22 bp, Homo sapiens
ccccaggacgtggccctcatag

SEQ ID NO: 14104 - DNA, 22 bp, Homo sapiens
ctggcaggagcattcacagagg

SEQ ID NO: 14105 - DNA, 22 bp, Homo sapiens
cctgggcctctcaaagtgctgg

SEQ ID NO: 14106 - DNA, 22 bp, Homo sapiens
gaggctggacgtgcatttctac

SEQ ID NO: 14107 - DNA, 22 bp, Homo sapiens
cccaggaggtggaggctgcagt

SEQ ID NO: 14108 - DNA, 22 bp, Homo sapiens
tctcagggctcagagctcaggc

SEQ ID NO: 14109 - DNA, 22 bp, Homo sapiens
atgccactgcgctctagcctgg

SEQ ID NO: 14110 - DNA, 22 bp, Homo sapiens
ctgagccaaggggacagtgaca

SEQ ID NO: 14111 - DNA, 16 bp, Homo sapiens
gcagaggaaaggggag

SEQ ID NO: 14112 - DNA, 22 bp, Homo sapiens
ttgtccttcttcattcagtccc

SEQ ID NO: 14113 - DNA, 22 bp, Homo sapiens
attataggcttgagccaccgtg

SEQ ID NO: 14114 - DNA, 22 bp, Homo sapiens
cgggcagcggcgtggccatggt

SEQ ID NO: 14115 - DNA, 22 bp, Homo sapiens
cgtggggcgggtggacacttgc

SEQ ID NO: 14116 - DNA, 22 bp, Homo sapiens
atgcaggcagacactgtgggca

SEQ ID NO: 14117 - DNA, 22 bp, Homo sapiens
gtggtgtaggtcacagttagga

SEQ ID NO: 14118 - DNA, 22 bp, Homo sapiens
gtccaaaagagccagccgggcg

SEQ ID NO: 14119 - DNA, 22 bp, Homo sapiens
tccttgactgtgaggaactagc

SEQ ID NO: 14120 - DNA, 19 bp, Homo sapiens
gactcacaccttccgctgt

SEQ ID NO: 14121 - DNA, 22 bp, Homo sapiens
gcgagggcacgcggttgaaggc

SEQ ID NO: 14122 - DNA, 22 bp, Homo sapiens
agccctggtttgcagcatttgc

SEQ ID NO: 14123 - DNA, 22 bp, Homo sapiens
ggcttggaccagtcacagtggt

SEQ ID NO: 14124 - DNA, 17 bp, Homo sapiens
aggtgggtggatcacct

SEQ ID NO: 14125 - DNA, 22 bp, Homo sapiens
tccttgccctaaatgtctgtgt

SEQ ID NO: 14126 - DNA, 22 bp, Homo sapiens
tactgcgccttcaccaagcggc

SEQ ID NO: 14127 - DNA, 22 bp, Homo sapiens
gggtacttaatatttacggggt

SEQ ID NO: 14128 - DNA, 22 bp, Homo sapiens
gtccccgacgtttggcttgatg

SEQ ID NO: 14129 - DNA, 22 bp, Homo sapiens
tgtctccaccatcatcttacca

SEQ ID NO: 14130 - DNA, 22 bp, Homo sapiens
cccaggaggtcgaagctgcagt

SEQ ID NO: 14131 - DNA, 22 bp, Homo sapiens
cccagaaggtcgaggctgcagt

SEQ ID NO: 14132 - DNA, 22 bp, Homo sapiens
cgagcatgatgacggctgtggc

SEQ ID NO: 14133 - DNA, 19 bp, Homo sapiens
agccagccagcaggtatgc

SEQ ID NO: 14134 - DNA, 22 bp, Homo sapiens
agtgggtgtagtcttcctcctg

SEQ ID NO: 14135 - DNA, 22 bp, Homo sapiens
cctggggccccgagccagaagc

SEQ ID NO: 14136 - DNA, 19 bp, Homo sapiens
tggttgtgcacgggttggt

SEQ ID NO: 14137 - DNA, 22 bp, Homo sapiens
gtagtctgaacagtaattttgt

SEQ ID NO: 14138 - DNA, 18 bp, Homo sapiens
ggtgagggagctggaagc

SEQ ID NO: 14139 - DNA, 22 bp, Homo sapiens
acagagcaatgcgtgttctcta

SEQ ID NO: 14140 - DNA, 22 bp, Homo sapiens
ttttggccacatccttttgagt

SEQ ID NO: 14141 - DNA, 22 bp, Homo sapiens
ggtgttgcagttgaagactggt

SEQ ID NO: 14142 - DNA, 22 bp, Homo sapiens
tacagaggaggggattttaata

SEQ ID NO: 14143 - DNA, 22 bp, Homo sapiens
atgacaagagtgttcagggaga

SEQ ID NO: 14144 - DNA, 22 bp, Homo sapiens
tgagatgtaaggtatgcttact

SEQ ID NO: 14145 - DNA, 22 bp, Homo sapiens
gccagatttacagatttgccct

SEQ ID NO: 14146 - DNA, 22 bp, Homo sapiens
aggctccctgaatcgcccgttc

SEQ ID NO: 14147 - DNA, 22 bp, Homo sapiens
catgtgtgtctccaccagctgc

SEQ ID NO: 14148 - DNA, 22 bp, Homo sapiens
aagaggtttaactgactcacag

SEQ ID NO: 14149 - DNA, 22 bp, Homo sapiens
tcttttgtgattctttagttac

SEQ ID NO: 14150 - DNA, 18 bp, Homo sapiens
gcctggcttcggagccgc

SEQ ID NO: 14151 - DNA, 22 bp, Homo sapiens
tcggagctgtagatgaaaccct

SEQ ID NO: 14152 - DNA, 22 bp, Homo sapiens
ttgggacagctgtggtagtgag

SEQ ID NO: 14153 - DNA, 22 bp, Homo sapiens
aacactgctgctgggttctgtg

SEQ ID NO: 14154 - DNA, 22 bp, Homo sapiens
aagggctctgtgcttgtcccat

SEQ ID NO: 14155 - DNA, 22 bp, Homo sapiens
cccatgaggtggaggttgcagt

SEQ ID NO: 14156 - DNA, 22 bp, Homo sapiens
gcgacgcaggcacgacgtgttg

SEQ ID NO: 14157 - DNA, 22 bp, Homo sapiens
aggatgagccgcgcaagctgac

SEQ ID NO: 14158 - DNA, 22 bp, Homo sapiens
tccacgctgtgtgaccttgggc

SEQ ID NO: 14159 - DNA, 22 bp, Homo sapiens
gccgggttcaagccattctcct

SEQ ID NO: 14160 - DNA, 22 bp, Homo sapiens
taggttttcctaaaattctggt

SEQ ID NO: 14161 - DNA, 22 bp, Homo sapiens
ggagaccagaaggaagcttcga

SEQ ID NO: 14162 - DNA, 22 bp, Homo sapiens
gagacacaggcacagaagaggc

SEQ ID NO: 14163 - DNA, 22 bp, Homo sapiens
tggggcagttaataaacattct

SEQ ID NO: 14164 - DNA, 22 bp, Homo sapiens
tgtccttcttgtcttgcccaaa

SEQ ID NO: 14165 - DNA, 22 bp, Homo sapiens
tttggaaattttcatccagaca

SEQ ID NO: 14166 - DNA, 22 bp, Homo sapiens
tatgggcatataaagaagtatg

SEQ ID NO: 14167 - DNA, 22 bp, Homo sapiens
tagcagcatttttgtagagtat

SEQ ID NO: 14168 - DNA, 22 bp, Homo sapiens
gtcatggtgctagcgggaatgt

SEQ ID NO: 14169 - DNA, 22 bp, Homo sapiens
catgtgtccacccttgaacaca

SEQ ID NO: 14170 - DNA, 22 bp, Homo sapiens
ctgtgcgtaagtagccaaaata

SEQ ID NO: 14171 - DNA, 23 bp, Homo sapiens
ccagtgattgcctggaaggaggt

SEQ ID NO: 14172 - DNA, 22 bp, Homo sapiens
cgggaaggtggaggttgcagtg

SEQ ID NO: 14173 - DNA, 22 bp, Homo sapiens
cagtagatttggtaaactagga

SEQ ID NO: 14174 - DNA, 22 bp, Homo sapiens
caaagtgctgggattacaggct

SEQ ID NO: 14175 - DNA, 22 bp, Homo sapiens
tacgttttaaacacggagccag

SEQ ID NO: 14176 - DNA, 22 bp, Homo sapiens
gaggcaggcagattgcttgagg

SEQ ID NO: 14177 - DNA, 22 bp, Homo sapiens
agggcgctgaaatactaacatg

SEQ ID NO: 14178 - DNA, 22 bp, Homo sapiens
aagctgcagcacagagaggtgg

SEQ ID NO: 14179 - DNA, 22 bp, Homo sapiens
actaggggctcaggcccaggga

SEQ ID NO: 14180 - DNA, 22 bp, Homo sapiens
aatgttacgatcaacaacacat

SEQ ID NO: 14181 - DNA, 22 bp, Homo sapiens
ttgggctgcagcaattattagt

SEQ ID NO: 14182 - DNA, 22 bp, Homo sapiens
tgggatgctcagggcctggagc

SEQ ID NO: 14183 - DNA, 22 bp, Homo sapiens
tgaggcaggagaatcaccggaa

SEQ ID NO: 14184 - DNA, 22 bp, Homo sapiens
gagcaacagtggcagtggtggg

SEQ ID NO: 14185 - DNA, 22 bp, Homo sapiens
ttggagatatcacaccttcaca

SEQ ID NO: 14186 - DNA, 22 bp, Homo sapiens
gcttctcaattctcaccctcca

SEQ ID NO: 14187 - DNA, 22 bp, Homo sapiens
tggggtgagattcagatattca

SEQ ID NO: 14188 - DNA, 22 bp, Homo sapiens
gtgaaatatttaacgtccaggt

SEQ ID NO: 14189 - DNA, 23 bp, Homo sapiens
gcctgggagttgcgatctgcccg

SEQ ID NO: 14190 - DNA, 22 bp, Homo sapiens
tccactgctacaacctcccaga

SEQ ID NO: 14191 - DNA, 22 bp, Homo sapiens
aatgttgtgcatgtattttgta

SEQ ID NO: 14192 - DNA, 22 bp, Homo sapiens
gctcatgactgtaatcccagca

SEQ ID NO: 14193 - DNA, 22 bp, Homo sapiens
tagcagcaaagcaggatctgct

SEQ ID NO: 14194 - DNA, 22 bp, Homo sapiens
gctcactgcctgggcaacaaga

SEQ ID NO: 14195 - DNA, 22 bp, Homo sapiens
acggggctagagaaggtttctt

SEQ ID NO: 14196 - DNA, 22 bp, Homo sapiens
cagtggcaggatttcagctcag

SEQ ID NO: 14197 - DNA, 22 bp, Homo sapiens
gaagccagtgtttgaagaattt

SEQ ID NO: 14198 - DNA, 22 bp, Homo sapiens
ctcctgagctctgaggaagctt

SEQ ID NO: 14199 - DNA, 22 bp, Homo sapiens
gcctggattccttgtttctcag

SEQ ID NO: 14200 - DNA, 22 bp, Homo sapiens
tccagaaggccacccggggatg

SEQ ID NO: 14201 - DNA, 22 bp, Homo sapiens
aggacaaaggaccagatctgga

SEQ ID NO: 14202 - DNA, 22 bp, Homo sapiens
aaggctgagacagcacaggtcc

SEQ ID NO: 14203 - DNA, 22 bp, Homo sapiens
gtctccggccgccctggtgctg

SEQ ID NO: 14204 - DNA, 22 bp, Homo sapiens
tcacaacgcctctgcaaatcct

SEQ ID NO: 14205 - DNA, 22 bp, Homo sapiens
ctcattgcaacctccgcctccc

SEQ ID NO: 14206 - DNA, 22 bp, Homo sapiens
attgagaagaaaatctaatata

SEQ ID NO: 14207 - DNA, 22 bp, Homo sapiens
acccacgaagatgagcggcatg

SEQ ID NO: 14208 - DNA, 20 bp, Homo sapiens
tttcttgtcggctgttgctg

SEQ ID NO: 14209 - DNA, 22 bp, Homo sapiens
ctgcactgacttccccggctgc

SEQ ID NO: 14210 - DNA, 22 bp, Homo sapiens
tttctgagaaattaaacacttt

SEQ ID NO: 14211 - DNA, 22 bp, Homo sapiens
tgcatggacgtgacttggccaa

SEQ ID NO: 14212 - DNA, 22 bp, Homo sapiens
cagggcctcctaaggcatctaa

SEQ ID NO: 14213 - DNA, 22 bp, Homo sapiens
ttctagtgtccttggacttgct

SEQ ID NO: 14214 - DNA, 22 bp, Homo sapiens
caggtggtcaggcaaggacacg

SEQ ID NO: 14215 - DNA, 22 bp, Homo sapiens
ctcacagtctgcctttcccttg

SEQ ID NO: 14216 - DNA, 22 bp, Homo sapiens
tggttaacttctgagcaggctg

SEQ ID NO: 14217 - DNA, 22 bp, Homo sapiens
gagctcatccccatggtccgtc

SEQ ID NO: 14218 - DNA, 22 bp, Homo sapiens
aagatgcggttgaccatggtgt

SEQ ID NO: 14219 - DNA, 22 bp, Homo sapiens
atgggctgtccattgctggctg

SEQ ID NO: 14220 - DNA, 22 bp, Homo sapiens
atttcagcagcccatgtttgga

SEQ ID NO: 14221 - DNA, 22 bp, Homo sapiens
ttccaatagtgtgaccttatag

SEQ ID NO: 14222 - DNA, 22 bp, Homo sapiens
taggtttcagaggtgccgggaa

SEQ ID NO: 14223 - DNA, 22 bp, Homo sapiens
gggaaggaaagttattagcaga

SEQ ID NO: 14224 - DNA, 22 bp, Homo sapiens
aggctgtgtggataatattggg

SEQ ID NO: 14225 - DNA, 22 bp, Homo sapiens
gcagtggggcaatcatagctca

SEQ ID NO: 14226 - DNA, 22 bp, Homo sapiens
tgggtgagcggctgcacacccg

SEQ ID NO: 14227 - DNA, 22 bp, Homo sapiens
aggtcacgtcctgtgatgtcat

SEQ ID NO: 14228 - DNA, 22 bp, Homo sapiens
tgggactcactcttttggccag

SEQ ID NO: 14229 - DNA, 22 bp, Homo sapiens
acatgagatttgggtggtgata

SEQ ID NO: 14230 - DNA, 22 bp, Homo sapiens
actggacagaggaaatatggag

SEQ ID NO: 14231 - DNA, 22 bp, Homo sapiens
cgggcgcactccgggcagctgt

SEQ ID NO: 14232 - DNA, 22 bp, Homo sapiens
ttgagaaccactgagttagata

SEQ ID NO: 14233 - DNA, 22 bp, Homo sapiens
aagaagcaggtcacagacaggg

SEQ ID NO: 14234 - DNA, 22 bp, Homo sapiens
atgcggagccccaagcttgaag

SEQ ID NO: 14235 - DNA, 22 bp, Homo sapiens
agcctgcgatcccacctggcct

SEQ ID NO: 14236 - DNA, 22 bp, Homo sapiens
gaccttgtgatccacccgcctt

SEQ ID NO: 14237 - DNA, 22 bp, Homo sapiens
gaatcccaatctgttattgaca

SEQ ID NO: 14238 - DNA, 22 bp, Homo sapiens
ccctgcctacagggttttcttt

SEQ ID NO: 14239 - DNA, 22 bp, Homo sapiens
cccaggaggttgaggctgcagt

SEQ ID NO: 14240 - DNA, 22 bp, Homo sapiens
cccaggaggcggaggttgcagt

SEQ ID NO: 14241 - DNA, 22 bp, Homo sapiens
aaatgcaacgggctttccttat

SEQ ID NO: 14242 - DNA, 21 bp, Homo sapiens
gttctacagttttagaattcc

SEQ ID NO: 14243 - DNA, 22 bp, Homo sapiens
agaaactctggaagaactttta

SEQ ID NO: 14244 - DNA, 22 bp, Homo sapiens
cctggcctttgaacgctagact

SEQ ID NO: 14245 - DNA, 22 bp, Homo sapiens
aagtcagacagctgagctgcct

SEQ ID NO: 14246 - DNA, 16 bp, Homo sapiens
aggtggagaagttcac

SEQ ID NO: 14247 - DNA, 22 bp, Homo sapiens
gcctgcagggcctgggcctacc

SEQ ID NO: 14248 - DNA, 22 bp, Homo sapiens
gagcccaggcagaggttgcagt

SEQ ID NO: 14249 - DNA, 18 bp, Homo sapiens
tcaagtgattctcctgcc

SEQ ID NO: 14250 - DNA, 22 bp, Homo sapiens
cccactgcatgagttggtatta

SEQ ID NO: 14251 - DNA, 19 bp, Homo sapiens
ctgggatgtctcctcccag

SEQ ID NO: 14252 - DNA, 22 bp, Homo sapiens
aggacttagaacattatgtact

SEQ ID NO: 14253 - DNA, 22 bp, Homo sapiens
ctgcactgagcatctaacctta

SEQ ID NO: 14254 - DNA, 22 bp, Homo sapiens
ttcattttctttcacgctgctg

SEQ ID NO: 14255 - DNA, 22 bp, Homo sapiens
ttgtgctcctgtgagaatctag

SEQ ID NO: 14256 - DNA, 23 bp, Homo sapiens
ggcactcggccgtgaactcgtgc

SEQ ID NO: 14257 - DNA, 22 bp, Homo sapiens
cagcccaggactgcaggtgttt

SEQ ID NO: 14258 - DNA, 22 bp, Homo sapiens
agcttagtggttgtatgagtta

SEQ ID NO: 14259 - DNA, 22 bp, Homo sapiens
gagggggctagcgcagtgccca

SEQ ID NO: 14260 - DNA, 22 bp, Homo sapiens
ctgtggccagagcgccgttgac

SEQ ID NO: 14261 - DNA, 22 bp, Homo sapiens
agtgaaaacctaatcatgcagt

SEQ ID NO: 14262 - DNA, 22 bp, Homo sapiens
cctactctgagcgcctccgcat

SEQ ID NO: 14263 - DNA, 22 bp, Homo sapiens
actcatgtcctaggagtaaagc

SEQ ID NO: 14264 - DNA, 22 bp, Homo sapiens
ggcaatatggtgaaaccccatc

SEQ ID NO: 14265 - DNA, 22 bp, Homo sapiens
acccagccatgttcagttctct

SEQ ID NO: 14266 - DNA, 22 bp, Homo sapiens
aaagagccgctgatgtcagccc

SEQ ID NO: 14267 - DNA, 22 bp, Homo sapiens
acaggatcgccctgttgcccag

SEQ ID NO: 14268 - DNA, 22 bp, Homo sapiens
gctgcagacttctcatctcatt

SEQ ID NO: 14269 - DNA, 22 bp, Homo sapiens
tccctagtcgcatctgtggaga

SEQ ID NO: 14270 - DNA, 22 bp, Homo sapiens
aaatactcatcccaggaactgg

SEQ ID NO: 14271 - DNA, 22 bp, Homo sapiens
tcgccccgaggcagccctatgc

SEQ ID NO: 14272 - DNA, 22 bp, Homo sapiens
actgtgtgtttgtctagcacag

SEQ ID NO: 14273 - DNA, 23 bp, Homo sapiens
cagagctggctcagagctgcctg

SEQ ID NO: 14274 - DNA, 22 bp, Homo sapiens
aacagaatgcaggggatgctgc

SEQ ID NO: 14275 - DNA, 22 bp, Homo sapiens
agaccactaaaactttctctat

SEQ ID NO: 14276 - DNA, 22 bp, Homo sapiens
atgcagttccacaggcgcatgg

SEQ ID NO: 14277 - DNA, 22 bp, Homo sapiens
acaggcttacaggctgcaagta

SEQ ID NO: 14278 - DNA, 22 bp, Homo sapiens
tgcacgtgtgagcattcacatg

SEQ ID NO: 14279 - DNA, 22 bp, Homo sapiens
tctgtgaagctctgaacagcag

SEQ ID NO: 14280 - DNA, 22 bp, Homo sapiens
ttgtgaaacattcatggatttg

SEQ ID NO: 14281 - DNA, 22 bp, Homo sapiens
ggagaagcagcttcttgatgaa

SEQ ID NO: 14282 - DNA, 22 bp, Homo sapiens
cgtgtgttgaaagatgtacatc

SEQ ID NO: 14283 - DNA, 22 bp, Homo sapiens
taaatgttttgtgggttgagtt

SEQ ID NO: 14284 - DNA, 22 bp, Homo sapiens
tcacttgaacctgggaggcaga

SEQ ID NO: 14285 - DNA, 22 bp, Homo sapiens
tggctacctgatttcttttcag

SEQ ID NO: 14286 - DNA, 20 bp, Homo sapiens
tggcctctgagatgccacgg

SEQ ID NO: 14287 - DNA, 22 bp, Homo sapiens
aaccaccattctctcctcttcc

SEQ ID NO: 14288 - DNA, 22 bp, Homo sapiens
cagagcccctcgtctccaccac

SEQ ID NO: 14289 - DNA, 17 bp, Homo sapiens
gctactggttacctcta

SEQ ID NO: 14290 - DNA, 20 bp, Homo sapiens
ggccggggagctctccaggg

SEQ ID NO: 14291 - DNA, 22 bp, Homo sapiens
tgggccactgctgcggaaggcg

SEQ ID NO: 14292 - DNA, 22 bp, Homo sapiens
ctgaggtgtgaaatggtggcaa

SEQ ID NO: 14293 - DNA, 22 bp, Homo sapiens
tcttcccccgtgctccagtgca

SEQ ID NO: 14294 - DNA, 22 bp, Homo sapiens
cggctcactgcagctccgcctc

SEQ ID NO: 14295 - DNA, 22 bp, Homo sapiens
gagtggggggtccgtctcagtg

SEQ ID NO: 14296 - DNA, 22 bp, Homo sapiens
tgaaatgtgttctagtgttttg

SEQ ID NO: 14297 - DNA, 22 bp, Homo sapiens
acaagaagggtgattaggggca

SEQ ID NO: 14298 - DNA, 22 bp, Homo sapiens
tgcttgtgacagaactgtgtcc

SEQ ID NO: 14299 - DNA, 22 bp, Homo sapiens
gctccctggtagccatgctctc

SEQ ID NO: 14300 - DNA, 22 bp, Homo sapiens
tgtggacgtcattaaagcagtg

SEQ ID NO: 14301 - DNA, 22 bp, Homo sapiens
gggctgcatcagcaggacccgg

SEQ ID NO: 14302 - DNA, 22 bp, Homo sapiens
tattattgacatttacttggtg

SEQ ID NO: 14303 - DNA, 22 bp, Homo sapiens
ttccagctaactcacatccctt

SEQ ID NO: 14304 - DNA, 22 bp, Homo sapiens
agctacctgatccttcttctga

SEQ ID NO: 14305 - DNA, 22 bp, Homo sapiens
tcagggattgcaaaattcatcc

SEQ ID NO: 14306 - DNA, 22 bp, Homo sapiens
gtctccttgtggatctcaagga

SEQ ID NO: 14307 - DNA, 22 bp, Homo sapiens
gaggtgggtgtatcacaggtca

SEQ ID NO: 14308 - DNA, 22 bp, Homo sapiens
aaagcagggaaatctatttgca

SEQ ID NO: 14309 - DNA, 22 bp, Homo sapiens
gctgggctgcgtcggggaagcc

SEQ ID NO: 14310 - DNA, 22 bp, Homo sapiens
ttgttcttgtctttgccttcac

SEQ ID NO: 14311 - DNA, 22 bp, Homo sapiens
atgttattgatgcctgaggctt

SEQ ID NO: 14312 - DNA, 22 bp, Homo sapiens
aggttatcatcagttgagcact

SEQ ID NO: 14313 - DNA, 22 bp, Homo sapiens
gggctgactcctattggatgaa

SEQ ID NO: 14314 - DNA, 22 bp, Homo sapiens
ggagtagctgcattccgagcac

SEQ ID NO: 14315 - DNA, 22 bp, Homo sapiens
ttctccctgtcctatcaagact

SEQ ID NO: 14316 - DNA, 22 bp, Homo sapiens
agtggaccagaagactgaagct

SEQ ID NO: 14317 - DNA, 22 bp, Homo sapiens
tgcgcctctaatctcgggcgtc

SEQ ID NO: 14318 - DNA, 22 bp, Homo sapiens
tccggcggccggcctgagcccg

SEQ ID NO: 14319 - DNA, 21 bp, Homo sapiens
ctgtcatgcaaccattctcca

SEQ ID NO: 14320 - DNA, 22 bp, Homo sapiens
gaggaggcagcctatcccttag

SEQ ID NO: 14321 - DNA, 22 bp, Homo sapiens
atgctgtttgcttttagtctgc

SEQ ID NO: 14322 - DNA, 22 bp, Homo sapiens
atgtgtcaggtacactcattag

SEQ ID NO: 14323 - DNA, 22 bp, Homo sapiens
ctctgctgtgccgccagggcct

SEQ ID NO: 14324 - DNA, 22 bp, Homo sapiens
ggtcagccttggatttggtagc

SEQ ID NO: 14325 - DNA, 22 bp, Homo sapiens
cctgggaggctgaggctgcagt

SEQ ID NO: 14326 - DNA, 22 bp, Homo sapiens
tgctcattggcgatctgaggga

SEQ ID NO: 14327 - DNA, 22 bp, Homo sapiens
ccccgaggctggagtgcagtgg

SEQ ID NO: 14328 - DNA, 22 bp, Homo sapiens
tgaaatctttagtttctgtccc

SEQ ID NO: 14329 - DNA, 22 bp, Homo sapiens
ggcaaggggtcaggctgagaca

SEQ ID NO: 14330 - DNA, 22 bp, Homo sapiens
agttgagggtgggagagaaatg

SEQ ID NO: 14331 - DNA, 22 bp, Homo sapiens
tacagtgcttggtatctagtaa

SEQ ID NO: 14332 - DNA, 22 bp, Homo sapiens
atctgtcttttaatgttaatgc

SEQ ID NO: 14333 - DNA, 22 bp, Homo sapiens
cctccagagggaagtactttct

SEQ ID NO: 14334 - DNA, 22 bp, Homo sapiens
ggacacgtggctgaaggcggcc

SEQ ID NO: 14335 - DNA, 22 bp, Homo sapiens
cctggcaggtggcgccctcggc

SEQ ID NO: 14336 - DNA, 22 bp, Homo sapiens
aaaactgaaatacgatccaatg

SEQ ID NO: 14337 - DNA, 22 bp, Homo sapiens
caggaaggggctcactctggcc

SEQ ID NO: 14338 - DNA, 22 bp, Homo sapiens
acatcccttgctcggggcccct

SEQ ID NO: 14339 - DNA, 22 bp, Homo sapiens
gccagggttcgaatccgtatgg

SEQ ID NO: 14340 - DNA, 22 bp, Homo sapiens
gtatccatgggggattggttcc

SEQ ID NO: 14341 - DNA, 22 bp, Homo sapiens
gcataaactccaaaaggcaggg

SEQ ID NO: 14342 - DNA, 22 bp, Homo sapiens
ggcgcccccttcaaacagagca

SEQ ID NO: 14343 - DNA, 22 bp, Homo sapiens
gtctcctccctttcattcacct

SEQ ID NO: 14344 - DNA, 22 bp, Homo sapiens
gagcccaggagtttgatgctgc

SEQ ID NO: 14345 - DNA, 22 bp, Homo sapiens
gtcagaggggcagctgccaggc

SEQ ID NO: 14346 - DNA, 22 bp, Homo sapiens
catggtgggtgtagtttccgcc

SEQ ID NO: 14347 - DNA, 22 bp, Homo sapiens
tgaggcactccaggatgctgtt

SEQ ID NO: 14348 - DNA, 22 bp, Homo sapiens
aagatactttgcatgcatgaag

SEQ ID NO: 14349 - DNA, 22 bp, Homo sapiens
ccaggtgtgctctgcagtggat

SEQ ID NO: 14350 - DNA, 20 bp, Homo sapiens
ggggcccaagccctcttgcc

SEQ ID NO: 14351 - DNA, 22 bp, Homo sapiens
ctggagggtggagagaagtctc

SEQ ID NO: 14352 - DNA, 22 bp, Homo sapiens
agtgagtttagggtgcaggtgt

SEQ ID NO: 14353 - DNA, 22 bp, Homo sapiens
tgttttggtggtctataggaaa

SEQ ID NO: 14354 - DNA, 22 bp, Homo sapiens
gaaaaggcctggggcaaagtgt

SEQ ID NO: 14355 - DNA, 22 bp, Homo sapiens
gatatcattgagcccaggagtt

SEQ ID NO: 14356 - DNA, 22 bp, Homo sapiens
aactagaaaaagactttctgag

SEQ ID NO: 14357 - DNA, 22 bp, Homo sapiens
tatgtgtttgacaccctgcaag

SEQ ID NO: 14358 - DNA, 22 bp, Homo sapiens
ctcacctccaggagctgctggc

SEQ ID NO: 14359 - DNA, 22 bp, Homo sapiens
gctgctgcttgaaggctcggag

SEQ ID NO: 14360 - DNA, 22 bp, Homo sapiens
ggtgcagaggagccagctgggg

SEQ ID NO: 14361 - DNA, 23 bp, Homo sapiens
cgcccagcctcagtgacctgggc

SEQ ID NO: 14362 - DNA, 22 bp, Homo sapiens
ttggacgctcctaagaccaagc

SEQ ID NO: 14363 - DNA, 22 bp, Homo sapiens
ttctgggcacacaggccctggt

SEQ ID NO: 14364 - DNA, 22 bp, Homo sapiens
ttgcctgtgtcagcaggtggaa

SEQ ID NO: 14365 - DNA, 22 bp, Homo sapiens
tgtatattctgcctaaaagctt

SEQ ID NO: 14366 - DNA, 22 bp, Homo sapiens
ttttaatactgctattgtagga

SEQ ID NO: 14367 - DNA, 19 bp, Homo sapiens
atgtacccagtgtcaatcc

SEQ ID NO: 14368 - DNA, 22 bp, Homo sapiens
cttgaagtggagcttttgaaat

SEQ ID NO: 14369 - DNA, 22 bp, Homo sapiens
tgtcctgtgattccagctcttc

SEQ ID NO: 14370 - DNA, 22 bp, Homo sapiens
gaatgtgtactgagtgcccctt

SEQ ID NO: 14371 - DNA, 22 bp, Homo sapiens
ggttggtaactccctgtgcagt

SEQ ID NO: 14372 - DNA, 22 bp, Homo sapiens
cctcggggcaccgcggcctgct

SEQ ID NO: 14373 - DNA, 22 bp, Homo sapiens
tagaataatctgaggaaatgct

SEQ ID NO: 14374 - DNA, 22 bp, Homo sapiens
tgtgagttcttagaaagtcagt

SEQ ID NO: 14375 - DNA, 22 bp, Homo sapiens
gggaaacaacaaagtatctatg

SEQ ID NO: 14376 - DNA, 20 bp, Homo sapiens
caggtccagcacgtgcacgg

SEQ ID NO: 14377 - DNA, 22 bp, Homo sapiens
acgtagcactgagagatgcagg

SEQ ID NO: 14378 - DNA, 22 bp, Homo sapiens
gcatgtgtctttatagcagcat

SEQ ID NO: 14379 - DNA, 22 bp, Homo sapiens
gtgaccaatattatgctaatta

SEQ ID NO: 14380 - DNA, 22 bp, Homo sapiens
aatgtcctctttagagggttac

SEQ ID NO: 14381 - DNA, 22 bp, Homo sapiens
tgtgacctcatcttaactggaa

SEQ ID NO: 14382 - DNA, 22 bp, Homo sapiens
ggttccacctggcgaggggtat

SEQ ID NO: 14383 - DNA, 22 bp, Homo sapiens
gactcgctcccttttgtcttat

SEQ ID NO: 14384 - DNA, 22 bp, Homo sapiens
ctgaggctggagtgcagtggtg

SEQ ID NO: 14385 - DNA, 22 bp, Homo sapiens
gcggtagctcaagcttgtaatc

SEQ ID NO: 14386 - DNA, 22 bp, Homo sapiens
ttctgtgaatcttttttcccac

SEQ ID NO: 14387 - DNA, 22 bp, Homo sapiens
ttcactcttcggcatctctgta

SEQ ID NO: 14388 - DNA, 17 bp, Homo sapiens
tgcatgtcctttgttcc

SEQ ID NO: 14389 - DNA, 22 bp, Homo sapiens
ccctttagcccctgcagagact

SEQ ID NO: 14390 - DNA, 22 bp, Homo sapiens
aggagcggatgtgtcctgccag

SEQ ID NO: 14391 - DNA, 21 bp, Homo sapiens
cctcaagtgcctcctgctgct

SEQ ID NO: 14392 - DNA, 22 bp, Homo sapiens
gtgagactcgcctttgtgtagc

SEQ ID NO: 14393 - DNA, 19 bp, Homo sapiens
ggcatggggtccggggacc

SEQ ID NO: 14394 - DNA, 22 bp, Homo sapiens
gctggagaggatcccaaagcca

SEQ ID NO: 14395 - DNA, 17 bp, Homo sapiens
ttcttttctgagccttg

SEQ ID NO: 14396 - DNA, 22 bp, Homo sapiens
actacagtgtgataagaggggc

SEQ ID NO: 14397 - DNA, 22 bp, Homo sapiens
tccacgtgagcttcgtgtgcag

SEQ ID NO: 14398 - DNA, 22 bp, Homo sapiens
tgagagcaacacgcagtagtat

SEQ ID NO: 14399 - DNA, 19 bp, Homo sapiens
tgtgactggttgtctcgct

SEQ ID NO: 14400 - DNA, 22 bp, Homo sapiens
agcctggtttaagcattttata

SEQ ID NO: 14401 - DNA, 22 bp, Homo sapiens
gagccaagctcttctccatgag

SEQ ID NO: 14402 - DNA, 22 bp, Homo sapiens
cctgagagcattccacactgaa

SEQ ID NO: 14403 - DNA, 22 bp, Homo sapiens
tatttaataaaactatggcatg

SEQ ID NO: 14404 - DNA, 22 bp, Homo sapiens
tgggctgcaggggttgagagct

SEQ ID NO: 14405 - DNA, 22 bp, Homo sapiens
gtgctccctccttcctcaagga

SEQ ID NO: 14406 - DNA, 22 bp, Homo sapiens
accctcaacaaattcactctat

SEQ ID NO: 14407 - DNA, 22 bp, Homo sapiens
acagtgcttagcacagagtaga

SEQ ID NO: 14408 - DNA, 20 bp, Homo sapiens
cagcagtggatgagagtttt

SEQ ID NO: 14409 - DNA, 22 bp, Homo sapiens
ccagaagcagagcctgaggcag

SEQ ID NO: 14410 - DNA, 22 bp, Homo sapiens
taagagaccgatattcttaagt

SEQ ID NO: 14411 - DNA, 22 bp, Homo sapiens
actggggactctggccttttga

SEQ ID NO: 14412 - DNA, 22 bp, Homo sapiens
tgggagcagcctcagcttcggg

SEQ ID NO: 14413 - DNA, 22 bp, Homo sapiens
tcccagagctctggaggttgga

SEQ ID NO: 14414 - DNA, 22 bp, Homo sapiens
cctcggaggcggaggctgcagt

SEQ ID NO: 14415 - DNA, 22 bp, Homo sapiens
aaggccctgtctccaaatacag

SEQ ID NO: 14416 - DNA, 22 bp, Homo sapiens
tctgctcagccgatctgctccg

SEQ ID NO: 14417 - DNA, 21 bp, Homo sapiens
gtgacctgcgcggggcgcagc

SEQ ID NO: 14418 - DNA, 22 bp, Homo sapiens
tacgcctgtaatcccagcactt

SEQ ID NO: 14419 - DNA, 19 bp, Homo sapiens
gccttgaagcaactcttgt

SEQ ID NO: 14420 - DNA, 22 bp, Homo sapiens
cccatttcttgagttcagctct

SEQ ID NO: 14421 - DNA, 22 bp, Homo sapiens
tgagcctgggtggtcgaggctg

SEQ ID NO: 14422 - DNA, 22 bp, Homo sapiens
tacatagctcctagtgatgcat

SEQ ID NO: 14423 - DNA, 22 bp, Homo sapiens
gcactggccgcacgcgtagggc

SEQ ID NO: 14424 - DNA, 22 bp, Homo sapiens
ttcactggtcctttataggaac

SEQ ID NO: 14425 - DNA, 22 bp, Homo sapiens
ctccaggccatggctgcggagg

SEQ ID NO: 14426 - DNA, 18 bp, Homo sapiens
atggtctcatactgggag

SEQ ID NO: 14427 - DNA, 22 bp, Homo sapiens
tgttgactcaacactgtgggca

SEQ ID NO: 14428 - DNA, 22 bp, Homo sapiens
atcttcccaggctggggagagg

SEQ ID NO: 14429 - DNA, 22 bp, Homo sapiens
gcaggctgtctaaagttagagt

SEQ ID NO: 14430 - DNA, 22 bp, Homo sapiens
cgggcccgagcacggcacccac

SEQ ID NO: 14431 - DNA, 22 bp, Homo sapiens
cggggccctggggctgaaggtc

SEQ ID NO: 14432 - DNA, 22 bp, Homo sapiens
atgaaaacggaccagagctatt

SEQ ID NO: 14433 - DNA, 22 bp, Homo sapiens
gaaccacaatgtgaagaaggag

SEQ ID NO: 14434 - DNA, 22 bp, Homo sapiens
gccataggcagcgtggccagca

SEQ ID NO: 14435 - DNA, 22 bp, Homo sapiens
atcaaatacaaagggcataagg

SEQ ID NO: 14436 - DNA, 22 bp, Homo sapiens
tcagcagtgagaattaatgttg

SEQ ID NO: 14437 - DNA, 22 bp, Homo sapiens
aaatgtaagtctttgtttctta

SEQ ID NO: 14438 - DNA, 22 bp, Homo sapiens
tgtaagtagtaatggaaggaca

SEQ ID NO: 14439 - DNA, 22 bp, Homo sapiens
tcacagagatgaacttttgata

SEQ ID NO: 14440 - DNA, 22 bp, Homo sapiens
tgtggtgccgagagtctggacg

SEQ ID NO: 14441 - DNA, 21 bp, Homo sapiens
ctagaaagaatgttgtcgtct

SEQ ID NO: 14442 - DNA, 22 bp, Homo sapiens
ttgtcgggcttacgcagggcca

SEQ ID NO: 14443 - DNA, 22 bp, Homo sapiens
gctcggtggccagcctgaggcc

SEQ ID NO: 14444 - DNA, 22 bp, Homo sapiens
gaatatcccgctatgcaaagta

SEQ ID NO: 14445 - DNA, 22 bp, Homo sapiens
tccttagacaaagagtgggctt

SEQ ID NO: 14446 - DNA, 22 bp, Homo sapiens
aagtcgtggcaggcttgcacga

SEQ ID NO: 14447 - DNA, 22 bp, Homo sapiens
ggtgtccacattccctggcagg

SEQ ID NO: 14448 - DNA, 22 bp, Homo sapiens
atggggagctcaccacctgttt

SEQ ID NO: 14449 - DNA, 22 bp, Homo sapiens
aatttcggttcaaggcccagtt

SEQ ID NO: 14450 - DNA, 22 bp, Homo sapiens
tgtattctaaatacatcttacc

SEQ ID NO: 14451 - DNA, 22 bp, Homo sapiens
aaaacctcagttctgctcttaa

SEQ ID NO: 14452 - DNA, 22 bp, Homo sapiens
tgctcgccccacatgccctcat

SEQ ID NO: 14453 - DNA, 22 bp, Homo sapiens
tgtcatggggttgttttgtaca

SEQ ID NO: 14454 - DNA, 22 bp, Homo sapiens
aatattatcaaaagctttttca

SEQ ID NO: 14455 - DNA, 22 bp, Homo sapiens
cgtgaggggggtaaggcgtccg

SEQ ID NO: 14456 - DNA, 22 bp, Homo sapiens
ttggaatgcacactgagcctgc

SEQ ID NO: 14457 - DNA, 22 bp, Homo sapiens
tgtggactggcgggacgcaatg

SEQ ID NO: 14458 - DNA, 22 bp, Homo sapiens
acagacaagtagttcagacaag

SEQ ID NO: 14459 - DNA, 22 bp, Homo sapiens
aagtagcagggattacaggtgt

SEQ ID NO: 14460 - DNA, 22 bp, Homo sapiens
aatggcaaggaaaccgttacca

SEQ ID NO: 14461 - DNA, 22 bp, Homo sapiens
cagtcactggaatagctgagga

SEQ ID NO: 14462 - DNA, 22 bp, Homo sapiens
gaaaattattgaaaatggctct

SEQ ID NO: 14463 - DNA, 22 bp, Homo sapiens
actgcaacctccgcctgccagg

SEQ ID NO: 14464 - DNA, 22 bp, Homo sapiens
ccaggctggagtatagtggcgc

SEQ ID NO: 14465 - DNA, 22 bp, Homo sapiens
caaagtgggtgccctgatgctc

SEQ ID NO: 14466 - DNA, 22 bp, Homo sapiens
gcctcctggggtgccatcatct

SEQ ID NO: 14467 - DNA, 22 bp, Homo sapiens
acacagagccaaaccatatcac

SEQ ID NO: 14468 - DNA, 22 bp, Homo sapiens
caccgcggagtgatggagaaac

SEQ ID NO: 14469 - DNA, 22 bp, Homo sapiens
gggctgagacgatggggtcttc

SEQ ID NO: 14470 - DNA, 22 bp, Homo sapiens
agatgcagtggttaacaataca

SEQ ID NO: 14471 - DNA, 22 bp, Homo sapiens
aaacaacctaaagttactgatc

SEQ ID NO: 14472 - DNA, 22 bp, Homo sapiens
atgccactgcacttcagcttgg

SEQ ID NO: 14473 - DNA, 22 bp, Homo sapiens
ggcatggacgtctctgaggcca

SEQ ID NO: 14474 - DNA, 22 bp, Homo sapiens
accagcctggccaacatggcaa

SEQ ID NO: 14475 - DNA, 22 bp, Homo sapiens
cgcaactcagcaacttaactgc

SEQ ID NO: 14476 - DNA, 22 bp, Homo sapiens
gtaatagtctcaaactcctgga

SEQ ID NO: 14477 - DNA, 22 bp, Homo sapiens
tcaagcggactgagatactctg

SEQ ID NO: 14478 - DNA, 22 bp, Homo sapiens
tataaactcctcttgcattcct

SEQ ID NO: 14479 - DNA, 22 bp, Homo sapiens
actgcacttcaccctgggtgac

SEQ ID NO: 14480 - DNA, 20 bp, Homo sapiens
cagtgcattgcttctgattt

SEQ ID NO: 14481 - DNA, 22 bp, Homo sapiens
tatttcttttcgtgacttattg

SEQ ID NO: 14482 - DNA, 22 bp, Homo sapiens
tgtttcttacgtttttagaggc

SEQ ID NO: 14483 - DNA, 19 bp, Homo sapiens
ttctctgctacattctcag

SEQ ID NO: 14484 - DNA, 22 bp, Homo sapiens
tgtctcttttcaagctaccctt

SEQ ID NO: 14485 - DNA, 22 bp, Homo sapiens
tcagggctgcagaagaggcagg

SEQ ID NO: 14486 - DNA, 21 bp, Homo sapiens
tgaaggggtggcagtgtgctt

SEQ ID NO: 14487 - DNA, 21 bp, Homo sapiens
accctgctttatgccgtcctc

SEQ ID NO: 14488 - DNA, 22 bp, Homo sapiens
taaatgttgtaagtacatctaa

SEQ ID NO: 14489 - DNA, 22 bp, Homo sapiens
tcaggcagtagaattgcttgaa

SEQ ID NO: 14490 - DNA, 22 bp, Homo sapiens
ccatgtggtgggaaggagaatg

SEQ ID NO: 14491 - DNA, 22 bp, Homo sapiens
ggtgggagagcttgctttgatg

SEQ ID NO: 14492 - DNA, 22 bp, Homo sapiens
cactgcacttcagcctgggtga

SEQ ID NO: 14493 - DNA, 22 bp, Homo sapiens
gcagggaggtttgctgacctgg

SEQ ID NO: 14494 - DNA, 22 bp, Homo sapiens
aggcaggaaaatcgcttgaacc

SEQ ID NO: 14495 - DNA, 22 bp, Homo sapiens
cctgcctactgagttttatatt

SEQ ID NO: 14496 - DNA, 22 bp, Homo sapiens
gcggggcccggacccagcctct

SEQ ID NO: 14497 - DNA, 22 bp, Homo sapiens
ctacttgttcactgtaggtcgc

SEQ ID NO: 14498 - DNA, 22 bp, Homo sapiens
taacaaagtattgtttgtgtat

SEQ ID NO: 14499 - DNA, 22 bp, Homo sapiens
ggctcactgcaacctccacctc

SEQ ID NO: 14500 - DNA, 22 bp, Homo sapiens
gcccgcagagatctttaacaaa

SEQ ID NO: 14501 - DNA, 22 bp, Homo sapiens
cccagttgttgccggctctgga

SEQ ID NO: 14502 - DNA, 22 bp, Homo sapiens
gtctctatcatagctgaaccct

SEQ ID NO: 14503 - DNA, 22 bp, Homo sapiens
tcacaactgggtgtcttcatca

SEQ ID NO: 14504 - DNA, 22 bp, Homo sapiens
ggctcactgcaacctctgcctc

SEQ ID NO: 14505 - DNA, 22 bp, Homo sapiens
tcgcttgaacccaggaagtgga

SEQ ID NO: 14506 - DNA, 22 bp, Homo sapiens
atgaaatatcttgaagaaattc

SEQ ID NO: 14507 - DNA, 22 bp, Homo sapiens
taatggttttttggagactgct

SEQ ID NO: 14508 - DNA, 17 bp, Homo sapiens
caggtgacctggtgatg

SEQ ID NO: 14509 - DNA, 22 bp, Homo sapiens
aggggctcctttgtgctgcgtc

SEQ ID NO: 14510 - DNA, 20 bp, Homo sapiens
aaacgagccatcattctggt

SEQ ID NO: 14511 - DNA, 22 bp, Homo sapiens
tggcactgagcagccgcggcag

SEQ ID NO: 14512 - DNA, 22 bp, Homo sapiens
gtcaccttgaacaggctactca

SEQ ID NO: 14513 - DNA, 22 bp, Homo sapiens
ttgtcacagcagcaaaggctct

SEQ ID NO: 14514 - DNA, 22 bp, Homo sapiens
tcttcctgtcaatgagaattaa

SEQ ID NO: 14515 - DNA, 22 bp, Homo sapiens
ttagatttacaagcactgttta

SEQ ID NO: 14516 - DNA, 22 bp, Homo sapiens
gacagacacaattgatccatga

SEQ ID NO: 14517 - DNA, 22 bp, Homo sapiens
aggtgcttggctcgtgcacaca

SEQ ID NO: 14518 - DNA, 22 bp, Homo sapiens
acctggaggcagaggttgcagt

SEQ ID NO: 14519 - DNA, 22 bp, Homo sapiens
gagcatcgctgagatcccagac

SEQ ID NO: 14520 - DNA, 22 bp, Homo sapiens
tgggcccgcagctgctgctcca

SEQ ID NO: 14521 - DNA, 22 bp, Homo sapiens
aagcacaatgaacatcttagat

SEQ ID NO: 14522 - DNA, 22 bp, Homo sapiens
ttcttggggttccacaatggga

SEQ ID NO: 14523 - DNA, 23 bp, Homo sapiens
ctggggctttcaaatctgggcag

SEQ ID NO: 14524 - DNA, 22 bp, Homo sapiens
ttactttgcttcaggaagagga

SEQ ID NO: 14525 - DNA, 22 bp, Homo sapiens
agtgctgtcagttttatagata

SEQ ID NO: 14526 - DNA, 23 bp, Homo sapiens
cgggttcacgccattctcctgcc

SEQ ID NO: 14527 - DNA, 22 bp, Homo sapiens
tccaaggtcagcgagagtcact

SEQ ID NO: 14528 - DNA, 22 bp, Homo sapiens
ggggatggaggcgtgtggtcct

SEQ ID NO: 14529 - DNA, 22 bp, Homo sapiens
caaagctggaaaaggaggctgg

SEQ ID NO: 14530 - DNA, 22 bp, Homo sapiens
aacccaggagatggaggttgtg

SEQ ID NO: 14531 - DNA, 22 bp, Homo sapiens
agatcacagtggcaactccctt

SEQ ID NO: 14532 - DNA, 22 bp, Homo sapiens
gctctctgcagcctccttggag

SEQ ID NO: 14533 - DNA, 22 bp, Homo sapiens
gagatcggtaaagagcatgcac

SEQ ID NO: 14534 - DNA, 22 bp, Homo sapiens
atgagttgaagctacaagaggc

SEQ ID NO: 14535 - DNA, 22 bp, Homo sapiens
gcctccggagttgcagtgtctt

SEQ ID NO: 14536 - DNA, 22 bp, Homo sapiens
gcagctgacatctggctgggcc

SEQ ID NO: 14537 - DNA, 22 bp, Homo sapiens
ccaggctggagtgcaatggcgt

SEQ ID NO: 14538 - DNA, 22 bp, Homo sapiens
agttctgacctaacctttctca

SEQ ID NO: 14539 - DNA, 22 bp, Homo sapiens
agttttcattaccatgctgcaa

SEQ ID NO: 14540 - DNA, 22 bp, Homo sapiens
ctgggcaaattgtgccagctat

SEQ ID NO: 14541 - DNA, 22 bp, Homo sapiens
agaaaatttaaagagacacaca

SEQ ID NO: 14542 - DNA, 22 bp, Homo sapiens
gggcaccttgggtctcaggcaa

SEQ ID NO: 14543 - DNA, 22 bp, Homo sapiens
gaaggaagtcattagtgcagac

SEQ ID NO: 14544 - DNA, 22 bp, Homo sapiens
attcagagcactgggtagaatt

SEQ ID NO: 14545 - DNA, 22 bp, Homo sapiens
tccctgaggatggttgtattta

SEQ ID NO: 14546 - DNA, 22 bp, Homo sapiens
gaatttaagaggatgaatctgt

SEQ ID NO: 14547 - DNA, 22 bp, Homo sapiens
gtatagaaacccagaaagatag

SEQ ID NO: 14548 - DNA, 22 bp, Homo sapiens
cccagtttcaactttccagtgg

SEQ ID NO: 14549 - DNA, 22 bp, Homo sapiens
tgttgatttgtgggctgcaaaa

SEQ ID NO: 14550 - DNA, 22 bp, Homo sapiens
catggcactgagcaggtatgca

SEQ ID NO: 14551 - DNA, 22 bp, Homo sapiens
gtacacaaagtgagacttgata

SEQ ID NO: 14552 - DNA, 22 bp, Homo sapiens
tagatctgatacaattcatctg

SEQ ID NO: 14553 - DNA, 22 bp, Homo sapiens
ctctgcctcccaggttcaagcg

SEQ ID NO: 14554 - DNA, 22 bp, Homo sapiens
ttcttctttccaattacatggt

SEQ ID NO: 14555 - DNA, 22 bp, Homo sapiens
tagcataacaggtaagagtgag

SEQ ID NO: 14556 - DNA, 22 bp, Homo sapiens
ccaggtgtgctctgcagtggat

SEQ ID NO: 14557 - DNA, 22 bp, Homo sapiens
gcgtctcaaggcccccaggcca

SEQ ID NO: 14558 - DNA, 22 bp, Homo sapiens
ggctcacgcaattatcccggcc

SEQ ID NO: 14559 - DNA, 22 bp, Homo sapiens
aggcaaggtgctacagacagtg

SEQ ID NO: 14560 - DNA, 22 bp, Homo sapiens
tgaagaaacgcagagaggtagg

SEQ ID NO: 14561 - DNA, 22 bp, Homo sapiens
tttattggatatttacaagata

SEQ ID NO: 14562 - DNA, 22 bp, Homo sapiens
tatccaattcaccattgatggg

SEQ ID NO: 14563 - DNA, 22 bp, Homo sapiens
gtgaggtggtacaatattaact

SEQ ID NO: 14564 - DNA, 22 bp, Homo sapiens
tctgctttcttactaaaaatga

SEQ ID NO: 14565 - DNA, 22 bp, Homo sapiens
acactgcagatgaaagcataag

SEQ ID NO: 14566 - DNA, 22 bp, Homo sapiens
gaagaaagatcaaatagtttcc

SEQ ID NO: 14567 - DNA, 22 bp, Homo sapiens
agatgtgtttctagttcctgca

SEQ ID NO: 14568 - DNA, 21 bp, Homo sapiens
tctgatggtagatgagatgtg

SEQ ID NO: 14569 - DNA, 22 bp, Homo sapiens
gggtggtggccagcagtgggca

SEQ ID NO: 14570 - DNA, 20 bp, Homo sapiens
tttgagaccagtctgcccaa

SEQ ID NO: 14571 - DNA, 20 bp, Homo sapiens
ttcatgggagcaaagaggcc

SEQ ID NO: 14572 - DNA, 22 bp, Homo sapiens
tacgcctgtaatcccagcactt

SEQ ID NO: 14573 - DNA, 22 bp, Homo sapiens
attgataaattgcaatggggct

SEQ ID NO: 14574 - DNA, 22 bp, Homo sapiens
ctgggatccacgggctcccaag

SEQ ID NO: 14575 - DNA, 22 bp, Homo sapiens
tttggtattgcacactgtcttc

SEQ ID NO: 14576 - DNA, 22 bp, Homo sapiens
ctggcaagaaatatatatctta

SEQ ID NO: 14577 - DNA, 22 bp, Homo sapiens
aggacttagaacattatgtact

SEQ ID NO: 14578 - DNA, 22 bp, Homo sapiens
gcatgtgtctttatagcagcat

SEQ ID NO: 14579 - DNA, 22 bp, Homo sapiens
gacaggtgctaagggacctggc

SEQ ID NO: 14580 - DNA, 22 bp, Homo sapiens
catgaaattgtattggcctcaa

SEQ ID NO: 14581 - DNA, 22 bp, Homo sapiens
ctgtaatcccagctactcggga

SEQ ID NO: 14582 - DNA, 22 bp, Homo sapiens
tgagagttctctcttcaggtgg

SEQ ID NO: 14583 - DNA, 22 bp, Homo sapiens
cacagacagtgtccctttgttg

SEQ ID NO: 14584 - DNA, 22 bp, Homo sapiens
agaaaacataggagacaggaaa

SEQ ID NO: 14585 - DNA, 22 bp, Homo sapiens
catgtgtcttgctgccctccat

SEQ ID NO: 14586 - DNA, 22 bp, Homo sapiens
cactgcactccagcctgggtga

SEQ ID NO: 14587 - DNA, 22 bp, Homo sapiens
acccggagtcggaggttgcagt

SEQ ID NO: 14588 - DNA, 22 bp, Homo sapiens
gaccttgtgatccgcccgcctt

SEQ ID NO: 14589 - DNA, 22 bp, Homo sapiens
acccgggaggcaggagtcatag

SEQ ID NO: 14590 - DNA, 22 bp, Homo sapiens
tgttcagaacaaaggtaaatga

SEQ ID NO: 14591 - DNA, 22 bp, Homo sapiens
aacactgctgctgggttctgtg

SEQ ID NO: 14592 - DNA, 22 bp, Homo sapiens
gcagggcacaaggacgcacagg

SEQ ID NO: 14593 - DNA, 20 bp, Homo sapiens
acgtggccaccagtggctta

SEQ ID NO: 14594 - DNA, 22 bp, Homo sapiens
gcatatgatcacgtgtgtcggt

SEQ ID NO: 14595 - DNA, 22 bp, Homo sapiens
atgattgaccatctgctgggct

SEQ ID NO: 14596 - DNA, 22 bp, Homo sapiens
ggaccggtggcttcctcgggtc

SEQ ID NO: 14597 - DNA, 22 bp, Homo sapiens
ctggtctggctacccagcgaat

SEQ ID NO: 14598 - DNA, 22 bp, Homo sapiens
aatactgcctgtgaggtaactc

SEQ ID NO: 14599 - DNA, 21 bp, Homo sapiens
agcgtcaatatcgtcaacagg

SEQ ID NO: 14600 - DNA, 22 bp, Homo sapiens
gctgtctcatacaaggccctgc

SEQ ID NO: 14601 - DNA, 22 bp, Homo sapiens
ggccagaagttggaaaagagcc

SEQ ID NO: 14602 - DNA, 22 bp, Homo sapiens
aagaagcaggtcacagacaggg

SEQ ID NO: 14603 - DNA, 22 bp, Homo sapiens
actgcacttcaccctgggtgac

SEQ ID NO: 14604 - DNA, 22 bp, Homo sapiens
gaccttgtgatccccctgcctt

SEQ ID NO: 14605 - DNA, 22 bp, Homo sapiens
ttgagacacagtttcactctgt

SEQ ID NO: 14606 - DNA, 22 bp, Homo sapiens
ttatatgtttctgtttggaggc

SEQ ID NO: 14607 - DNA, 22 bp, Homo sapiens
tgacttgtctctttgggagaca

SEQ ID NO: 14608 - DNA, 22 bp, Homo sapiens
tttgaagactactgggagtgaa

SEQ ID NO: 14609 - DNA, 22 bp, Homo sapiens
gagaggtggaggttgcagtgag

SEQ ID NO: 14610 - DNA, 22 bp, Homo sapiens
cctggtgctgctatcaggggta

SEQ ID NO: 14611 - DNA, 22 bp, Homo sapiens
ttatttaaaagtggtaagattc

SEQ ID NO: 14612 - DNA, 22 bp, Homo sapiens
ttgagcaatgtcactgaggctt

SEQ ID NO: 14613 - DNA, 22 bp, Homo sapiens
ggttgtagttggaggttgtata

SEQ ID NO: 14614 - DNA, 22 bp, Homo sapiens
gctggtagacctcactgcactc

SEQ ID NO: 14615 - DNA, 22 bp, Homo sapiens
actgcactccaacctgggtgac

SEQ ID NO: 14616 - DNA, 18 bp, Homo sapiens
atggtctcatactgggag

SEQ ID NO: 14617 - DNA, 22 bp, Homo sapiens
atacagggacatccagtttttc

SEQ ID NO: 14618 - DNA, 22 bp, Homo sapiens
ggaagaaaggtggacaacaggt

SEQ ID NO: 14619 - DNA, 22 bp, Homo sapiens
gggttactgcttcaaaaaatta

SEQ ID NO: 14620 - DNA, 22 bp, Homo sapiens
cactgcactccagcttgggtga

SEQ ID NO: 14621 - DNA, 22 bp, Homo sapiens
gggagctgaaggagccggcggg

SEQ ID NO: 14622 - DNA, 22 bp, Homo sapiens
gcttaattctggctcagtttcc

SEQ ID NO: 14623 - DNA, 22 bp, Homo sapiens
cctggtgcaggtgtgttgccag

SEQ ID NO: 14624 - DNA, 22 bp, Homo sapiens
ttggagatatcacaccttcaca

SEQ ID NO: 14625 - DNA, 19 bp, Homo sapiens
ccctcttgcacaaagcaaa

SEQ ID NO: 14626 - DNA, 22 bp, Homo sapiens
caggtggtcaggcaaggacacg

SEQ ID NO: 14627 - DNA, 22 bp, Homo sapiens
tgacagagtgacactcttgtct

SEQ ID NO: 14628 - DNA, 22 bp, Homo sapiens
gataccagacagggagggagaa

SEQ ID NO: 14629 - DNA, 22 bp, Homo sapiens
tcactacaacctccgcctcctg

SEQ ID NO: 14630 - DNA, 22 bp, Homo sapiens
accactgcccatggtgaaaact

SEQ ID NO: 14631 - DNA, 22 bp, Homo sapiens
tctcctggtacccttcctagca

SEQ ID NO: 14632 - DNA, 22 bp, Homo sapiens
ggttccacctggcgaggggtat

SEQ ID NO: 14633 - DNA, 22 bp, Homo sapiens
cagatgtacatgaagggcaatg

SEQ ID NO: 14634 - DNA, 22 bp, Homo sapiens
gaggtgtcatcaggcagctctg

SEQ ID NO: 14635 - DNA, 22 bp, Homo sapiens
ggggccgaccgcggttcaggcc

SEQ ID NO: 14636 - DNA, 22 bp, Homo sapiens
tggctaacaaggtgaaaccccg

SEQ ID NO: 14637 - DNA, 22 bp, Homo sapiens
cgagagatgggttggcaggggc

SEQ ID NO: 14638 - DNA, 22 bp, Homo sapiens
gggaaatctcgtcctctattta

SEQ ID NO: 14639 - DNA, 22 bp, Homo sapiens
actgcacttcagcctgggtgac

SEQ ID NO: 14640 - DNA, 19 bp, Homo sapiens
agccccttggtactgtcct

SEQ ID NO: 14641 - DNA, 22 bp, Homo sapiens
gcaggtggatcacctgaggtca

SEQ ID NO: 14642 - DNA, 22 bp, Homo sapiens
gctgctttggaaagcatggaaa

SEQ ID NO: 14643 - DNA, 22 bp, Homo sapiens
cactgcactccagcctgggaga

SEQ ID NO: 14644 - DNA, 22 bp, Homo sapiens
aggcaatcccctgaggatactt

SEQ ID NO: 14645 - DNA, 22 bp, Homo sapiens
tagatgtgttgcctggagttgt

SEQ ID NO: 14646 - DNA, 22 bp, Homo sapiens
gtaatctcagctacttgggagg

SEQ ID NO: 14647 - DNA, 22 bp, Homo sapiens
actgcactccagcctgggtgac

SEQ ID NO: 14648 - DNA, 22 bp, Homo sapiens
caccgcggagtgatggagaaac

SEQ ID NO: 14649 - DNA, 22 bp, Homo sapiens
taaattgagattattagggtaa

SEQ ID NO: 14650 - DNA, 22 bp, Homo sapiens
gcaggtggatcaccacgtcagg

SEQ ID NO: 14651 - DNA, 22 bp, Homo sapiens
tgctgagcgcatccggcggccg

SEQ ID NO: 14652 - DNA, 22 bp, Homo sapiens
cgtggggcgggtggacacttgc

SEQ ID NO: 14653 - DNA, 23 bp, Homo sapiens
aggtaggttattgctgctacctg

SEQ ID NO: 14654 - DNA, 22 bp, Homo sapiens
tcactgcaacctccacctcctg

SEQ ID NO: 14655 - DNA, 18 bp, Homo sapiens
ccctcttgcacaaagcaa

SEQ ID NO: 14656 - DNA, 22 bp, Homo sapiens
cacggtggcccacaggtgcaag

SEQ ID NO: 14657 - DNA, 22 bp, Homo sapiens
gtgtcaggccctgcattatgtg

SEQ ID NO: 14658 - DNA, 22 bp, Homo sapiens
gctgctttgtctgtaaaatgga

SEQ ID NO: 14659 - DNA, 20 bp, Homo sapiens
caaatccctgctctgtgctg

SEQ ID NO: 14660 - DNA, 22 bp, Homo sapiens
gggcaggggtcagtggccccaa

SEQ ID NO: 14661 - DNA, 22 bp, Homo sapiens
aggtggggaggagtgtctcttt

SEQ ID NO: 14662 - DNA, 22 bp, Homo sapiens
attacctatttcattttctgtc

SEQ ID NO: 14663 - DNA, 22 bp, Homo sapiens
ctcattgcaacctccgcctccc

SEQ ID NO: 14664 - DNA, 22 bp, Homo sapiens
agacactgttctcacatgcttg

SEQ ID NO: 14665 - DNA, 18 bp, Homo sapiens
cccggctaatttttggta

SEQ ID NO: 14666 - DNA, 22 bp, Homo sapiens
tggtttgtctaaatgagtaata

SEQ ID NO: 14667 - DNA, 21 bp, Homo sapiens
tgcaatccagcctgggcgaca

SEQ ID NO: 14668 - DNA, 22 bp, Homo sapiens
gaatttcctctaaacccctgag

SEQ ID NO: 14669 - DNA, 22 bp, Homo sapiens
tctcgctctgtcgcccaggctg

SEQ ID NO: 14670 - DNA, 22 bp, Homo sapiens
tgggcaggggccctgcttccgt

SEQ ID NO: 14671 - DNA, 19 bp, Homo sapiens
gcagacaggtccagagagg

SEQ ID NO: 14672 - DNA, 22 bp, Homo sapiens
ggggcaggagcccttcttcagc

SEQ ID NO: 14673 - DNA, 22 bp, Homo sapiens
cgcagggccgcgagcgggacca

SEQ ID NO: 14674 - DNA, 22 bp, Homo sapiens
aaagcctcccaggttatgagta

SEQ ID NO: 14675 - DNA, 22 bp, Homo sapiens
tgtcctcatcctccagtctgtc

SEQ ID NO: 14676 - DNA, 22 bp, Homo sapiens
gaaggaagtcattagtgcagac

SEQ ID NO: 14677 - DNA, 23 bp, Homo sapiens
ttgtcctctggatcggtttggtt

SEQ ID NO: 14678 - DNA, 22 bp, Homo sapiens
aaaggtcaaaatcgtgacattg

SEQ ID NO: 14679 - DNA, 22 bp, Homo sapiens
gttattgaggtggagtctcact

SEQ ID NO: 14680 - DNA, 22 bp, Homo sapiens
aacccgggaggcggaggttgtg

SEQ ID NO: 14681 - DNA, 22 bp, Homo sapiens
tctcgatctcctgaccttgtga

SEQ ID NO: 14682 - DNA, 22 bp, Homo sapiens
tccaagatctacagcagtttag

SEQ ID NO: 14683 - DNA, 22 bp, Homo sapiens
tggtggggccagacttcagctc

SEQ ID NO: 14684 - DNA, 23 bp, Homo sapiens
ctcctggtgctgctatcaggggt

SEQ ID NO: 14685 - DNA, 22 bp, Homo sapiens
actttaaaactgatcatcagag

SEQ ID NO: 14686 - DNA, 22 bp, Homo sapiens
tgcactccaggctgggtgacag

SEQ ID NO: 14687 - DNA, 22 bp, Homo sapiens
ccagatgtccctctcaggtttg

SEQ ID NO: 14688 - DNA, 19 bp, Homo sapiens
tggctctgtcgaaggcaca

SEQ ID NO: 14689 - DNA, 22 bp, Homo sapiens
tgtctttgttattgtggacagg

SEQ ID NO: 14690 - DNA, 22 bp, Homo sapiens
gaccttgtgatccacctgcctt

SEQ ID NO: 14691 - DNA, 21 bp, Homo sapiens
tgtaagtttcatctgaattgg

SEQ ID NO: 14692 - DNA, 22 bp, Homo sapiens
cgcgaggtggaggttgcagtga

SEQ ID NO: 14693 - DNA, 22 bp, Homo sapiens
tctggtgtcagtattctttgaa

SEQ ID NO: 14694 - DNA, 22 bp, Homo sapiens
gatgtgtttccaggatttgttt

SEQ ID NO: 14695 - DNA, 22 bp, Homo sapiens
aagaaatgctgatgttggatgg

SEQ ID NO: 14696 - DNA, 22 bp, Homo sapiens
tgagaattacaaatgagtcaca

SEQ ID NO: 14697 - DNA, 22 bp, Homo sapiens
aggctagaggcttctggcttca

SEQ ID NO: 14698 - DNA, 22 bp, Homo sapiens
tacatagctcctagtgatgcat

SEQ ID NO: 14699 - DNA, 22 bp, Homo sapiens
aagaggttgtctgtgatgagtt

SEQ ID NO: 14700 - DNA, 22 bp, Homo sapiens
tgacagaggagctggaatgatt

SEQ ID NO: 14701 - DNA, 22 bp, Homo sapiens
cactgcactccatcctgggaaa

SEQ ID NO: 14702 - DNA, 22 bp, Homo sapiens
tgctgtgaggttgagaaggaag

SEQ ID NO: 14703 - DNA, 22 bp, Homo sapiens
caggtgttggaagggcagtggg

SEQ ID NO: 14704 - DNA, 22 bp, Homo sapiens
ggctcactgcaacttccgcctc

SEQ ID NO: 14705 - DNA, 22 bp, Homo sapiens
taggctaggctgaaggttttgg

SEQ ID NO: 14706 - DNA, 22 bp, Homo sapiens
ccgcccacactaaatatgagcg

SEQ ID NO: 14707 - DNA, 22 bp, Homo sapiens
gaccttgtgatctgcctgcctt

SEQ ID NO: 14708 - DNA, 22 bp, Homo sapiens
gtttcgtcaggcttattctatc

SEQ ID NO: 14709 - DNA, 22 bp, Homo sapiens
caggaggattgcttgaggccag

SEQ ID NO: 14710 - DNA, 22 bp, Homo sapiens
tatactctgagaaacgtgtcac

SEQ ID NO: 14711 - DNA, 22 bp, Homo sapiens
cacatgaaggctggggtcgtga

SEQ ID NO: 14712 - DNA, 22 bp, Homo sapiens
tttaaaaaactagtctgagtct

SEQ ID NO: 14713 - DNA, 22 bp, Homo sapiens
tagaagaaagtgaagctgggga

SEQ ID NO: 14714 - DNA, 22 bp, Homo sapiens
aggtggagaagagatgggcagt

SEQ ID NO: 14715 - DNA, 22 bp, Homo sapiens
taagtcgtggatgattcttcgg

SEQ ID NO: 14716 - DNA, 22 bp, Homo sapiens
tgtgtcagaaggcaatggggat

SEQ ID NO: 14717 - DNA, 22 bp, Homo sapiens
gggaggttgaggctgcagtgag

SEQ ID NO: 14718 - DNA, 22 bp, Homo sapiens
ggagaagaggagctggaagcct

SEQ ID NO: 14719 - DNA, 22 bp, Homo sapiens
accatgttggccaagctggtct

SEQ ID NO: 14720 - DNA, 22 bp, Homo sapiens
ccaaagaaacccaagctcaggg

SEQ ID NO: 14721 - DNA, 17 bp, Homo sapiens
caggtgttctgtttttc

SEQ ID NO: 14722 - DNA, 22 bp, Homo sapiens
gggagctgagctggaagagaat

SEQ ID NO: 14723 - DNA, 22 bp, Homo sapiens
gtgtgtcccttggaacctcagc

SEQ ID NO: 14724 - DNA, 22 bp, Homo sapiens
cactgcactccagcccgggcaa

SEQ ID NO: 14725 - DNA, 22 bp, Homo sapiens
gtgtgtccaaggcacggatgac

SEQ ID NO: 14726 - DNA, 22 bp, Homo sapiens
cactgcactccagcctgggcaa

SEQ ID NO: 14727 - DNA, 22 bp, Homo sapiens
cgcaggtgaaagaggctgggca

SEQ ID NO: 14728 - DNA, 22 bp, Homo sapiens
catgtgtccacccttgaacaca

SEQ ID NO: 14729 - DNA, 22 bp, Homo sapiens
actgcacttcagcctgggtgtc

SEQ ID NO: 14730 - DNA, 22 bp, Homo sapiens
gggagctggagctggaagactc

SEQ ID NO: 14731 - DNA, 22 bp, Homo sapiens
ggccctggcagccacgaaagcc

SEQ ID NO: 14732 - DNA, 22 bp, Homo sapiens
tcactgcaacctccacctcccg

SEQ ID NO: 14733 - DNA, 22 bp, Homo sapiens
tgtctggtgggttgacaggcag

SEQ ID NO: 14734 - DNA, 22 bp, Homo sapiens
tacaggcatgtagcatggtgat

SEQ ID NO: 14735 - DNA, 22 bp, Homo sapiens
ccggctactcgggaggctgacg

SEQ ID NO: 14736 - DNA, 22 bp, Homo sapiens
cggctcactgcagctccgcctc

SEQ ID NO: 14737 - DNA, 17 bp, Homo sapiens
gggcagggactcctggg

SEQ ID NO: 14738 - DNA, 23 bp, Homo sapiens
tgaatgtttattctcggtgcaga

SEQ ID NO: 14739 - DNA, 22 bp, Homo sapiens
acagattcactgcactggccat

SEQ ID NO: 14740 - DNA, 22 bp, Homo sapiens
ctgcaccgtgtctcgggctgcc

SEQ ID NO: 14741 - DNA, 22 bp, Homo sapiens
actgcactccagcctgggtgat

SEQ ID NO: 14742 - DNA, 22 bp, Homo sapiens
gaggctgaggcaggaggatcac

SEQ ID NO: 14743 - DNA, 22 bp, Homo sapiens
atgtgtcaggtacactcattag

SEQ ID NO: 14744 - DNA, 22 bp, Homo sapiens
ttatttttaaaagttcacacag

SEQ ID NO: 14745 - DNA, 22 bp, Homo sapiens
gacagacacaattgatccatga

SEQ ID NO: 14746 - DNA, 22 bp, Homo sapiens
ctgaagcagggagtgatgaagt

SEQ ID NO: 14747 - DNA, 22 bp, Homo sapiens
acctggacacctgctgtcatct

SEQ ID NO: 14748 - DNA, 23 bp, Homo sapiens
ggagtgcaatggcgccatctcgg

SEQ ID NO: 14749 - DNA, 22 bp, Homo sapiens
gaaacactcaatttagtaattc

SEQ ID NO: 14750 - DNA, 22 bp, Homo sapiens
ttgtgggggctgccctgtacgg

SEQ ID NO: 14751 - DNA, 22 bp, Homo sapiens
tgggcagggagctggaaccaca

SEQ ID NO: 14752 - DNA, 22 bp, Homo sapiens
agggctctgagtgggaaagagg

SEQ ID NO: 14753 - DNA, 22 bp, Homo sapiens
attataggcttgagccaccgtg

SEQ ID NO: 14754 - DNA, 22 bp, Homo sapiens
ttatgatttgccacagattggt

SEQ ID NO: 14755 - DNA, 22 bp, Homo sapiens
ccaccgccatggcgttgtacag

SEQ ID NO: 14756 - DNA, 22 bp, Homo sapiens
tgtctcctcggctgtccagcca

SEQ ID NO: 14757 - DNA, 22 bp, Homo sapiens
ggcagggcaggaaagtcaggaa

SEQ ID NO: 14758 - DNA, 22 bp, Homo sapiens
aacccgggaggtggaggttatg

SEQ ID NO: 14759 - DNA, 22 bp, Homo sapiens
tgacatgtatatcttacgctat

SEQ ID NO: 14760 - DNA, 22 bp, Homo sapiens
gaacactgctgttgggttctga

SEQ ID NO: 14761 - DNA, 22 bp, Homo sapiens
gtccaaaagagccagccgggcg

SEQ ID NO: 14762 - DNA, 22 bp, Homo sapiens
actgcaacacctcctgggttca

SEQ ID NO: 14763 - DNA, 20 bp, Homo sapiens
agcagagtgcccatcccgga

SEQ ID NO: 14764 - DNA, 22 bp, Homo sapiens
ggggtgggcgtgcagggacacc

SEQ ID NO: 14765 - DNA, 22 bp, Homo sapiens
caaatgaatatttccatgggtt

SEQ ID NO: 14766 - DNA, 22 bp, Homo sapiens
tcattgccatggcatttgcaga

SEQ ID NO: 14767 - DNA, 22 bp, Homo sapiens
cactgcacttcagcctgggtga

SEQ ID NO: 14768 - DNA, 22 bp, Homo sapiens
caggaattcatagcattgttct

SEQ ID NO: 14769 - DNA, 22 bp, Homo sapiens
ttggcataccttagtggtggag

SEQ ID NO: 14770 - DNA, 22 bp, Homo sapiens
actttatttcctattgcatcca

SEQ ID NO: 14771 - DNA, 22 bp, Homo sapiens
actggacagaggaaatatggag

SEQ ID NO: 14772 - DNA, 21 bp, Homo sapiens
cgcagagcgaacttgcggcgc

SEQ ID NO: 14773 - DNA, 19 bp, Homo sapiens
atctgccttagtgctgctg

SEQ ID NO: 14774 - DNA, 22 bp, Homo sapiens
tagattcagatatttaggacaa

SEQ ID NO: 14775 - DNA, 22 bp, Homo sapiens
agcataagttggtacagccact

SEQ ID NO: 14776 - DNA, 22 bp, Homo sapiens
tgcaatctcggcactttgggag

SEQ ID NO: 14777 - DNA, 22 bp, Homo sapiens
ttgtatagcccagagagtgaga

SEQ ID NO: 14778 - DNA, 22 bp, Homo sapiens
aggcactgtgcagtcccaagca

SEQ ID NO: 14779 - DNA, 22 bp, Homo sapiens
acgcctgtaatcccagcacttt

SEQ ID NO: 14780 - DNA, 22 bp, Homo sapiens
caagcttgtttctcctgggggt

SEQ ID NO: 14781 - DNA, 22 bp, Homo sapiens
agcgccactgcactccagcctg

SEQ ID NO: 14782 - DNA, 22 bp, Homo sapiens
gggggctccaggcgagaatgtg

SEQ ID NO: 14783 - DNA, 22 bp, Homo sapiens
cactgcactccagcctgggtca

SEQ ID NO: 14784 - DNA, 22 bp, Homo sapiens
tcctggtgctgacacccatagc

SEQ ID NO: 14785 - DNA, 22 bp, Homo sapiens
cacttcaacctctgagtcctgg

SEQ ID NO: 14786 - DNA, 22 bp, Homo sapiens
aatggaatacctaggtggccca

SEQ ID NO: 14787 - DNA, 22 bp, Homo sapiens
aatgaattgcagtactgacttg

SEQ ID NO: 14788 - DNA, 22 bp, Homo sapiens
caggtgtcggtcaggcggtttt

SEQ ID NO: 14789 - DNA, 22 bp, Homo sapiens
aacccgggaggcagaggttgtg

SEQ ID NO: 14790 - DNA, 22 bp, Homo sapiens
ctcttagtaatgccatgaagca

SEQ ID NO: 14791 - DNA, 22 bp, Homo sapiens
gccggggctggggagagacatg

SEQ ID NO: 14792 - DNA, 22 bp, Homo sapiens
tccgggaggcagaggttgcagt

SEQ ID NO: 14793 - DNA, 22 bp, Homo sapiens
tctcctggagcccagatgctgg

SEQ ID NO: 14794 - DNA, 22 bp, Homo sapiens
ttattttaccttcctctgagct

SEQ ID NO: 14795 - DNA, 22 bp, Homo sapiens
tgtattctaaatacatcttacc

SEQ ID NO: 14796 - DNA, 22 bp, Homo sapiens
tatgaggtaggtattatactta

SEQ ID NO: 14797 - DNA, 22 bp, Homo sapiens
cactgcaacctccacctcctgg

SEQ ID NO: 14798 - DNA, 22 bp, Homo sapiens
gattgtggaagtcagtggttct

SEQ ID NO: 14799 - DNA, 20 bp, Homo sapiens
catgtgtcagttctcaccca

SEQ ID NO: 14800 - DNA, 22 bp, Homo sapiens
actgcaacctccacctcctggg

SEQ ID NO: 14801 - DNA, 22 bp, Homo sapiens
tgacatttcctagtgctttgtg

SEQ ID NO: 14802 - DNA, 21 bp, Homo sapiens
agtagtttagcacagggtttg

SEQ ID NO: 14803 - DNA, 22 bp, Homo sapiens
gcagctgacatctggctgggcc

SEQ ID NO: 14804 - DNA, 22 bp, Homo sapiens
atagaatatgacttttagatcc

SEQ ID NO: 14805 - DNA, 22 bp, Homo sapiens
cactgcactccagcctgggtga

SEQ ID NO: 14806 - DNA, 22 bp, Homo sapiens
tacttttagcctatttgattct

SEQ ID NO: 14807 - DNA, 22 bp, Homo sapiens
tgtctggatagagcctaggccc

SEQ ID NO: 14808 - DNA, 22 bp, Homo sapiens
tcctggtgctgacacccatagc

SEQ ID NO: 14809 - DNA, 22 bp, Homo sapiens
gctggaggatggactggaagaa

SEQ ID NO: 14810 - DNA, 22 bp, Homo sapiens
aaagtgctgagattacaagcgt

SEQ ID NO: 14811 - DNA, 22 bp, Homo sapiens
gaggctgcagctatcagacatt

SEQ ID NO: 14812 - DNA, 22 bp, Homo sapiens
ggtgaggggctcctctgcccgg

SEQ ID NO: 14813 - DNA, 22 bp, Homo sapiens
tttctcatggaacatcgtttag

SEQ ID NO: 14814 - DNA, 22 bp, Homo sapiens
tgttgattagtgtttagactta

SEQ ID NO: 14815 - DNA, 22 bp, Homo sapiens
tacagatgaggaaactgaggca

SEQ ID NO: 14816 - DNA, 22 bp, Homo sapiens
caccttactccctctggatgcc

SEQ ID NO: 14817 - DNA, 22 bp, Homo sapiens
atttagaactttgtttgccaat

SEQ ID NO: 14818 - DNA, 22 bp, Homo sapiens
ctggcaggagcattcacagagg

SEQ ID NO: 14819 - DNA, 22 bp, Homo sapiens
gcttccacctactaaatgccac

SEQ ID NO: 14820 - DNA, 22 bp, Homo sapiens
tcccagattcctgctcttatat

SEQ ID NO: 14821 - DNA, 22 bp, Homo sapiens
tctgcaggaagctggcggctga

SEQ ID NO: 14822 - DNA, 22 bp, Homo sapiens
tgagatgaataactcctgctaa

SEQ ID NO: 14823 - DNA, 22 bp, Homo sapiens
cgcggctctgcgggccgctgag

SEQ ID NO: 14824 - DNA, 22 bp, Homo sapiens
tggaagggagctggaatttgga

SEQ ID NO: 14825 - DNA, 22 bp, Homo sapiens
tacatttataaggcttctctgt

SEQ ID NO: 14826 - DNA, 22 bp, Homo sapiens
ccttttatagatcagtgtgtta

SEQ ID NO: 14827 - DNA, 22 bp, Homo sapiens
tcaggaggtccgcccgggaggg

SEQ ID NO: 14828 - DNA, 22 bp, Homo sapiens
ttgtgtgtactggttatgggca

SEQ ID NO: 14829 - DNA, 22 bp, Homo sapiens
ggagaagcagcttcttgatgaa

SEQ ID NO: 14830 - DNA, 22 bp, Homo sapiens
gagcactgatttatttttgtct

SEQ ID NO: 14831 - DNA, 22 bp, Homo sapiens
tgtggactggcgggacgcaatg

SEQ ID NO: 14832 - DNA, 22 bp, Homo sapiens
ggaggcagaatagagtgtgggt

SEQ ID NO: 14833 - DNA, 17 bp, Homo sapiens
gggcagggactcctggg

SEQ ID NO: 14834 - DNA, 22 bp, Homo sapiens
aactcactttgtggcttctgaa

SEQ ID NO: 14835 - DNA, 22 bp, Homo sapiens
tttaatcaggcaaagcataata

SEQ ID NO: 14836 - DNA, 22 bp, Homo sapiens
tttcttctatgtgtgatatttt

SEQ ID NO: 14837 - DNA, 23 bp, Homo sapiens
tctgtgtctccacccaaatctca

SEQ ID NO: 14838 - DNA, 22 bp, Homo sapiens
caggctggagtgcaatgacgcc

SEQ ID NO: 14839 - DNA, 22 bp, Homo sapiens
gagctgggcctgcgagtgctgc

SEQ ID NO: 14840 - DNA, 22 bp, Homo sapiens
gggctctcccacaacgtgccag

SEQ ID NO: 14841 - DNA, 22 bp, Homo sapiens
tctagttctagatccctgagga

SEQ ID NO: 14842 - DNA, 22 bp, Homo sapiens
aggggatggagctggaaggcag

SEQ ID NO: 14843 - DNA, 22 bp, Homo sapiens
ccaggaggttgaggctgcagtg

SEQ ID NO: 14844 - DNA, 22 bp, Homo sapiens
tctctatttgcctaggcttgtg

SEQ ID NO: 14845 - DNA, 22 bp, Homo sapiens
agccttacataaacagccttat

SEQ ID NO: 14846 - DNA, 22 bp, Homo sapiens
gcaggtggatcaccacgtcagg

SEQ ID NO: 14847 - DNA, 22 bp, Homo sapiens
tcacagacccttgctgagctct

SEQ ID NO: 14848 - DNA, 22 bp, Homo sapiens
tttctcggcagagatgatgggc

SEQ ID NO: 14849 - DNA, 22 bp, Homo sapiens
ctagttctagatccctgaggaa

SEQ ID NO: 14850 - DNA, 22 bp, Homo sapiens
accgggaagtcctgcactgggc

SEQ ID NO: 14851 - DNA, 22 bp, Homo sapiens
tagcataacaggtaagagtgag

SEQ ID NO: 14852 - DNA, 22 bp, Homo sapiens
aggtggggaggagtgtctcttt

SEQ ID NO: 14853 - DNA, 17 bp, Homo sapiens
gcgtggagttggtgcgc

SEQ ID NO: 14854 - DNA, 22 bp, Homo sapiens
ggcgtggggccttctgcccgct

SEQ ID NO: 14855 - DNA, 22 bp, Homo sapiens
ctgcagtctacctggattttta

SEQ ID NO: 14856 - DNA, 22 bp, Homo sapiens
ctggcaggtggaggttgcagtg

SEQ ID NO: 14857 - DNA, 22 bp, Homo sapiens
tcgagctctggagccaaggatg

SEQ ID NO: 14858 - DNA, 22 bp, Homo sapiens
ccaggagttggaagctgccatg

SEQ ID NO: 14859 - DNA, 22 bp, Homo sapiens
ggctgggcctctccctcagctg

SEQ ID NO: 14860 - DNA, 22 bp, Homo sapiens
agaggctgcacttgctcatgat

SEQ ID NO: 14861 - DNA, 22 bp, Homo sapiens
gaggtggctgcttgctgggaaa

SEQ ID NO: 14862 - DNA, 22 bp, Homo sapiens
cagcctgtagtctggtccaggt

SEQ ID NO: 14863 - DNA, 22 bp, Homo sapiens
gctcgcgccgcaccggtccacc

SEQ ID NO: 14864 - DNA, 22 bp, Homo sapiens
agctggggctgtggttgtgatt

SEQ ID NO: 14865 - DNA, 22 bp, Homo sapiens
agccttcggccagagggtggcc

SEQ ID NO: 14866 - DNA, 22 bp, Homo sapiens
gtcccataagtagtgcaacttg

SEQ ID NO: 14867 - DNA, 22 bp, Homo sapiens
gcaagacctatctagttgctgt

SEQ ID NO: 14868 - DNA, 22 bp, Homo sapiens
ccttggcaggcacgtcctgcgg

SEQ ID NO: 14869 - DNA, 22 bp, Homo sapiens
gtagggttggagagcacaacca

SEQ ID NO: 14870 - DNA, 22 bp, Homo sapiens
cgtctctggcccggcccctggg

SEQ ID NO: 14871 - DNA, 22 bp, Homo sapiens
ggtgatccaccagcctcggcct

SEQ ID NO: 14872 - DNA, 22 bp, Homo sapiens
catataaatacaacatgtgtta

SEQ ID NO: 14873 - DNA, 22 bp, Homo sapiens
tccccagcttgctacttctgct

SEQ ID NO: 14874 - DNA, 22 bp, Homo sapiens
agggccagcactcctggcagga

SEQ ID NO: 14875 - DNA, 22 bp, Homo sapiens
tctcctggtacccttcctagca

SEQ ID NO: 14876 - DNA, 22 bp, Homo sapiens
gcccagccacagtcactttcat

SEQ ID NO: 14877 - DNA, 22 bp, Homo sapiens
aggccagcagcatgacggcatc

SEQ ID NO: 14878 - DNA, 22 bp, Homo sapiens
agccacacttgccaggggaagg

SEQ ID NO: 14879 - DNA, 22 bp, Homo sapiens
gtagtctgaacagtaattttgt

SEQ ID NO: 14880 - DNA, 22 bp, Homo sapiens
ggctgcaggttggttggcagct

SEQ ID NO: 14881 - DNA, 22 bp, Homo sapiens
agtggagcttttcctatcagag

SEQ ID NO: 14882 - DNA, 23 bp, Homo sapiens
ccagtgattgcctggaaggaggt

SEQ ID NO: 14883 - DNA, 22 bp, Homo sapiens
ggcccaggctggagtgcagtgg

SEQ ID NO: 14884 - DNA, 22 bp, Homo sapiens
ctctggagtgtctggccagggt

SEQ ID NO: 14885 - DNA, 22 bp, Homo sapiens
aagacccacaaggctgaatgtt

SEQ ID NO: 14886 - DNA, 22 bp, Homo sapiens
gtggatggagctggaagccatt

SEQ ID NO: 14887 - DNA, 22 bp, Homo sapiens
attcacagggggagaagggtat

SEQ ID NO: 14888 - DNA, 22 bp, Homo sapiens
caggaattcatagcattgttct

SEQ ID NO: 14889 - DNA, 22 bp, Homo sapiens
gagtggggggtccgtctcagtg

SEQ ID NO: 14890 - DNA, 22 bp, Homo sapiens
caggcactgtgctgagctctgc

SEQ ID NO: 14891 - DNA, 22 bp, Homo sapiens
tgctgggggtagctctgcgtag

SEQ ID NO: 14892 - DNA, 23 bp, Homo sapiens
aggtaggttattgctgctacctg

SEQ ID NO: 14893 - DNA, 21 bp, Homo sapiens
agggttttatagatctcttcc

SEQ ID NO: 14894 - DNA, 22 bp, Homo sapiens
tagatacctgctggacctcatt

SEQ ID NO: 14895 - DNA, 22 bp, Homo sapiens
gcaggctgtctaaagttagagt

SEQ ID NO: 14896 - DNA, 22 bp, Homo sapiens
ttaataaagtatgaattggaaa

SEQ ID NO: 14897 - DNA, 22 bp, Homo sapiens
ctcctctttagccccagctgga

SEQ ID NO: 14898 - DNA, 22 bp, Homo sapiens
ggaggtggaggttgcagtgagc

SEQ ID NO: 14899 - DNA, 22 bp, Homo sapiens
ggaggcggaggttgcagtgagt

SEQ ID NO: 14900 - DNA, 22 bp, Homo sapiens
aggcgaagggaccagacggtag

SEQ ID NO: 14901 - DNA, 22 bp, Homo sapiens
caggtgagaggcggtcctgcat

SEQ ID NO: 14902 - DNA, 22 bp, Homo sapiens
cccagggaggcccaggctctgc

SEQ ID NO: 14903 - DNA, 16 bp, Homo sapiens
gcagaggaaaggggag

SEQ ID NO: 14904 - DNA, 22 bp, Homo sapiens
gaggtaggtgtaggaggcctgc

SEQ ID NO: 14905 - DNA, 22 bp, Homo sapiens
tcttcctggatgggggttgatg

SEQ ID NO: 14906 - DNA, 22 bp, Homo sapiens
ttgttcttgtctttgccttcac

SEQ ID NO: 14907 - DNA, 22 bp, Homo sapiens
gcccagcccagaaaggttcgga

SEQ ID NO: 14908 - DNA, 22 bp, Homo sapiens
taagggttcagaatgcagtggt

SEQ ID NO: 14909 - DNA, 22 bp, Homo sapiens
ttcttctttccaattacatggt

SEQ ID NO: 14910 - DNA, 20 bp, Homo sapiens
gaaatgtacacattaccaca

SEQ ID NO: 14911 - DNA, 22 bp, Homo sapiens
tgagctgacacccaatcatact

SEQ ID NO: 14912 - DNA, 22 bp, Homo sapiens
tttataatagatttggggcggc

SEQ ID NO: 14913 - DNA, 22 bp, Homo sapiens
gggccccaagaacctcctcctg

SEQ ID NO: 14914 - DNA, 22 bp, Homo sapiens
ttttcatttttgtagatgcaag

SEQ ID NO: 14915 - DNA, 22 bp, Homo sapiens
tgatctttggtaatctggcaca

SEQ ID NO: 14916 - DNA, 22 bp, Homo sapiens
ctgggcagctgtatcagggagt

SEQ ID NO: 14917 - DNA, 22 bp, Homo sapiens
ggctcacgcaattatcccggcc

SEQ ID NO: 14918 - DNA, 22 bp, Homo sapiens
gggagctgaaggagccggcggg

SEQ ID NO: 14919 - DNA, 23 bp, Homo sapiens
gcgtccggcctctctcgctcccg

SEQ ID NO: 14920 - DNA, 22 bp, Homo sapiens
aattacagtcggagcagcactg

SEQ ID NO: 14921 - DNA, 22 bp, Homo sapiens
acccagggctcaagcgtaggca

SEQ ID NO: 14922 - DNA, 22 bp, Homo sapiens
agctacctgatccttcttctga

SEQ ID NO: 14923 - DNA, 22 bp, Homo sapiens
atatgcagtctcttgcccttct

SEQ ID NO: 14924 - DNA, 22 bp, Homo sapiens
ccaggtgtgctctgcagtggat

SEQ ID NO: 14925 - DNA, 22 bp, Homo sapiens
ctgcgggctgtcaggcgtgcca

SEQ ID NO: 14926 - DNA, 22 bp, Homo sapiens
tgggcagggagctggaaccaca

SEQ ID NO: 14927 - DNA, 16 bp, Homo sapiens
aggtggagaagttcac

SEQ ID NO: 14928 - DNA, 20 bp, Homo sapiens
agcagagtgcccatcccgga

SEQ ID NO: 14929 - DNA, 22 bp, Homo sapiens
aggccaggaatccttgtcccag

SEQ ID NO: 14930 - DNA, 22 bp, Homo sapiens
gggggagagacgagcggctctg

SEQ ID NO: 14931 - DNA, 22 bp, Homo sapiens
ggaggagcatgagagggtagtg

SEQ ID NO: 14932 - DNA, 22 bp, Homo sapiens
agtgcaggccccaggccaggcc

SEQ ID NO: 14933 - DNA, 22 bp, Homo sapiens
agaggaagtaatcaggacctgc

SEQ ID NO: 14934 - DNA, 21 bp, Homo sapiens
tggcggggacttgtggctgcc

SEQ ID NO: 14935 - DNA, 22 bp, Homo sapiens
gggagctgagctggaagagaat

SEQ ID NO: 14936 - DNA, 22 bp, Homo sapiens
cattgcaacttcaaactcctgg

SEQ ID NO: 14937 - DNA, 23 bp, Homo sapiens
tgctggagaagcaaagttctgag

SEQ ID NO: 14938 - DNA, 22 bp, Homo sapiens
cttttcattgtttgtacatgca

SEQ ID NO: 14939 - DNA, 22 bp, Homo sapiens
agccagggtctctcgctctgtt

SEQ ID NO: 14940 - DNA, 22 bp, Homo sapiens
tgccaccccggaccccgaagtg

SEQ ID NO: 14941 - DNA, 22 bp, Homo sapiens
ttcagacatgcaggctgaggct

SEQ ID NO: 14942 - DNA, 22 bp, Homo sapiens
cctgggccctcaccgccggtgg

SEQ ID NO: 14943 - DNA, 22 bp, Homo sapiens
gggccctgggattcagagcaag

SEQ ID NO: 14944 - DNA, 22 bp, Homo sapiens
gggagtgggtttggcctaggcc

SEQ ID NO: 14945 - DNA, 22 bp, Homo sapiens
actagaaagaagttttttgaga

SEQ ID NO: 14946 - DNA, 22 bp, Homo sapiens
ttcttttaattgtgggggagtg

SEQ ID NO: 14947 - DNA, 22 bp, Homo sapiens
tgtgaagatagctgttacatct

SEQ ID NO: 14948 - DNA, 22 bp, Homo sapiens
taaaatttgtccctgagtgttg

SEQ ID NO: 14949 - DNA, 22 bp, Homo sapiens
tcagggctgcagaagaggcagg

SEQ ID NO: 14950 - DNA, 22 bp, Homo sapiens
ttggccttagcttcttcttaaa

SEQ ID NO: 14951 - DNA, 21 bp, Homo sapiens
ggccccgcagacccagcacgt

SEQ ID NO: 14952 - DNA, 22 bp, Homo sapiens
gaatttcctctaaacccctgag

SEQ ID NO: 14953 - DNA, 22 bp, Homo sapiens
ccgggcgggggctctcgtcacc

SEQ ID NO: 14954 - DNA, 22 bp, Homo sapiens
ggggccgaccgcggttcaggcc

SEQ ID NO: 14955 - DNA, 22 bp, Homo sapiens
tttgaagactactgggagtgaa

SEQ ID NO: 14956 - DNA, 22 bp, Homo sapiens
ctgaaggatgtgtggtgggagt

SEQ ID NO: 14957 - DNA, 22 bp, Homo sapiens
tagaaaagccccagctggaggg

SEQ ID NO: 14958 - DNA, 22 bp, Homo sapiens
cagagcccctcgtctccaccac

SEQ ID NO: 14959 - DNA, 22 bp, Homo sapiens
tggccttggccgtgctggggtc

SEQ ID NO: 14960 - DNA, 22 bp, Homo sapiens
cttagatgaagtcacagaaccc

SEQ ID NO: 14961 - DNA, 21 bp, Homo sapiens
acacaggcagtgtcccgaggt

SEQ ID NO: 14962 - DNA, 22 bp, Homo sapiens
agggttgcaccatgttggtcag

SEQ ID NO: 14963 - DNA, 23 bp, Homo sapiens
tcggtgggcgtggaggccgaggc

SEQ ID NO: 14964 - DNA, 22 bp, Homo sapiens
aactatgttaataagtttcatt

SEQ ID NO: 14965 - DNA, 18 bp, Homo sapiens
tcctttctccctcatctt

SEQ ID NO: 14966 - DNA, 22 bp, Homo sapiens
aacccacaaaggatttcagctc

SEQ ID NO: 14967 - DNA, 22 bp, Homo sapiens
gggtggtggccagcagtgggca

SEQ ID NO: 14968 - DNA, 22 bp, Homo sapiens
tgaactcctgacctcatgatcc

SEQ ID NO: 14969 - DNA, 22 bp, Homo sapiens
ggagcagggaattacagcgcag

SEQ ID NO: 14970 - DNA, 22 bp, Homo sapiens
gtgggctgcccttgaggtcagc

SEQ ID NO: 14971 - DNA, 22 bp, Homo sapiens
gagtcgagcagaaagccgtcgg

SEQ ID NO: 14972 - DNA, 22 bp, Homo sapiens
ggaggtgggctaaggactctct

SEQ ID NO: 14973 - DNA, 22 bp, Homo sapiens
caggtgcctcaggatgagacaa

SEQ ID NO: 14974 - DNA, 22 bp, Homo sapiens
aggtctgtttaacaaagtcagg

SEQ ID NO: 14975 - DNA, 22 bp, Homo sapiens
gaggctgaggttgcagtgagct

SEQ ID NO: 14976 - DNA, 18 bp, Homo sapiens
cagggctgtggggtcact

SEQ ID NO: 14977 - DNA, 22 bp, Homo sapiens
gcaggcagatcacctgtcagga

SEQ ID NO: 14978 - DNA, 22 bp, Homo sapiens
ttagatttgtagtgagttcaga

SEQ ID NO: 14979 - DNA, 18 bp, Homo sapiens
tctggaacaacttcatgt

SEQ ID NO: 14980 - DNA, 22 bp, Homo sapiens
gtggggcctgtggcttccgtgg

SEQ ID NO: 14981 - DNA, 22 bp, Homo sapiens
atacaaagtattaatcctggat

SEQ ID NO: 14982 - DNA, 22 bp, Homo sapiens
ccacgtccagctaattttcgta

SEQ ID NO: 14983 - DNA, 22 bp, Homo sapiens
aaaaagtattggccatggttga

SEQ ID NO: 14984 - DNA, 21 bp, Homo sapiens
gaacccagcagcagtgctctg

SEQ ID NO: 14985 - DNA, 19 bp, Homo sapiens
gcctcatttccacctcccc

SEQ ID NO: 14986 - DNA, 22 bp, Homo sapiens
gaggtggatgttgcagtgagct

SEQ ID NO: 14987 - DNA, 22 bp, Homo sapiens
taaatgttttgtgggttgagtt

SEQ ID NO: 14988 - DNA, 22 bp, Homo sapiens
cctgggaggctgaggctgcagt

SEQ ID NO: 14989 - DNA, 22 bp, Homo sapiens
accagcacttccagaggtcagg

SEQ ID NO: 14990 - DNA, 22 bp, Homo sapiens
cagtggccaacttcctgcctct

SEQ ID NO: 14991 - DNA, 22 bp, Homo sapiens
ggccagcctggggctcccagac

SEQ ID NO: 14992 - DNA, 22 bp, Homo sapiens
gcaggtggatcacctgaggtca

SEQ ID NO: 14993 - DNA, 22 bp, Homo sapiens
gggcggggggagctggaatgaa

SEQ ID NO: 14994 - DNA, 22 bp, Homo sapiens
attctacatgatagaagggaga

SEQ ID NO: 14995 - DNA, 22 bp, Homo sapiens
ctggctgggagcgagctgctca

SEQ ID NO: 14996 - DNA, 22 bp, Homo sapiens
gggcactcctctggtccagccc

SEQ ID NO: 14997 - DNA, 16 bp, Homo sapiens
aggctcagaggctgga

SEQ ID NO: 14998 - DNA, 17 bp, Homo sapiens
ttgaatgcattacttgg

SEQ ID NO: 14999 - DNA, 22 bp, Homo sapiens
ttattgaaggaactgaaataaa

SEQ ID NO: 15000 - DNA, 22 bp, Homo sapiens
tgggaaggggagctggaaagga

SEQ ID NO: 15001 - DNA, 20 bp, Homo sapiens
ctgggtggcaagcaaggggg

SEQ ID NO: 15002 - DNA, 22 bp, Homo sapiens
ggggtctgggcttagctggaat

SEQ ID NO: 15003 - DNA, 22 bp, Homo sapiens
tcacaacgcctctgcaaatcct

SEQ ID NO: 15004 - DNA, 22 bp, Homo sapiens
taggcccctagtgccacgtggc

SEQ ID NO: 15005 - DNA, 22 bp, Homo sapiens
caggctggagttcagtggtgtg

SEQ ID NO: 15006 - DNA, 22 bp, Homo sapiens
gtgggacaggtcaaatcttaaa

SEQ ID NO: 15007 - DNA, 22 bp, Homo sapiens
cgcgctgcagacagcggaggcc

SEQ ID NO: 15008 - DNA, 21 bp, Homo sapiens
tgtaagtttcatctgaattgg

SEQ ID NO: 15009 - DNA, 22 bp, Homo sapiens
cactgcagcctctgcctctcag

SEQ ID NO: 15010 - DNA, 22 bp, Homo sapiens
caagaatcaacattatttagtg

SEQ ID NO: 15011 - DNA, 22 bp, Homo sapiens
gcgtggcttagagtggggtacc

SEQ ID NO: 15012 - DNA, 22 bp, Homo sapiens
ttgtgttaaggtgcatctagtg

SEQ ID NO: 15013 - DNA, 22 bp, Homo sapiens
aagatgcggttgaccatggtgt

SEQ ID NO: 15014 - DNA, 22 bp, Homo sapiens
tctggtgtcagtattctttgaa

SEQ ID NO: 15015 - DNA, 21 bp, Homo sapiens
gcagcagtgttctagaatact

SEQ ID NO: 15016 - DNA, 22 bp, Homo sapiens
tctgttgcaatgtgcatggtga

SEQ ID NO: 15017 - DNA, 22 bp, Homo sapiens
agagggtgggcacgtgatggat

SEQ ID NO: 15018 - DNA, 22 bp, Homo sapiens
tccggcggccggcctgagcccg

SEQ ID NO: 15019 - DNA, 22 bp, Homo sapiens
ggggatggaggcgtgtggtcct

SEQ ID NO: 15020 - DNA, 19 bp, Homo sapiens
gccgggcccgggttggccg

SEQ ID NO: 15021 - DNA, 22 bp, Homo sapiens
tggaatggaaacaaactgagga

SEQ ID NO: 15022 - DNA, 22 bp, Homo sapiens
gactgtggggaagcagatgcca

SEQ ID NO: 15023 - DNA, 22 bp, Homo sapiens
aaggggtgagcagaggcttcgc

SEQ ID NO: 15024 - DNA, 22 bp, Homo sapiens
ggccactgctctccagcctggg

SEQ ID NO: 15025 - DNA, 22 bp, Homo sapiens
ttgtgagtagtgccgcaataaa

SEQ ID NO: 15026 - DNA, 22 bp, Homo sapiens
ataatacatggttgatcttttc

SEQ ID NO: 15027 - DNA, 22 bp, Homo sapiens
cctggggccccgagccagaagc

SEQ ID NO: 15028 - DNA, 22 bp, Homo sapiens
ggcgtgggcgaggtgctctatc

SEQ ID NO: 15029 - DNA, 22 bp, Homo sapiens
cagagggttgatgtgaggctta

SEQ ID NO: 15030 - DNA, 22 bp, Homo sapiens
gggctagcctcttccctgctcc

SEQ ID NO: 15031 - DNA, 23 bp, Homo sapiens
ggctgggagctccgggtgcacgt

SEQ ID NO: 15032 - DNA, 23 bp, Homo sapiens
cagggccctgctcaatttctcca

SEQ ID NO: 15033 - DNA, 22 bp, Homo sapiens
gcgggcgggggttcccaggtct

SEQ ID NO: 15034 - DNA, 22 bp, Homo sapiens
cagccccatggtgtgctccagc

SEQ ID NO: 15035 - DNA, 22 bp, Homo sapiens
ttgtgaaacattcatggatttg

SEQ ID NO: 15036 - DNA, 22 bp, Homo sapiens
ggaggctgaggcaggcggatca

SEQ ID NO: 15037 - DNA, 22 bp, Homo sapiens
gaggggctgccctggtgtcagg

SEQ ID NO: 15038 - DNA, 22 bp, Homo sapiens
catgctgtgtgttttagctcca

SEQ ID NO: 15039 - DNA, 18 bp, Homo sapiens
cagctgccagctcatgga

SEQ ID NO: 15040 - DNA, 22 bp, Homo sapiens
gagacctcttggtatcgctagg

SEQ ID NO: 15041 - DNA, 22 bp, Homo sapiens
tggtgccatcatagctcactgc

SEQ ID NO: 15042 - DNA, 22 bp, Homo sapiens
gtatagaaacccagaaagatag

SEQ ID NO: 15043 - DNA, 22 bp, Homo sapiens
atccatttgacataatttcagc

SEQ ID NO: 15044 - DNA, 22 bp, Homo sapiens
cctcggggcaccgcggcctgct

SEQ ID NO: 15045 - DNA, 22 bp, Homo sapiens
ggaggcccagaaggaagcccag

SEQ ID NO: 15046 - DNA, 22 bp, Homo sapiens
cctcagacccctgctgagcttc

SEQ ID NO: 15047 - DNA, 22 bp, Homo sapiens
actgtactccagcctggtggca

SEQ ID NO: 15048 - DNA, 22 bp, Homo sapiens
caaagtgggtgccctgatgctc

SEQ ID NO: 15049 - DNA, 22 bp, Homo sapiens
atgccactgcacttcagcctgg

SEQ ID NO: 15050 - DNA, 22 bp, Homo sapiens
tgggcaggggccctgcttccgt

SEQ ID NO: 15051 - DNA, 22 bp, Homo sapiens
ttcatatttctttaaggacttt

SEQ ID NO: 15052 - DNA, 20 bp, Homo sapiens
ttgagcagcagtgctgtgtc

SEQ ID NO: 15053 - DNA, 23 bp, Homo sapiens
cccagaccttgtgctgcccttgg

SEQ ID NO: 15054 - DNA, 22 bp, Homo sapiens
tagcacagagcttttaaacttc

SEQ ID NO: 15055 - DNA, 22 bp, Homo sapiens
cagagctgtccaaaccctgaca

SEQ ID NO: 15056 - DNA, 22 bp, Homo sapiens
cagcagcattgctctggattcc

SEQ ID NO: 15057 - DNA, 22 bp, Homo sapiens
ggaggtcccaggcctggcagca

SEQ ID NO: 15058 - DNA, 20 bp, Homo sapiens
caaatccctgctctgtgctg

SEQ ID NO: 15059 - DNA, 22 bp, Homo sapiens
cgctgataaacgtcacgttccc

SEQ ID NO: 15060 - DNA, 22 bp, Homo sapiens
gatagtcacctcccttaacttt

SEQ ID NO: 15061 - DNA, 22 bp, Homo sapiens
tggccgggaagggacagtgtgg

SEQ ID NO: 15062 - DNA, 22 bp, Homo sapiens
gaaggaccctctggggtctcag

SEQ ID NO: 15063 - DNA, 22 bp, Homo sapiens
cgcccaggctggagagcagtgg

SEQ ID NO: 15064 - DNA, 22 bp, Homo sapiens
ggggcagagaataaaaacctaa

SEQ ID NO: 15065 - DNA, 22 bp, Homo sapiens
aggaaataagggacaagacaaa

SEQ ID NO: 15066 - DNA, 22 bp, Homo sapiens
tcagtggagagcttccaggatt

SEQ ID NO: 15067 - DNA, 22 bp, Homo sapiens
aaagtgctgggattacaagcgt

SEQ ID NO: 15068 - DNA, 22 bp, Homo sapiens
caggctggagtgcagtggcgct

SEQ ID NO: 15069 - DNA, 22 bp, Homo sapiens
ggtggcagtagcactgggcctg

SEQ ID NO: 15070 - DNA, 22 bp, Homo sapiens
ggagtgaagtggcgcgatctcg

SEQ ID NO: 15071 - DNA, 19 bp, Homo sapiens
tgagggtgagctttggaga

SEQ ID NO: 15072 - DNA, 22 bp, Homo sapiens
ctggagggctgcagcgaggctg

SEQ ID NO: 15073 - DNA, 22 bp, Homo sapiens
gagggagggactagcattctct

SEQ ID NO: 15074 - DNA, 22 bp, Homo sapiens
ttgcactccagtctgggaacaa

SEQ ID NO: 15075 - DNA, 22 bp, Homo sapiens
gccatcatatcccctgtgacct

SEQ ID NO: 15076 - DNA, 22 bp, Homo sapiens
cgcgctctccttctggcaccca

SEQ ID NO: 15077 - DNA, 22 bp, Homo sapiens
cgaggaggaaacgcggagaact

SEQ ID NO: 15078 - DNA, 22 bp, Homo sapiens
cccgggaggtggaggttgcagt

SEQ ID NO: 15079 - DNA, 22 bp, Homo sapiens
ggccctggcagccacgaaagcc

SEQ ID NO: 15080 - DNA, 22 bp, Homo sapiens
tctcagggctcagagctcaggc

SEQ ID NO: 15081 - DNA, 22 bp, Homo sapiens
ctacattaaattggcttactta

SEQ ID NO: 15082 - DNA, 22 bp, Homo sapiens
gagcctggagctggaacgaagc

SEQ ID NO: 15083 - DNA, 22 bp, Homo sapiens
aagaaatgtgaatattgaatag

SEQ ID NO: 15084 - DNA, 22 bp, Homo sapiens
cccaggaggcagaagttgcagt

SEQ ID NO: 15085 - DNA, 20 bp, Homo sapiens
gggcagagccagccagtccc

SEQ ID NO: 15086 - DNA, 22 bp, Homo sapiens
tgagcttgcagtgccagccttg

SEQ ID NO: 15087 - DNA, 22 bp, Homo sapiens
cgcggaggaggtcaggaggtga

SEQ ID NO: 15088 - DNA, 19 bp, Homo sapiens
acccagcccaggagtggca

SEQ ID NO: 15089 - DNA, 22 bp, Homo sapiens
tccacgctgtgtgaccttgggc

SEQ ID NO: 15090 - DNA, 22 bp, Homo sapiens
tttttgggtccaggctgtatct

SEQ ID NO: 15091 - DNA, 22 bp, Homo sapiens
gcgaggaggggtgctgggcccc

SEQ ID NO: 15092 - DNA, 22 bp, Homo sapiens
tggaaacacccacgcatgcata

SEQ ID NO: 15093 - DNA, 20 bp, Homo sapiens
tgcagcacgggccctttcca

SEQ ID NO: 15094 - DNA, 22 bp, Homo sapiens
ggagagggtaggggtcctgccc

SEQ ID NO: 15095 - DNA, 22 bp, Homo sapiens
ttggagatatcacaccttcaca

SEQ ID NO: 15096 - DNA, 22 bp, Homo sapiens
aaacccagggttttgtcttccc

SEQ ID NO: 15097 - DNA, 22 bp, Homo sapiens
ttatgatttgccacagattggt

SEQ ID NO: 15098 - DNA, 22 bp, Homo sapiens
atcaacatgtcataaagtgaaa

SEQ ID NO: 15099 - DNA, 22 bp, Homo sapiens
cactgcaccctcaaactcctgg

SEQ ID NO: 15100 - DNA, 22 bp, Homo sapiens
agggcgacaatggagagcgttt

SEQ ID NO: 15101 - DNA, 22 bp, Homo sapiens
cactgcactccagcctgggtca

SEQ ID NO: 15102 - DNA, 22 bp, Homo sapiens
tttggactgcatgatgatctgg

SEQ ID NO: 15103 - DNA, 22 bp, Homo sapiens
cagggtgctgcaccatccctca

SEQ ID NO: 15104 - DNA, 22 bp, Homo sapiens
gtaggccatggtggttgtctct

SEQ ID NO: 15105 - DNA, 22 bp, Homo sapiens
ggccaattccaggagccggcgg

SEQ ID NO: 15106 - DNA, 22 bp, Homo sapiens
ggcctctgccccgcggggctcg

SEQ ID NO: 15107 - DNA, 22 bp, Homo sapiens
tgtgggagaaggaagcaagctg

SEQ ID NO: 15108 - DNA, 20 bp, Homo sapiens
aactcctagcctcaagtgat

SEQ ID NO: 15109 - DNA, 22 bp, Homo sapiens
actccacatttgaacacagttc

SEQ ID NO: 15110 - DNA, 22 bp, Homo sapiens
gctggccacagatccccaggga

SEQ ID NO: 15111 - DNA, 22 bp, Homo sapiens
tgtgggtggcatcgtcctggcc

SEQ ID NO: 15112 - DNA, 22 bp, Homo sapiens
caggagtgtctccacacagcaa

SEQ ID NO: 15113 - DNA, 22 bp, Homo sapiens
tgctgagcgcatccggcggccg

SEQ ID NO: 15114 - DNA, 22 bp, Homo sapiens
gggctgggattgcttgctgtga

SEQ ID NO: 15115 - DNA, 22 bp, Homo sapiens
gaggaggcttccgggaggcacg

SEQ ID NO: 15116 - DNA, 22 bp, Homo sapiens
actgtactccagcctgggagac

SEQ ID NO: 15117 - DNA, 22 bp, Homo sapiens
ctgaggagaggtggcctgtgtt

SEQ ID NO: 15118 - DNA, 22 bp, Homo sapiens
agagcacagggttttgtgccgg

SEQ ID NO: 15119 - DNA, 22 bp, Homo sapiens
agagcgagtctggggctcggat

SEQ ID NO: 15120 - DNA, 22 bp, Homo sapiens
ggctctgcgcctgcggggactt

SEQ ID NO: 15121 - DNA, 22 bp, Homo sapiens
agggggctccttggtgtgcaga

SEQ ID NO: 15122 - DNA, 22 bp, Homo sapiens
ggaagggcaaaagagatgaact

SEQ ID NO: 15123 - DNA, 22 bp, Homo sapiens
gtagaccatttatctggggagt

SEQ ID NO: 15124 - DNA, 22 bp, Homo sapiens
cgtgaggggggtaaggcgtccg

SEQ ID NO: 15125 - DNA, 22 bp, Homo sapiens
ggaactcctgctccaagcagct

SEQ ID NO: 15126 - DNA, 22 bp, Homo sapiens
agggcagagctgtctaaatggc

SEQ ID NO: 15127 - DNA, 22 bp, Homo sapiens
cactgcacttcagcctgggtga

SEQ ID NO: 15128 - DNA, 22 bp, Homo sapiens
aagaataagaggatttagaaca

SEQ ID NO: 15129 - DNA, 22 bp, Homo sapiens
catttctgggagacatgctaga

SEQ ID NO: 15130 - DNA, 18 bp, Homo sapiens
ggtgagggagctggaagc

SEQ ID NO: 15131 - DNA, 22 bp, Homo sapiens
agagtggagagaaacaactctg

SEQ ID NO: 15132 - DNA, 22 bp, Homo sapiens
ctagagtgcaggtgtatggtta

SEQ ID NO: 15133 - DNA, 21 bp, Homo sapiens
cggaaaggactagggctcaga

SEQ ID NO: 15134 - DNA, 22 bp, Homo sapiens
aggcaaggtgctacagacagtg

SEQ ID NO: 15135 - DNA, 22 bp, Homo sapiens
gtgtgggctgcagaggcacagc

SEQ ID NO: 15136 - DNA, 22 bp, Homo sapiens
ggttgctgggggtggcagagct

SEQ ID NO: 15137 - DNA, 22 bp, Homo sapiens
tcccagagctctggaggttgga

SEQ ID NO: 15138 - DNA, 21 bp, Homo sapiens
acatggactgtgaatggggac

SEQ ID NO: 15139 - DNA, 22 bp, Homo sapiens
cctgtacttgtattaaaggtcc

SEQ ID NO: 15140 - DNA, 22 bp, Homo sapiens
ttgagtttcctgacagcgaagg

SEQ ID NO: 15141 - DNA, 21 bp, Homo sapiens
ctggccactgcacctcttcct

SEQ ID NO: 15142 - DNA, 22 bp, Homo sapiens
tagatagattctcctatagagt

SEQ ID NO: 15143 - DNA, 16 bp, Homo sapiens
ggcaggcgcggagccc

SEQ ID NO: 15144 - DNA, 22 bp, Homo sapiens
gcagaggacacaggagggcaag

SEQ ID NO: 15145 - DNA, 22 bp, Homo sapiens
cgccaggcttggtagctcatgc

SEQ ID NO: 15146 - DNA, 20 bp, Homo sapiens
ggggcccaagccctcttgcc

SEQ ID NO: 15147 - DNA, 22 bp, Homo sapiens
agaaatatgctgattagatgaa

SEQ ID NO: 15148 - DNA, 22 bp, Homo sapiens
caggaggattgcttgaggccag

SEQ ID NO: 15149 - DNA, 22 bp, Homo sapiens
tggccttgagagatcaaaaggt

SEQ ID NO: 15150 - DNA, 19 bp, Homo sapiens
gccttgaagcaactcttgt

SEQ ID NO: 15151 - DNA, 22 bp, Homo sapiens
gaagccagtgtttgaagaattt

SEQ ID NO: 15152 - DNA, 22 bp, Homo sapiens
aagaagcaggtcacagacaggg

SEQ ID NO: 15153 - DNA, 22 bp, Homo sapiens
ccccatgaagtagggtctctga

SEQ ID NO: 15154 - DNA, 22 bp, Homo sapiens
actgttttctgtaaagggccag

SEQ ID NO: 15155 - DNA, 22 bp, Homo sapiens
gctgctgcttgaaggctcggag

SEQ ID NO: 15156 - DNA, 22 bp, Homo sapiens
agtgcactggcaccatctcagc

SEQ ID NO: 15157 - DNA, 22 bp, Homo sapiens
tccacttccacgtgtgcagaat

SEQ ID NO: 15158 - DNA, 22 bp, Homo sapiens
gccggggctggggagagacatg

SEQ ID NO: 15159 - DNA, 22 bp, Homo sapiens
tgtttcttacgtttttagaggc

SEQ ID NO: 15160 - DNA, 22 bp, Homo sapiens
gctctgagtcacactgccctgt

SEQ ID NO: 15161 - DNA, 22 bp, Homo sapiens
gcagcctgggcaacagagtgag

SEQ ID NO: 15162 - DNA, 22 bp, Homo sapiens
tggccggggctgatggacagtg

SEQ ID NO: 15163 - DNA, 23 bp, Homo sapiens
ctcctggtgctgctatcaggggt

SEQ ID NO: 15164 - DNA, 22 bp, Homo sapiens
agacaaagaaaccgtagaagca

SEQ ID NO: 15165 - DNA, 22 bp, Homo sapiens
tcccacaggtggagcttgcagt

SEQ ID NO: 15166 - DNA, 22 bp, Homo sapiens
tcagagagcagaacttttttac

SEQ ID NO: 15167 - DNA, 22 bp, Homo sapiens
ttttctaacatctagtaatttg

SEQ ID NO: 15168 - DNA, 22 bp, Homo sapiens
ccgcggggtcatggctgggccg

SEQ ID NO: 15169 - DNA, 22 bp, Homo sapiens
cccaggggttcaaggctgcagt

SEQ ID NO: 15170 - DNA, 22 bp, Homo sapiens
ttttcagaattagcataccatt

SEQ ID NO: 15171 - DNA, 22 bp, Homo sapiens
cctcgtccacaatccttgcaca

SEQ ID NO: 15172 - DNA, 22 bp, Homo sapiens
ccgcccacactaaatatgagcg

SEQ ID NO: 15173 - DNA, 22 bp, Homo sapiens
ccagtgtgcaatctctggctta

SEQ ID NO: 15174 - DNA, 22 bp, Homo sapiens
ggctgggctccgggagcatgcg

SEQ ID NO: 15175 - DNA, 22 bp, Homo sapiens
gaccaaggaagaggggagccag

SEQ ID NO: 15176 - DNA, 22 bp, Homo sapiens
tgggttttatatgtggtggaca

SEQ ID NO: 15177 - DNA, 22 bp, Homo sapiens
aattcacatccgaccaggtcaa

SEQ ID NO: 15178 - DNA, 22 bp, Homo sapiens
tctgcgtgaaactagatggcag

SEQ ID NO: 15179 - DNA, 22 bp, Homo sapiens
atctagattaggtataagagct

SEQ ID NO: 15180 - DNA, 22 bp, Homo sapiens
ctcgggcttgaggctgtttacc

SEQ ID NO: 15181 - DNA, 17 bp, Homo sapiens
ttcttttctgagccttg

SEQ ID NO: 15182 - DNA, 22 bp, Homo sapiens
gagagtctagtgcacctagttt

SEQ ID NO: 15183 - DNA, 22 bp, Homo sapiens
ttacctaaaatagctcaattta

SEQ ID NO: 15184 - DNA, 22 bp, Homo sapiens
actgcaacacctcctgggttca

SEQ ID NO: 15185 - DNA, 22 bp, Homo sapiens
gaggcagaagttgcagtgagca

SEQ ID NO: 15186 - DNA, 22 bp, Homo sapiens
tgggctgcaggggttgagagct

SEQ ID NO: 15187 - DNA, 22 bp, Homo sapiens
cctctgtgtctccaagaggcct

SEQ ID NO: 15188 - DNA, 22 bp, Homo sapiens
aaatatcttaggagtatatgag

SEQ ID NO: 15189 - DNA, 22 bp, Homo sapiens
cccgggaggcggaggttgcagt

SEQ ID NO: 15190 - DNA, 22 bp, Homo sapiens
gggaagagggagctggaatgat

SEQ ID NO: 15191 - DNA, 22 bp, Homo sapiens
aggaaggactccatggtccgtc

SEQ ID NO: 15192 - DNA, 22 bp, Homo sapiens
cagggtttcaccatgttagcag

SEQ ID NO: 15193 - DNA, 22 bp, Homo sapiens
aaagtaattgcagtttctgcca

SEQ ID NO: 15194 - DNA, 21 bp, Homo sapiens
ctggaggcaggtggtgccagg

SEQ ID NO: 15195 - DNA, 22 bp, Homo sapiens
cagctgctgttcagttttgttt

SEQ ID NO: 15196 - DNA, 21 bp, Homo sapiens
tgctccaggagggggcagtcc

SEQ ID NO: 15197 - DNA, 18 bp, Homo sapiens
ccgggctttggtgacaca

SEQ ID NO: 15198 - DNA, 22 bp, Homo sapiens
tgagtggacacctgcttcttta

SEQ ID NO: 15199 - DNA, 22 bp, Homo sapiens
ctgtgggatcccatgactttcc

SEQ ID NO: 15200 - DNA, 22 bp, Homo sapiens
ctgggtggcagagcctgcagtg

SEQ ID NO: 15201 - DNA, 22 bp, Homo sapiens
gctaggagtggtgggtcaagga

SEQ ID NO: 15202 - DNA, 22 bp, Homo sapiens
cggctgggttcggctgcaggcc

SEQ ID NO: 15203 - DNA, 22 bp, Homo sapiens
tgctcgaggtccccaccggctc

SEQ ID NO: 15204 - DNA, 22 bp, Homo sapiens
ggccggggcctgctcgcctgtg

SEQ ID NO: 15205 - DNA, 22 bp, Homo sapiens
aggagaagccaagttgtgagca

SEQ ID NO: 15206 - DNA, 22 bp, Homo sapiens
gaatgcagatggctggtgtatg

SEQ ID NO: 15207 - DNA, 22 bp, Homo sapiens
ccaggggttggaggttgcagtg

SEQ ID NO: 15208 - DNA, 22 bp, Homo sapiens
agtggcctggagccccgcctgg

SEQ ID NO: 15209 - DNA, 22 bp, Homo sapiens
attgtcgtcaatggacacatag

SEQ ID NO: 15210 - DNA, 22 bp, Homo sapiens
tcaccaggctagagtgcagtgg

SEQ ID NO: 15211 - DNA, 23 bp, Homo sapiens
gcagaggagcaagctggacacca

SEQ ID NO: 15212 - DNA, 22 bp, Homo sapiens
gccctgggcaaggttctggcca

SEQ ID NO: 15213 - DNA, 22 bp, Homo sapiens
acccagccatgttcagttctct

SEQ ID NO: 15214 - DNA, 22 bp, Homo sapiens
tagctcaaaggttaagtgtgga

SEQ ID NO: 15215 - DNA, 22 bp, Homo sapiens
ctgggaggcagaggttgcagtg

SEQ ID NO: 15216 - DNA, 22 bp, Homo sapiens
tcaatcacgtgttccatgttct

SEQ ID NO: 15217 - DNA, 19 bp, Homo sapiens
ccagagagctaggtacaga

SEQ ID NO: 15218 - DNA, 22 bp, Homo sapiens
cagtcactggaatagctgagga

SEQ ID NO: 15219 - DNA, 22 bp, Homo sapiens
acatgtttaagtttgttatatg

SEQ ID NO: 15220 - DNA, 22 bp, Homo sapiens
tgaagttgttaaggttgccatt

SEQ ID NO: 15221 - DNA, 20 bp, Homo sapiens
tttgaatgtaaagcatgtca

SEQ ID NO: 15222 - DNA, 22 bp, Homo sapiens
caccgcggagtgatggagaaac

SEQ ID NO: 15223 - DNA, 22 bp, Homo sapiens
gtccaagagtcaagaagggggc

SEQ ID NO: 15224 - DNA, 22 bp, Homo sapiens
ggccaggcgatgacccctccac

SEQ ID NO: 15225 - DNA, 22 bp, Homo sapiens
tgggggtgtcctggtgcacaca

SEQ ID NO: 15226 - DNA, 22 bp, Homo sapiens
cgggcagtgtggctccagagtc

SEQ ID NO: 15227 - DNA, 22 bp, Homo sapiens
tctgttttgcataatgttcttt

SEQ ID NO: 15228 - DNA, 22 bp, Homo sapiens
atgccaggaacaaacagtggtg

SEQ ID NO: 15229 - DNA, 22 bp, Homo sapiens
gcgggttgaagggcgcatcgaa

SEQ ID NO: 15230 - DNA, 22 bp, Homo sapiens
actgtactccagcctcggtgac

SEQ ID NO: 15231 - DNA, 22 bp, Homo sapiens
cgcggtggcggcctccagcgcc

SEQ ID NO: 15232 - DNA, 22 bp, Homo sapiens
gtgcgcaccctcccggcatccc

SEQ ID NO: 15233 - DNA, 22 bp, Homo sapiens
cctgcaccacaaggcttcagag

SEQ ID NO: 15234 - DNA, 22 bp, Homo sapiens
gctccggcttggtgtgcagggt

SEQ ID NO: 15235 - DNA, 22 bp, Homo sapiens
tagagcattatgacaaccccat

SEQ ID NO: 15236 - DNA, 22 bp, Homo sapiens
catgaaattgtattggcctcaa

SEQ ID NO: 15237 - DNA, 22 bp, Homo sapiens
gggcactcagctgtagagcagg

SEQ ID NO: 15238 - DNA, 22 bp, Homo sapiens
cctaggagttcgaagctgcagt

SEQ ID NO: 15239 - DNA, 22 bp, Homo sapiens
actcatgtaagcggaatgtagt

SEQ ID NO: 15240 - DNA, 22 bp, Homo sapiens
tcctcagaatcacctggcagct

SEQ ID NO: 15241 - DNA, 18 bp, Homo sapiens
gaccccgggatctgtcga

SEQ ID NO: 15242 - DNA, 22 bp, Homo sapiens
acagacaagtagttcagacaag

SEQ ID NO: 15243 - DNA, 22 bp, Homo sapiens
tggacaggcaagcaagacatac

SEQ ID NO: 15244 - DNA, 22 bp, Homo sapiens
gctgtctcatacaaggccctgc

SEQ ID NO: 15245 - DNA, 22 bp, Homo sapiens
gtggaggagaggcgccttgcgg

SEQ ID NO: 15246 - DNA, 22 bp, Homo sapiens
ggcgccgcactcggtgcagccg

SEQ ID NO: 15247 - DNA, 22 bp, Homo sapiens
gccataggcagcgtggccagca

SEQ ID NO: 15248 - DNA, 22 bp, Homo sapiens
ggaggcggaggttgcagtgagc

SEQ ID NO: 15249 - DNA, 22 bp, Homo sapiens
atttggcagtataaattctggc

SEQ ID NO: 15250 - DNA, 22 bp, Homo sapiens
gggagaggttacccgagcaact

SEQ ID NO: 15251 - DNA, 22 bp, Homo sapiens
gggtggagagaaagaaacgtga

SEQ ID NO: 15252 - DNA, 22 bp, Homo sapiens
cggggaagcggttctggcggta

SEQ ID NO: 15253 - DNA, 22 bp, Homo sapiens
tgtggtgccgagagtctggacg

SEQ ID NO: 15254 - DNA, 22 bp, Homo sapiens
aggctcagatccttgtgtcctg

SEQ ID NO: 15255 - DNA, 22 bp, Homo sapiens
cattccttaacgtggggagtct

SEQ ID NO: 15256 - DNA, 22 bp, Homo sapiens
aggtggagaagagatgggcagt

SEQ ID NO: 15257 - DNA, 22 bp, Homo sapiens
ctggtgtggactccgcgcggag

SEQ ID NO: 15258 - DNA, 22 bp, Homo sapiens
ggagaggcttccagagtcgtgc

SEQ ID NO: 15259 - DNA, 22 bp, Homo sapiens
gccctgccctctcggcactcgc

SEQ ID NO: 15260 - DNA, 22 bp, Homo sapiens
gagggtggtggcttaaggtgct

SEQ ID NO: 15261 - DNA, 22 bp, Homo sapiens
tggtgggctgagtctcatcgga

SEQ ID NO: 15262 - DNA, 19 bp, Homo sapiens
gagaaagcaggcacagcac

SEQ ID NO: 15263 - DNA, 22 bp, Homo sapiens
tgggagcggcccgggccacacg

SEQ ID NO: 15264 - DNA, 22 bp, Homo sapiens
gctgtgtccaggtgggggtgac

SEQ ID NO: 15265 - DNA, 22 bp, Homo sapiens
taaatgttgtaagtacatctaa

SEQ ID NO: 15266 - DNA, 22 bp, Homo sapiens
ggtgcagaggagccagctgggg

SEQ ID NO: 15267 - DNA, 20 bp, Homo sapiens
agagtgagactccatctcag

SEQ ID NO: 15268 - DNA, 22 bp, Homo sapiens
ttttaatactgctattgtagga

SEQ ID NO: 15269 - DNA, 22 bp, Homo sapiens
actgtactcaagcctgggcaat

SEQ ID NO: 15270 - DNA, 22 bp, Homo sapiens
tccttagacaaagagtgggctt

SEQ ID NO: 15271 - DNA, 22 bp, Homo sapiens
ctgggaggcggaggttgcagtg

SEQ ID NO: 15272 - DNA, 22 bp, Homo sapiens
agaaggggcccaaggatgtcag

SEQ ID NO: 15273 - DNA, 22 bp, Homo sapiens
tcttttgtgattctttagttac

SEQ ID NO: 15274 - DNA, 22 bp, Homo sapiens
accctactaaatgtggtatgtc

SEQ ID NO: 15275 - DNA, 22 bp, Homo sapiens
agtgagagtattaatgtgaact

SEQ ID NO: 15276 - DNA, 22 bp, Homo sapiens
gagaaagcttctttcccacagg

SEQ ID NO: 15277 - DNA, 22 bp, Homo sapiens
ggcctctcttgggacagctgtc

SEQ ID NO: 15278 - DNA, 22 bp, Homo sapiens
tgaggcaggagttcaggctgcg

SEQ ID NO: 15279 - DNA, 22 bp, Homo sapiens
gcgcaccacctccaggtggccg

SEQ ID NO: 15280 - DNA, 22 bp, Homo sapiens
acaggggcaagggctcacggcc

SEQ ID NO: 15281 - DNA, 22 bp, Homo sapiens
gagagtctaggaacctcatata

SEQ ID NO: 15282 - DNA, 22 bp, Homo sapiens
cctggtgctgctatcaggggta

SEQ ID NO: 15283 - DNA, 22 bp, Homo sapiens
aggccagcctcaggcagggacc

SEQ ID NO: 15284 - DNA, 22 bp, Homo sapiens
tgggttttgtcctgatccatca

SEQ ID NO: 15285 - DNA, 18 bp, Homo sapiens
ggcgggtgttttattcac

SEQ ID NO: 15286 - DNA, 22 bp, Homo sapiens
agacgcggtggtgcatgcctgt

SEQ ID NO: 15287 - DNA, 22 bp, Homo sapiens
tttctcttcactgtgtgcctca

SEQ ID NO: 15288 - DNA, 22 bp, Homo sapiens
ggaggaggggtgactgaatgct

SEQ ID NO: 15289 - DNA, 22 bp, Homo sapiens
cggctggtgtcgggcacagcaa

SEQ ID NO: 15290 - DNA, 22 bp, Homo sapiens
gcggcaggagtaaaggaggaag

SEQ ID NO: 15291 - DNA, 22 bp, Homo sapiens
gctggcagacttcctctggaac

SEQ ID NO: 15292 - DNA, 22 bp, Homo sapiens
gggctccgcccttggctgagct

SEQ ID NO: 15293 - DNA, 22 bp, Homo sapiens
gggcaggggtcagtggccccaa

SEQ ID NO: 15294 - DNA, 22 bp, Homo sapiens
cgtaggtggctcagcacctggg

SEQ ID NO: 15295 - DNA, 22 bp, Homo sapiens
actgcaacctccacctcctggg

SEQ ID NO: 15296 - DNA, 22 bp, Homo sapiens
ggggctgaacctggaggtggtc

SEQ ID NO: 15297 - DNA, 22 bp, Homo sapiens
accagcctggccaacatggcaa

SEQ ID NO: 15298 - DNA, 22 bp, Homo sapiens
accccactcacacatggacctg

SEQ ID NO: 15299 - DNA, 22 bp, Homo sapiens
attgttcaatgtaataattttg

SEQ ID NO: 15300 - DNA, 22 bp, Homo sapiens
ttgcatcagaattacttggagg

SEQ ID NO: 15301 - DNA, 22 bp, Homo sapiens
cctcggaggcggaggctgcagt

SEQ ID NO: 15302 - DNA, 22 bp, Homo sapiens
gggaggctctgctcagcccccg

SEQ ID NO: 15303 - DNA, 22 bp, Homo sapiens
atgcctgtaatcccagcacttt

SEQ ID NO: 15304 - DNA, 22 bp, Homo sapiens
gcgagcctctggagtcctctgg

SEQ ID NO: 15305 - DNA, 22 bp, Homo sapiens
ccacaggggcccacgagccgct

SEQ ID NO: 15306 - DNA, 22 bp, Homo sapiens
ttcctttctctggactgcagcc

SEQ ID NO: 15307 - DNA, 22 bp, Homo sapiens
caggaggacatactggctcaca

SEQ ID NO: 15308 - DNA, 22 bp, Homo sapiens
caggcagggagctggaaaggat

SEQ ID NO: 15309 - DNA, 22 bp, Homo sapiens
tggggccatctcacccactgtt

SEQ ID NO: 15310 - DNA, 22 bp, Homo sapiens
tctgccacttgaggtcattggc

SEQ ID NO: 15311 - DNA, 22 bp, Homo sapiens
gaggaggcagcctatcccttag

SEQ ID NO: 15312 - DNA, 22 bp, Homo sapiens
tggtgctgccaggctcctgcca

SEQ ID NO: 15313 - DNA, 22 bp, Homo sapiens
tagaataatctgaggaaatgct

SEQ ID NO: 15314 - DNA, 19 bp, Homo sapiens
ctctggagtcattgctccc

SEQ ID NO: 15315 - DNA, 22 bp, Homo sapiens
agccacacagcttaatgacaga

SEQ ID NO: 15316 - DNA, 22 bp, Homo sapiens
tcgaaataatttagaatataga

SEQ ID NO: 15317 - DNA, 22 bp, Homo sapiens
ctgggaggcggaggttgtagtg

SEQ ID NO: 15318 - DNA, 18 bp, Homo sapiens
gaggatggaaggagatgc

SEQ ID NO: 15319 - DNA, 22 bp, Homo sapiens
gtggagggtgattgccggctgt

SEQ ID NO: 15320 - DNA, 22 bp, Homo sapiens
actcagtacatctggagttggc

SEQ ID NO: 15321 - DNA, 22 bp, Homo sapiens
ggaggcggaggctgcagtgagc

SEQ ID NO: 15322 - DNA, 22 bp, Homo sapiens
acttttaaatgagtttcagttg

SEQ ID NO: 15323 - DNA, 22 bp, Homo sapiens
cagcagcagtggctgcagaaca

SEQ ID NO: 15324 - DNA, 22 bp, Homo sapiens
cagtttcttcctcccccagaga

SEQ ID NO: 15325 - DNA, 22 bp, Homo sapiens
tgggggagctcagtccagccca

SEQ ID NO: 15326 - DNA, 22 bp, Homo sapiens
gaaggaagtcattagtgcagac

SEQ ID NO: 15327 - DNA, 22 bp, Homo sapiens
aaagcctcccaggttatgagta

SEQ ID NO: 15328 - DNA, 22 bp, Homo sapiens
agaagccaccagctgaggaaga

SEQ ID NO: 15329 - DNA, 22 bp, Homo sapiens
gagagaagggggatatgagcct

SEQ ID NO: 15330 - DNA, 22 bp, Homo sapiens
catctgctgttccttggactca

SEQ ID NO: 15331 - DNA, 22 bp, Homo sapiens
gtgcagagaggaccttggggag

SEQ ID NO: 15332 - DNA, 22 bp, Homo sapiens
atgcacctgaactccatcagct

SEQ ID NO: 15333 - DNA, 22 bp, Homo sapiens
gcaggcggaggttgcagtgagc

SEQ ID NO: 15334 - DNA, 22 bp, Homo sapiens
ggctccccaggtccaggagctg

SEQ ID NO: 15335 - DNA, 22 bp, Homo sapiens
aggagcagaccgtagtcctgca

SEQ ID NO: 15336 - DNA, 22 bp, Homo sapiens
gaggtgggcggatcacaaggtc

SEQ ID NO: 15337 - DNA, 22 bp, Homo sapiens
ggactgggaatcagggagatgc

SEQ ID NO: 15338 - DNA, 22 bp, Homo sapiens
aaaagagcttggttgattttgc

SEQ ID NO: 15339 - DNA, 22 bp, Homo sapiens
tccaactttctcctccggcttg

SEQ ID NO: 15340 - DNA, 22 bp, Homo sapiens
gcctccccaagcagcagggatt

SEQ ID NO: 15341 - DNA, 22 bp, Homo sapiens
acagagcaatgcgtgttctcta

SEQ ID NO: 15342 - DNA, 22 bp, Homo sapiens
gggaaggccttgtcagcggatt

SEQ ID NO: 15343 - DNA, 22 bp, Homo sapiens
tttattctgtgctacatgaaga

SEQ ID NO: 15344 - DNA, 22 bp, Homo sapiens
tgggaggccgaggcaggtggat

SEQ ID NO: 15345 - DNA, 22 bp, Homo sapiens
agaggaggctctgggatcgtcc

SEQ ID NO: 15346 - DNA, 22 bp, Homo sapiens
agggcactgcaagggttgaagg

SEQ ID NO: 15347 - DNA, 22 bp, Homo sapiens
ctatacagcagcttactagtta

SEQ ID NO: 15348 - DNA, 22 bp, Homo sapiens
ccaggctggagtgcagtggcac

SEQ ID NO: 15349 - DNA, 22 bp, Homo sapiens
ctgggaggcagaggttgtagtg

SEQ ID NO: 15350 - DNA, 22 bp, Homo sapiens
ctcagctcattgtggatccggt

SEQ ID NO: 15351 - DNA, 22 bp, Homo sapiens
ccttctcagccccagctcccgc

SEQ ID NO: 15352 - DNA, 22 bp, Homo sapiens
tctgcaacagtgccctgtaaat

SEQ ID NO: 15353 - DNA, 22 bp, Homo sapiens
gggagaagaatgtgtcaattgt

SEQ ID NO: 15354 - DNA, 22 bp, Homo sapiens
cctgggcctctcaaagtgctgg

SEQ ID NO: 15355 - DNA, 22 bp, Homo sapiens
tgtctttgttattgtggacagg

SEQ ID NO: 15356 - DNA, 22 bp, Homo sapiens
gtggcccaggttggagtgcagt

SEQ ID NO: 15357 - DNA, 22 bp, Homo sapiens
tgctcgccccacatgccctcat

SEQ ID NO: 15358 - DNA, 22 bp, Homo sapiens
gccagtggtcactgaggaagaa

SEQ ID NO: 15359 - DNA, 22 bp, Homo sapiens
acacttggagcaacacttatgg

SEQ ID NO: 15360 - DNA, 22 bp, Homo sapiens
gagcctgagcaatgtgatgttt

SEQ ID NO: 15361 - DNA, 22 bp, Homo sapiens
ggcctgcctcacagtcagcacc

SEQ ID NO: 15362 - DNA, 22 bp, Homo sapiens
ctggccagatgttacgtccaat

SEQ ID NO: 15363 - DNA, 22 bp, Homo sapiens
gggactggagtagaggccggtg

SEQ ID NO: 15364 - DNA, 22 bp, Homo sapiens
aggagggtgggaagcagtttta

SEQ ID NO: 15365 - DNA, 22 bp, Homo sapiens
ctcactgcaagctccacctctt

SEQ ID NO: 15366 - DNA, 22 bp, Homo sapiens
gctggggaggcagcagagaaca

SEQ ID NO: 15367 - DNA, 22 bp, Homo sapiens
aggccctattcaatggggccca

SEQ ID NO: 15368 - DNA, 22 bp, Homo sapiens
gcaggcagaggtggaggagaca

SEQ ID NO: 15369 - DNA, 22 bp, Homo sapiens
gccaggacctcagatgcagggc

SEQ ID NO: 15370 - DNA, 22 bp, Homo sapiens
caggtagaggctgccatcagct

SEQ ID NO: 15371 - DNA, 22 bp, Homo sapiens
ccaggcaggcgatggtgcagtg

SEQ ID NO: 15372 - DNA, 22 bp, Homo sapiens
gttattgaggtggagtctcact

SEQ ID NO: 15373 - DNA, 22 bp, Homo sapiens
gaggtaacactgttcagtgggc

SEQ ID NO: 15374 - DNA, 22 bp, Homo sapiens
caggctggagtgcagtggggcg

SEQ ID NO: 15375 - DNA, 22 bp, Homo sapiens
tcctccactttgtctagcaaca

SEQ ID NO: 15376 - DNA, 22 bp, Homo sapiens
tgggaagggtcaacagctggaa

SEQ ID NO: 15377 - DNA, 22 bp, Homo sapiens
tggggcagttaataaacattct

SEQ ID NO: 15378 - DNA, 22 bp, Homo sapiens
aaagtaattgtggttcttgcca

SEQ ID NO: 15379 - DNA, 22 bp, Homo sapiens
agaccactaaaactttctctat

SEQ ID NO: 15380 - DNA, 22 bp, Homo sapiens
gagcccaggaagtggaggctga

SEQ ID NO: 15381 - DNA, 22 bp, Homo sapiens
acctggccagtggggccgcgct

SEQ ID NO: 15382 - DNA, 22 bp, Homo sapiens
tactgtgtgcccagccgagctg

SEQ ID NO: 15383 - DNA, 22 bp, Homo sapiens
gtgaggtggtacaatattaact

SEQ ID NO: 15384 - DNA, 22 bp, Homo sapiens
gatactcttcaggtcttgcaga

SEQ ID NO: 15385 - DNA, 22 bp, Homo sapiens
ctgcaccgtgtctcgggctgcc

SEQ ID NO: 15386 - DNA, 22 bp, Homo sapiens
tccaaggtcagcgagagtcact

SEQ ID NO: 15387 - DNA, 22 bp, Homo sapiens
gagggggctagcgcagtgccca

SEQ ID NO: 15388 - DNA, 22 bp, Homo sapiens
atggccaggcacctctggctga

SEQ ID NO: 15389 - DNA, 22 bp, Homo sapiens
tgcctaggctggagtgtagtgg

SEQ ID NO: 15390 - DNA, 22 bp, Homo sapiens
aggtgggcggattcatgaggtc

SEQ ID NO: 15391 - DNA, 22 bp, Homo sapiens
tccaccatgtaacaagctctgt

SEQ ID NO: 15392 - DNA, 19 bp, Homo sapiens
tcctgcccaccagccaggg

SEQ ID NO: 15393 - DNA, 22 bp, Homo sapiens
tgggcccgcagctgctgctcca

SEQ ID NO: 15394 - DNA, 22 bp, Homo sapiens
ccagcctggttcagaattggct

SEQ ID NO: 15395 - DNA, 22 bp, Homo sapiens
gggccggagctgggtcccgcgc

SEQ ID NO: 15396 - DNA, 22 bp, Homo sapiens
ataaaaactgacccatcctttg

SEQ ID NO: 15397 - DNA, 20 bp, Homo sapiens
gggcaaggaaacagccccca

SEQ ID NO: 15398 - DNA, 22 bp, Homo sapiens
gggctgtaggagctggaatggg

SEQ ID NO: 15399 - DNA, 22 bp, Homo sapiens
ctgaggggtcgtgggagcccag

SEQ ID NO: 15400 - DNA, 22 bp, Homo sapiens
agaaaatttaaagagacacaca

SEQ ID NO: 15401 - DNA, 22 bp, Homo sapiens
ggcagacctctccagccccaca

SEQ ID NO: 15402 - DNA, 22 bp, Homo sapiens
cctcttctaggacgtccttgtg

SEQ ID NO: 15403 - DNA, 22 bp, Homo sapiens
gagcacagtaaagcagtgtcac

SEQ ID NO: 15404 - DNA, 22 bp, Homo sapiens
tggaatcattgctgtgttgctt

SEQ ID NO: 15405 - DNA, 22 bp, Homo sapiens
atataatttttggttagctcaa

SEQ ID NO: 15406 - DNA, 22 bp, Homo sapiens
ggcagcactgcagcttgttggg

SEQ ID NO: 15407 - DNA, 22 bp, Homo sapiens
gttttgaatactactagaactt

SEQ ID NO: 15408 - DNA, 22 bp, Homo sapiens
ggcaggaggtgagtggcgggtg

SEQ ID NO: 15409 - DNA, 22 bp, Homo sapiens
gagagtgagatcctcctgggga

SEQ ID NO: 15410 - DNA, 22 bp, Homo sapiens
ttgagcaatgtcactgaggctt

SEQ ID NO: 15411 - DNA, 22 bp, Homo sapiens
ctccggccgcggtgcccagcgc

SEQ ID NO: 15412 - DNA, 22 bp, Homo sapiens
ctggcaggttatagagctgccc

SEQ ID NO: 15413 - DNA, 22 bp, Homo sapiens
tggagccagcggcctgctgagg

SEQ ID NO: 15414 - DNA, 22 bp, Homo sapiens
tgttcttgagcctttagaccta

SEQ ID NO: 15415 - DNA, 22 bp, Homo sapiens
cctccagagggaagtactttct

SEQ ID NO: 15416 - DNA, 22 bp, Homo sapiens
ccaggctgctgttggtgtccgc

SEQ ID NO: 15417 - DNA, 22 bp, Homo sapiens
ggagtgactcacagctgggaca

SEQ ID NO: 15418 - DNA, 22 bp, Homo sapiens
gagatatgttggcagctggtat

SEQ ID NO: 15419 - DNA, 22 bp, Homo sapiens
aagaggagaaaggctggctttg

SEQ ID NO: 15420 - DNA, 22 bp, Homo sapiens
atttcacttagtgtaatgtctt

SEQ ID NO: 15421 - DNA, 22 bp, Homo sapiens
gggagctggagctggaagactc

SEQ ID NO: 15422 - DNA, 21 bp, Homo sapiens
gcccacagtgaggaggatccc

SEQ ID NO: 15423 - DNA, 22 bp, Homo sapiens
gaggcctgggcaagggggtctg

SEQ ID NO: 15424 - DNA, 22 bp, Homo sapiens
agaggggcccggttctccgtct

SEQ ID NO: 15425 - DNA, 22 bp, Homo sapiens
acattacctggcatttgatctt

SEQ ID NO: 15426 - DNA, 22 bp, Homo sapiens
aggtgggcgctgctcccgctgg

SEQ ID NO: 15427 - DNA, 22 bp, Homo sapiens
ttcccacattctttacattcat

SEQ ID NO: 15428 - DNA, 22 bp, Homo sapiens
tcgggctcgctctcctagcgga

SEQ ID NO: 15429 - DNA, 22 bp, Homo sapiens
cgagagatgggttggcaggggc

SEQ ID NO: 15430 - DNA, 23 bp, Homo sapiens
cagagctggctcagagctgcctg

SEQ ID NO: 15431 - DNA, 22 bp, Homo sapiens
agatttggtgtctggttgatat

SEQ ID NO: 15432 - DNA, 22 bp, Homo sapiens
tgagcaggcgcagcaggaggtc

SEQ ID NO: 15433 - DNA, 22 bp, Homo sapiens
attcccagatttatattgatag

SEQ ID NO: 15434 - DNA, 22 bp, Homo sapiens
cactgcactccatcctgggaaa

SEQ ID NO: 15435 - DNA, 22 bp, Homo sapiens
ggtgggaggactgtttgaggca

SEQ ID NO: 15436 - DNA, 22 bp, Homo sapiens
ccatgtggtgggaaggagaatg

SEQ ID NO: 15437 - DNA, 21 bp, Homo sapiens
tgaaggggtggcagtgtgctt

SEQ ID NO: 15438 - DNA, 22 bp, Homo sapiens
ctcggagggcaacagaagtgct

SEQ ID NO: 15439 - DNA, 22 bp, Homo sapiens
gccctagcgccagctcagcacc

SEQ ID NO: 15440 - DNA, 22 bp, Homo sapiens
ttagatttacaagcactgttta

SEQ ID NO: 15441 - DNA, 22 bp, Homo sapiens
gcttctggtgaggcctcaggaa

SEQ ID NO: 15442 - DNA, 22 bp, Homo sapiens
agacccaggattggggctgccg

SEQ ID NO: 15443 - DNA, 22 bp, Homo sapiens
tggcacagactgggccaaggaa

SEQ ID NO: 15444 - DNA, 22 bp, Homo sapiens
gaggcgggcagatcacctgagg

SEQ ID NO: 15445 - DNA, 22 bp, Homo sapiens
tgcagtttaaacttggcaactt

SEQ ID NO: 15446 - DNA, 21 bp, Homo sapiens
ccaccaggtcttctgctcggg

SEQ ID NO: 15447 - DNA, 21 bp, Homo sapiens
gggcagaggggcctcctgggt

SEQ ID NO: 15448 - DNA, 22 bp, Homo sapiens
cttgtagaattgaaatggtctc

SEQ ID NO: 15449 - DNA, 22 bp, Homo sapiens
agcagctcctgtttttgggata

SEQ ID NO: 15450 - DNA, 22 bp, Homo sapiens
cctggtgcaggtgtgttgccag

SEQ ID NO: 15451 - DNA, 22 bp, Homo sapiens
tgggaggccaaggcaggcggat

SEQ ID NO: 15452 - DNA, 20 bp, Homo sapiens
ttgttagaggaatgccatag

SEQ ID NO: 15453 - DNA, 22 bp, Homo sapiens
agcgcttgccgcactccaagca

SEQ ID NO: 15454 - DNA, 22 bp, Homo sapiens
accctcaacaaattcactctat

SEQ ID NO: 15455 - DNA, 22 bp, Homo sapiens
actgtactccagccttggcgac

SEQ ID NO: 15456 - DNA, 22 bp, Homo sapiens
gcccagcacctctctcagggtt

SEQ ID NO: 15457 - DNA, 22 bp, Homo sapiens
ctgccctggggggcctccttgc

SEQ ID NO: 15458 - DNA, 22 bp, Homo sapiens
gtgaaatatttaacgtccaggt

SEQ ID NO: 15459 - DNA, 19 bp, Homo sapiens
tggttgtgcacgggttggt

SEQ ID NO: 15460 - DNA, 22 bp, Homo sapiens
cactgcactccagcctgggaga

SEQ ID NO: 15461 - DNA, 22 bp, Homo sapiens
catgcacttacctgaaattcaa

SEQ ID NO: 15462 - DNA, 18 bp, Homo sapiens
gcactgaggaaaacctct

SEQ ID NO: 15463 - DNA, 22 bp, Homo sapiens
ttcccacagtgactccagagaa

SEQ ID NO: 15464 - DNA, 22 bp, Homo sapiens
ctctggaggtggaggttgcagt

SEQ ID NO: 15465 - DNA, 22 bp, Homo sapiens
ggctagggatctagaccaggac

SEQ ID NO: 15466 - DNA, 22 bp, Homo sapiens
ataaagctattcctctcttttt

SEQ ID NO: 15467 - DNA, 22 bp, Homo sapiens
ccgccgtgtcgacaggccctgg

SEQ ID NO: 15468 - DNA, 22 bp, Homo sapiens
ttatttttaaaagttcacacag

SEQ ID NO: 15469 - DNA, 22 bp, Homo sapiens
ggagaggggaacttgttgcttg

SEQ ID NO: 15470 - DNA, 23 bp, Homo sapiens
ggggcctgcaccggtctgcgcgg

SEQ ID NO: 15471 - DNA, 22 bp, Homo sapiens
gccgtggggagagagggtgcgt

SEQ ID NO: 15472 - DNA, 22 bp, Homo sapiens
gctgctttggaaagcatggaaa

SEQ ID NO: 15473 - DNA, 22 bp, Homo sapiens
ggctgagttgagaggattactt

SEQ ID NO: 15474 - DNA, 22 bp, Homo sapiens
cagccccacacggtctagctct

SEQ ID NO: 15475 - DNA, 22 bp, Homo sapiens
actggggctgatgcgttcgtgt

SEQ ID NO: 15476 - DNA, 22 bp, Homo sapiens
gacaggaggcagagctcaggtg

SEQ ID NO: 15477 - DNA, 22 bp, Homo sapiens
ggtgacagtggttaaaatttgt

SEQ ID NO: 15478 - DNA, 17 bp, Homo sapiens
aggaggccctggcgttt

SEQ ID NO: 15479 - DNA, 22 bp, Homo sapiens
gcgagggcacgcggttgaaggc

SEQ ID NO: 15480 - DNA, 22 bp, Homo sapiens
tccattatacttctgattcaaa

SEQ ID NO: 15481 - DNA, 19 bp, Homo sapiens
aaaggtagtaacctctgat

SEQ ID NO: 15482 - DNA, 22 bp, Homo sapiens
tcccctctttctggaaacacaa

SEQ ID NO: 15483 - DNA, 21 bp, Homo sapiens
ctacttaagtaggggattagg

SEQ ID NO: 15484 - DNA, 22 bp, Homo sapiens
gcaggaggttgagccaggactg

SEQ ID NO: 15485 - DNA, 22 bp, Homo sapiens
ctggaggccactgtacagattg

SEQ ID NO: 15486 - DNA, 22 bp, Homo sapiens
ttctggaaggatgtttctatct

SEQ ID NO: 15487 - DNA, 22 bp, Homo sapiens
ggcagggcaggaaagtcaggaa

SEQ ID NO: 15488 - DNA, 18 bp, Homo sapiens
tgtagagccaggtttgcc

SEQ ID NO: 15489 - DNA, 22 bp, Homo sapiens
agaaaatgtgaacttgtgaatt

SEQ ID NO: 15490 - DNA, 22 bp, Homo sapiens
cccatgtgtgacagtccatttg

SEQ ID NO: 15491 - DNA, 22 bp, Homo sapiens
cagccagtgtgaccgaggagga

SEQ ID NO: 15492 - DNA, 22 bp, Homo sapiens
gggcagagactcagaaacagaa

SEQ ID NO: 15493 - DNA, 22 bp, Homo sapiens
gtggagaggaacccagctctgt

SEQ ID NO: 15494 - DNA, 22 bp, Homo sapiens
ggccactgacctacatctgggg

SEQ ID NO: 15495 - DNA, 22 bp, Homo sapiens
cggccaggcacagtggcccacg

SEQ ID NO: 15496 - DNA, 22 bp, Homo sapiens
gcggcccgagcaggacgggtgg

SEQ ID NO: 15497 - DNA, 22 bp, Homo sapiens
gctgaaggcccggaggacaggg

SEQ ID NO: 15498 - DNA, 21 bp, Homo sapiens
ggagcctctggcagggggcca

SEQ ID NO: 15499 - DNA, 22 bp, Homo sapiens
ctgctccccagcctgcgccttt

SEQ ID NO: 15500 - DNA, 22 bp, Homo sapiens
aacagctttgtatacagtaact

SEQ ID NO: 15501 - DNA, 16 bp, Homo sapiens
tgggtgggaggagcgg

SEQ ID NO: 15502 - DNA, 22 bp, Homo sapiens
catagacagatggtaagaagct

SEQ ID NO: 15503 - DNA, 22 bp, Homo sapiens
tgtctggtgggttgacaggcag

SEQ ID NO: 15504 - DNA, 19 bp, Homo sapiens
tcctggggaggggcatggc

SEQ ID NO: 15505 - DNA, 22 bp, Homo sapiens
ctgtccgccgacttggccaggc

SEQ ID NO: 15506 - DNA, 22 bp, Homo sapiens
tcgcggggaagtggtgggctaa

SEQ ID NO: 15507 - DNA, 22 bp, Homo sapiens
gaggccacggaagggagctgtg

SEQ ID NO: 15508 - DNA, 22 bp, Homo sapiens
gctctgccagcccaaggcgcag

SEQ ID NO: 15509 - DNA, 22 bp, Homo sapiens
tgcctgttgcccacctgataaa

SEQ ID NO: 15510 - DNA, 22 bp, Homo sapiens
ttatgggagcaattggggaggt

SEQ ID NO: 15511 - DNA, 23 bp, Homo sapiens
aaaacagcttcctccagtggctc

SEQ ID NO: 15512 - DNA, 22 bp, Homo sapiens
gaggcctcatgaggtgagcatt

SEQ ID NO: 15513 - DNA, 22 bp, Homo sapiens
tatcacagtaaatctgggtgca

SEQ ID NO: 15514 - DNA, 21 bp, Homo sapiens
ggcctcccggaccgcagcgcc

SEQ ID NO: 15515 - DNA, 22 bp, Homo sapiens
ggcctgtaatcccagctactca

SEQ ID NO: 15516 - DNA, 22 bp, Homo sapiens
gcccaggctggagtgcagtggc

SEQ ID NO: 15517 - DNA, 22 bp, Homo sapiens
agcataagttggtacagccact

SEQ ID NO: 15518 - DNA, 22 bp, Homo sapiens
acgtgcaggatctggttggcga

SEQ ID NO: 15519 - DNA, 22 bp, Homo sapiens
tggagggcatgctgtccatggg

SEQ ID NO: 15520 - DNA, 22 bp, Homo sapiens
aggctgagataggtggatcatt

SEQ ID NO: 15521 - DNA, 22 bp, Homo sapiens
cgggcccgagcacggcacccac

SEQ ID NO: 15522 - DNA, 22 bp, Homo sapiens
cctcaggttctggagaagggcc

SEQ ID NO: 15523 - DNA, 22 bp, Homo sapiens
ggggaaagccagccctgcttcc

SEQ ID NO: 15524 - DNA, 22 bp, Homo sapiens
aaaggtcaaaatcgtgacattg

SEQ ID NO: 15525 - DNA, 22 bp, Homo sapiens
gagccaggtcgggccgcggcga

SEQ ID NO: 15526 - DNA, 22 bp, Homo sapiens
tgggccacacacagaagaatca

SEQ ID NO: 15527 - DNA, 18 bp, Homo sapiens
tctgtgggatcagtgagg

SEQ ID NO: 15528 - DNA, 22 bp, Homo sapiens
atacagggacatccagtttttc

SEQ ID NO: 15529 - DNA, 22 bp, Homo sapiens
aagcctggactatcgcgtgtgc

SEQ ID NO: 15530 - DNA, 22 bp, Homo sapiens
ctgaggctggagtgcagtggtg

SEQ ID NO: 15531 - DNA, 22 bp, Homo sapiens
aagctctttccactaaaccact

SEQ ID NO: 15532 - DNA, 20 bp, Homo sapiens
ggcagagggcctgggagaag

SEQ ID NO: 15533 - DNA, 18 bp, Homo sapiens
gcagtgaagaaagagctt

SEQ ID NO: 15534 - DNA, 22 bp, Homo sapiens
cggagcgctgggggactctgca

SEQ ID NO: 15535 - DNA, 22 bp, Homo sapiens
ctgcagggagaggggacagcct

SEQ ID NO: 15536 - DNA, 22 bp, Homo sapiens
gagaaagctaaataagttgatt

SEQ ID NO: 15537 - DNA, 18 bp, Homo sapiens
ccctcttgcacaaagcaa

SEQ ID NO: 15538 - DNA, 22 bp, Homo sapiens
ccgaggctggagtgcagtggcg

SEQ ID NO: 15539 - DNA, 22 bp, Homo sapiens
gctcaagccttctgcccacctc

SEQ ID NO: 15540 - DNA, 22 bp, Homo sapiens
ttgggacagctgtggtagtgag

SEQ ID NO: 15541 - DNA, 22 bp, Homo sapiens
gaggtgggtgtatcacaggtca

SEQ ID NO: 15542 - DNA, 22 bp, Homo sapiens
cagagagaatcttggcagctga

SEQ ID NO: 15543 - DNA, 22 bp, Homo sapiens
tacaaaggaggtgcatagaaca

SEQ ID NO: 15544 - DNA, 22 bp, Homo sapiens
ggcgggacggggcgtgcacaga

SEQ ID NO: 15545 - DNA, 22 bp, Homo sapiens
cggggccctggggctgaaggtc

SEQ ID NO: 15546 - DNA, 22 bp, Homo sapiens
cctgggggccaggaaggtgtga

SEQ ID NO: 15547 - DNA, 22 bp, Homo sapiens
gggataagagagtatttatgca

SEQ ID NO: 15548 - DNA, 22 bp, Homo sapiens
gcggggcctgactctgacccgc

SEQ ID NO: 15549 - DNA, 22 bp, Homo sapiens
aactagaaaaagactttctgag

SEQ ID NO: 15550 - DNA, 22 bp, Homo sapiens
catggtgggtgtagtttccgcc

SEQ ID NO: 15551 - DNA, 22 bp, Homo sapiens
ctcactgcaagttccacctacc

SEQ ID NO: 15552 - DNA, 22 bp, Homo sapiens
tgctccagcaccaagagctcca

SEQ ID NO: 15553 - DNA, 22 bp, Homo sapiens
cctgccctgctcactgtcggta

SEQ ID NO: 15554 - DNA, 22 bp, Homo sapiens
cccccagctctgctgggtcccg

SEQ ID NO: 15555 - DNA, 22 bp, Homo sapiens
gaggctgaggttgcagtgagcc

SEQ ID NO: 15556 - DNA, 22 bp, Homo sapiens
tgaaatcttcactaagtctctt

SEQ ID NO: 15557 - DNA, 22 bp, Homo sapiens
ccgggccccacggtgacctcag

SEQ ID NO: 15558 - DNA, 22 bp, Homo sapiens
acagcagcaatagcagtgacat

SEQ ID NO: 15559 - DNA, 22 bp, Homo sapiens
agatacattgttctaagcattg

SEQ ID NO: 15560 - DNA, 22 bp, Homo sapiens
ttgatgagaccattgccgcgtc

SEQ ID NO: 15561 - DNA, 18 bp, Homo sapiens
tcaagccattctcctgcc

SEQ ID NO: 15562 - DNA, 22 bp, Homo sapiens
tgtgtctcaagtcagagcatca

SEQ ID NO: 15563 - DNA, 20 bp, Homo sapiens
atcctctcctgattaattca

SEQ ID NO: 15564 - DNA, 22 bp, Homo sapiens
gggcagagagctggaactcctt

SEQ ID NO: 15565 - DNA, 22 bp, Homo sapiens
atgttattgatgcctgaggctt

SEQ ID NO: 15566 - DNA, 22 bp, Homo sapiens
aggctgaggcaagaggatcact

SEQ ID NO: 15567 - DNA, 22 bp, Homo sapiens
taaagctctgggtttctagatc

SEQ ID NO: 15568 - DNA, 22 bp, Homo sapiens
tggcccagtatgtataatctta

SEQ ID NO: 15569 - DNA, 22 bp, Homo sapiens
ggtcgggcactctccagggctg

SEQ ID NO: 15570 - DNA, 22 bp, Homo sapiens
gaggtggccaagcgaggaaggg

SEQ ID NO: 15571 - DNA, 22 bp, Homo sapiens
accagcctggccaacatggtga

SEQ ID NO: 15572 - DNA, 22 bp, Homo sapiens
gcctggagaaaggaaggtggga

SEQ ID NO: 15573 - DNA, 22 bp, Homo sapiens
ccaggagttggaggctgcagtg

SEQ ID NO: 15574 - DNA, 22 bp, Homo sapiens
agcgccactgcactccagcctg

SEQ ID NO: 15575 - DNA, 22 bp, Homo sapiens
agccaccaccactgaaaggtta

SEQ ID NO: 15576 - DNA, 22 bp, Homo sapiens
acgtagcactgagagatgcagg

SEQ ID NO: 15577 - DNA, 22 bp, Homo sapiens
gggccctgcgactcgcggcgga

SEQ ID NO: 15578 - DNA, 22 bp, Homo sapiens
gcagatggatgtggacggcgcc

SEQ ID NO: 15579 - DNA, 22 bp, Homo sapiens
tgtgaatggacaattaaatcta

SEQ ID NO: 15580 - DNA, 22 bp, Homo sapiens
gaggagggagctggaagctctt

SEQ ID NO: 15581 - DNA, 22 bp, Homo sapiens
gagtttcttcatggtgcagagg

SEQ ID NO: 15582 - DNA, 20 bp, Homo sapiens
aggggcacctgcgacggggc

SEQ ID NO: 15583 - DNA, 22 bp, Homo sapiens
cactgggcgtgtcctgggtgag

SEQ ID NO: 15584 - DNA, 22 bp, Homo sapiens
tggagaagattggtcaccattc

SEQ ID NO: 15585 - DNA, 22 bp, Homo sapiens
taaagggtaggttttactgtaa

SEQ ID NO: 15586 - DNA, 22 bp, Homo sapiens
cccgggaggcagaggttgcagt

SEQ ID NO: 15587 - DNA, 22 bp, Homo sapiens
acaattctgatggtttcccagt

SEQ ID NO: 15588 - DNA, 22 bp, Homo sapiens
tcagcctgctccaagtgctgcc

SEQ ID NO: 15589 - DNA, 22 bp, Homo sapiens
tcaggggcttgaggtgcatgtc

SEQ ID NO: 15590 - DNA, 22 bp, Homo sapiens
gaggggagcccccatcctccag

SEQ ID NO: 15591 - DNA, 22 bp, Homo sapiens
atcccaggcggcacaggttgca

SEQ ID NO: 15592 - DNA, 22 bp, Homo sapiens
gcccaggctggagtgcagtggt

SEQ ID NO: 15593 - DNA, 22 bp, Homo sapiens
ttcacagcttaataaggctcag

SEQ ID NO: 15594 - DNA, 22 bp, Homo sapiens
ttggaggcaatgggaaggaggc

SEQ ID NO: 15595 - DNA, 22 bp, Homo sapiens
ggggtggatttcaggcggtgtc

SEQ ID NO: 15596 - DNA, 22 bp, Homo sapiens
tttgtgaataggttggcttcca

SEQ ID NO: 15597 - DNA, 22 bp, Homo sapiens
ctgggaggcggagcttgcagtg

SEQ ID NO: 15598 - DNA, 19 bp, Homo sapiens
catctggatgattctcctg

SEQ ID NO: 15599 - DNA, 22 bp, Homo sapiens
gctttatccgcttgacccttac

SEQ ID NO: 15600 - DNA, 22 bp, Homo sapiens
gccccagcctcccgagtagctg

SEQ ID NO: 15601 - DNA, 22 bp, Homo sapiens
gaatgctaagcatgtgggagtt

SEQ ID NO: 15602 - DNA, 22 bp, Homo sapiens
gcccaggaggagaggctgcagt

SEQ ID NO: 15603 - DNA, 22 bp, Homo sapiens
tgctgggctggggcctcagacc

SEQ ID NO: 15604 - DNA, 22 bp, Homo sapiens
acatttatataactcactagga

SEQ ID NO: 15605 - DNA, 21 bp, Homo sapiens
tgggggtcttcacggtgttgt

SEQ ID NO: 15606 - DNA, 22 bp, Homo sapiens
tcgcaccattgcactccagcca

SEQ ID NO: 15607 - DNA, 22 bp, Homo sapiens
gcccagtggtaaaagcaggcct

SEQ ID NO: 15608 - DNA, 22 bp, Homo sapiens
ctggagggtggagagaagtctc

SEQ ID NO: 15609 - DNA, 22 bp, Homo sapiens
agaggccggccgagcccatggg

SEQ ID NO: 15610 - DNA, 22 bp, Homo sapiens
tcttaagcagagaagaagttga

SEQ ID NO: 15611 - DNA, 22 bp, Homo sapiens
agtgctgggctatctactgcta

SEQ ID NO: 15612 - DNA, 22 bp, Homo sapiens
ggggtcggggcatagccactta

SEQ ID NO: 15613 - DNA, 22 bp, Homo sapiens
gatttctctgcacccactcagg

SEQ ID NO: 15614 - DNA, 22 bp, Homo sapiens
agggctgcccagtgtgagagct

SEQ ID NO: 15615 - DNA, 22 bp, Homo sapiens
tggaggcagccgtgaaccacct

SEQ ID NO: 15616 - DNA, 22 bp, Homo sapiens
caaggtgccatgctgggcgggg

SEQ ID NO: 15617 - DNA, 18 bp, Homo sapiens
ccctgccagctcccagca

SEQ ID NO: 15618 - DNA, 22 bp, Homo sapiens
aacattgaacttggcacaccca

SEQ ID NO: 15619 - DNA, 22 bp, Homo sapiens
atacagttatagtcagggctaa

SEQ ID NO: 15620 - DNA, 22 bp, Homo sapiens
ggtgccaggctgtagtcagggt

SEQ ID NO: 15621 - DNA, 22 bp, Homo sapiens
agagcggggatagttaatattc

SEQ ID NO: 15622 - DNA, 22 bp, Homo sapiens
ccacagtcctggcttctgtctg

SEQ ID NO: 15623 - DNA, 22 bp, Homo sapiens
ctgtggctctcagaggctgctg

SEQ ID NO: 15624 - DNA, 22 bp, Homo sapiens
cgtcctctagagggaagcactt

SEQ ID NO: 15625 - DNA, 22 bp, Homo sapiens
gacccacctcaccaagcatgtg

SEQ ID NO: 15626 - DNA, 22 bp, Homo sapiens
tagcacagggctcctcaaccca

SEQ ID NO: 15627 - DNA, 22 bp, Homo sapiens
agtccgcctgctgccgtggcag

SEQ ID NO: 15628 - DNA, 22 bp, Homo sapiens
tctgctcagccgatctgctccg

SEQ ID NO: 15629 - DNA, 22 bp, Homo sapiens
ggaggagacagtaaaaagcacg

SEQ ID NO: 15630 - DNA, 22 bp, Homo sapiens
atgctaaggcccaggagaaaat

SEQ ID NO: 15631 - DNA, 22 bp, Homo sapiens
tccaaacgggagccaaatgagc

SEQ ID NO: 15632 - DNA, 22 bp, Homo sapiens
gatggaggagatggcagggtgc

SEQ ID NO: 15633 - DNA, 22 bp, Homo sapiens
gggcgccgtgggaaacagccgg

SEQ ID NO: 15634 - DNA, 22 bp, Homo sapiens
cgtgggtcgggactccgcctcg

SEQ ID NO: 15635 - DNA, 22 bp, Homo sapiens
agtgaggggcagctgagtgggc

SEQ ID NO: 15636 - DNA, 22 bp, Homo sapiens
tggaggccagaggtactgggac

SEQ ID NO: 15637 - DNA, 22 bp, Homo sapiens
cctggaggcggaggttgcagtg

SEQ ID NO: 15638 - DNA, 22 bp, Homo sapiens
gaaaggagagggttaaggagct

SEQ ID NO: 15639 - DNA, 22 bp, Homo sapiens
aagaggttgtctgtgatgagtt

SEQ ID NO: 15640 - DNA, 22 bp, Homo sapiens
aaggtagggatgtattcagctt

SEQ ID NO: 15641 - DNA, 22 bp, Homo sapiens
acgggctgggacggggaagctc

SEQ ID NO: 15642 - DNA, 22 bp, Homo sapiens
ctgggcgcgtcccctgaggcgg

SEQ ID NO: 15643 - DNA, 22 bp, Homo sapiens
cttggtgccacagcagcttgcg

SEQ ID NO: 15644 - DNA, 22 bp, Homo sapiens
actgggccaggtgtgggtgagt

SEQ ID NO: 15645 - DNA, 22 bp, Homo sapiens
ctctctgggcccagttggcacc

SEQ ID NO: 15646 - DNA, 22 bp, Homo sapiens
acactgtgtgacttctgagact

SEQ ID NO: 15647 - DNA, 22 bp, Homo sapiens
gcgcactgggcgcacgcgtagg

SEQ ID NO: 15648 - DNA, 22 bp, Homo sapiens
gagtccaccacagctcaaagag

SEQ ID NO: 15649 - DNA, 22 bp, Homo sapiens
agacagggtgatcgcttgagcc

SEQ ID NO: 15650 - DNA, 22 bp, Homo sapiens
ccttctagcaaatcaacataaa

SEQ ID NO: 15651 - DNA, 22 bp, Homo sapiens
tccaagatctacagcagtttag

SEQ ID NO: 15652 - DNA, 22 bp, Homo sapiens
tgccaggcgtggtggtgcgcac

SEQ ID NO: 15653 - DNA, 22 bp, Homo sapiens
catgatctggtcctactgtggg

SEQ ID NO: 15654 - DNA, 22 bp, Homo sapiens
agagtgcaaccgaaacaagcag

SEQ ID NO: 15655 - DNA, 22 bp, Homo sapiens
gcggggcccggacccagcctct

SEQ ID NO: 15656 - DNA, 22 bp, Homo sapiens
ctcattgcagctgcattactgt

SEQ ID NO: 15657 - DNA, 23 bp, Homo sapiens
acagcaagaggaccagatgtgag

SEQ ID NO: 15658 - DNA, 22 bp, Homo sapiens
cgagcatgatgacggctgtggc

SEQ ID NO: 15659 - DNA, 22 bp, Homo sapiens
ttccactctacacactgctggc

SEQ ID NO: 15660 - DNA, 22 bp, Homo sapiens
ttaagtgcaaaaatgaaagtat

SEQ ID NO: 15661 - DNA, 22 bp, Homo sapiens
gagaggtggaggttgcagtgag

SEQ ID NO: 15662 - DNA, 22 bp, Homo sapiens
aggggaggtgtccccaaatctc

SEQ ID NO: 15663 - DNA, 22 bp, Homo sapiens
ttgatgaggggatcagggtagc

SEQ ID NO: 15664 - DNA, 22 bp, Homo sapiens
tctagggtgtataaggaagcct

SEQ ID NO: 15665 - DNA, 22 bp, Homo sapiens
gggctgagacgatggggtcttc

SEQ ID NO: 15666 - DNA, 23 bp, Homo sapiens
caccccaccctgaggaggaggga

SEQ ID NO: 15667 - DNA, 23 bp, Homo sapiens
ttgcagaagcagacgaccataat

SEQ ID NO: 15668 - DNA, 22 bp, Homo sapiens
aggagggagcttaagccaggca

SEQ ID NO: 15669 - DNA, 22 bp, Homo sapiens
tgcgcggctcagtcatctccag

SEQ ID NO: 15670 - DNA, 22 bp, Homo sapiens
gaggcctcagcctgccctgaac

SEQ ID NO: 15671 - DNA, 23 bp, Homo sapiens
ctggggctttcaaatctgggcag

SEQ ID NO: 15672 - DNA, 22 bp, Homo sapiens
tgggaaagtctttatttctctt

SEQ ID NO: 15673 - DNA, 22 bp, Homo sapiens
ccctggaggttgaggctgcagt

SEQ ID NO: 15674 - DNA, 22 bp, Homo sapiens
cagtggaggccttgggaccttt

SEQ ID NO: 15675 - DNA, 22 bp, Homo sapiens
gagccccaccctagacattctg

SEQ ID NO: 15676 - DNA, 22 bp, Homo sapiens
ccttcccacattccttacatgc

SEQ ID NO: 15677 - DNA, 22 bp, Homo sapiens
gctgacccctacaggttgtgtt

SEQ ID NO: 15678 - DNA, 22 bp, Homo sapiens
ttttgagatggagtcttgctct

SEQ ID NO: 15679 - DNA, 22 bp, Homo sapiens
gggaaatctcgtcctctattta

SEQ ID NO: 15680 - DNA, 21 bp, Homo sapiens
tactgtagccttgcactgtag

SEQ ID NO: 15681 - DNA, 22 bp, Homo sapiens
aaagaaggtagggctggtgact

SEQ ID NO: 15682 - DNA, 22 bp, Homo sapiens
gtggcagagccaaggctggagc

SEQ ID NO: 15683 - DNA, 22 bp, Homo sapiens
gtctccggccgccctggtgctg

SEQ ID NO: 15684 - DNA, 22 bp, Homo sapiens
acagttaataagtagtaagtca

SEQ ID NO: 15685 - DNA, 22 bp, Homo sapiens
ttacttaaacagaaatgcagaa

SEQ ID NO: 15686 - DNA, 22 bp, Homo sapiens
caggctggagtgcagtggtgcc

SEQ ID NO: 15687 - DNA, 22 bp, Homo sapiens
aggaggggttctcgggtgctga

SEQ ID NO: 15688 - DNA, 22 bp, Homo sapiens
tttgagatctcaatgaggacta

SEQ ID NO: 15689 - DNA, 22 bp, Homo sapiens
cactgcactccagcactccagc

SEQ ID NO: 15690 - DNA, 22 bp, Homo sapiens
ctctgcaacttctagcagtgtc

SEQ ID NO: 15691 - DNA, 22 bp, Homo sapiens
caggcgctgtggctcccacctg

SEQ ID NO: 15692 - DNA, 22 bp, Homo sapiens
cgggcagcggcgtggccatggt

SEQ ID NO: 15693 - DNA, 22 bp, Homo sapiens
tatgacttttcccaattcagga

SEQ ID NO: 15694 - DNA, 22 bp, Homo sapiens
ctgaaattctttggagttttct

SEQ ID NO: 15695 - DNA, 22 bp, Homo sapiens
tttgtagattttctctccagta

SEQ ID NO: 15696 - DNA, 19 bp, Homo sapiens
agccccttggtactgtcct

SEQ ID NO: 15697 - DNA, 22 bp, Homo sapiens
aaggagaaatggtagatgtgca

SEQ ID NO: 15698 - DNA, 22 bp, Homo sapiens
actgtactccagcctgggaaac

SEQ ID NO: 15699 - DNA, 22 bp, Homo sapiens
ttgctaccattgataccagcac

SEQ ID NO: 15700 - DNA, 22 bp, Homo sapiens
cggggcgagcagacggcggcaa

SEQ ID NO: 15701 - DNA, 22 bp, Homo sapiens
aactaatacattaatacatgtg

SEQ ID NO: 15702 - DNA, 22 bp, Homo sapiens
gggggaagaaagaacatggcat

SEQ ID NO: 15703 - DNA, 20 bp, Homo sapiens
aggccccaggtggacactag

SEQ ID NO: 15704 - DNA, 22 bp, Homo sapiens
tctgtagtaggttgtagttctt

SEQ ID NO: 15705 - DNA, 22 bp, Homo sapiens
tctcctggagcccagatgctgg

SEQ ID NO: 15706 - DNA, 22 bp, Homo sapiens
ggggcaggagcccttcttcagc

SEQ ID NO: 15707 - DNA, 22 bp, Homo sapiens
agggcgctgaaatactaacatg

SEQ ID NO: 15708 - DNA, 22 bp, Homo sapiens
ccaggaggcggaaggtacagtg

SEQ ID NO: 15709 - DNA, 22 bp, Homo sapiens
gaggcagaggttgcagtgagct

SEQ ID NO: 15710 - DNA, 22 bp, Homo sapiens
aggtggaaatggctttcctagg

SEQ ID NO: 15711 - DNA, 19 bp, Homo sapiens
caggcctcttaccctctct

SEQ ID NO: 15712 - DNA, 22 bp, Homo sapiens
taaaggtagtgtgacatattgt

SEQ ID NO: 15713 - DNA, 22 bp, Homo sapiens
actgggcctgattgggtcggag

SEQ ID NO: 15714 - DNA, 22 bp, Homo sapiens
tgaaggggttcagcatgggggt

SEQ ID NO: 15715 - DNA, 21 bp, Homo sapiens
tctgatggtagatgagatgtg

SEQ ID NO: 15716 - DNA, 22 bp, Homo sapiens
cgttaataggtgcaaggtaagg

SEQ ID NO: 15717 - DNA, 22 bp, Homo sapiens
gcacggctaatttttgtatttt

SEQ ID NO: 15718 - DNA, 22 bp, Homo sapiens
gcctccagggatgattccttcc

SEQ ID NO: 15719 - DNA, 23 bp, Homo sapiens
cgcccagcctcagtgacctgggc

SEQ ID NO: 15720 - DNA, 22 bp, Homo sapiens
tgggtgctctgcgaccgtaggg

SEQ ID NO: 15721 - DNA, 22 bp, Homo sapiens
cagcctggtccccggctcaccc

SEQ ID NO: 15722 - DNA, 22 bp, Homo sapiens
actgggctcaagtgattgtcct

SEQ ID NO: 15723 - DNA, 19 bp, Homo sapiens
acacagggatcagagggtt

SEQ ID NO: 15724 - DNA, 22 bp, Homo sapiens
cgggttttccacaggagtcttt

SEQ ID NO: 15725 - DNA, 20 bp, Homo sapiens
ataaaataactgccacaaga

SEQ ID NO: 15726 - DNA, 22 bp, Homo sapiens
ggaggcggaagttgcagtgagc

SEQ ID NO: 15727 - DNA, 22 bp, Homo sapiens
tagactggtgaattagggggaa

SEQ ID NO: 15728 - DNA, 22 bp, Homo sapiens
aaagtgctaggattacaagcgt

SEQ ID NO: 15729 - DNA, 22 bp, Homo sapiens
ttcttctcagggtcccacatgg

SEQ ID NO: 15730 - DNA, 22 bp, Homo sapiens
tgaggcaggagaatcaccggaa

SEQ ID NO: 15731 - DNA, 21 bp, Homo sapiens
cctcaaagatgatggggtttc

SEQ ID NO: 15732 - DNA, 21 bp, Homo sapiens
ggtgctcgctgatgaggagtg

SEQ ID NO: 15733 - DNA, 22 bp, Homo sapiens
actgccctccagcctgggtgac

SEQ ID NO: 15734 - DNA, 22 bp, Homo sapiens
cctcgcggcactcgggccggat

SEQ ID NO: 15735 - DNA, 22 bp, Homo sapiens
tttcacagaggaggaagctgag

SEQ ID NO: 15736 - DNA, 22 bp, Homo sapiens
tgggcttaggtcggaggcggcc

SEQ ID NO: 15737 - DNA, 22 bp, Homo sapiens
caggctggagtgcagtggcgcc

SEQ ID NO: 15738 - DNA, 22 bp, Homo sapiens
gctgcagggagctggaaggctc

SEQ ID NO: 15739 - DNA, 22 bp, Homo sapiens
gccccgtcgtggggccagggat

SEQ ID NO: 15740 - DNA, 22 bp, Homo sapiens
ggggtgggcgtgcagggacacc

SEQ ID NO: 15741 - DNA, 22 bp, Homo sapiens
ggcaggactgatcagtgggatg

SEQ ID NO: 15742 - DNA, 22 bp, Homo sapiens
gcccccgtagtagatgaggcgc

SEQ ID NO: 15743 - DNA, 22 bp, Homo sapiens
caagtctgacctctgggtgaag

SEQ ID NO: 15744 - DNA, 18 bp, Homo sapiens
tcttccaacactgacacc

SEQ ID NO: 15745 - DNA, 22 bp, Homo sapiens
aatgtgaggccttggtagttat

SEQ ID NO: 15746 - DNA, 22 bp, Homo sapiens
tagcacagcttcttgatgtcac

SEQ ID NO: 15747 - DNA, 22 bp, Homo sapiens
gttttagataaagctgtccttg

SEQ ID NO: 15748 - DNA, 22 bp, Homo sapiens
tagctgggactactggccctgc

SEQ ID NO: 15749 - DNA, 22 bp, Homo sapiens
caggaaggcgcggctgtgcctg

SEQ ID NO: 15750 - DNA, 22 bp, Homo sapiens
gagcaggaaggccagaagggtc

SEQ ID NO: 15751 - DNA, 22 bp, Homo sapiens
cctgcgggctgtgctgaagcct

SEQ ID NO: 15752 - DNA, 22 bp, Homo sapiens
acgcctgtaatcccagcacttt

SEQ ID NO: 15753 - DNA, 22 bp, Homo sapiens
ttgaaattttaggccttgcaat

SEQ ID NO: 15754 - DNA, 22 bp, Homo sapiens
catgtgaattccaaagctaggt

SEQ ID NO: 15755 - DNA, 23 bp, Homo sapiens
tgtgggcgcattgtaagggtagc

SEQ ID NO: 15756 - DNA, 22 bp, Homo sapiens
gagggccctggctggctccagc

SEQ ID NO: 15757 - DNA, 22 bp, Homo sapiens
cgagagttagctaggagtcaca

SEQ ID NO: 15758 - DNA, 22 bp, Homo sapiens
tgcctcagctgaggccgctcca

SEQ ID NO: 15759 - DNA, 22 bp, Homo sapiens
agaatagaattctcatagaatt

SEQ ID NO: 15760 - DNA, 22 bp, Homo sapiens
gggaggaggaatgttttgtgta

SEQ ID NO: 15761 - DNA, 20 bp, Homo sapiens
ggtggccgtagcgggcggcg

SEQ ID NO: 15762 - DNA, 22 bp, Homo sapiens
gtggcccaggctggagtgcagt

SEQ ID NO: 15763 - DNA, 22 bp, Homo sapiens
aggctcgcatgccctgcaccac

SEQ ID NO: 15764 - DNA, 22 bp, Homo sapiens
ctggaggtgcttcgctggccac

SEQ ID NO: 15765 - DNA, 22 bp, Homo sapiens
actgtactccagccttggggac

SEQ ID NO: 15766 - DNA, 19 bp, Homo sapiens
ggggcccggggtctgcgag

SEQ ID NO: 15767 - DNA, 22 bp, Homo sapiens
aaagaaatagatggcatttaaa

SEQ ID NO: 15768 - DNA, 22 bp, Homo sapiens
aaagcttaccttttcagtcttt

SEQ ID NO: 15769 - DNA, 22 bp, Homo sapiens
gggaggcacgaggcgcgcagtg

SEQ ID NO: 15770 - DNA, 22 bp, Homo sapiens
agtgctgtcagttttatagata

SEQ ID NO: 15771 - DNA, 22 bp, Homo sapiens
gggcttcagttctgaccatctt

SEQ ID NO: 15772 - DNA, 22 bp, Homo sapiens
aaaaaattatcatagttcctga

SEQ ID NO: 15773 - DNA, 22 bp, Homo sapiens
tgcgggagggcaacgcggcatt

SEQ ID NO: 15774 - DNA, 22 bp, Homo sapiens
actgtactccaacctgggcaac

SEQ ID NO: 15775 - DNA, 22 bp, Homo sapiens
gaggccactgtccctgccttcc

SEQ ID NO: 15776 - DNA, 22 bp, Homo sapiens
atcatcatgcccacttgagact

SEQ ID NO: 15777 - DNA, 22 bp, Homo sapiens
ttgggctcaggagtttgagacc

SEQ ID NO: 15778 - DNA, 22 bp, Homo sapiens
actctgtcttcatatttgcatt

SEQ ID NO: 15779 - DNA, 22 bp, Homo sapiens
ctgggaggtggaggttgcattg

SEQ ID NO: 15780 - DNA, 22 bp, Homo sapiens
actgtactccagcctgggggac

SEQ ID NO: 15781 - DNA, 22 bp, Homo sapiens
gagaaatatggctcagttccac

SEQ ID NO: 15782 - DNA, 22 bp, Homo sapiens
agggctggagccacagctggga

SEQ ID NO: 15783 - DNA, 22 bp, Homo sapiens
atagcagggatgtcagcaagta

SEQ ID NO: 15784 - DNA, 22 bp, Homo sapiens
gggggcttggcccggtctggtt

SEQ ID NO: 15785 - DNA, 20 bp, Homo sapiens
atggggtgagtgacgccctc

SEQ ID NO: 15786 - DNA, 22 bp, Homo sapiens
agggaagaggaccagagtctct

SEQ ID NO: 15787 - DNA, 22 bp, Homo sapiens
ggaaggcagaggtgtcgtgggg

SEQ ID NO: 15788 - DNA, 22 bp, Homo sapiens
tgttgcccaggttctctcctgc

SEQ ID NO: 15789 - DNA, 21 bp, Homo sapiens
cagagctgtccaaaccctgac

SEQ ID NO: 15790 - DNA, 22 bp, Homo sapiens
gggaggcagtgctggaggctgg

SEQ ID NO: 15791 - DNA, 21 bp, Homo sapiens
ctctgtttgcctgctgccatc

SEQ ID NO: 15792 - DNA, 22 bp, Homo sapiens
ctgagcagatgaccagccccag

SEQ ID NO: 15793 - DNA, 22 bp, Homo sapiens
actgggcctacccagattggca

SEQ ID NO: 15794 - DNA, 22 bp, Homo sapiens
tggagaattctatgttgagggg

SEQ ID NO: 15795 - DNA, 22 bp, Homo sapiens
gaggggcacagtaaagggtccc

SEQ ID NO: 15796 - DNA, 18 bp, Homo sapiens
cccacggtgctgtagggc

SEQ ID NO: 15797 - DNA, 22 bp, Homo sapiens
attttctatgttgtaattgtta

SEQ ID NO: 15798 - DNA, 22 bp, Homo sapiens
aggggatgcctagtggagtctc

SEQ ID NO: 15799 - DNA, 22 bp, Homo sapiens
ttctgggtttacatctgacttc

SEQ ID NO: 15800 - DNA, 19 bp, Homo sapiens
ggagccgccgcccttcatt

SEQ ID NO: 15801 - DNA, 22 bp, Homo sapiens
ttagacatgatggtgcagagag

SEQ ID NO: 15802 - DNA, 22 bp, Homo sapiens
ctttatgaaaacctgaattatg

SEQ ID NO: 15803 - DNA, 22 bp, Homo sapiens
aggtgtctggacttgtgaagca

SEQ ID NO: 15804 - DNA, 22 bp, Homo sapiens
ggctgggcaggtctgcacaggg

SEQ ID NO: 15805 - DNA, 22 bp, Homo sapiens
taagaaatttagttatagaatg

SEQ ID NO: 15806 - DNA, 22 bp, Homo sapiens
gtttacttgtgccttggcttaa

SEQ ID NO: 15807 - DNA, 22 bp, Homo sapiens
tgggcggactcgggcatggaat

SEQ ID NO: 15808 - DNA, 22 bp, Homo sapiens
atgagaaagttaatcatcatga

SEQ ID NO: 15809 - DNA, 22 bp, Homo sapiens
actgcaacctccgcctgccagg

SEQ ID NO: 15810 - DNA, 22 bp, Homo sapiens
gcctcctgtcccaggctgagga

SEQ ID NO: 15811 - DNA, 22 bp, Homo sapiens
tggctgagttacgaacagagca

SEQ ID NO: 15812 - DNA, 22 bp, Homo sapiens
cagtgcagccaaggacaggcac

SEQ ID NO: 15813 - DNA, 22 bp, Homo sapiens
caggcgggcaggtgcggcccct

SEQ ID NO: 15814 - DNA, 22 bp, Homo sapiens
taaaggtctgaacacagtgagg

SEQ ID NO: 15815 - DNA, 22 bp, Homo sapiens
tggccaccaccaatacttgcct

SEQ ID NO: 15816 - DNA, 22 bp, Homo sapiens
cacgcacgctgggtggaggcgc

SEQ ID NO: 15817 - DNA, 22 bp, Homo sapiens
tacaacaatttccacattagaa

SEQ ID NO: 15818 - DNA, 22 bp, Homo sapiens
tgtctcctcggctgtccagcca

SEQ ID NO: 15819 - DNA, 22 bp, Homo sapiens
tggtattacttctagacacaag

SEQ ID NO: 15820 - DNA, 21 bp, Homo sapiens
gctgctcgagatccagtgctt

SEQ ID NO: 15821 - DNA, 23 bp, Homo sapiens
gacagagtgagaccttgtcttac

SEQ ID NO: 15822 - DNA, 22 bp, Homo sapiens
tcaccaggctggagtgcagtgg

SEQ ID NO: 15823 - DNA, 22 bp, Homo sapiens
cagccctcctaccctgccaggc

SEQ ID NO: 15824 - DNA, 22 bp, Homo sapiens
ggcctcacccatcggtgccttt

SEQ ID NO: 15825 - DNA, 22 bp, Homo sapiens
actgtactccagctctgggtga

SEQ ID NO: 15826 - DNA, 22 bp, Homo sapiens
aataatctcactttatgtggaa

SEQ ID NO: 15827 - DNA, 22 bp, Homo sapiens
gacggagctggttgctgcggct

SEQ ID NO: 15828 - DNA, 22 bp, Homo sapiens
tcctagttctctgccagtcgct

SEQ ID NO: 15829 - DNA, 22 bp, Homo sapiens
ttgtgaatagtgccgctataaa

SEQ ID NO: 15830 - DNA, 22 bp, Homo sapiens
tcagcctggcaggatggcctgg

SEQ ID NO: 15831 - DNA, 22 bp, Homo sapiens
cactgcactccagcccgggcaa

SEQ ID NO: 15832 - DNA, 22 bp, Homo sapiens
ggaaggggtgggtgagcctcag

SEQ ID NO: 15833 - DNA, 22 bp, Homo sapiens
atgaaatatcttgaagaaattc

SEQ ID NO: 15834 - DNA, 20 bp, Homo sapiens
ggccggggagctctccaggg

SEQ ID NO: 15835 - DNA, 22 bp, Homo sapiens
ttgcatttggttctgcctggta

SEQ ID NO: 15836 - DNA, 22 bp, Homo sapiens
aggcgcctgcgggatccttgcc

SEQ ID NO: 15837 - DNA, 18 bp, Homo sapiens
agagtatacagacaacaa

SEQ ID NO: 15838 - DNA, 22 bp, Homo sapiens
ggctctgcttgaggccagcctg

SEQ ID NO: 15839 - DNA, 21 bp, Homo sapiens
cgcagagcgaacttgcggcgc

SEQ ID NO: 15840 - DNA, 22 bp, Homo sapiens
tgggaaagctgcagaaattctc

SEQ ID NO: 15841 - DNA, 22 bp, Homo sapiens
cccacacacatttatgatagga

SEQ ID NO: 15842 - DNA, 22 bp, Homo sapiens
tctgcaacattcctctccccac

SEQ ID NO: 15843 - DNA, 22 bp, Homo sapiens
tttgaaatgtatcagtataggt

SEQ ID NO: 15844 - DNA, 22 bp, Homo sapiens
agtggagacaggacagtcgata

SEQ ID NO: 15845 - DNA, 20 bp, Homo sapiens
ggcctcggacttcatcgtag

SEQ ID NO: 15846 - DNA, 22 bp, Homo sapiens
cacagagatggtctggcaggtg

SEQ ID NO: 15847 - DNA, 22 bp, Homo sapiens
ttgtctaatgagctccacttca

SEQ ID NO: 15848 - DNA, 22 bp, Homo sapiens
aggggctcctttgtgctgcgtc

SEQ ID NO: 15849 - DNA, 22 bp, Homo sapiens
taacaaagtattgtttgtgtat

SEQ ID NO: 15850 - DNA, 22 bp, Homo sapiens
cagcagcagtgttctagaatct

SEQ ID NO: 15851 - DNA, 22 bp, Homo sapiens
ggtgccagatgaggcccgcgat

SEQ ID NO: 15852 - DNA, 22 bp, Homo sapiens
aggaggaagggaagacaagtaa

SEQ ID NO: 15853 - DNA, 17 bp, Homo sapiens
ggctgcagtccaggagg

SEQ ID NO: 15854 - DNA, 22 bp, Homo sapiens
aagcctggcacattggagtctg

SEQ ID NO: 15855 - DNA, 22 bp, Homo sapiens
acaattctgatggtttcccagt

SEQ ID NO: 15856 - DNA, 22 bp, Homo sapiens
atgccactgcgctccagcctgg

SEQ ID NO: 15857 - DNA, 22 bp, Homo sapiens
acagaagcctttggccatttga

SEQ ID NO: 15858 - DNA, 22 bp, Homo sapiens
gcagaagcacaggtgacgggcc

SEQ ID NO: 15859 - DNA, 22 bp, Homo sapiens
ttggatccatctcaggcatagg

SEQ ID NO: 15860 - DNA, 22 bp, Homo sapiens
tacccaaggccctttcaatttc

SEQ ID NO: 15861 - DNA, 23 bp, Homo sapiens
acagtcgtaggtatccttttcct

SEQ ID NO: 15862 - DNA, 22 bp, Homo sapiens
gcttggccagcagccgggatgc

SEQ ID NO: 15863 - DNA, 22 bp, Homo sapiens
ttcatagtgtttccttccagtg

SEQ ID NO: 15864 - DNA, 22 bp, Homo sapiens
atgccactgcgctctagcctgg

SEQ ID NO: 15865 - DNA, 20 bp, Homo sapiens
tttgagaccagtctgcccaa

SEQ ID NO: 15866 - DNA, 21 bp, Homo sapiens
acatggactgtgaatggggac

SEQ ID NO: 15867 - DNA, 22 bp, Homo sapiens
taaatacttagttttgtgtcta

SEQ ID NO: 15868 - DNA, 22 bp, Homo sapiens
ccaagctacttaggagtctgag

SEQ ID NO: 15869 - DNA, 22 bp, Homo sapiens
gttaaggatcttgagatgagga

SEQ ID NO: 15870 - DNA, 22 bp, Homo sapiens
ttatttttaaaagttcacacag

SEQ ID NO: 15871 - DNA, 22 bp, Homo sapiens
aaggagtctgggccattcagag

SEQ ID NO: 15872 - DNA, 20 bp, Homo sapiens
ataaaataactgccacaaga

SEQ ID NO: 15873 - DNA, 22 bp, Homo sapiens
gaccatcctggccaacgtggta

SEQ ID NO: 15874 - DNA, 22 bp, Homo sapiens
tgtgacctcatcttaactggaa

SEQ ID NO: 15875 - DNA, 22 bp, Homo sapiens
aagtcagacagctgagctgcct

SEQ ID NO: 15876 - DNA, 22 bp, Homo sapiens
agcttgtagaaggccacgagca

SEQ ID NO: 15877 - DNA, 22 bp, Homo sapiens
atgccacttcattccagcctcg

SEQ ID NO: 15878 - DNA, 22 bp, Homo sapiens
ttcttctaaatgtgcttattaa

SEQ ID NO: 15879 - DNA, 22 bp, Homo sapiens
tacgcctgtaatcccagcactt

SEQ ID NO: 15880 - DNA, 22 bp, Homo sapiens
aagaggagaaaggctggctttg

SEQ ID NO: 15881 - DNA, 22 bp, Homo sapiens
actgcactccaacctgggtgac

SEQ ID NO: 15882 - DNA, 22 bp, Homo sapiens
ctgaacttattgagtgcttgct

SEQ ID NO: 15883 - DNA, 22 bp, Homo sapiens
gggcggatcatttgaggtcagg

SEQ ID NO: 15884 - DNA, 22 bp, Homo sapiens
aggggcgtgctcttccccgacg

SEQ ID NO: 15885 - DNA, 22 bp, Homo sapiens
agaggctgcacttgctcatgat

SEQ ID NO: 15886 - DNA, 22 bp, Homo sapiens
gagaggtggaggttgcagtgag

SEQ ID NO: 15887 - DNA, 22 bp, Homo sapiens
ggctttgacatgctgaattaaa

SEQ ID NO: 15888 - DNA, 22 bp, Homo sapiens
cctacagttatattcttgattg

SEQ ID NO: 15889 - DNA, 23 bp, Homo sapiens
atgtttgcagtaacccatcctgg

SEQ ID NO: 15890 - DNA, 22 bp, Homo sapiens
gaaaattattgaaaatggctct

SEQ ID NO: 15891 - DNA, 22 bp, Homo sapiens
actgcacttcaccctgggtgac

SEQ ID NO: 15892 - DNA, 22 bp, Homo sapiens
cctgggaggctgaggctgcagt

SEQ ID NO: 15893 - DNA, 22 bp, Homo sapiens
ttatttaatgtgatctgaagag

SEQ ID NO: 15894 - DNA, 22 bp, Homo sapiens
attgctaggaacaggttgcacc

SEQ ID NO: 15895 - DNA, 22 bp, Homo sapiens
attaagactgcccatgttttta

SEQ ID NO: 15896 - DNA, 22 bp, Homo sapiens
atgccactgcactccagcctgg

SEQ ID NO: 15897 - DNA, 22 bp, Homo sapiens
acattaaaattgggtggggtaa

SEQ ID NO: 15898 - DNA, 22 bp, Homo sapiens
tgaaggtgggaattcaccaggt

SEQ ID NO: 15899 - DNA, 22 bp, Homo sapiens
acccgatgttggtgctctagta

SEQ ID NO: 15900 - DNA, 20 bp, Homo sapiens
tttctgtgagaaacactgtt

SEQ ID NO: 15901 - DNA, 22 bp, Homo sapiens
cttcctcctccatctcgaaggc

SEQ ID NO: 15902 - DNA, 22 bp, Homo sapiens
tgtgaagaattaatgtgaatca

SEQ ID NO: 15903 - DNA, 22 bp, Homo sapiens
cttagagatgggttttacttag

SEQ ID NO: 15904 - DNA, 22 bp, Homo sapiens
tttaatcataagaaggaaaata

SEQ ID NO: 15905 - DNA, 22 bp, Homo sapiens
cactgcactccagcctgggaga

SEQ ID NO: 15906 - DNA, 18 bp, Homo sapiens
tgagaggctattttttgc

SEQ ID NO: 15907 - DNA, 22 bp, Homo sapiens
gcgagaaactaagtgccctttg

SEQ ID NO: 15908 - DNA, 22 bp, Homo sapiens
ggtttgacagcttggggctgtc

SEQ ID NO: 15909 - DNA, 22 bp, Homo sapiens
cactgcactccagcctgggtca

SEQ ID NO: 15910 - DNA, 22 bp, Homo sapiens
ccgtggtcacctgagctccttg

SEQ ID NO: 15911 - DNA, 22 bp, Homo sapiens
tttgcattgcattaagtattct

SEQ ID NO: 15912 - DNA, 17 bp, Homo sapiens
catcaaagaaatttcca

SEQ ID NO: 15913 - DNA, 22 bp, Homo sapiens
agcgccactgcactccagcctg

SEQ ID NO: 15914 - DNA, 22 bp, Homo sapiens
gcctcactgcagccccaggaag

SEQ ID NO: 15915 - DNA, 22 bp, Homo sapiens
gaccttcttgctgtgtcctaac

SEQ ID NO: 15916 - DNA, 22 bp, Homo sapiens
tgcactccaggctgggtgacag

SEQ ID NO: 15917 - DNA, 22 bp, Homo sapiens
gttcaagaccagcctggccaac

SEQ ID NO: 15918 - DNA, 19 bp, Homo sapiens
gagtattttccaacttggt

SEQ ID NO: 15919 - DNA, 22 bp, Homo sapiens
gagaacagaagcattcctaatt

SEQ ID NO: 15920 - DNA, 22 bp, Homo sapiens
cgtgccactgcactctagcctg

SEQ ID NO: 15921 - DNA, 22 bp, Homo sapiens
ctgctaaacctctctgagagct

SEQ ID NO: 15922 - DNA, 22 bp, Homo sapiens
actgcacttcagcctgggtgtc

SEQ ID NO: 15923 - DNA, 22 bp, Homo sapiens
actttaaaactgatcatcagag

SEQ ID NO: 15924 - DNA, 22 bp, Homo sapiens
ccggctactcgggaggctgacg

SEQ ID NO: 15925 - DNA, 22 bp, Homo sapiens
ggtgagttctcagcttattgca

SEQ ID NO: 15926 - DNA, 22 bp, Homo sapiens
tcgtgaggctctgcatcgcaca

SEQ ID NO: 15927 - DNA, 22 bp, Homo sapiens
gtcgtggagctcacagtgtgcc

SEQ ID NO: 15928 - DNA, 22 bp, Homo sapiens
gggaggttgaggctgcagtgag

SEQ ID NO: 15929 - DNA, 22 bp, Homo sapiens
ttaaatattatgttgtctgcaa

SEQ ID NO: 15930 - DNA, 22 bp, Homo sapiens
tcagcctccgaaagtgctggga

SEQ ID NO: 15931 - DNA, 22 bp, Homo sapiens
gggagctgagctggaagagaat

SEQ ID NO: 15932 - DNA, 22 bp, Homo sapiens
tcttgaacttctgcacactcag

SEQ ID NO: 15933 - DNA, 22 bp, Homo sapiens
atgccactgcactccagcctag

SEQ ID NO: 15934 - DNA, 22 bp, Homo sapiens
aaaaaattatcatagttcctga

SEQ ID NO: 15935 - DNA, 20 bp, Homo sapiens
aaattactgccacacatttc

SEQ ID NO: 15936 - DNA, 22 bp, Homo sapiens
ataaaagatcccttctgagctc

SEQ ID NO: 15937 - DNA, 22 bp, Homo sapiens
caggccagggttgagaagagaa

SEQ ID NO: 15938 - DNA, 22 bp, Homo sapiens
cttagatgaagtcacagaaccc

SEQ ID NO: 15939 - DNA, 22 bp, Homo sapiens
aagtcgtggcaggcttgcacga

SEQ ID NO: 15940 - DNA, 22 bp, Homo sapiens
gtctttatttgagattgtcatt

SEQ ID NO: 15941 - DNA, 22 bp, Homo sapiens
actgcacttcagcctgggtgac

SEQ ID NO: 15942 - DNA, 22 bp, Homo sapiens
ttgggctcaggagtttgagacc

SEQ ID NO: 15943 - DNA, 22 bp, Homo sapiens
aatttaagagcatagctccaac

SEQ ID NO: 15944 - DNA, 22 bp, Homo sapiens
gtatccatgggggattggttcc

SEQ ID NO: 15945 - DNA, 22 bp, Homo sapiens
tcgcaccattgcactccagcca

SEQ ID NO: 15946 - DNA, 20 bp, Homo sapiens
tttcttgtcggctgttgctg

SEQ ID NO: 15947 - DNA, 22 bp, Homo sapiens
tgtgagttcttagaaagtcagt

SEQ ID NO: 15948 - DNA, 19 bp, Homo sapiens
aggaatggaattaattctg

SEQ ID NO: 15949 - DNA, 22 bp, Homo sapiens
aactcaaagatgcatgacgctt

SEQ ID NO: 15950 - DNA, 22 bp, Homo sapiens
cactgcacttcagcctgggtga

SEQ ID NO: 15951 - DNA, 22 bp, Homo sapiens
ttatttaaaagtggtaagattc

SEQ ID NO: 15952 - DNA, 22 bp, Homo sapiens
gctcatgactgtaatcccagca

SEQ ID NO: 15953 - DNA, 21 bp, Homo sapiens
aggcttggatctagacaggcc

SEQ ID NO: 15954 - DNA, 20 bp, Homo sapiens
ttgagcttttagtacagaca

SEQ ID NO: 15955 - DNA, 17 bp, Homo sapiens
gtaaggcttgcagatgc

SEQ ID NO: 15956 - DNA, 22 bp, Homo sapiens
tgactctgataagacatatggc

SEQ ID NO: 15957 - DNA, 22 bp, Homo sapiens
ctgatcctcctttaagtagctg

SEQ ID NO: 15958 - DNA, 22 bp, Homo sapiens
tttaaaaaactagtctgagtct

SEQ ID NO: 15959 - DNA, 22 bp, Homo sapiens
tttcataatactgtacatgaaa

SEQ ID NO: 15960 - DNA, 22 bp, Homo sapiens
ttcgactctgtgcctgaagagc

SEQ ID NO: 15961 - DNA, 22 bp, Homo sapiens
agatttatgtggtcacactcag

SEQ ID NO: 15962 - DNA, 22 bp, Homo sapiens
cactctcagcataatgaatgtg

SEQ ID NO: 15963 - DNA, 22 bp, Homo sapiens
tctgcatattgttaatggaatg

SEQ ID NO: 15964 - DNA, 22 bp, Homo sapiens
tggagagttctgtagatatcta

SEQ ID NO: 15965 - DNA, 23 bp, Homo sapiens
attttttgtctttgtaactagat

SEQ ID NO: 15966 - DNA, 22 bp, Homo sapiens
atacttctttagcatattgaac

SEQ ID NO: 15967 - DNA, 22 bp, Homo sapiens
agatcacagtggcaactccctt

SEQ ID NO: 15968 - DNA, 22 bp, Homo sapiens
agatgtgagaatcaagtgacca

SEQ ID NO: 15969 - DNA, 22 bp, Homo sapiens
tgtagctctccagccagcaagg

SEQ ID NO: 15970 - DNA, 22 bp, Homo sapiens
ttctgattgctgatgaggccca

SEQ ID NO: 15971 - DNA, 22 bp, Homo sapiens
cgccgcctgctgcagcagctgt

SEQ ID NO: 15972 - DNA, 22 bp, Homo sapiens
actatagatgctggcgaggctg

SEQ ID NO: 15973 - DNA, 22 bp, Homo sapiens
agcaagattgaggcttcctcag

SEQ ID NO: 15974 - DNA, 22 bp, Homo sapiens
ggagagcttggagtgcgatttt

SEQ ID NO: 15975 - DNA, 22 bp, Homo sapiens
ttcccaggaagcctctccaagc

SEQ ID NO: 15976 - DNA, 22 bp, Homo sapiens
gaattcttttctttctgaaagt

SEQ ID NO: 15977 - DNA, 22 bp, Homo sapiens
ctgggagtggtgacagctctcg

SEQ ID NO: 15978 - DNA, 23 bp, Homo sapiens
actcgtggaattctctgcgatcg

SEQ ID NO: 15979 - DNA, 22 bp, Homo sapiens
agcttgacagacagatggtagc

SEQ ID NO: 15980 - DNA, 22 bp, Homo sapiens
ttggaaacgtcaccttttcctt

SEQ ID NO: 15981 - DNA, 22 bp, Homo sapiens
agagttgctccattagaactta

SEQ ID NO: 15982 - DNA, 22 bp, Homo sapiens
actgtgaacggactgaagccca

SEQ ID NO: 15983 - DNA, 22 bp, Homo sapiens
tgtcagtgtctatgaagaattt

SEQ ID NO: 15984 - DNA, 22 bp, Homo sapiens
gcgtctcaaggcccccaggcca

SEQ ID NO: 15985 - DNA, 22 bp, Homo sapiens
tacatttataaggcttctctgt

SEQ ID NO: 15986 - DNA, 22 bp, Homo sapiens
agagctaagaaacagaattgct

SEQ ID NO: 15987 - DNA, 22 bp, Homo sapiens
tgcctgtgtcagcaggtggaag

SEQ ID NO: 15988 - DNA, 22 bp, Homo sapiens
ctgaccaacatggtgaaacctt

SEQ ID NO: 15989 - DNA, 19 bp, Homo sapiens
agggagtttatatttgcac

SEQ ID NO: 15990 - DNA, 22 bp, Homo sapiens
cactgcactccagcctgggtga

SEQ ID NO: 15991 - DNA, 22 bp, Homo sapiens
cataaaaggtagcagtttgaaa

SEQ ID NO: 15992 - DNA, 21 bp, Homo sapiens
tctgatggtagatgagatgtg

SEQ ID NO: 15993 - DNA, 22 bp, Homo sapiens
tttaagaagttatgttataaat

SEQ ID NO: 15994 - DNA, 22 bp, Homo sapiens
cttgtagaattgaaatggtctc

SEQ ID NO: 15995 - DNA, 22 bp, Homo sapiens
actttcttggtcccatgtttga

SEQ ID NO: 15996 - DNA, 22 bp, Homo sapiens
taattcttcaggccttttgtct

SEQ ID NO: 15997 - DNA, 22 bp, Homo sapiens
gtcgtggtcagacaccagaaaa

SEQ ID NO: 15998 - DNA, 22 bp, Homo sapiens
cggagcgctgggggactctgca

SEQ ID NO: 15999 - DNA, 18 bp, Homo sapiens
tgtccctgcaaataacat

SEQ ID NO: 16000 - DNA, 22 bp, Homo sapiens
agccaggatggtctcgatcggc

SEQ ID NO: 16001 - DNA, 22 bp, Homo sapiens
gcggggggaggaacatcttgca

SEQ ID NO: 16002 - DNA, 22 bp, Homo sapiens
tgacttgtctctttgggagaca

SEQ ID NO: 16003 - DNA, 22 bp, Homo sapiens
agaaatatgctgattagatgaa

SEQ ID NO: 16004 - DNA, 22 bp, Homo sapiens
attttctatgttgtaattgtta

SEQ ID NO: 16005 - DNA, 22 bp, Homo sapiens
tgcctgtggaaaggctggtgct

SEQ ID NO: 16006 - DNA, 22 bp, Homo sapiens
tccattatacttctgattcaaa

SEQ ID NO: 16007 - DNA, 22 bp, Homo sapiens
gatttttatataaagtgagaaa

SEQ ID NO: 16008 - DNA, 22 bp, Homo sapiens
ttggccatctaagcccagccac

SEQ ID NO: 16009 - DNA, 22 bp, Homo sapiens
ggctcactgcaacttccgcctc

SEQ ID NO: 16010 - DNA, 22 bp, Homo sapiens
atgccactgcacttcagcctgg

SEQ ID NO: 16011 - DNA, 22 bp, Homo sapiens
ccagaagcagagcctgaggcag

SEQ ID NO: 16012 - DNA, 22 bp, Homo sapiens
taagcctgcatgaaccatgaga

SEQ ID NO: 16013 - DNA, 22 bp, Homo sapiens
aaagaaatagatggcatttaaa

SEQ ID NO: 16014 - DNA, 22 bp, Homo sapiens
tttgaacagtagcttaggtgtg

SEQ ID NO: 16015 - DNA, 22 bp, Homo sapiens
aaagttctctatggtgtaaaaa

SEQ ID NO: 16016 - DNA, 22 bp, Homo sapiens
gggtccctggaattacttgaca

SEQ ID NO: 16017 - DNA, 22 bp, Homo sapiens
gtgagtaaaggttcattgaatt

SEQ ID NO: 16018 - DNA, 22 bp, Homo sapiens
gagctactgaaatattgatttt

SEQ ID NO: 16019 - DNA, 20 bp, Homo sapiens
aaaatatgtataactcttct

SEQ ID NO: 16020 - DNA, 22 bp, Homo sapiens
ggtgttgcagttgaagactggt

SEQ ID NO: 16021 - DNA, 19 bp, Homo sapiens
atcccaaggagctgggact

SEQ ID NO: 16022 - DNA, 22 bp, Homo sapiens
tagactggtgaattagggggaa

SEQ ID NO: 16023 - DNA, 22 bp, Homo sapiens
gggagctggagctggaagactc

SEQ ID NO: 16024 - DNA, 22 bp, Homo sapiens
gctgcagggagctggaaggctc

SEQ ID NO: 16025 - DNA, 22 bp, Homo sapiens
gcagcctcaaactccccagctc

SEQ ID NO: 16026 - DNA, 21 bp, Homo sapiens
acagcctccatctcctgggct

SEQ ID NO: 16027 - DNA, 22 bp, Homo sapiens
tggttcctcaagcgctggcggc

SEQ ID NO: 16028 - DNA, 22 bp, Homo sapiens
tgtatgaggcatacatcaggca

SEQ ID NO: 16029 - DNA, 22 bp, Homo sapiens
agttattactctttaacatatt

SEQ ID NO: 16030 - DNA, 22 bp, Homo sapiens
ctctgtagaaagagcccaggtg

SEQ ID NO: 16031 - DNA, 22 bp, Homo sapiens
gacaattgcttttgccgaataa

SEQ ID NO: 16032 - DNA, 22 bp, Homo sapiens
cgttggtctgtcccctggcacc

SEQ ID NO: 16033 - DNA, 22 bp, Homo sapiens
acatttatataactcactagga

SEQ ID NO: 16034 - DNA, 22 bp, Homo sapiens
ttcaatatgatattagctgtgg

SEQ ID NO: 16035 - DNA, 22 bp, Homo sapiens
tatttcttttcgtgacttattg

SEQ ID NO: 16036 - DNA, 22 bp, Homo sapiens
tttctttatcatagcatctttg

SEQ ID NO: 16037 - DNA, 22 bp, Homo sapiens
tctggacaggggcgctttgggg

SEQ ID NO: 16038 - DNA, 22 bp, Homo sapiens
tttaatcaggcaaagcataata

SEQ ID NO: 16039 - DNA, 22 bp, Homo sapiens
aagcatttcaggtagagatatt

SEQ ID NO: 16040 - DNA, 22 bp, Homo sapiens
ggtgtccgcgctgtagaaggtc

SEQ ID NO: 16041 - DNA, 22 bp, Homo sapiens
gtagctctgtttaaagttcttt

SEQ ID NO: 16042 - DNA, 22 bp, Homo sapiens
ttccgagggctcggcggccgcc

SEQ ID NO: 16043 - DNA, 22 bp, Homo sapiens
acctggacacctgctgtcatct

SEQ ID NO: 16044 - DNA, 22 bp, Homo sapiens
tgtttgagttctagcgcattta

SEQ ID NO: 16045 - DNA, 17 bp, Homo sapiens
tgtagcttctccttctc

SEQ ID NO: 16046 - DNA, 22 bp, Homo sapiens
ctagcctgggatttgaacttat

SEQ ID NO: 16047 - DNA, 22 bp, Homo sapiens
ggcctcgcggcttctggtggct

SEQ ID NO: 16048 - DNA, 22 bp, Homo sapiens
ctatggtctggaccgaggtcct

SEQ ID NO: 16049 - DNA, 22 bp, Homo sapiens
gtccccgacgtttggcttgatg

SEQ ID NO: 16050 - DNA, 22 bp, Homo sapiens
cgcaccactgaattccagcctg

SEQ ID NO: 16051 - DNA, 22 bp, Homo sapiens
atgaaatatcttgaagaaattc

SEQ ID NO: 16052 - DNA, 22 bp, Homo sapiens
gctgcagtgagccaagatcgtg

SEQ ID NO: 16053 - DNA, 22 bp, Homo sapiens
gacaggtgctaagggacctggc

SEQ ID NO: 16054 - DNA, 19 bp, Homo sapiens
catggtgaaaccccgtctc

SEQ ID NO: 16055 - DNA, 22 bp, Homo sapiens
acattaaacttgcttggctgta

SEQ ID NO: 16056 - DNA, 22 bp, Homo sapiens
ctgctgagccgcacccaggagc

SEQ ID NO: 16057 - DNA, 22 bp, Homo sapiens
gctcgtacaccagcgtggaggt

SEQ ID NO: 16058 - DNA, 22 bp, Homo sapiens
tgtcaatatgtaataactgaat

SEQ ID NO: 16059 - DNA, 18 bp, Homo sapiens
ggaaggtgattcagtttt

SEQ ID NO: 16060 - DNA, 22 bp, Homo sapiens
tggagttggccgcccggaccga

SEQ ID NO: 16061 - DNA, 22 bp, Homo sapiens
cactgcactccatcctgggaaa

SEQ ID NO: 16062 - DNA, 22 bp, Homo sapiens
tggctaacaaggtgaaaccccg

SEQ ID NO: 16063 - DNA, 22 bp, Homo sapiens
atgagctagaaaaccatgtgga

SEQ ID NO: 16064 - DNA, 22 bp, Homo sapiens
taagaaatttagttatagaatg

SEQ ID NO: 16065 - DNA, 22 bp, Homo sapiens
atttattcctttatggctggag

SEQ ID NO: 16066 - DNA, 22 bp, Homo sapiens
tctgacattagattaattggaa

SEQ ID NO: 16067 - DNA, 22 bp, Homo sapiens
tgcagcctggcttcgcgcctcc

SEQ ID NO: 16068 - DNA, 22 bp, Homo sapiens
actgcactccagcctgggtgac

SEQ ID NO: 16069 - DNA, 22 bp, Homo sapiens
tctcagaacctcagtttgctct

SEQ ID NO: 16070 - DNA, 19 bp, Homo sapiens
agcggttctcaaagtcagg

SEQ ID NO: 16071 - DNA, 22 bp, Homo sapiens
gtgagccgagtatagttcatag

SEQ ID NO: 16072 - DNA, 22 bp, Homo sapiens
tggattcacaccattctcctgc

SEQ ID NO: 16073 - DNA, 22 bp, Homo sapiens
caggagatgacagggaagaacc

SEQ ID NO: 16074 - DNA, 22 bp, Homo sapiens
acgcctgtaatcccagcacttt

SEQ ID NO: 16075 - DNA, 22 bp, Homo sapiens
aataaaatggtcagttttctca

SEQ ID NO: 16076 - DNA, 22 bp, Homo sapiens
aaaaatcacttttataggcagc

SEQ ID NO: 16077 - DNA, 22 bp, Homo sapiens
cagaggatatactatctggaaa

SEQ ID NO: 16078 - DNA, 22 bp, Homo sapiens
actgcactccagcctgggtgat

SEQ ID NO: 16079 - DNA, 22 bp, Homo sapiens
atgaaaacggaccagagctatt

SEQ ID NO: 16080 - DNA, 22 bp, Homo sapiens
tcaccttgtgatctccctgcct

SEQ ID NO: 16081 - DNA, 22 bp, Homo sapiens
agctagtatttcattgaggatt

SEQ ID NO: 16082 - DNA, 22 bp, Homo sapiens
ttttctaacatctagtaatttg

SEQ ID NO: 16083 - DNA, 23 bp, Homo sapiens
cagtgtgacaaaacttattactt

SEQ ID NO: 16084 - DNA, 22 bp, Homo sapiens
tgggattcaccatgggcttcag

SEQ ID NO: 16085 - DNA, 22 bp, Homo sapiens
tgagaacggatactaagggctg

SEQ ID NO: 16086 - DNA, 22 bp, Homo sapiens
gggcggatcacctgaggtcagg

SEQ ID NO: 16087 - DNA, 22 bp, Homo sapiens
atggagttctgccagcgctgct

SEQ ID NO: 16088 - DNA, 21 bp, Homo sapiens
ccaggccaggcctacggggat

SEQ ID NO: 16089 - DNA, 22 bp, Homo sapiens
agaggaggctctgggatcgtcc

SEQ ID NO: 16090 - DNA, 22 bp, Homo sapiens
cttctgagatgttgttttacag

SEQ ID NO: 16091 - DNA, 22 bp, Homo sapiens
ttcttctttccaattacatggt

SEQ ID NO: 16092 - DNA, 22 bp, Homo sapiens
tgtcatagtgtggtagcagtgg

SEQ ID NO: 16093 - DNA, 22 bp, Homo sapiens
atacctgtgtatccacaagcgt

SEQ ID NO: 16094 - DNA, 22 bp, Homo sapiens
tgcgccatgtgctctcggccct

SEQ ID NO: 16095 - DNA, 22 bp, Homo sapiens
tgtgagttattttcaggagttt

SEQ ID NO: 16096 - DNA, 22 bp, Homo sapiens
taacatttaaatttttcacata

SEQ ID NO: 16097 - DNA, 22 bp, Homo sapiens
ggccttggcctagccctccagg

SEQ ID NO: 16098 - DNA, 16 bp, Homo sapiens
gcgcctcctcggcctc

SEQ ID NO: 16099 - DNA, 20 bp, Homo sapiens
tatttctgggcaaccattta

SEQ ID NO: 16100 - DNA, 22 bp, Homo sapiens
ttgtctaatgagctccacttca

SEQ ID NO: 16101 - DNA, 22 bp, Homo sapiens
tggagaattctatgttgagggg

SEQ ID NO: 16102 - DNA, 22 bp, Homo sapiens
tttagcgtagctgacagctaat

SEQ ID NO: 16103 - DNA, 21 bp, Homo sapiens
aaactgaccttgcctgagaca

SEQ ID NO: 16104 - DNA, 22 bp, Homo sapiens
cttgatctacatagtgaaaccc

SEQ ID NO: 16105 - DNA, 22 bp, Homo sapiens
gaagccttgaactgcaaacccc

SEQ ID NO: 16106 - DNA, 22 bp, Homo sapiens
ggagttgattttggatatatta

SEQ ID NO: 16107 - DNA, 22 bp, Homo sapiens
ggaggggatttagtagatgcta

SEQ ID NO: 16108 - DNA, 22 bp, Homo sapiens
tatactctgagaaacgtgtcac

SEQ ID NO: 16109 - DNA, 22 bp, Homo sapiens
tcgtgaggctctgcatcgcaca

SEQ ID NO: 16110 - DNA, 22 bp, Homo sapiens
ttcctttctctggactgcagcc

SEQ ID NO: 16111 - DNA, 22 bp, Homo sapiens
agattctaccagagctagtttg

SEQ ID NO: 16112 - DNA, 22 bp, Homo sapiens
aaaactgaaatacgatccaatg

SEQ ID NO: 16113 - DNA, 22 bp, Homo sapiens
tcaccagatctctctgtaatgg

SEQ ID NO: 16114 - DNA, 22 bp, Homo sapiens
ctgggaggcagaggttgcagtg

SEQ ID NO: 16115 - DNA, 22 bp, Homo sapiens
actgattgcattcatagggttt

SEQ ID NO: 16116 - DNA, 18 bp, Homo sapiens
ccatcaccctaactagtg

SEQ ID NO: 16117 - DNA, 22 bp, Homo sapiens
atgagttgaagctacaagaggc

SEQ ID NO: 16118 - DNA, 22 bp, Homo sapiens
taccagggaacagggatattaa

SEQ ID NO: 16119 - DNA, 22 bp, Homo sapiens
ctgggaggcggaggttgcagtg

SEQ ID NO: 16120 - DNA, 20 bp, Homo sapiens
atcggcttgcctggaaacaa

SEQ ID NO: 16121 - DNA, 22 bp, Homo sapiens
agcccttagtacatttctcaag

SEQ ID NO: 16122 - DNA, 22 bp, Homo sapiens
tagtggatgttcagagatttga

SEQ ID NO: 16123 - DNA, 22 bp, Homo sapiens
gccatcatatcccctgtgacct

SEQ ID NO: 16124 - DNA, 22 bp, Homo sapiens
agatttatgtggtcacactcag

SEQ ID NO: 16125 - DNA, 22 bp, Homo sapiens
atgccactgcacttcagcctgg

SEQ ID NO: 16126 - DNA, 22 bp, Homo sapiens
ataaaatttgctactgttaaat

SEQ ID NO: 16127 - DNA, 22 bp, Homo sapiens
caagcttgtttctcctgggggt

SEQ ID NO: 16128 - DNA, 23 bp, Homo sapiens
tgttccagatacgccttttcctc

SEQ ID NO: 16129 - DNA, 22 bp, Homo sapiens
ttttggttgttgggtaagagta

SEQ ID NO: 16130 - DNA, 22 bp, Homo sapiens
tgttatctgagcaacgtcgacg

SEQ ID NO: 16131 - DNA, 22 bp, Homo sapiens
agaaatatgctgattagatgaa

SEQ ID NO: 16132 - DNA, 22 bp, Homo sapiens
aataaacaaatccttccttccc

SEQ ID NO: 16133 - DNA, 23 bp, Homo sapiens
acagtcgtaggtatccttttcct

SEQ ID NO: 16134 - DNA, 23 bp, Homo sapiens
ttttgcaataagtcactggaata

SEQ ID NO: 16135 - DNA, 22 bp, Homo sapiens
atgaccagccgagataaacaga

SEQ ID NO: 16136 - DNA, 22 bp, Homo sapiens
tgcacgtgggctctctgctctt

SEQ ID NO: 16137 - DNA, 17 bp, Homo sapiens
tgcatgtcctttgttcc

SEQ ID NO: 16138 - DNA, 22 bp, Homo sapiens
gtaaaaaggccaagcccttgtg

SEQ ID NO: 16139 - DNA, 22 bp, Homo sapiens
acattacctggcatttgatctt

SEQ ID NO: 16140 - DNA, 22 bp, Homo sapiens
gaatatcccgctatgcaaagta

SEQ ID NO: 16141 - DNA, 22 bp, Homo sapiens
gatgcgggcccgctccactgcc

SEQ ID NO: 16142 - DNA, 22 bp, Homo sapiens
tgacaggaaacatgcagtgatt

SEQ ID NO: 16143 - DNA, 22 bp, Homo sapiens
ctacttgttcactgtaggtcgc

SEQ ID NO: 16144 - DNA, 22 bp, Homo sapiens
aggttatcatcagttgagcact

SEQ ID NO: 16145 - DNA, 22 bp, Homo sapiens
tgaggcaggagttcaggctgcg

SEQ ID NO: 16146 - DNA, 22 bp, Homo sapiens
agtttgaattttaatctcggtg

SEQ ID NO: 16147 - DNA, 22 bp, Homo sapiens
tttattctgtgctacatgaaga

SEQ ID NO: 16148 - DNA, 23 bp, Homo sapiens
ttgcttgagcccaggaagtggag

SEQ ID NO: 16149 - DNA, 23 bp, Homo sapiens
tgaggcaggcggatcacgaggtc

SEQ ID NO: 16150 - DNA, 22 bp, Homo sapiens
tatttggtgaatctatggtcag

SEQ ID NO: 16151 - DNA, 22 bp, Homo sapiens
gcaactgaacatgtgtgtggcc

SEQ ID NO: 16152 - DNA, 22 bp, Homo sapiens
acatttatataactcactagga

SEQ ID NO: 16153 - DNA, 22 bp, Homo sapiens
aatgctctttaacctattctga

SEQ ID NO: 16154 - DNA, 22 bp, Homo sapiens
ggagaagcagcttcttgatgaa

SEQ ID NO: 16155 - DNA, 22 bp, Homo sapiens
cttgatctacatagtgaaaccc

SEQ ID NO: 16156 - DNA, 22 bp, Homo sapiens
atgaaatatcttgaagaaattc

SEQ ID NO: 16157 - DNA, 22 bp, Homo sapiens
aatattatcaaaagctttttca

SEQ ID NO: 16158 - DNA, 22 bp, Homo sapiens
atttcagcagcccatgtttgga

SEQ ID NO: 16159 - DNA, 22 bp, Homo sapiens
ttggaacatgccggggtccagg

SEQ ID NO: 16160 - DNA, 22 bp, Homo sapiens
acgggccttctcttcaggcgag

SEQ ID NO: 16161 - DNA, 16 bp, Homo sapiens
atgctgctattagagg

SEQ ID NO: 16162 - DNA, 22 bp, Homo sapiens
agtgaccgaggcacttggcaac

SEQ ID NO: 16163 - DNA, 22 bp, Homo sapiens
acatttttcacatttgtagggt

SEQ ID NO: 16164 - DNA, 22 bp, Homo sapiens
tacaacaatttccacattagaa

SEQ ID NO: 16165 - DNA, 22 bp, Homo sapiens
gtctttatttgagattgtcatt

SEQ ID NO: 16166 - DNA, 22 bp, Homo sapiens
tacagtgcttggtatctagtaa

SEQ ID NO: 16167 - DNA, 22 bp, Homo sapiens
aaagaaatagatggcatttaaa

SEQ ID NO: 16168 - DNA, 23 bp, Homo sapiens
caccactttctccttctccttgg

SEQ ID NO: 16169 - DNA, 22 bp, Homo sapiens
tggaagggagctggaatttgga

SEQ ID NO: 16170 - DNA, 22 bp, Homo sapiens
tgaggcaggaggattgcaggat

SEQ ID NO: 16171 - DNA, 22 bp, Homo sapiens
catagcggtattccacgtggtt

SEQ ID NO: 16172 - DNA, 22 bp, Homo sapiens
tatccaattcaccattgatggg

SEQ ID NO: 16173 - DNA, 22 bp, Homo sapiens
tttctttatcatagcatctttg

SEQ ID NO: 16174 - DNA, 22 bp, Homo sapiens
catttggtcactatcctttttg

SEQ ID NO: 16175 - DNA, 22 bp, Homo sapiens
ttatttttaaaagttcacacag

SEQ ID NO: 16176 - DNA, 22 bp, Homo sapiens
ttgcttgaacccaggaagtgga

SEQ ID NO: 16177 - DNA, 22 bp, Homo sapiens
tgggcgacagagcaagactccg

SEQ ID NO: 16178 - DNA, 22 bp, Homo sapiens
ctccagttggccccagttggtt

SEQ ID NO: 16179 - DNA, 22 bp, Homo sapiens
ctttggtcaattgctgcgggga

SEQ ID NO: 16180 - DNA, 22 bp, Homo sapiens
atcaaatacaaagggcataagg

SEQ ID NO: 16181 - DNA, 22 bp, Homo sapiens
tctttggtttctgtctctgtaa

SEQ ID NO: 16182 - DNA, 22 bp, Homo sapiens
ggcctcgcggcttctggtggct

SEQ ID NO: 16183 - DNA, 22 bp, Homo sapiens
gttacagtcaggagatattttg

SEQ ID NO: 16184 - DNA, 22 bp, Homo sapiens
tgctgtgaggttgagaaggaag

SEQ ID NO: 16185 - DNA, 22 bp, Homo sapiens
gctgtgtatcagatgccacggg

SEQ ID NO: 16186 - DNA, 22 bp, Homo sapiens
ttctcttttcaccagttgctaa

SEQ ID NO: 16187 - DNA, 22 bp, Homo sapiens
tccattatacttctgattcaaa

SEQ ID NO: 16188 - DNA, 22 bp, Homo sapiens
atgtgggccgtgcgggtgtcct

SEQ ID NO: 16189 - DNA, 22 bp, Homo sapiens
ctggcccaggtggtcgttgagg

SEQ ID NO: 16190 - DNA, 22 bp, Homo sapiens
tgtacttgaacttgactgtaga

SEQ ID NO: 16191 - DNA, 22 bp, Homo sapiens
cttatttgcccatgtttcttta

SEQ ID NO: 16192 - DNA, 22 bp, Homo sapiens
ttccatttggcacttcactgag

SEQ ID NO: 16193 - DNA, 22 bp, Homo sapiens
agctgaaacttcccattaattg

SEQ ID NO: 16194 - DNA, 22 bp, Homo sapiens
atatatttgagaatattcatga

SEQ ID NO: 16195 - DNA, 22 bp, Homo sapiens
cccattcatcctcgcttccttc

SEQ ID NO: 16196 - DNA, 22 bp, Homo sapiens
atgcacctgaactccatcagct

SEQ ID NO: 16197 - DNA, 22 bp, Homo sapiens
atgccactgcgctctagcctgg

SEQ ID NO: 16198 - DNA, 22 bp, Homo sapiens
tgaggcaggaggttgagaactg

SEQ ID NO: 16199 - DNA, 22 bp, Homo sapiens
tatgctctgagacctttgtgca

SEQ ID NO: 16200 - DNA, 22 bp, Homo sapiens
atgaagtaggactgaacttggg

SEQ ID NO: 16201 - DNA, 22 bp, Homo sapiens
gtggaatttttacctatgaatg

SEQ ID NO: 16202 - DNA, 22 bp, Homo sapiens
gatttggttgcaggaagtaatt

SEQ ID NO: 16203 - DNA, 22 bp, Homo sapiens
ggcctctcttgggacagctgtc

SEQ ID NO: 16204 - DNA, 22 bp, Homo sapiens
cagccacttgtgatgctgggga

SEQ ID NO: 16205 - DNA, 22 bp, Homo sapiens
gaatttcctctaaacccctgag

SEQ ID NO: 16206 - DNA, 22 bp, Homo sapiens
gaagattgaaggctgggaatta

SEQ ID NO: 16207 - DNA, 22 bp, Homo sapiens
gtcttagatttcaccgataatg

SEQ ID NO: 16208 - DNA, 23 bp, Homo sapiens
ttttgcaataagtcactggaata

SEQ ID NO: 16209 - DNA, 21 bp, Homo sapiens
tgtaagtttcatctgaattgg

SEQ ID NO: 16210 - DNA, 22 bp, Homo sapiens
attctcaaaacataacttcact

SEQ ID NO: 16211 - DNA, 22 bp, Homo sapiens
acaccatactcatgttggttcc

SEQ ID NO: 16212 - DNA, 22 bp, Homo sapiens
tgttgattagtgtttagactta

SEQ ID NO: 16213 - DNA, 20 bp, Homo sapiens
ttcatgggagcaaagaggcc

SEQ ID NO: 16214 - DNA, 22 bp, Homo sapiens
gaagattgaaggctgggaatta

SEQ ID NO: 16215 - DNA, 22 bp, Homo sapiens
taccttctaggtgatggttaca

SEQ ID NO: 16216 - DNA, 22 bp, Homo sapiens
agggaaatctcagctctaaaat

SEQ ID NO: 16217 - DNA, 22 bp, Homo sapiens
taacatttaaatttttcacata

SEQ ID NO: 16218 - DNA, 22 bp, Homo sapiens
agatttatgtggtcacactcag

SEQ ID NO: 16219 - DNA, 22 bp, Homo sapiens
acatttatataactcactagga

SEQ ID NO: 16220 - DNA, 22 bp, Homo sapiens
ttatcacttatgagctttttgc

SEQ ID NO: 16221 - DNA, 22 bp, Homo sapiens
agggaaattaatgtgagcaatg

SEQ ID NO: 16222 - DNA, 22 bp, Homo sapiens
aaatggaagctatttatgattc

SEQ ID NO: 16223 - DNA, 22 bp, Homo sapiens
ttaaattttagaaacagactct

SEQ ID NO: 16224 - DNA, 22 bp, Homo sapiens
ttatagcagcatgatttatagt

SEQ ID NO: 16225 - DNA, 22 bp, Homo sapiens
cagtgacgtaaactgcatgtgc

SEQ ID NO: 16226 - DNA, 22 bp, Homo sapiens
cattctgaccctatgatttaag

SEQ ID NO: 16227 - DNA, 22 bp, Homo sapiens
tttaatgtagcgtgaaatgatt

SEQ ID NO: 16228 - DNA, 22 bp, Homo sapiens
tgttcagaacaaaggtaaatga

SEQ ID NO: 16229 - DNA, 22 bp, Homo sapiens
atataatttttggttagctcaa

SEQ ID NO: 16230 - DNA, 22 bp, Homo sapiens
catcatactgtttacactcaaa

SEQ ID NO: 16231 - DNA, 22 bp, Homo sapiens
tctaattttggcattttaacct

SEQ ID NO: 16232 - DNA, 22 bp, Homo sapiens
ctagttgaagaggctgtcatca

SEQ ID NO: 16233 - DNA, 22 bp, Homo sapiens
atatgcagtctcttgcccttct

SEQ ID NO: 16234 - DNA, 22 bp, Homo sapiens
cttgtcagccaattgtggattt

SEQ ID NO: 16235 - DNA, 22 bp, Homo sapiens
aatactgcctgtgaggtaactc

SEQ ID NO: 16236 - DNA, 22 bp, Homo sapiens
ttggatccatctcaggcatagg

SEQ ID NO: 16237 - DNA, 22 bp, Homo sapiens
ttatagcagcatgatttacaat

SEQ ID NO: 16238 - DNA, 22 bp, Homo sapiens
gggtaaatctcttttcatggct

SEQ ID NO: 16239 - DNA, 22 bp, Homo sapiens
aataaaatggtcagttttctca

SEQ ID NO: 16240 - DNA, 22 bp, Homo sapiens
ataaaatttgctactgttaaat

SEQ ID NO: 16241 - DNA, 22 bp, Homo sapiens
gctgtgcagaggtgagaatcca

SEQ ID NO: 16242 - DNA, 22 bp, Homo sapiens
tcaatcacgtgttccatgttct

SEQ ID NO: 16243 - DNA, 22 bp, Homo sapiens
actattagcatatcatgaatgg

SEQ ID NO: 16244 - DNA, 22 bp, Homo sapiens
gggaaatagagctggaaccttg

SEQ ID NO: 16245 - DNA, 22 bp, Homo sapiens
cagcagcattgctctggattcc

SEQ ID NO: 16246 - DNA, 22 bp, Homo sapiens
atgaaaacggaccagagctatt

SEQ ID NO: 16247 - DNA, 22 bp, Homo sapiens
ttatagcagcatgatttataat

SEQ ID NO: 16248 - DNA, 23 bp, Homo sapiens
aaaacagcttcctccagtggctc

SEQ ID NO: 16249 - DNA, 22 bp, Homo sapiens
ttgcacatctaataatgctaga

SEQ ID NO: 16250 - DNA, 22 bp, Homo sapiens
agttgggtttgtgtcagttgca

SEQ ID NO: 16251 - DNA, 22 bp, Homo sapiens
tcactacaaccgctacctgaca

SEQ ID NO: 16252 - DNA, 22 bp, Homo sapiens
tgcactccaggctgggtgacag

SEQ ID NO: 16253 - DNA, 22 bp, Homo sapiens
actggacagaggaaatatggag

SEQ ID NO: 16254 - DNA, 22 bp, Homo sapiens
attggtagttttgtatttctct

SEQ ID NO: 16255 - DNA, 22 bp, Homo sapiens
aagacttgaccaggttgaaggc

SEQ ID NO: 16256 - DNA, 23 bp, Homo sapiens
ccactagcacctgttcaacttct

SEQ ID NO: 16257 - DNA, 22 bp, Homo sapiens
aatggcactttataaatgttaa

SEQ ID NO: 16258 - DNA, 22 bp, Homo sapiens
aggacttagaacattatgtact

SEQ ID NO: 16259 - DNA, 22 bp, Homo sapiens
taggattatttgttctatttct

SEQ ID NO: 16260 - DNA, 22 bp, Homo sapiens
tgagcacatttcacatgacagg

SEQ ID NO: 16261 - DNA, 22 bp, Homo sapiens
tgaagactcagaagctaagata

SEQ ID NO: 16262 - DNA, 22 bp, Homo sapiens
taatggttttttggagactgct

SEQ ID NO: 16263 - DNA, 22 bp, Homo sapiens
ggttggtaactccctgtgcagt

SEQ ID NO: 16264 - DNA, 22 bp, Homo sapiens
ttgtttaatccttgtacccatg

SEQ ID NO: 16265 - DNA, 22 bp, Homo sapiens
tcatcataatatggaatcttgt

SEQ ID NO: 16266 - DNA, 22 bp, Homo sapiens
aatgtgaggccttggtagttat

SEQ ID NO: 16267 - DNA, 22 bp, Homo sapiens
tttatagtagcatgatttatag

SEQ ID NO: 16268 - DNA, 22 bp, Homo sapiens
gtcactgtatccaggttccagc

SEQ ID NO: 16269 - DNA, 22 bp, Homo sapiens
atgattgaaaatgacattgcca

SEQ ID NO: 16270 - DNA, 22 bp, Homo sapiens
aagcatttcaggtagagatatt

SEQ ID NO: 16271 - DNA, 22 bp, Homo sapiens
ttatttaaaagtggtaagattc

SEQ ID NO: 16272 - DNA, 22 bp, Homo sapiens
aatatgcactctgatttagcag

SEQ ID NO: 16273 - DNA, 22 bp, Homo sapiens
caatttgattaataccatactt

SEQ ID NO: 16274 - DNA, 22 bp, Homo sapiens
cttgctactatgcctggctaat

SEQ ID NO: 16275 - DNA, 22 bp, Homo sapiens
cattaaacaaccttgaatcaat

SEQ ID NO: 16276 - DNA, 22 bp, Homo sapiens
atgtacataaaatgtataatga

SEQ ID NO: 16277 - DNA, 22 bp, Homo sapiens
tacttttagcctatttgattct

SEQ ID NO: 16278 - DNA, 23 bp, Homo sapiens
gggggccgtcctggggattatag

SEQ ID NO: 16279 - DNA, 22 bp, Homo sapiens
tttatagtagcatgatttataa

SEQ ID NO: 16280 - DNA, 22 bp, Homo sapiens
ataataacaatgccagatgcct

SEQ ID NO: 16281 - DNA, 22 bp, Homo sapiens
agcctattccaggatgagctca

SEQ ID NO: 16282 - DNA, 22 bp, Homo sapiens
tacagtgcttggtatctagtaa

SEQ ID NO: 16283 - DNA, 22 bp, Homo sapiens
gctgacccctacaggttgtgtt

SEQ ID NO: 16284 - DNA, 22 bp, Homo sapiens
agatttggtgtctggttgatat

SEQ ID NO: 16285 - DNA, 22 bp, Homo sapiens
gggctgtaggagctggaatggg

SEQ ID NO: 16286 - DNA, 21 bp, Homo sapiens
ggagtttttctggaagggact

SEQ ID NO: 16287 - DNA, 22 bp, Homo sapiens
gagagtctaggaacctcatata

SEQ ID NO: 16288 - DNA, 22 bp, Homo sapiens
agtggcctggagccccgcctgg

SEQ ID NO: 16289 - DNA, 22 bp, Homo sapiens
gttcagatttgactggtttctc

SEQ ID NO: 16290 - DNA, 22 bp, Homo sapiens
gacagacacaattgatccatga

SEQ ID NO: 16291 - DNA, 22 bp, Homo sapiens
tttggtattgcacactgtcttc

SEQ ID NO: 16292 - DNA, 22 bp, Homo sapiens
agagctgggtggacttgtagtt

SEQ ID NO: 16293 - DNA, 22 bp, Homo sapiens
tcagtgatttctggggtgaggg

SEQ ID NO: 16294 - DNA, 20 bp, Homo sapiens
tgatatggtttggctgtgtt

SEQ ID NO: 16295 - DNA, 22 bp, Homo sapiens
cggctggtgtcgggcacagcaa

SEQ ID NO: 16296 - DNA, 22 bp, Homo sapiens
acagattcactgcactggccat

SEQ ID NO: 16297 - DNA, 22 bp, Homo sapiens
ctcgggcttgaggctgtttacc

SEQ ID NO: 16298 - DNA, 22 bp, Homo sapiens
ttgtgttaaggtgcatctagtg

SEQ ID NO: 16299 - DNA, 22 bp, Homo sapiens
attgtcgtcaatggacacatag

SEQ ID NO: 16300 - DNA, 22 bp, Homo sapiens
tagattcagatatttaggacaa

SEQ ID NO: 16301 - DNA, 21 bp, Homo sapiens
taggtgggagccccagtatgc

SEQ ID NO: 16302 - DNA, 22 bp, Homo sapiens
tattgggtaaagatccagtttt

SEQ ID NO: 16303 - DNA, 22 bp, Homo sapiens
tgcctaggctggagtgtagtgg

SEQ ID NO: 16304 - DNA, 22 bp, Homo sapiens
tcgggctcgctctcctagcgga

SEQ ID NO: 16305 - DNA, 22 bp, Homo sapiens
ctggctttgatcagagtgacct

SEQ ID NO: 16306 - DNA, 22 bp, Homo sapiens
tgctccatgcgctcggccggcg

SEQ ID NO: 16307 - DNA, 22 bp, Homo sapiens
tgggtggcagcttcagcatgtt

SEQ ID NO: 16308 - DNA, 22 bp, Homo sapiens
aggtggggaggagtgtctcttt

SEQ ID NO: 16309 - DNA, 23 bp, Homo sapiens
tcggtgggcgtggaggccgaggc

SEQ ID NO: 16310 - DNA, 22 bp, Homo sapiens
tggtggggccagacttcagctc

SEQ ID NO: 16311 - DNA, 22 bp, Homo sapiens
ggggccgaccgcggttcaggcc

SEQ ID NO: 16312 - DNA, 22 bp, Homo sapiens
acggggctagagaaggtttctt

SEQ ID NO: 16313 - DNA, 22 bp, Homo sapiens
gtgctccctccttcctcaagga

SEQ ID NO: 16314 - DNA, 22 bp, Homo sapiens
aggggctcctttgtgctgcgtc

SEQ ID NO: 16315 - DNA, 22 bp, Homo sapiens
gaggtggccaagcgaggaaggg

SEQ ID NO: 16316 - DNA, 22 bp, Homo sapiens
cggtctcccgtgtgtgtgcgct

SEQ ID NO: 16317 - DNA, 22 bp, Homo sapiens
tgggattcaccatgggcttcag

SEQ ID NO: 16318 - DNA, 22 bp, Homo sapiens
atggggagctcaccacctgttt

SEQ ID NO: 16319 - DNA, 22 bp, Homo sapiens
acccggagtcggaggttgcagt

SEQ ID NO: 16320 - DNA, 22 bp, Homo sapiens
ccaggagttggaggttgcagtg

SEQ ID NO: 16321 - DNA, 19 bp, Homo sapiens
gccgaccgttggggtgccc

SEQ ID NO: 16322 - DNA, 22 bp, Homo sapiens
attggtggtgaggacatgccag

SEQ ID NO: 16323 - DNA, 22 bp, Homo sapiens
accctcaacaaattcactctat

SEQ ID NO: 16324 - DNA, 22 bp, Homo sapiens
tatcagcgtgcaaatctttgga

SEQ ID NO: 16325 - DNA, 22 bp, Homo sapiens
tgatctggtcctactgtgggca

SEQ ID NO: 16326 - DNA, 22 bp, Homo sapiens
tcaggggcttgaggtgcatgtc

SEQ ID NO: 16327 - DNA, 22 bp, Homo sapiens
ttgtgaatagtgctgcagtaaa

SEQ ID NO: 16328 - DNA, 22 bp, Homo sapiens
gtggtgtttgagctgccaggga

SEQ ID NO: 16329 - DNA, 22 bp, Homo sapiens
gtgctgacaggagcctggcggt

SEQ ID NO: 16330 - DNA, 22 bp, Homo sapiens
ggctggtgttgagtgcctgtag

SEQ ID NO: 16331 - DNA, 23 bp, Homo sapiens
aatgggtgcaactatccatgaca

SEQ ID NO: 16332 - DNA, 22 bp, Homo sapiens
taccagggaacagggatattaa

SEQ ID NO: 16333 - DNA, 22 bp, Homo sapiens
attgctaggaacaggttgcacc

SEQ ID NO: 16334 - DNA, 22 bp, Homo sapiens
ccggagtgtctggcctgctggg

SEQ ID NO: 16335 - DNA, 22 bp, Homo sapiens
tgatatgggaaaagggctcgga

SEQ ID NO: 16336 - DNA, 22 bp, Homo sapiens
cgtggggcgggtggacacttgc

SEQ ID NO: 16337 - DNA, 22 bp, Homo sapiens
gtcgtggagctcacagtgtgcc

SEQ ID NO: 16338 - DNA, 22 bp, Homo sapiens
actgcaacctccgcctgccagg

SEQ ID NO: 16339 - DNA, 22 bp, Homo sapiens
cccatgaggtggaggttgcagt

SEQ ID NO: 16340 - DNA, 22 bp, Homo sapiens
tgcccaggctggagtgcagtgg

SEQ ID NO: 16341 - DNA, 22 bp, Homo sapiens
gcaggcagatcacctgtcagga

SEQ ID NO: 16342 - DNA, 22 bp, Homo sapiens
cttctcggggttcccgcgccct

SEQ ID NO: 16343 - DNA, 18 bp, Homo sapiens
tcttccaacactgacacc

SEQ ID NO: 16344 - DNA, 22 bp, Homo sapiens
ctgctctgctgatcagtgtctc

SEQ ID NO: 16345 - DNA, 22 bp, Homo sapiens
agaggcagtatacaatccgagc

SEQ ID NO: 16346 - DNA, 22 bp, Homo sapiens
cccgggaggcagaggttgcagt

SEQ ID NO: 16347 - DNA, 22 bp, Homo sapiens
tgattcatcagaataggagttt

SEQ ID NO: 16348 - DNA, 22 bp, Homo sapiens
gtggtgtaggtcacagttagga

SEQ ID NO: 16349 - DNA, 23 bp, Homo sapiens
ggagtgcaatggcgccatctcgg

SEQ ID NO: 16350 - DNA, 22 bp, Homo sapiens
agaaaatttaaagagacacaca

SEQ ID NO: 16351 - DNA, 22 bp, Homo sapiens
cctgattcagtggtgcccagag

SEQ ID NO: 16352 - DNA, 23 bp, Homo sapiens
tgtgggcgcattgtaagggtagc

SEQ ID NO: 16353 - DNA, 23 bp, Homo sapiens
cctgcctccccatcagttataca

SEQ ID NO: 16354 - DNA, 22 bp, Homo sapiens
tctggtgtcagtattctttgaa

SEQ ID NO: 16355 - DNA, 22 bp, Homo sapiens
tgacatgtatatcttacgctat

SEQ ID NO: 16356 - DNA, 21 bp, Homo sapiens
gggcagaggggcctcctgggt

SEQ ID NO: 16357 - DNA, 22 bp, Homo sapiens
gccagatttacagatttgccct

SEQ ID NO: 16358 - DNA, 22 bp, Homo sapiens
gcaggctgtctaaagttagagt

SEQ ID NO: 16359 - DNA, 22 bp, Homo sapiens
cagtgacgtaaactgcatgtgc

SEQ ID NO: 16360 - DNA, 22 bp, Homo sapiens
tgtgactggttgtcccgctttc

SEQ ID NO: 16361 - DNA, 22 bp, Homo sapiens
gtgagactcgcctttgtgtagc

SEQ ID NO: 16362 - DNA, 22 bp, Homo sapiens
ctgaggagaggtggcctgtgtt

SEQ ID NO: 16363 - DNA, 22 bp, Homo sapiens
ctgatcctcctttaagtagctg

SEQ ID NO: 16364 - DNA, 22 bp, Homo sapiens
gcagctattgtctcctgggccc

SEQ ID NO: 16365 - DNA, 22 bp, Homo sapiens
aaagaaatagatggcatttaaa

SEQ ID NO: 16366 - DNA, 22 bp, Homo sapiens
gcccaggagttcaagtctagtg

SEQ ID NO: 16367 - DNA, 22 bp, Homo sapiens
tgtagctctccagccagcaagg

SEQ ID NO: 16368 - DNA, 22 bp, Homo sapiens
actccacaccacgggggccgcc

SEQ ID NO: 16369 - DNA, 22 bp, Homo sapiens
aaccaccattctctcctcttcc

SEQ ID NO: 16370 - DNA, 22 bp, Homo sapiens
tactttaatatatgtgaagttc

SEQ ID NO: 16371 - DNA, 22 bp, Homo sapiens
cttgatctacatagtgaaaccc

SEQ ID NO: 16372 - DNA, 22 bp, Homo sapiens
gcccttacagggtggtcagcca

SEQ ID NO: 16373 - DNA, 22 bp, Homo sapiens
ggctccaccctgcttccagaag

SEQ ID NO: 16374 - DNA, 22 bp, Homo sapiens
tgaggcaggagttcaggctgcg

SEQ ID NO: 16375 - DNA, 23 bp, Homo sapiens
aatggtcttcctccacccctctg

SEQ ID NO: 16376 - DNA, 22 bp, Homo sapiens
cagagctgtccaaaccctgaca

SEQ ID NO: 16377 - DNA, 22 bp, Homo sapiens
cccagaaggtcgaggctgcagt

SEQ ID NO: 16378 - DNA, 22 bp, Homo sapiens
cccaggaggtcgaagctgcagt

SEQ ID NO: 16379 - DNA, 22 bp, Homo sapiens
tgtaccactctactaagggttc

SEQ ID NO: 16380 - DNA, 22 bp, Homo sapiens
ttctgtgaatcttttttcccac

SEQ ID NO: 16381 - DNA, 23 bp, Homo sapiens
aaacttgctatggctgaaatcat

SEQ ID NO: 16382 - DNA, 22 bp, Homo sapiens
taaaatttgtccctgagtgttg

SEQ ID NO: 16383 - DNA, 22 bp, Homo sapiens
ctcgtgatccgcccacctcagc

SEQ ID NO: 16384 - DNA, 22 bp, Homo sapiens
aagaggagaaaggctggctttg

SEQ ID NO: 16385 - DNA, 22 bp, Homo sapiens
gtcagaggggcagctgccaggc

SEQ ID NO: 16386 - DNA, 20 bp, Homo sapiens
tgttgattggtgtcatctca

SEQ ID NO: 16387 - DNA, 22 bp, Homo sapiens
ctgatagacaatcaccatggga

SEQ ID NO: 16388 - DNA, 22 bp, Homo sapiens
cctcggctgggccttggccact

SEQ ID NO: 16389 - DNA, 22 bp, Homo sapiens
cctacagttatattcttgattg

SEQ ID NO: 16390 - DNA, 22 bp, Homo sapiens
acaagaagggtgattaggggca

SEQ ID NO: 16391 - DNA, 22 bp, Homo sapiens
aggaaggcttctttggtcttct

SEQ ID NO: 16392 - DNA, 22 bp, Homo sapiens
tgctccagcaccaagagctcca

SEQ ID NO: 16393 - DNA, 22 bp, Homo sapiens
cccaggaggcagaagttgcagt

SEQ ID NO: 16394 - DNA, 22 bp, Homo sapiens
cccattgtggttgttgaggata

SEQ ID NO: 16395 - DNA, 22 bp, Homo sapiens
tgaggcaggagaatcaccggaa

SEQ ID NO: 16396 - DNA, 22 bp, Homo sapiens
ccaggctggagtgcagtggcac

SEQ ID NO: 16397 - DNA, 22 bp, Homo sapiens
atcttggggaatcctctgtgta

SEQ ID NO: 16398 - DNA, 22 bp, Homo sapiens
atcgcaagtttaaaaatctttg

SEQ ID NO: 16399 - DNA, 22 bp, Homo sapiens
tcctcagcttttatttcacttg

SEQ ID NO: 16400 - DNA, 22 bp, Homo sapiens
catggcggtcaggatgtaggtg

SEQ ID NO: 16401 - DNA, 22 bp, Homo sapiens
acccagccatgttcagttctct

SEQ ID NO: 16402 - DNA, 22 bp, Homo sapiens
tttgtcttatccaatctctcag

SEQ ID NO: 16403 - DNA, 21 bp, Homo sapiens
tctgatggtagatgagatgtg

SEQ ID NO: 16404 - DNA, 22 bp, Homo sapiens
gaaggaagtcattagtgcagac

SEQ ID NO: 16405 - DNA, 22 bp, Homo sapiens
agcccaggagtttgaggctgtg

SEQ ID NO: 16406 - DNA, 22 bp, Homo sapiens
tagcatgtcagtcgccacacgt

SEQ ID NO: 16407 - DNA, 22 bp, Homo sapiens
ccagcagagcatggggaggaag

SEQ ID NO: 16408 - DNA, 22 bp, Homo sapiens
tctttgctccacactctagaga

SEQ ID NO: 16409 - DNA, 22 bp, Homo sapiens
gaggctgaggcggatggatcac

SEQ ID NO: 16410 - DNA, 22 bp, Homo sapiens
accattgccccctagtgtctgt

SEQ ID NO: 16411 - DNA, 22 bp, Homo sapiens
aaagggaagttgcacatgttcc

SEQ ID NO: 16412 - DNA, 22 bp, Homo sapiens
tttaaaaaactagtctgagtct

SEQ ID NO: 16413 - DNA, 22 bp, Homo sapiens
catataaatacaacatgtgtta

SEQ ID NO: 16414 - DNA, 22 bp, Homo sapiens
aaatggaagctatttatgattc

SEQ ID NO: 16415 - DNA, 22 bp, Homo sapiens
tttgttttcaatgtgtcattca

SEQ ID NO: 16416 - DNA, 22 bp, Homo sapiens
tgcccagggtggagtgcagtgg

SEQ ID NO: 16417 - DNA, 22 bp, Homo sapiens
aatgcaatgcagcacctccttg

SEQ ID NO: 16418 - DNA, 22 bp, Homo sapiens
tgtgaactggcaggtggacggg

SEQ ID NO: 16419 - DNA, 22 bp, Homo sapiens
atttgtgggactataatgcagg

SEQ ID NO: 16420 - DNA, 22 bp, Homo sapiens
ttcccttaaattatggcatcta

SEQ ID NO: 16421 - DNA, 22 bp, Homo sapiens
ggaggtgggctaaggactctct

SEQ ID NO: 16422 - DNA, 22 bp, Homo sapiens
ggtgtctatgattcagtttatg

SEQ ID NO: 16423 - DNA, 22 bp, Homo sapiens
tgtcaccatgcgaggctaattt

SEQ ID NO: 16424 - DNA, 22 bp, Homo sapiens
cttctgagatgttgttttacag

SEQ ID NO: 16425 - DNA, 22 bp, Homo sapiens
ctgtccatattcaaggggtagg

SEQ ID NO: 16426 - DNA, 22 bp, Homo sapiens
ttcacagcttaataaggctcag

SEQ ID NO: 16427 - DNA, 22 bp, Homo sapiens
tgccgcagtgcggggagggccc

SEQ ID NO: 16428 - DNA, 22 bp, Homo sapiens
gactttgtgccaaacgccagaa

SEQ ID NO: 16429 - DNA, 22 bp, Homo sapiens
cagtgcatgcacacacatggta

SEQ ID NO: 16430 - DNA, 22 bp, Homo sapiens
tgcaccctcatcagtcaaatgg

SEQ ID NO: 16431 - DNA, 22 bp, Homo sapiens
accagcctggccaacatggcaa

SEQ ID NO: 16432 - DNA, 22 bp, Homo sapiens
ttgtgaatggtgccgcaataaa

SEQ ID NO: 16433 - DNA, 22 bp, Homo sapiens
ggttgtagttggaggttgtata

SEQ ID NO: 16434 - DNA, 22 bp, Homo sapiens
acccgggaggcaggagtcatag

SEQ ID NO: 16435 - DNA, 22 bp, Homo sapiens
gcaggagaacaaagcaagctgc

SEQ ID NO: 16436 - DNA, 22 bp, Homo sapiens
gctcccagtctgatggaggaga

SEQ ID NO: 16437 - DNA, 22 bp, Homo sapiens
agcccaggtccagttcactgca

SEQ ID NO: 16438 - DNA, 22 bp, Homo sapiens
caaatgtataaatgtactttct

SEQ ID NO: 16439 - DNA, 22 bp, Homo sapiens
ggaggacaggggctgcagcaca

SEQ ID NO: 16440 - DNA, 22 bp, Homo sapiens
gagtgcagtggcgtgatctctg

SEQ ID NO: 16441 - DNA, 22 bp, Homo sapiens
cccaggaggtggaggctgcagt

SEQ ID NO: 16442 - DNA, 22 bp, Homo sapiens
caggaggttgagggtgcagtga

SEQ ID NO: 16443 - DNA, 22 bp, Homo sapiens
ctgtccccacccaaatctcatc

SEQ ID NO: 16444 - DNA, 22 bp, Homo sapiens
ttctatttttgtggaactgtag

SEQ ID NO: 16445 - DNA, 22 bp, Homo sapiens
aaggagaggttgtccgtgttgt

SEQ ID NO: 16446 - DNA, 22 bp, Homo sapiens
ccagagctgattcctgggactt

SEQ ID NO: 16447 - DNA, 21 bp, Homo sapiens
ggagtttttctggaagggact

SEQ ID NO: 16448 - DNA, 22 bp, Homo sapiens
ggggccttggatctgtgccccg

SEQ ID NO: 16449 - DNA, 22 bp, Homo sapiens
gagctcattcattcattgcctg

SEQ ID NO: 16450 - DNA, 22 bp, Homo sapiens
ctggagtagccggacgggtctg

SEQ ID NO: 16451 - DNA, 19 bp, Homo sapiens
tctcacagctctactatgt

SEQ ID NO: 16452 - DNA, 22 bp, Homo sapiens
tttccatgtgtactggccagaa

SEQ ID NO: 16453 - DNA, 22 bp, Homo sapiens
tgcccaggctggagtacagtgg

SEQ ID NO: 16454 - DNA, 22 bp, Homo sapiens
ctgcgcagcaatcagagaggag

SEQ ID NO: 16455 - DNA, 20 bp, Homo sapiens
ttgagcttttagtacagaca

SEQ ID NO: 16456 - DNA, 22 bp, Homo sapiens
agatgtgtttctagttcctgca

SEQ ID NO: 16457 - DNA, 22 bp, Homo sapiens
actgcactccaacctgggtgac

SEQ ID NO: 16458 - DNA, 22 bp, Homo sapiens
ctagggtcaggggcctgcgtcg

SEQ ID NO: 16459 - DNA, 20 bp, Homo sapiens
tgtttgtgtggggccttggc

SEQ ID NO: 16460 - DNA, 22 bp, Homo sapiens
acctgcaggcacaggtgtgcgc

SEQ ID NO: 16461 - DNA, 22 bp, Homo sapiens
gaatttcctctaaacccctgag

SEQ ID NO: 16462 - DNA, 22 bp, Homo sapiens
tttgtgaataggttggcttcca

SEQ ID NO: 16463 - DNA, 22 bp, Homo sapiens
cccaggcttttctcttgcccca

SEQ ID NO: 16464 - DNA, 22 bp, Homo sapiens
ggcgcccccttcaaacagagca

SEQ ID NO: 16465 - DNA, 22 bp, Homo sapiens
cagcaggaggtgagtagcaggt

SEQ ID NO: 16466 - DNA, 22 bp, Homo sapiens
tttgcttgttcaagatttctgt

SEQ ID NO: 16467 - DNA, 20 bp, Homo sapiens
gacatgtctttctcacacaa

SEQ ID NO: 16468 - DNA, 22 bp, Homo sapiens
aaagaggcaatcaatgtagcaa

SEQ ID NO: 16469 - DNA, 22 bp, Homo sapiens
aagtgctgggattacaggtgtg

SEQ ID NO: 16470 - DNA, 22 bp, Homo sapiens
tggcagtggcgggactcagggc

SEQ ID NO: 16471 - DNA, 22 bp, Homo sapiens
gagagcaggaggcagcgggacg

SEQ ID NO: 16472 - DNA, 22 bp, Homo sapiens
agagagcccgggccagggcaca

SEQ ID NO: 16473 - DNA, 22 bp, Homo sapiens
taatatctacttcatagagttt

SEQ ID NO: 16474 - DNA, 21 bp, Homo sapiens
cctcaagtgcctcctgctgct

SEQ ID NO: 16475 - DNA, 22 bp, Homo sapiens
tgaggcaggaggttgagaactg

SEQ ID NO: 16476 - DNA, 22 bp, Homo sapiens
tccgggttttacactcacatca

SEQ ID NO: 16477 - DNA, 22 bp, Homo sapiens
aggagggagcttaagccaggca

SEQ ID NO: 16478 - DNA, 22 bp, Homo sapiens
ggcgctcagtgttgccccagag

SEQ ID NO: 16479 - DNA, 22 bp, Homo sapiens
agctcaagctacacacagagtc

SEQ ID NO: 16480 - DNA, 22 bp, Homo sapiens
aggcggaagatggccccataga

SEQ ID NO: 16481 - DNA, 22 bp, Homo sapiens
aggctgtagtgcatgtgctatg

SEQ ID NO: 16482 - DNA, 22 bp, Homo sapiens
ctgagggtcaacttgattgtat

SEQ ID NO: 16483 - DNA, 22 bp, Homo sapiens
gcagcctgggcaacagagtgag

SEQ ID NO: 16484 - DNA, 22 bp, Homo sapiens
ttagggttacaccagcctcctg

SEQ ID NO: 16485 - DNA, 22 bp, Homo sapiens
agctgccgatgcccagctgcat

SEQ ID NO: 16486 - DNA, 22 bp, Homo sapiens
atgggttcaagtgattctcctg

SEQ ID NO: 16487 - DNA, 22 bp, Homo sapiens
agtgctgggctatctactgcta

SEQ ID NO: 16488 - DNA, 22 bp, Homo sapiens
tgggcagggagctggaaccaca

SEQ ID NO: 16489 - DNA, 22 bp, Homo sapiens
cccagcaggaggaggttgcagt

SEQ ID NO: 16490 - DNA, 22 bp, Homo sapiens
gcggcggagacagcaggaagcc

SEQ ID NO: 16491 - DNA, 22 bp, Homo sapiens
ggagagtgggagcaactgttgc

SEQ ID NO: 16492 - DNA, 22 bp, Homo sapiens
gttgagtgggttaggatgctga

SEQ ID NO: 16493 - DNA, 22 bp, Homo sapiens
acagattcactgcactggccat

SEQ ID NO: 16494 - DNA, 22 bp, Homo sapiens
agctcaatgcaacctccgcctc

SEQ ID NO: 16495 - DNA, 22 bp, Homo sapiens
aaaatcttgtgacttaggaagg

SEQ ID NO: 16496 - DNA, 22 bp, Homo sapiens
tgtcttcagcagtcatctgggg

SEQ ID NO: 16497 - DNA, 22 bp, Homo sapiens
ttttggccacatccttttgagt

SEQ ID NO: 16498 - DNA, 22 bp, Homo sapiens
aggctgagataggtggatcatt

SEQ ID NO: 16499 - DNA, 22 bp, Homo sapiens
gtgttgatgacattttagaaac

SEQ ID NO: 16500 - DNA, 22 bp, Homo sapiens
caccaggctggagtgcagtggc

SEQ ID NO: 16501 - DNA, 22 bp, Homo sapiens
cccaagaggtggaggttgcagt

SEQ ID NO: 16502 - DNA, 22 bp, Homo sapiens
ccgaggtcctggacttggccct

SEQ ID NO: 16503 - DNA, 17 bp, Homo sapiens
gtaaggcttgcagatgc

SEQ ID NO: 16504 - DNA, 22 bp, Homo sapiens
ggcagcactgcagcttgttggg

SEQ ID NO: 16505 - DNA, 22 bp, Homo sapiens
tttaatgtagcgtgaaatgatt

SEQ ID NO: 16506 - DNA, 22 bp, Homo sapiens
tactaggaagcagctgcattgg

SEQ ID NO: 16507 - DNA, 19 bp, Homo sapiens
gctgaggtggaggaaggag

SEQ ID NO: 16508 - DNA, 22 bp, Homo sapiens
agcagcagtatccttccccggc

SEQ ID NO: 16509 - DNA, 22 bp, Homo sapiens
agcctggtttaagcattttata

SEQ ID NO: 16510 - DNA, 22 bp, Homo sapiens
tcaccggcagacgtggcctgat

SEQ ID NO: 16511 - DNA, 22 bp, Homo sapiens
tgtgtgattgcaggagatgtgg

SEQ ID NO: 16512 - DNA, 22 bp, Homo sapiens
ttgaggtccccagtacccactg

SEQ ID NO: 16513 - DNA, 19 bp, Homo sapiens
acccagcccaggagtggca

SEQ ID NO: 16514 - DNA, 22 bp, Homo sapiens
tgtctggtgggttgacaggcag

SEQ ID NO: 16515 - DNA, 22 bp, Homo sapiens
ggtgacagtggttaaaatttgt

SEQ ID NO: 16516 - DNA, 22 bp, Homo sapiens
ggagacagggttgaaccacgca

SEQ ID NO: 16517 - DNA, 22 bp, Homo sapiens
tcagtgatttctggggtgaggg

SEQ ID NO: 16518 - DNA, 22 bp, Homo sapiens
cccaggatggggctgcagttat

SEQ ID NO: 16519 - DNA, 22 bp, Homo sapiens
gaggttggggctgcagtgagct

SEQ ID NO: 16520 - DNA, 22 bp, Homo sapiens
gtcccataagtagtgcaacttg

SEQ ID NO: 16521 - DNA, 22 bp, Homo sapiens
ttctcttttcaccagttgctaa

SEQ ID NO: 16522 - DNA, 18 bp, Homo sapiens
ggagactaaactgttgac

SEQ ID NO: 16523 - DNA, 22 bp, Homo sapiens
caggaaggcgcggctgtgcctg

SEQ ID NO: 16524 - DNA, 22 bp, Homo sapiens
gctactgattgaccttggagag

SEQ ID NO: 16525 - DNA, 22 bp, Homo sapiens
cccaggaggtcaaggctgcagt

SEQ ID NO: 16526 - DNA, 22 bp, Homo sapiens
gctcaggtagatggggttgtcc

SEQ ID NO: 16527 - DNA, 22 bp, Homo sapiens
ggagaccagaaggaagcttcga

SEQ ID NO: 16528 - DNA, 22 bp, Homo sapiens
gctgaggtggaggaaggagacc

SEQ ID NO: 16529 - DNA, 22 bp, Homo sapiens
ttcctagggcagagccgctggg

SEQ ID NO: 16530 - DNA, 22 bp, Homo sapiens
ctgaacttattgagtgcttgct

SEQ ID NO: 16531 - DNA, 23 bp, Homo sapiens
ttggcaaagcctatgaagtcctc

SEQ ID NO: 16532 - DNA, 22 bp, Homo sapiens
atacacgtgccatgttggtgtg

SEQ ID NO: 16533 - DNA, 22 bp, Homo sapiens
aggatgagccgcgcaagctgac

SEQ ID NO: 16534 - DNA, 22 bp, Homo sapiens
aactcaaagatgcatgacgctt

SEQ ID NO: 16535 - DNA, 22 bp, Homo sapiens
gagctgagaagcagcgcttgat

SEQ ID NO: 16536 - DNA, 22 bp, Homo sapiens
tggctgagttacgaacagagca

SEQ ID NO: 16537 - DNA, 21 bp, Homo sapiens
tcacgtggtcacatgagcttt

SEQ ID NO: 16538 - DNA, 22 bp, Homo sapiens
ttttaatactgctattgtagga

SEQ ID NO: 16539 - DNA, 22 bp, Homo sapiens
actgcactccagcctgggtgac

SEQ ID NO: 16540 - DNA, 19 bp, Homo sapiens
aggagcactgccagcacca

SEQ ID NO: 16541 - DNA, 22 bp, Homo sapiens
tcactgcaacctccacctcccg

SEQ ID NO: 16542 - DNA, 22 bp, Homo sapiens
ccccggaggcggaggttgcagt

SEQ ID NO: 16543 - DNA, 22 bp, Homo sapiens
cccaggaggcgcaggttgcggt

SEQ ID NO: 16544 - DNA, 22 bp, Homo sapiens
cccgggaggaggaagttgcagt

SEQ ID NO: 16545 - DNA, 22 bp, Homo sapiens
aagatattcaaagatttattag

SEQ ID NO: 16546 - DNA, 22 bp, Homo sapiens
tttccagagggtgctcagggcg

SEQ ID NO: 16547 - DNA, 22 bp, Homo sapiens
tgtctcatctcttaaccccact

SEQ ID NO: 16548 - DNA, 22 bp, Homo sapiens
agcctgggccctgcctcttctc

SEQ ID NO: 16549 - DNA, 22 bp, Homo sapiens
tgtttgagttctagcgcattta

SEQ ID NO: 16550 - DNA, 22 bp, Homo sapiens
cctttcccgctttgagggcaag

SEQ ID NO: 16551 - DNA, 23 bp, Homo sapiens
actgattcttgaagttgacaagt

SEQ ID NO: 16552 - DNA, 22 bp, Homo sapiens
tggtcttagctggaaggaggga

SEQ ID NO: 16553 - DNA, 22 bp, Homo sapiens
cgccgcctgctgcagcagctgt

SEQ ID NO: 16554 - DNA, 22 bp, Homo sapiens
tcccacaggtggagcttgcagt

SEQ ID NO: 16555 - DNA, 22 bp, Homo sapiens
atgaattgaggaaaacagtcgt

SEQ ID NO: 16556 - DNA, 22 bp, Homo sapiens
aacagtgtttttcttcagcact

SEQ ID NO: 16557 - DNA, 22 bp, Homo sapiens
tataccatgtgtgcacactccc

SEQ ID NO: 16558 - DNA, 22 bp, Homo sapiens
tctgttgactcctagcagccat

SEQ ID NO: 16559 - DNA, 22 bp, Homo sapiens
tggagtgcaatagtaataaggt

SEQ ID NO: 16560 - DNA, 22 bp, Homo sapiens
acaaacagagttgaaaaatagg

SEQ ID NO: 16561 - DNA, 22 bp, Homo sapiens
ttccacggggctccccgctctt

SEQ ID NO: 16562 - DNA, 22 bp, Homo sapiens
gccaggttgctgacgacgatct

SEQ ID NO: 16563 - DNA, 20 bp, Homo sapiens
tgaggcccagcagagtcggg

SEQ ID NO: 16564 - DNA, 22 bp, Homo sapiens
ggagaggcttccagagtcgtgc

SEQ ID NO: 16565 - DNA, 22 bp, Homo sapiens
cccagtttcaactttccagtgg

SEQ ID NO: 16566 - DNA, 22 bp, Homo sapiens
ggtgagaaagggattcctgttc

SEQ ID NO: 16567 - DNA, 22 bp, Homo sapiens
tgttatcctcagctcacctcta

SEQ ID NO: 16568 - DNA, 22 bp, Homo sapiens
ggacaagcctgtgagtgggttt

SEQ ID NO: 16569 - DNA, 22 bp, Homo sapiens
ccttttgctctcccatccagaa

SEQ ID NO: 16570 - DNA, 22 bp, Homo sapiens
caggaaagggatgggctgccac

SEQ ID NO: 16571 - DNA, 23 bp, Homo sapiens
ccagtgattgcctggaaggaggt

SEQ ID NO: 16572 - DNA, 22 bp, Homo sapiens
ctggctgggagcgagctgctca

SEQ ID NO: 16573 - DNA, 22 bp, Homo sapiens
tgaggcaggtggattacaaggt

SEQ ID NO: 16574 - DNA, 22 bp, Homo sapiens
tgcctcagctgaggccgctcca

SEQ ID NO: 16575 - DNA, 22 bp, Homo sapiens
ttatcacttatgagctttttgc

SEQ ID NO: 16576 - DNA, 22 bp, Homo sapiens
tagactagaggatcagcaaggg

SEQ ID NO: 16577 - DNA, 22 bp, Homo sapiens
tctatgcttgagacagatgggg

SEQ ID NO: 16578 - DNA, 20 bp, Homo sapiens
tcacatcctctcccaacatg

SEQ ID NO: 16579 - DNA, 20 bp, Homo sapiens
ctgtggaattttaccatgcg

SEQ ID NO: 16580 - DNA, 22 bp, Homo sapiens
ggaggaggggtgactgaatgct

SEQ ID NO: 16581 - DNA, 22 bp, Homo sapiens
ccccatgaagtagggtctctga

SEQ ID NO: 16582 - DNA, 22 bp, Homo sapiens
cacttgttggtggtgaaatcac

SEQ ID NO: 16583 - DNA, 22 bp, Homo sapiens
ggcaagaaccacaattactttt

SEQ ID NO: 16584 - DNA, 22 bp, Homo sapiens
tgggtactcctattagttcagt

SEQ ID NO: 16585 - DNA, 22 bp, Homo sapiens
tccttgtgctgagggtgttgct

SEQ ID NO: 16586 - DNA, 22 bp, Homo sapiens
agttgcagacgcagagatgttg

SEQ ID NO: 16587 - DNA, 22 bp, Homo sapiens
actgcacttcagcctgggtgac

SEQ ID NO: 16588 - DNA, 22 bp, Homo sapiens
ggaggcagaatagagtgtgggt

SEQ ID NO: 16589 - DNA, 21 bp, Homo sapiens
ctggccactgcacctcttcct

SEQ ID NO: 16590 - DNA, 22 bp, Homo sapiens
aagcagatctgatagggccctg

SEQ ID NO: 16591 - DNA, 20 bp, Homo sapiens
gggcagtggcgctatctcag

SEQ ID NO: 16592 - DNA, 22 bp, Homo sapiens
gacaggtgctaagggacctggc

SEQ ID NO: 16593 - DNA, 22 bp, Homo sapiens
caggctgatcagggctgggatg

SEQ ID NO: 16594 - DNA, 22 bp, Homo sapiens
ggcttttgtttcagctctgcta

SEQ ID NO: 16595 - DNA, 22 bp, Homo sapiens
tggtcgaccagttggaaagtaa

SEQ ID NO: 16596 - DNA, 22 bp, Homo sapiens
ctcagccccagcccagatagca

SEQ ID NO: 16597 - DNA, 22 bp, Homo sapiens
cagctgcccctccagggctggg

SEQ ID NO: 16598 - DNA, 22 bp, Homo sapiens
ggtccccgtggaggctggagcg

SEQ ID NO: 16599 - DNA, 22 bp, Homo sapiens
ggctgatgggcatgagctgtca

SEQ ID NO: 16600 - DNA, 22 bp, Homo sapiens
caagtctgacctctgggtgaag

SEQ ID NO: 16601 - DNA, 22 bp, Homo sapiens
cagcatgaatgtgttcgtaggg

SEQ ID NO: 16602 - DNA, 22 bp, Homo sapiens
tctcgctctgtcgcccaggctg

SEQ ID NO: 16603 - DNA, 22 bp, Homo sapiens
tctgtggcccaagtgatggctg

SEQ ID NO: 16604 - DNA, 22 bp, Homo sapiens
acagtctgtcccccaggtgcta

SEQ ID NO: 16605 - DNA, 22 bp, Homo sapiens
cggctggtgtcgggcacagcaa

SEQ ID NO: 16606 - DNA, 22 bp, Homo sapiens
aagtgctgggattataggcatg

SEQ ID NO: 16607 - DNA, 22 bp, Homo sapiens
ggagagcttggagtgcgatttt

SEQ ID NO: 16608 - DNA, 22 bp, Homo sapiens
cttgtcttgcacacggttgcca

SEQ ID NO: 16609 - DNA, 22 bp, Homo sapiens
tatgccactgctctccatccta

SEQ ID NO: 16610 - DNA, 22 bp, Homo sapiens
aaggagtggggcatatcacaga

SEQ ID NO: 16611 - DNA, 22 bp, Homo sapiens
atgtttttggaaatgggaacat

SEQ ID NO: 16612 - DNA, 22 bp, Homo sapiens
gttggccaggctggtctcaaac

SEQ ID NO: 16613 - DNA, 22 bp, Homo sapiens
ggctcacgcaattatcccggcc

SEQ ID NO: 16614 - DNA, 22 bp, Homo sapiens
ccctggaggcggagcttgcagt

SEQ ID NO: 16615 - DNA, 22 bp, Homo sapiens
ctggggtcagggatcagagagc

SEQ ID NO: 16616 - DNA, 22 bp, Homo sapiens
aggaggggttctcgggtgctga

SEQ ID NO: 16617 - DNA, 22 bp, Homo sapiens
tgctcatcaacatgatgatcat

SEQ ID NO: 16618 - DNA, 22 bp, Homo sapiens
cggctcactgcagctccgcctc

SEQ ID NO: 16619 - DNA, 22 bp, Homo sapiens
ctagttctagatccctgaggaa

SEQ ID NO: 16620 - DNA, 22 bp, Homo sapiens
ttcaccctggaccagaaattgg

SEQ ID NO: 16621 - DNA, 22 bp, Homo sapiens
cagatgtcatttcccatgcagc

SEQ ID NO: 16622 - DNA, 22 bp, Homo sapiens
ttgaggtcatctgaagtactag

SEQ ID NO: 16623 - DNA, 18 bp, Homo sapiens
tgagaggctattttttgc

SEQ ID NO: 16624 - DNA, 22 bp, Homo sapiens
gcgagtgccgagagggcagggc

SEQ ID NO: 16625 - DNA, 22 bp, Homo sapiens
cctcttcaggcactcgaaggcc

SEQ ID NO: 16626 - DNA, 22 bp, Homo sapiens
aagcccttggcgcacaccgggc

SEQ ID NO: 16627 - DNA, 22 bp, Homo sapiens
gttggccaggctggtctcaatc

SEQ ID NO: 16628 - DNA, 23 bp, Homo sapiens
cagagctggctcagagctgcctg

SEQ ID NO: 16629 - DNA, 22 bp, Homo sapiens
tgtggggatcttctagcttttc

SEQ ID NO: 16630 - DNA, 18 bp, Homo sapiens
taggttacagccagccag

SEQ ID NO: 16631 - DNA, 21 bp, Homo sapiens
atctcgggcttctcgcccagc

SEQ ID NO: 16632 - DNA, 22 bp, Homo sapiens
ttttcatttttgtagatgcaag

SEQ ID NO: 16633 - DNA, 22 bp, Homo sapiens
cggccaagccggggccccgaag

SEQ ID NO: 16634 - DNA, 22 bp, Homo sapiens
taggtttcagaggtgccgggaa

SEQ ID NO: 16635 - DNA, 22 bp, Homo sapiens
ccagatatcactgccgtgttgt

SEQ ID NO: 16636 - DNA, 22 bp, Homo sapiens
atacctgtgtatccacaagcgt

SEQ ID NO: 16637 - DNA, 22 bp, Homo sapiens
ttccgagggctcggcggccgcc

SEQ ID NO: 16638 - DNA, 22 bp, Homo sapiens
ttggccatctaagcccagccac

SEQ ID NO: 16639 - DNA, 22 bp, Homo sapiens
tccagcttataggtagatttaa

SEQ ID NO: 16640 - DNA, 22 bp, Homo sapiens
cccaggaggtggagcttgcagt

SEQ ID NO: 16641 - DNA, 22 bp, Homo sapiens
aagaataagaggatttagaaca

SEQ ID NO: 16642 - DNA, 16 bp, Homo sapiens
atgctgctattagagg

SEQ ID NO: 16643 - DNA, 22 bp, Homo sapiens
agcccttagtacatttctcaag

SEQ ID NO: 16644 - DNA, 22 bp, Homo sapiens
tttgggcaggcttttccctaga

SEQ ID NO: 16645 - DNA, 19 bp, Homo sapiens
gggcaaagtgatcgtcctg

SEQ ID NO: 16646 - DNA, 22 bp, Homo sapiens
ggctcaatgcaacttctgcctc

SEQ ID NO: 16647 - DNA, 22 bp, Homo sapiens
gggatcgtcatggaaagtgcta

SEQ ID NO: 16648 - DNA, 22 bp, Homo sapiens
taggtttaggagtgaaggtgaa

SEQ ID NO: 16649 - DNA, 22 bp, Homo sapiens
ctccttctgggcctggcagtgg

SEQ ID NO: 16650 - DNA, 22 bp, Homo sapiens
ctcctctttagccccagctgga

SEQ ID NO: 16651 - DNA, 22 bp, Homo sapiens
tcgagctctggagccaaggatg

SEQ ID NO: 16652 - DNA, 21 bp, Homo sapiens
ttagaagctaatgcagctggt

SEQ ID NO: 16653 - DNA, 19 bp, Homo sapiens
ttctggtctggaatcaagg

SEQ ID NO: 16654 - DNA, 22 bp, Homo sapiens
aggccagcctcaggcagggacc

SEQ ID NO: 16655 - DNA, 22 bp, Homo sapiens
tcggactcggcaaggctatgca

SEQ ID NO: 16656 - DNA, 22 bp, Homo sapiens
tcctgccttgcctgggacatca

SEQ ID NO: 16657 - DNA, 22 bp, Homo sapiens
aagaagagaactggcatcctaa

SEQ ID NO: 16658 - DNA, 22 bp, Homo sapiens
cccaggggttcaaggctgcagt

SEQ ID NO: 16659 - DNA, 21 bp, Homo sapiens
gtggttctagagaaacagaat

SEQ ID NO: 16660 - DNA, 22 bp, Homo sapiens
ctgagatggagttttgctcttg

SEQ ID NO: 16661 - DNA, 22 bp, Homo sapiens
ctcccagccttcgccagtctga

SEQ ID NO: 16662 - DNA, 22 bp, Homo sapiens
gtgcagagaggaccttggggag

SEQ ID NO: 16663 - DNA, 22 bp, Homo sapiens
gaccttgtgatctgcccacctt

SEQ ID NO: 16664 - DNA, 22 bp, Homo sapiens
tcgtgatctgtccacctcggcc

SEQ ID NO: 16665 - DNA, 22 bp, Homo sapiens
gcccaggaggcagaggttgtgg

SEQ ID NO: 16666 - DNA, 22 bp, Homo sapiens
cttgtagacccctggactcacg

SEQ ID NO: 16667 - DNA, 22 bp, Homo sapiens
tagatgaccttgtgttaggcaa

SEQ ID NO: 16668 - DNA, 22 bp, Homo sapiens
accctcaagatggaagcagttt

SEQ ID NO: 16669 - DNA, 22 bp, Homo sapiens
gtctatatattgcttgaataat

SEQ ID NO: 16670 - DNA, 22 bp, Homo sapiens
ctgagatctttatacgaggcac

SEQ ID NO: 16671 - DNA, 22 bp, Homo sapiens
ggcccaggctggagtgcagtgg

SEQ ID NO: 16672 - DNA, 23 bp, Homo sapiens
gcagaggagcaagctggacacca

SEQ ID NO: 16673 - DNA, 22 bp, Homo sapiens
gaaaagagacagggtgggtgat

SEQ ID NO: 16674 - DNA, 22 bp, Homo sapiens
gggtccctggaattacttgaca

SEQ ID NO: 16675 - DNA, 22 bp, Homo sapiens
cagtggcgtgatctctgctcac

SEQ ID NO: 16676 - DNA, 22 bp, Homo sapiens
agcgccactgcactccagcctg

SEQ ID NO: 16677 - DNA, 21 bp, Homo sapiens
gaccccagaccagcagacaca

SEQ ID NO: 16678 - DNA, 22 bp, Homo sapiens
tgggccgtggagcactctgaga

SEQ ID NO: 16679 - DNA, 22 bp, Homo sapiens
aatggaatacctaggtggccca

SEQ ID NO: 16680 - DNA, 22 bp, Homo sapiens
tgcacgtgtgagcattcacatg

SEQ ID NO: 16681 - DNA, 22 bp, Homo sapiens
aaggctgagacagcacaggtcc

SEQ ID NO: 16682 - DNA, 22 bp, Homo sapiens
accctcaacaaattcactctat

SEQ ID NO: 16683 - DNA, 22 bp, Homo sapiens
agcagcagtgttctggaattct

SEQ ID NO: 16684 - DNA, 22 bp, Homo sapiens
cactgctacctctgcctcccgg

SEQ ID NO: 16685 - DNA, 20 bp, Homo sapiens
tttctgtgagaaacactgtt

SEQ ID NO: 16686 - DNA, 23 bp, Homo sapiens
actcgtggaattctctgcgatcg

SEQ ID NO: 16687 - DNA, 22 bp, Homo sapiens
tctagctctgcttatcatggct

SEQ ID NO: 16688 - DNA, 22 bp, Homo sapiens
accctggaggtggaggtgcagt

SEQ ID NO: 16689 - DNA, 22 bp, Homo sapiens
tagattcagatatttaggacaa

SEQ ID NO: 16690 - DNA, 18 bp, Homo sapiens
cagctgccagctcatgga

SEQ ID NO: 16691 - DNA, 22 bp, Homo sapiens
gaggctgaggttgcagtgagct

SEQ ID NO: 16692 - DNA, 22 bp, Homo sapiens
cctcttctaggacgtccttgtg

SEQ ID NO: 16693 - DNA, 22 bp, Homo sapiens
tgtccccacccaaatctcatct

SEQ ID NO: 16694 - DNA, 22 bp, Homo sapiens
gggcagagactcagaaacagaa

SEQ ID NO: 16695 - DNA, 22 bp, Homo sapiens
actcaaatagcaacggtgagaa

SEQ ID NO: 16696 - DNA, 22 bp, Homo sapiens
cccaggaggcagagcttgcagt

SEQ ID NO: 16697 - DNA, 22 bp, Homo sapiens
cagcgtctcgttgtgggcctcg

SEQ ID NO: 16698 - DNA, 22 bp, Homo sapiens
gtcactgtatccaggttccagc

SEQ ID NO: 16699 - DNA, 22 bp, Homo sapiens
cccaggccccagggcttgtcag

SEQ ID NO: 16700 - DNA, 22 bp, Homo sapiens
ccggcgtctcttccacttccta

SEQ ID NO: 16701 - DNA, 22 bp, Homo sapiens
gaggctgaggttgcagtgagcc

SEQ ID NO: 16702 - DNA, 22 bp, Homo sapiens
ttatttgtggcatatgagacga

SEQ ID NO: 16703 - DNA, 22 bp, Homo sapiens
gggctagcctcttccctgctcc

SEQ ID NO: 16704 - DNA, 22 bp, Homo sapiens
atgagctcatccgagtcacact

SEQ ID NO: 16705 - DNA, 22 bp, Homo sapiens
cgggttcacgccattctcctgc

SEQ ID NO: 16706 - DNA, 22 bp, Homo sapiens
tggcaatgttagcaaagcattt

SEQ ID NO: 16707 - DNA, 22 bp, Homo sapiens
tgagacaggcttccttcttggg

SEQ ID NO: 16708 - DNA, 22 bp, Homo sapiens
tcactgcaacctccacctcctg

SEQ ID NO: 16709 - DNA, 22 bp, Homo sapiens
attttctatgttgtaattgtta

SEQ ID NO: 16710 - DNA, 20 bp, Homo sapiens
gctgaggggtctatggcata

SEQ ID NO: 16711 - DNA, 22 bp, Homo sapiens
ctgagatggagtttcgctcttc

SEQ ID NO: 16712 - DNA, 22 bp, Homo sapiens
ctcatcagaaatacctgacaaa

SEQ ID NO: 16713 - DNA, 22 bp, Homo sapiens
tgtgtggattcatctcaaagag

SEQ ID NO: 16714 - DNA, 22 bp, Homo sapiens
aagagggctgcaatcttattgc

SEQ ID NO: 16715 - DNA, 22 bp, Homo sapiens
cctgtatggctattccttggac

SEQ ID NO: 16716 - DNA, 22 bp, Homo sapiens
atgattgaccatctgctgggct

SEQ ID NO: 16717 - DNA, 22 bp, Homo sapiens
tccgggagctgaacgtcttgcg

SEQ ID NO: 16718 - DNA, 22 bp, Homo sapiens
ttcaatatgatattagctgtgg

SEQ ID NO: 16719 - DNA, 22 bp, Homo sapiens
tttgaggttagctagcagatca

SEQ ID NO: 16720 - DNA, 22 bp, Homo sapiens
ataaaaactgacccatcctttg

SEQ ID NO: 16721 - DNA, 22 bp, Homo sapiens
atcttcccaggctggggagagg

SEQ ID NO: 16722 - DNA, 22 bp, Homo sapiens
acagcccagctctttctctgca

SEQ ID NO: 16723 - DNA, 22 bp, Homo sapiens
tttctggcagcgggacaggggt

SEQ ID NO: 16724 - DNA, 23 bp, Homo sapiens
agagcaaggaaatgaggtgtgat

SEQ ID NO: 16725 - DNA, 22 bp, Homo sapiens
gggcggggtggctcatgcctgt

SEQ ID NO: 16726 - DNA, 22 bp, Homo sapiens
aataaaatggtcagttttctca

SEQ ID NO: 16727 - DNA, 22 bp, Homo sapiens
ttgggctcaggagtttgagacc

SEQ ID NO: 16728 - DNA, 22 bp, Homo sapiens
ttatttttaaaagttcacacag

SEQ ID NO: 16729 - DNA, 22 bp, Homo sapiens
gaactttataactgtaaatgtc

SEQ ID NO: 16730 - DNA, 22 bp, Homo sapiens
ttgattatagactcactaatct

SEQ ID NO: 16731 - DNA, 22 bp, Homo sapiens
aagaggtaaccatagcaaccac

SEQ ID NO: 16732 - DNA, 22 bp, Homo sapiens
ctgcatccatgttgctgcaaag

SEQ ID NO: 16733 - DNA, 22 bp, Homo sapiens
tcgcccaggctggaagtgcagt

SEQ ID NO: 16734 - DNA, 22 bp, Homo sapiens
ataatggaaaagatcatttcct

SEQ ID NO: 16735 - DNA, 22 bp, Homo sapiens
cccaggaggtggagttcacagt

SEQ ID NO: 16736 - DNA, 22 bp, Homo sapiens
taagcctgcatgaaccatgaga

SEQ ID NO: 16737 - DNA, 22 bp, Homo sapiens
gccttgccgctcagcagtgggg

SEQ ID NO: 16738 - DNA, 22 bp, Homo sapiens
gcacctgcctgggactgaagat

SEQ ID NO: 16739 - DNA, 22 bp, Homo sapiens
agagggtgggcacgtgatggat

SEQ ID NO: 16740 - DNA, 22 bp, Homo sapiens
tgttcagaacaaaggtaaatga

SEQ ID NO: 16741 - DNA, 18 bp, Homo sapiens
cccggctaatttttggta

SEQ ID NO: 16742 - DNA, 22 bp, Homo sapiens
cccaggaagtggaggttgcagt

SEQ ID NO: 16743 - DNA, 22 bp, Homo sapiens
gactggaaagcctgtcctcaga

SEQ ID NO: 16744 - DNA, 22 bp, Homo sapiens
agtgctatcgagttctaatgct

SEQ ID NO: 16745 - DNA, 22 bp, Homo sapiens
ttggcttttatgcagcttaggt

SEQ ID NO: 16746 - DNA, 22 bp, Homo sapiens
ggctgagttgagaggattactt

SEQ ID NO: 16747 - DNA, 22 bp, Homo sapiens
aaggctcggcaatgtgcggctc

SEQ ID NO: 16748 - DNA, 22 bp, Homo sapiens
ggtttgttggggtccaggccca

SEQ ID NO: 16749 - DNA, 22 bp, Homo sapiens
tgacttgtctctttgggagaca

SEQ ID NO: 16750 - DNA, 22 bp, Homo sapiens
atgttgtgtttgactgttaccc

SEQ ID NO: 16751 - DNA, 22 bp, Homo sapiens
taatgtataacaaatactcatc

SEQ ID NO: 16752 - DNA, 22 bp, Homo sapiens
tgggcagttttctatgctgcaa

SEQ ID NO: 16753 - DNA, 22 bp, Homo sapiens
ccggctcggcgaccaggctgaa

SEQ ID NO: 16754 - DNA, 22 bp, Homo sapiens
tagtatagattgaagcagatca

SEQ ID NO: 16755 - DNA, 22 bp, Homo sapiens
tctgcaacagtgccctgtaaat

SEQ ID NO: 16756 - DNA, 22 bp, Homo sapiens
aagcagaatagaggcccttccc

SEQ ID NO: 16757 - DNA, 22 bp, Homo sapiens
tgagacgaagtcttgctctgtt

SEQ ID NO: 16758 - DNA, 22 bp, Homo sapiens
cactgcaacctccacctcctgg

SEQ ID NO: 16759 - DNA, 22 bp, Homo sapiens
acccaggagacggaggtgcagt

SEQ ID NO: 16760 - DNA, 22 bp, Homo sapiens
aggagagctggtgtctggaatc

SEQ ID NO: 16761 - DNA, 18 bp, Homo sapiens
tgtccctgcaaataacat

SEQ ID NO: 16762 - DNA, 22 bp, Homo sapiens
cgggcaaggcgagactaggccc

SEQ ID NO: 16763 - DNA, 22 bp, Homo sapiens
tgaggcaggagaatcacatgaa

SEQ ID NO: 16764 - DNA, 22 bp, Homo sapiens
gggaagatagtgttgagggccc

SEQ ID NO: 16765 - DNA, 22 bp, Homo sapiens
gctgtatgtgaggccacagtga

SEQ ID NO: 16766 - DNA, 22 bp, Homo sapiens
cacccaggcaaggattctgcaa

SEQ ID NO: 16767 - DNA, 22 bp, Homo sapiens
tcaccgaggctggagtgcagtg

SEQ ID NO: 16768 - DNA, 22 bp, Homo sapiens
ggcctcacccatcggtgccttt

SEQ ID NO: 16769 - DNA, 22 bp, Homo sapiens
ctcttagtaatgccatgaagca

SEQ ID NO: 16770 - DNA, 22 bp, Homo sapiens
tcattgccatggcatttgcaga

SEQ ID NO: 16771 - DNA, 18 bp, Homo sapiens
gcagctagccaggggggc

SEQ ID NO: 16772 - DNA, 22 bp, Homo sapiens
ctgaggctggagtgcagtggtg

SEQ ID NO: 16773 - DNA, 22 bp, Homo sapiens
ctggagcaaaagtgactcctct

SEQ ID NO: 16774 - DNA, 22 bp, Homo sapiens
tgtgctctgactttctcctggt

SEQ ID NO: 16775 - DNA, 22 bp, Homo sapiens
gcatctaaataaacgtgggagt

SEQ ID NO: 16776 - DNA, 23 bp, Homo sapiens
aggcgagctcttctccagcacgt

SEQ ID NO: 16777 - DNA, 22 bp, Homo sapiens
aacggctgtggctggcggcagc

SEQ ID NO: 16778 - DNA, 18 bp, Homo sapiens
taggagagaatttattta

SEQ ID NO: 16779 - DNA, 22 bp, Homo sapiens
tcaccttgtgatctccctgcct

SEQ ID NO: 16780 - DNA, 22 bp, Homo sapiens
cacccaggctggaatgcagtgg

SEQ ID NO: 16781 - DNA, 22 bp, Homo sapiens
aaagatcacgtcccaggactcg

SEQ ID NO: 16782 - DNA, 22 bp, Homo sapiens
tctcgatctcctgaccttgtga

SEQ ID NO: 16783 - DNA, 17 bp, Homo sapiens
tggctctgtcctcagct

SEQ ID NO: 16784 - DNA, 22 bp, Homo sapiens
cagcagagaaattacatatttg

SEQ ID NO: 16785 - DNA, 22 bp, Homo sapiens
gaggaggcttccgggaggcacg

SEQ ID NO: 16786 - DNA, 23 bp, Homo sapiens
actctcaggttctttccagcagg

SEQ ID NO: 16787 - DNA, 22 bp, Homo sapiens
gacctcgtgatccgccctcctt

SEQ ID NO: 16788 - DNA, 22 bp, Homo sapiens
gcccagtagttcaaggttgcag

SEQ ID NO: 16789 - DNA, 22 bp, Homo sapiens
ttggaaacgtcaccttttcctt

SEQ ID NO: 16790 - DNA, 22 bp, Homo sapiens
tgttgagtatatacctacaagt

SEQ ID NO: 16791 - DNA, 20 bp, Homo sapiens
tgagacccgctgacaagttc

SEQ ID NO: 16792 - DNA, 22 bp, Homo sapiens
tttattctgtgctacatgaaga

SEQ ID NO: 16793 - DNA, 22 bp, Homo sapiens
tccatgaggaccaaattcgtag

SEQ ID NO: 16794 - DNA, 22 bp, Homo sapiens
tcactacaacctccgcctcctg

SEQ ID NO: 16795 - DNA, 22 bp, Homo sapiens
ctgtggctctttagttgagcac

SEQ ID NO: 16796 - DNA, 22 bp, Homo sapiens
tgtcctcatcctccagtctgtc

SEQ ID NO: 16797 - DNA, 22 bp, Homo sapiens
ttccagctaactcacatccctt

SEQ ID NO: 16798 - DNA, 22 bp, Homo sapiens
aagtgctgagactacaggcatg

SEQ ID NO: 16799 - DNA, 22 bp, Homo sapiens
atgagtatatgatatggtttgg

SEQ ID NO: 16800 - DNA, 22 bp, Homo sapiens
gaggcagaggttgttgcagtga

SEQ ID NO: 16801 - DNA, 22 bp, Homo sapiens
ggaggctgaggcaggcggatca

SEQ ID NO: 16802 - DNA, 22 bp, Homo sapiens
ttatgatttgccacagattggt

SEQ ID NO: 16803 - DNA, 20 bp, Homo sapiens
gctgaggtggaggaaggaga

SEQ ID NO: 16804 - DNA, 22 bp, Homo sapiens
tgaggcaggacttgcataaagt

SEQ ID NO: 16805 - DNA, 22 bp, Homo sapiens
ctggcttttttcccattatgca

SEQ ID NO: 16806 - DNA, 22 bp, Homo sapiens
ccgcccacactaaatatgagcg

SEQ ID NO: 16807 - DNA, 22 bp, Homo sapiens
ccaggctgctgttggtgtccgc

SEQ ID NO: 16808 - DNA, 22 bp, Homo sapiens
ccaggctggagtatagtggcgc

SEQ ID NO: 16809 - DNA, 22 bp, Homo sapiens
actcaagtcataggcttctttc

SEQ ID NO: 16810 - DNA, 22 bp, Homo sapiens
agcccaggttgaggctgcagtg

SEQ ID NO: 16811 - DNA, 22 bp, Homo sapiens
tagtcccggaactccttcaggt

SEQ ID NO: 16812 - DNA, 20 bp, Homo sapiens
tttgagaccagtctgcccaa

SEQ ID NO: 16813 - DNA, 22 bp, Homo sapiens
cccaggaggcctgcctggccgg

SEQ ID NO: 16814 - DNA, 22 bp, Homo sapiens
ggcagcttgtcctggaggatgg

SEQ ID NO: 16815 - DNA, 22 bp, Homo sapiens
actgcactccagcctgggtgat

SEQ ID NO: 16816 - DNA, 22 bp, Homo sapiens
gagagattaccacgcttcctga

SEQ ID NO: 16817 - DNA, 22 bp, Homo sapiens
gcgggttgaagggcgcatcgaa

SEQ ID NO: 16818 - DNA, 22 bp, Homo sapiens
cggagtcttgctatgttgccca

SEQ ID NO: 16819 - DNA, 22 bp, Homo sapiens
gctgctctccaagcctccttga

SEQ ID NO: 16820 - DNA, 22 bp, Homo sapiens
ccctgcctacagggttttcttt

SEQ ID NO: 16821 - DNA, 23 bp, Homo sapiens
tgttccagatacgccttttcctc

SEQ ID NO: 16822 - DNA, 22 bp, Homo sapiens
ccaggctggagtgcaatggcat

SEQ ID NO: 16823 - DNA, 22 bp, Homo sapiens
gcccaggaggagaggctgcagt

SEQ ID NO: 16824 - DNA, 22 bp, Homo sapiens
tgactggattgtcattacgacg

SEQ ID NO: 16825 - DNA, 22 bp, Homo sapiens
accctccccaagaggtcgtgcc

SEQ ID NO: 16826 - DNA, 22 bp, Homo sapiens
tttgaagactactgggagtgaa

SEQ ID NO: 16827 - DNA, 22 bp, Homo sapiens
ctatggtgatagaaatcagaat

SEQ ID NO: 16828 - DNA, 22 bp, Homo sapiens
actttaattaatgaactgtggc

SEQ ID NO: 16829 - DNA, 22 bp, Homo sapiens
tgagctgtagcagatgctgttg

SEQ ID NO: 16830 - DNA, 22 bp, Homo sapiens
ttatttaaaagtggtaagattc

SEQ ID NO: 16831 - DNA, 22 bp, Homo sapiens
gcagaggacacaggagggcaag

SEQ ID NO: 16832 - DNA, 22 bp, Homo sapiens
agggaattcactggaacgccct

SEQ ID NO: 16833 - DNA, 20 bp, Homo sapiens
gggcagagccagccagtccc

SEQ ID NO: 16834 - DNA, 22 bp, Homo sapiens
ttatttaatgtgatctgaagag

SEQ ID NO: 16835 - DNA, 22 bp, Homo sapiens
ctctgctgtgccgccagggcct

SEQ ID NO: 16836 - DNA, 22 bp, Homo sapiens
tgcctccaacagcccatcctag

SEQ ID NO: 16837 - DNA, 22 bp, Homo sapiens
gggctgagacgatggggtcttc

SEQ ID NO: 16838 - DNA, 22 bp, Homo sapiens
agtcaaagatgaccgagttcct

SEQ ID NO: 16839 - DNA, 22 bp, Homo sapiens
gaccttcttgctgtgtcctaac

SEQ ID NO: 16840 - DNA, 22 bp, Homo sapiens
ggtttattgttaataagtttga

SEQ ID NO: 16841 - DNA, 22 bp, Homo sapiens
agagggatcaccctgtttctgg

SEQ ID NO: 16842 - DNA, 22 bp, Homo sapiens
ttgagggtctggatctgctgct

SEQ ID NO: 16843 - DNA, 22 bp, Homo sapiens
cccaggaggttgaggctgcagt

SEQ ID NO: 16844 - DNA, 22 bp, Homo sapiens
gctggtgtttcccgcggctcca

SEQ ID NO: 16845 - DNA, 22 bp, Homo sapiens
aagtgctgggattacaggcatg

SEQ ID NO: 16846 - DNA, 22 bp, Homo sapiens
attctcaaaacataacttcact

SEQ ID NO: 16847 - DNA, 22 bp, Homo sapiens
agggaagaggaccagagtctct

SEQ ID NO: 16848 - DNA, 22 bp, Homo sapiens
gcgcaccacctccaggtggccg

SEQ ID NO: 16849 - DNA, 22 bp, Homo sapiens
tgcctaggctggagtgtagtgg

SEQ ID NO: 16850 - DNA, 22 bp, Homo sapiens
cccgggttgtccgcgcgtccgg

SEQ ID NO: 16851 - DNA, 22 bp, Homo sapiens
tcttaagcagagaagaagttga

SEQ ID NO: 16852 - DNA, 22 bp, Homo sapiens
tgttgattagtgtttagactta

SEQ ID NO: 16853 - DNA, 22 bp, Homo sapiens
ttgagactgagtctcgccctgt

SEQ ID NO: 16854 - DNA, 22 bp, Homo sapiens
gtagatgagctcacatgacctt

SEQ ID NO: 16855 - DNA, 22 bp, Homo sapiens
gaggcggaggttgcagtgagct

SEQ ID NO: 16856 - DNA, 22 bp, Homo sapiens
cccaggaggcggaggttgcagt

SEQ ID NO: 16857 - DNA, 22 bp, Homo sapiens
acaagcatgggctttgacatca

SEQ ID NO: 16858 - DNA, 22 bp, Homo sapiens
ttgtgaatagtgccgcaataaa

SEQ ID NO: 16859 - DNA, 22 bp, Homo sapiens
attgtggtgtcagttataggca

SEQ ID NO: 16860 - DNA, 22 bp, Homo sapiens
aggtgactggtttatctggcag

SEQ ID NO: 16861 - DNA, 22 bp, Homo sapiens
tcccggcgctgggaggtgggtc

SEQ ID NO: 16862 - DNA, 22 bp, Homo sapiens
aggctctgtcaggcggagcagc

SEQ ID NO: 16863 - DNA, 22 bp, Homo sapiens
cccaggaattggaggctgcagt

SEQ ID NO: 16864 - DNA, 22 bp, Homo sapiens
gcccagccacagtcactttcat

SEQ ID NO: 16865 - DNA, 22 bp, Homo sapiens
cccgggaggcggaggttgcagt

SEQ ID NO: 16866 - DNA, 22 bp, Homo sapiens
cccgggaggtggaggttgcagt

SEQ ID NO: 16867 - DNA, 22 bp, Homo sapiens
tccttagacaaagagtgggctt

SEQ ID NO: 16868 - DNA, 22 bp, Homo sapiens
gatagtcacctcccttaacttt

SEQ ID NO: 16869 - DNA, 22 bp, Homo sapiens
cccagagcatgtgctgcctttg

SEQ ID NO: 16870 - DNA, 22 bp, Homo sapiens
agagtgcaaccgaaacaagcag

SEQ ID NO: 16871 - DNA, 22 bp, Homo sapiens
gtagctctgtttaaagttcttt

SEQ ID NO: 16872 - DNA, 22 bp, Homo sapiens
ctagcctgggatttgaacttat

SEQ ID NO: 16873 - DNA, 22 bp, Homo sapiens
cttctcaaagttgtgaatcagg

SEQ ID NO: 16874 - DNA, 22 bp, Homo sapiens
actgcacttcagcctgggtgtc

SEQ ID NO: 16875 - DNA, 22 bp, Homo sapiens
cccaggagttggaggctgcagt

SEQ ID NO: 16876 - DNA, 22 bp, Homo sapiens
aggctgaggcaagaggatcact

SEQ ID NO: 16877 - DNA, 22 bp, Homo sapiens
tcctggtgctgacacccatagc

SEQ ID NO: 16878 - DNA, 22 bp, Homo sapiens
atgtcttctctgtaggtaaatt

SEQ ID NO: 16879 - DNA, 22 bp, Homo sapiens
ccttctagcaaatcaacataaa

SEQ ID NO: 16880 - DNA, 22 bp, Homo sapiens
gcctgctcccagttggcgcctc

SEQ ID NO: 16881 - DNA, 22 bp, Homo sapiens
tgaactcctgacctcatgatcc

SEQ ID NO: 16882 - DNA, 22 bp, Homo sapiens
tgagcaggcgcagcaggaggtc

SEQ ID NO: 16883 - DNA, 22 bp, Homo sapiens
ggccgctctccggtgtggatct

SEQ ID NO: 16884 - DNA, 22 bp, Homo sapiens
aggacagagggaccagagccca

SEQ ID NO: 16885 - DNA, 22 bp, Homo sapiens
aggcaacttttggggatgatgg

SEQ ID NO: 16886 - DNA, 21 bp, Homo sapiens
ggcaagaaacacaatcaagta

SEQ ID NO: 16887 - DNA, 19 bp, Homo sapiens
atgtacccagtgtcaatcc

SEQ ID NO: 16888 - DNA, 22 bp, Homo sapiens
ccgggttgaggttcccatagat

SEQ ID NO: 16889 - DNA, 22 bp, Homo sapiens
tctgctctgtggcttcagctaa

SEQ ID NO: 16890 - DNA, 22 bp, Homo sapiens
gttctgagtcctcctttgaagg

SEQ ID NO: 16891 - DNA, 23 bp, Homo sapiens
ctcaaccctagtaagggagtagg

SEQ ID NO: 16892 - DNA, 22 bp, Homo sapiens
ttgtatgtggcaaatgggggag

SEQ ID NO: 16893 - DNA, 22 bp, Homo sapiens
aaaccgcaattacttttgcgtc

SEQ ID NO: 16894 - DNA, 22 bp, Homo sapiens
agaagccaccagctgaggaaga

SEQ ID NO: 16895 - DNA, 23 bp, Homo sapiens
gcgtccggcctctctcgctcccg

SEQ ID NO: 16896 - DNA, 22 bp, Homo sapiens
tgaggaaacttacaaggcagaa

SEQ ID NO: 16897 - DNA, 22 bp, Homo sapiens
agtgaggggcagctgagtgggc

SEQ ID NO: 16898 - DNA, 22 bp, Homo sapiens
ctgtatctgtgttggatgagtt

SEQ ID NO: 16899 - DNA, 22 bp, Homo sapiens
ttgtggttaaccgcacattttt

SEQ ID NO: 16900 - DNA, 22 bp, Homo sapiens
ggctgcaggttggttggcagct

SEQ ID NO: 16901 - DNA, 22 bp, Homo sapiens
gctgtatgtttatttgggaatt

SEQ ID NO: 16902 - DNA, 22 bp, Homo sapiens
agaggcaggaggttgacttgag

SEQ ID NO: 16903 - DNA, 23 bp, Homo sapiens
tgaggcaggcggatcacgaggtc

SEQ ID NO: 16904 - DNA, 22 bp, Homo sapiens
ctgtggctcaggcctgtaagcc

SEQ ID NO: 16905 - DNA, 22 bp, Homo sapiens
gagccaggttggaggctgcagt

SEQ ID NO: 16906 - DNA, 22 bp, Homo sapiens
gaactctctcatctgtcagttg

SEQ ID NO: 16907 - DNA, 22 bp, Homo sapiens
agagtactgcctcagttatgaa

SEQ ID NO: 16908 - DNA, 22 bp, Homo sapiens
tgagaactgcctgtatttatct

SEQ ID NO: 16909 - DNA, 22 bp, Homo sapiens
taggaatggtgctcagcagaaa

SEQ ID NO: 16910 - DNA, 22 bp, Homo sapiens
cagctgctgttcagttttgttt

SEQ ID NO: 16911 - DNA, 22 bp, Homo sapiens
aataatctcactttatgtggaa

SEQ ID NO: 16912 - DNA, 22 bp, Homo sapiens
agtgagagtattaatgtgaact

SEQ ID NO: 16913 - DNA, 22 bp, Homo sapiens
gctcaagacccctctgtgactg

SEQ ID NO: 16914 - DNA, 20 bp, Homo sapiens
ccagagctgatggctgcccg

SEQ ID NO: 16915 - DNA, 22 bp, Homo sapiens
gggccatgagaggttcatcaac

SEQ ID NO: 16916 - DNA, 20 bp, Homo sapiens
tgtccccaccaaaatttcat

SEQ ID NO: 16917 - DNA, 22 bp, Homo sapiens
ggctcagatggtttgttctaga

SEQ ID NO: 16918 - DNA, 22 bp, Homo sapiens
ggaatcctgccagctctgcccc

SEQ ID NO: 16919 - DNA, 22 bp, Homo sapiens
cccaggaggcagatgttgcagt

SEQ ID NO: 16920 - DNA, 22 bp, Homo sapiens
attaagtgactaaagtaatgct

SEQ ID NO: 16921 - DNA, 23 bp, Homo sapiens
tatgaactgcattgctggtgtgt

SEQ ID NO: 16922 - DNA, 22 bp, Homo sapiens
atctagattaggtataagagct

SEQ ID NO: 16923 - DNA, 22 bp, Homo sapiens
tgccatggcctagacctgtgat

SEQ ID NO: 16924 - DNA, 22 bp, Homo sapiens
cccaggagttagaggttgtggt

SEQ ID NO: 16925 - DNA, 22 bp, Homo sapiens
tgaccctgagagctgaatggct

SEQ ID NO: 16926 - DNA, 22 bp, Homo sapiens
ggccagcctggggctcccagac

SEQ ID NO: 16927 - DNA, 22 bp, Homo sapiens
attgctaggaacaggttgcacc

SEQ ID NO: 16928 - DNA, 21 bp, Homo sapiens
caatggcgagatcttggctca

SEQ ID NO: 16929 - DNA, 22 bp, Homo sapiens
cagagctggtgtgtcctggcat

SEQ ID NO: 16930 - DNA, 22 bp, Homo sapiens
aaagcagaggttgcagtgagct

SEQ ID NO: 16931 - DNA, 22 bp, Homo sapiens
agaggctgcacttgctcatgat

SEQ ID NO: 16932 - DNA, 22 bp, Homo sapiens
gccatcatatcccctgtgacct

SEQ ID NO: 16933 - DNA, 22 bp, Homo sapiens
ggcagagcttgcagtgagccga

SEQ ID NO: 16934 - DNA, 22 bp, Homo sapiens
tcctcagaatcacctggcagct

SEQ ID NO: 16935 - DNA, 22 bp, Homo sapiens
caggcaggtcagtgaagaagga

SEQ ID NO: 16936 - DNA, 22 bp, Homo sapiens
tgaggcaggaggattgcaggat

SEQ ID NO: 16937 - DNA, 22 bp, Homo sapiens
tgaactcgggaggaggctgcag

SEQ ID NO: 16938 - DNA, 22 bp, Homo sapiens
tgacctattagatttccttgcc

SEQ ID NO: 16939 - DNA, 22 bp, Homo sapiens
gtgcatgtcggggtgcatgtca

SEQ ID NO: 16940 - DNA, 22 bp, Homo sapiens
agtgggtgtagtcttcctcctg

SEQ ID NO: 16941 - DNA, 22 bp, Homo sapiens
gtgtatgttctacttaatatta

SEQ ID NO: 16942 - DNA, 22 bp, Homo sapiens
cggggccctggggctgaaggtc

SEQ ID NO: 16943 - DNA, 22 bp, Homo sapiens
ttacctaaaatagctcaattta

SEQ ID NO: 16944 - DNA, 22 bp, Homo sapiens
aagtgctgggattacaggtgtc

SEQ ID NO: 16945 - DNA, 22 bp, Homo sapiens
taatggattaacgtccctgtcg

SEQ ID NO: 16946 - DNA, 22 bp, Homo sapiens
atagacgcggccgctgatgcag

SEQ ID NO: 16947 - DNA, 22 bp, Homo sapiens
tgagatgtaaggtatgcttact

SEQ ID NO: 16948 - DNA, 22 bp, Homo sapiens
gccttgatctgctgtgtttgag

SEQ ID NO: 16949 - DNA, 22 bp, Homo sapiens
ttggagatatcacaccttcaca

SEQ ID NO: 16950 - DNA, 22 bp, Homo sapiens
tcccagctactctagaggctga

SEQ ID NO: 16951 - DNA, 22 bp, Homo sapiens
ggcttggaccagtcacagtggt

SEQ ID NO: 16952 - DNA, 22 bp, Homo sapiens
gctggaggatggactggaagaa

SEQ ID NO: 16953 - DNA, 22 bp, Homo sapiens
tgggatgccggcaggaggcaat

SEQ ID NO: 16954 - DNA, 22 bp, Homo sapiens
aaagcagaactgagagagctgg

SEQ ID NO: 16955 - DNA, 22 bp, Homo sapiens
tcatcagaggcatctggcaagg

SEQ ID NO: 16956 - DNA, 21 bp, Homo sapiens
aggcaccacatctccctcccc

SEQ ID NO: 16957 - DNA, 22 bp, Homo sapiens
agagcgcactgtctgcaggcaa

SEQ ID NO: 16958 - DNA, 22 bp, Homo sapiens
ccccaggacgtggccctcatag

SEQ ID NO: 16959 - DNA, 22 bp, Homo sapiens
attataggcttgagccaccgtg

SEQ ID NO: 16960 - DNA, 22 bp, Homo sapiens
gggagaggttacccgagcaact

SEQ ID NO: 16961 - DNA, 22 bp, Homo sapiens
ctgtggctctcagaggctgctg

SEQ ID NO: 16962 - DNA, 22 bp, Homo sapiens
agatgcttactatggttgtatg

SEQ ID NO: 16963 - DNA, 22 bp, Homo sapiens
gtggatggagctggaagccatt

SEQ ID NO: 16964 - DNA, 22 bp, Homo sapiens
gcaggcagaggtggaggagaca

SEQ ID NO: 16965 - DNA, 22 bp, Homo sapiens
ccctggaggttgaggctgcagt

SEQ ID NO: 16966 - DNA, 22 bp, Homo sapiens
gggctgcatcagcaggacccgg

SEQ ID NO: 16967 - DNA, 22 bp, Homo sapiens
tagcccctgcctttgaacctgg

SEQ ID NO: 16968 - DNA, 22 bp, Homo sapiens
gagggagggactagcattctct

SEQ ID NO: 16969 - DNA, 22 bp, Homo sapiens
ttgcccaggctggagtgcagta

SEQ ID NO: 16970 - DNA, 22 bp, Homo sapiens
caggcagaagaagtggaaggac

SEQ ID NO: 16971 - DNA, 22 bp, Homo sapiens
gctaggttggggaagttctcct

SEQ ID NO: 16972 - DNA, 22 bp, Homo sapiens
gaggctgaggcaggaggatcac

SEQ ID NO: 16973 - DNA, 22 bp, Homo sapiens
aggcaatcccctgaggatactt

SEQ ID NO: 16974 - DNA, 22 bp, Homo sapiens
agttgggtttgtgtcagttgca

SEQ ID NO: 16975 - DNA, 22 bp, Homo sapiens
ggggtgggcgtgcagggacacc

SEQ ID NO: 16976 - DNA, 22 bp, Homo sapiens
ccctggctgcgtgatggatgaa

SEQ ID NO: 16977 - DNA, 20 bp, Homo sapiens
cagcagtggatgagagtttt

SEQ ID NO: 16978 - DNA, 22 bp, Homo sapiens
gagaaagctaaataagttgatt

SEQ ID NO: 16979 - DNA, 18 bp, Homo sapiens
atggtctcatactgggag

SEQ ID NO: 16980 - DNA, 22 bp, Homo sapiens
ccaggcagcctgctccattctg

SEQ ID NO: 16981 - DNA, 22 bp, Homo sapiens
ggatgttctggggttctcttgt

SEQ ID NO: 16982 - DNA, 22 bp, Homo sapiens
tccttgtaaaggagctctaaca

SEQ ID NO: 16983 - DNA, 23 bp, Homo sapiens
tgacctcatgatccgcccacctc

SEQ ID NO: 16984 - DNA, 22 bp, Homo sapiens
gccggggctggggagagacatg

SEQ ID NO: 16985 - DNA, 22 bp, Homo sapiens
tgaggctccttgtagagagtgg

SEQ ID NO: 16986 - DNA, 21 bp, Homo sapiens
cagagctgtccaaaccctgac

SEQ ID NO: 16987 - DNA, 22 bp, Homo sapiens
cccaggaggcagagatagcagt

SEQ ID NO: 16988 - DNA, 21 bp, Homo sapiens
ctacttaagtaggggattagg

SEQ ID NO: 16989 - DNA, 22 bp, Homo sapiens
ggcatcttgttgctcaaatcta

SEQ ID NO: 16990 - DNA, 22 bp, Homo sapiens
ttgaggtcttcaggatcaggct

SEQ ID NO: 16991 - DNA, 19 bp, Homo sapiens
agtcctggcctgggggacc

SEQ ID NO: 16992 - DNA, 22 bp, Homo sapiens
tctctcaggctggagtgcagtg

SEQ ID NO: 16993 - DNA, 22 bp, Homo sapiens
ttcttcagcctaccttgacctc

SEQ ID NO: 16994 - DNA, 22 bp, Homo sapiens
ctccagttggccccagttggtt

SEQ ID NO: 16995 - DNA, 22 bp, Homo sapiens
tgggactcactcttttggccag

SEQ ID NO: 16996 - DNA, 22 bp, Homo sapiens
gtagtcccagctaccccggagg

SEQ ID NO: 16997 - DNA, 22 bp, Homo sapiens
gctgcagggagctggaaggctc

SEQ ID NO: 16998 - DNA, 17 bp, Homo sapiens
gacctcaggtgatctgc

SEQ ID NO: 16999 - DNA, 22 bp, Homo sapiens
actgttgaagtgccagcttgat

SEQ ID NO: 17000 - DNA, 22 bp, Homo sapiens
ggggcccctcggacacgtgcgg

SEQ ID NO: 17001 - DNA, 22 bp, Homo sapiens
gcaggcggaggttgcagtgagc

SEQ ID NO: 17002 - DNA, 22 bp, Homo sapiens
ctggtaggggtgactgttatcg

SEQ ID NO: 17003 - DNA, 22 bp, Homo sapiens
aagcagagaatctgggagcgag

SEQ ID NO: 17004 - DNA, 22 bp, Homo sapiens
ttgcccaggctggagtgcagtg

SEQ ID NO: 17005 - DNA, 22 bp, Homo sapiens
agttattactctttaacatatt

SEQ ID NO: 17006 - DNA, 22 bp, Homo sapiens
agggaagaaaatccatcgctgc

SEQ ID NO: 17007 - DNA, 22 bp, Homo sapiens
aggcaggaggatcatggatgca

SEQ ID NO: 17008 - DNA, 22 bp, Homo sapiens
tctaatcctatggtggggaggg

SEQ ID NO: 17009 - DNA, 22 bp, Homo sapiens
tcgaactcatagtcgtagctgt

SEQ ID NO: 17010 - DNA, 22 bp, Homo sapiens
ccaggctggagtgcaatggcgt

SEQ ID NO: 17011 - DNA, 22 bp, Homo sapiens
cgggcgcactccgggcagctgt

SEQ ID NO: 17012 - DNA, 22 bp, Homo sapiens
tgtctgcctgcgggccggcaca

SEQ ID NO: 17013 - DNA, 22 bp, Homo sapiens
tactgcgccttcaccaagcggc

SEQ ID NO: 17014 - DNA, 22 bp, Homo sapiens
attggtagttttgtatttctct

SEQ ID NO: 17015 - DNA, 22 bp, Homo sapiens
caggcagggagctggaaaggat

SEQ ID NO: 17016 - DNA, 22 bp, Homo sapiens
gaggcagaggttgcagtgagct

SEQ ID NO: 17017 - DNA, 22 bp, Homo sapiens
tcacagagatgaacttttgata

SEQ ID NO: 17018 - DNA, 22 bp, Homo sapiens
ctccagattccgtttattcagg

SEQ ID NO: 17019 - DNA, 22 bp, Homo sapiens
gggcagagagctggaactcctt

SEQ ID NO: 17020 - DNA, 22 bp, Homo sapiens
atatatttgagaatattcatga

SEQ ID NO: 17021 - DNA, 22 bp, Homo sapiens
ctggcaagaaatatatatctta

SEQ ID NO: 17022 - DNA, 22 bp, Homo sapiens
ggcaggaggtgagtggcgggtg

SEQ ID NO: 17023 - DNA, 22 bp, Homo sapiens
cctgcacatgtgtgcgcctgta

SEQ ID NO: 17024 - DNA, 22 bp, Homo sapiens
agcccaggctggagtgcagtgg

SEQ ID NO: 17025 - DNA, 22 bp, Homo sapiens
gaggcagaagttgcagtgagca

SEQ ID NO: 17026 - DNA, 22 bp, Homo sapiens
ttgagcaggatggctatgcaca

SEQ ID NO: 17027 - DNA, 22 bp, Homo sapiens
ggcaagaacctcaattaccttt

SEQ ID NO: 17028 - DNA, 22 bp, Homo sapiens
cttagatgaagtcacagaaccc

SEQ ID NO: 17029 - DNA, 22 bp, Homo sapiens
agatcacagtggcaactccctt

SEQ ID NO: 17030 - DNA, 22 bp, Homo sapiens
tttcctcttctggcaggcaggg

SEQ ID NO: 17031 - DNA, 19 bp, Homo sapiens
gggcttggggctgaagcct

SEQ ID NO: 17032 - DNA, 22 bp, Homo sapiens
tcacttcccagacggggtggca

SEQ ID NO: 17033 - DNA, 22 bp, Homo sapiens
ggatgttgattgaatggccatt

SEQ ID NO: 17034 - DNA, 22 bp, Homo sapiens
gccgggttcaagccattctcct

SEQ ID NO: 17035 - DNA, 22 bp, Homo sapiens
gcccagcccagaaaggttcgga

SEQ ID NO: 17036 - DNA, 23 bp, Homo sapiens
ggttccaggaacacagcctgatg

SEQ ID NO: 17037 - DNA, 22 bp, Homo sapiens
gctggtagacctcactgcactc

SEQ ID NO: 17038 - DNA, 21 bp, Homo sapiens
agaaggcaaaagcagacatct

SEQ ID NO: 17039 - DNA, 22 bp, Homo sapiens
gcgttggggaccccgaagctgg

SEQ ID NO: 17040 - DNA, 22 bp, Homo sapiens
ggtcgctgtgtaggttcagcta

SEQ ID NO: 17041 - DNA, 22 bp, Homo sapiens
taagaaatttagttatagaatg

SEQ ID NO: 17042 - DNA, 22 bp, Homo sapiens
ctgccgttgtgaagctcttaga

SEQ ID NO: 17043 - DNA, 22 bp, Homo sapiens
ttaataaagtatgaattggaaa

SEQ ID NO: 17044 - DNA, 22 bp, Homo sapiens
accagaagctggagcacaagga

SEQ ID NO: 17045 - DNA, 22 bp, Homo sapiens
agggactatttacccatctcac

SEQ ID NO: 17046 - DNA, 22 bp, Homo sapiens
gccatgactctccataccaaag

SEQ ID NO: 17047 - DNA, 22 bp, Homo sapiens
attggccatttgcatgtattat

SEQ ID NO: 17048 - DNA, 19 bp, Homo sapiens
ttctctgctacattctcag

SEQ ID NO: 17049 - DNA, 22 bp, Homo sapiens
aaggctgaggcagtgaggcaga

SEQ ID NO: 17050 - DNA, 22 bp, Homo sapiens
tcagtgttaatcagtggtacct

SEQ ID NO: 17051 - DNA, 22 bp, Homo sapiens
cccagttgttgccggctctgga

SEQ ID NO: 17052 - DNA, 22 bp, Homo sapiens
tgcagattcaaatgaaatgcaa

SEQ ID NO: 17053 - DNA, 22 bp, Homo sapiens
gaggcggaggttgcagtgagcc

SEQ ID NO: 17054 - DNA, 22 bp, Homo sapiens
aactctatttaccctactaaac

SEQ ID NO: 17055 - DNA, 22 bp, Homo sapiens
ccagatgtccctctcaggtttg

SEQ ID NO: 17056 - DNA, 22 bp, Homo sapiens
atgtttttaaatagacttacag

SEQ ID NO: 17057 - DNA, 22 bp, Homo sapiens
gcgtctcaaggcccccaggcca

SEQ ID NO: 17058 - DNA, 22 bp, Homo sapiens
ggcatcgtcctgggcataggga

SEQ ID NO: 17059 - DNA, 22 bp, Homo sapiens
ctcgcatgccctgcctcatcca

SEQ ID NO: 17060 - DNA, 22 bp, Homo sapiens
ctcgcaagtcgctccggttact

SEQ ID NO: 17061 - DNA, 22 bp, Homo sapiens
accatgtcatttattggccaaa

SEQ ID NO: 17062 - DNA, 22 bp, Homo sapiens
ttaaatattatgttgtctgcaa

SEQ ID NO: 17063 - DNA, 22 bp, Homo sapiens
acatgtttaagtttgttatatg

SEQ ID NO: 17064 - DNA, 22 bp, Homo sapiens
ccattgtaaattctgtggaagt

SEQ ID NO: 17065 - DNA, 22 bp, Homo sapiens
actgcacttcaccctgggtgac

SEQ ID NO: 17066 - DNA, 22 bp, Homo sapiens
tggtattacttctagacacaag

SEQ ID NO: 17067 - DNA, 22 bp, Homo sapiens
cagcagcagtggctgcagaaca

SEQ ID NO: 17068 - DNA, 22 bp, Homo sapiens
tccacgctgtgtgaccttgggc

SEQ ID NO: 17069 - DNA, 22 bp, Homo sapiens
cccaccagtacagatggtagat

SEQ ID NO: 17070 - DNA, 20 bp, Homo sapiens
ggcagagggcctgggagaag

SEQ ID NO: 17071 - DNA, 22 bp, Homo sapiens
atgtatgtctaaaacggggagg

SEQ ID NO: 17072 - DNA, 22 bp, Homo sapiens
cgccggcttgaggcaggcggca

SEQ ID NO: 17073 - DNA, 22 bp, Homo sapiens
cgcgctctccttctggcaccca

SEQ ID NO: 17074 - DNA, 22 bp, Homo sapiens
tagatgcttgttcagaaatagg

SEQ ID NO: 17075 - DNA, 22 bp, Homo sapiens
gcgtctgagttgcgggggctca

SEQ ID NO: 17076 - DNA, 19 bp, Homo sapiens
tccagatgatatggattac

SEQ ID NO: 17077 - DNA, 21 bp, Homo sapiens
tagcccttctccacctcgccc

SEQ ID NO: 17078 - DNA, 22 bp, Homo sapiens
acttcttcttcagctgggggat

SEQ ID NO: 17079 - DNA, 22 bp, Homo sapiens
tgagccatgggactccaaggga

SEQ ID NO: 17080 - DNA, 22 bp, Homo sapiens
acatatgcgatcataggatgca

SEQ ID NO: 17081 - DNA, 22 bp, Homo sapiens
tctagttctagatccctgagga

SEQ ID NO: 17082 - DNA, 21 bp, Homo sapiens
tgttttccaccttgaggcaag

SEQ ID NO: 17083 - DNA, 22 bp, Homo sapiens
ctaggtgatccactgctctctt

SEQ ID NO: 17084 - DNA, 20 bp, Homo sapiens
ataaaataactgccacaaga

SEQ ID NO: 17085 - DNA, 23 bp, Homo sapiens
ccactagcacctgttcaacttct

SEQ ID NO: 17086 - DNA, 22 bp, Homo sapiens
tccaactttctcctccggcttg

SEQ ID NO: 17087 - DNA, 22 bp, Homo sapiens
gcgccccatctacagtactttt

SEQ ID NO: 17088 - DNA, 22 bp, Homo sapiens
agttggagtgaacatgagattg

SEQ ID NO: 17089 - DNA, 22 bp, Homo sapiens
gacaggaggcagagctcaggtg

SEQ ID NO: 17090 - DNA, 22 bp, Homo sapiens
tactgtactgcagttctgcaaa

SEQ ID NO: 17091 - DNA, 22 bp, Homo sapiens
tttgatccgttgctggtgagga

SEQ ID NO: 17092 - DNA, 22 bp, Homo sapiens
aggccagcagcatgacggcatc

SEQ ID NO: 17093 - DNA, 22 bp, Homo sapiens
catgatctggtcctactgtggg

SEQ ID NO: 17094 - DNA, 22 bp, Homo sapiens
gagatggagtctttttctgtca

SEQ ID NO: 17095 - DNA, 22 bp, Homo sapiens
caggctgaagtgcagtggtgtg

SEQ ID NO: 17096 - DNA, 18 bp, Homo sapiens
gaggatggaaggagatgc

SEQ ID NO: 17097 - DNA, 22 bp, Homo sapiens
ggaggggatttagtagatgcta

SEQ ID NO: 17098 - DNA, 22 bp, Homo sapiens
gagacgtggcctttgcctgagc

SEQ ID NO: 17099 - DNA, 22 bp, Homo sapiens
gaggcagaggttgcagtgagct

SEQ ID NO: 17100 - DNA, 22 bp, Homo sapiens
gaccttcttgctgtgtcctaac

SEQ ID NO: 17101 - DNA, 22 bp, Homo sapiens
aagccgggcctgagaaatgaca

SEQ ID NO: 17102 - DNA, 18 bp, Homo sapiens
agaggatgcatctaagag

SEQ ID NO: 17103 - DNA, 22 bp, Homo sapiens
actgattgcattcatagggttt

SEQ ID NO: 17104 - DNA, 22 bp, Homo sapiens
gtgttgatgacattttagaaac

SEQ ID NO: 17105 - DNA, 22 bp, Homo sapiens
atgatccaaagccacaggggca

SEQ ID NO: 17106 - DNA, 22 bp, Homo sapiens
caggaagctgtgaaggagacgg

SEQ ID NO: 17107 - DNA, 22 bp, Homo sapiens
cccgtgtgtgcgaggctcccgc

SEQ ID NO: 17108 - DNA, 22 bp, Homo sapiens
ggaggggatttagtagatgcta

SEQ ID NO: 17109 - DNA, 22 bp, Homo sapiens
atacagggacatccagtttttc

SEQ ID NO: 17110 - DNA, 22 bp, Homo sapiens
aggaggaagggaagacaagtaa

SEQ ID NO: 17111 - DNA, 22 bp, Homo sapiens
agaggaagtaatcaggacctgc

SEQ ID NO: 17112 - DNA, 22 bp, Homo sapiens
ggcgccgcactcggtgcagccg

SEQ ID NO: 17113 - DNA, 22 bp, Homo sapiens
cagccagtgtgaccgaggagga

SEQ ID NO: 17114 - DNA, 21 bp, Homo sapiens
tgactgaggcttcttcacaca

SEQ ID NO: 17115 - DNA, 22 bp, Homo sapiens
acctggacacctgctgtcatct

SEQ ID NO: 17116 - DNA, 22 bp, Homo sapiens
tgttgattagtgtttagactta

SEQ ID NO: 17117 - DNA, 22 bp, Homo sapiens
aggaggggttctcgggtgctga

SEQ ID NO: 17118 - DNA, 22 bp, Homo sapiens
agggaaattaatgtgagcaatg

SEQ ID NO: 17119 - DNA, 22 bp, Homo sapiens
aggggatggagctggaaggcag

SEQ ID NO: 17120 - DNA, 22 bp, Homo sapiens
gaggcagaagttgcagtgagca

SEQ ID NO: 17121 - DNA, 22 bp, Homo sapiens
atgccactgcacttcagcttgg

SEQ ID NO: 17122 - DNA, 22 bp, Homo sapiens
ggagaggggaacttgttgcttg

SEQ ID NO: 17123 - DNA, 22 bp, Homo sapiens
ccattgtaaattctgtggaagt

SEQ ID NO: 17124 - DNA, 22 bp, Homo sapiens
ccctgcctacagggttttcttt

SEQ ID NO: 17125 - DNA, 22 bp, Homo sapiens
ctgggaggtggaggttgcattg

SEQ ID NO: 17126 - DNA, 22 bp, Homo sapiens
actgcactccagcctcggggtc

SEQ ID NO: 17127 - DNA, 17 bp, Homo sapiens
cttcccaccatctcctg

SEQ ID NO: 17128 - DNA, 22 bp, Homo sapiens
taagcctgcatgaaccatgaga

SEQ ID NO: 17129 - DNA, 22 bp, Homo sapiens
cccagcgagtttgccggtgaac

SEQ ID NO: 17130 - DNA, 22 bp, Homo sapiens
cctttaggagtgaggaccgagc

SEQ ID NO: 17131 - DNA, 22 bp, Homo sapiens
tggattcacaccattctcctgc

SEQ ID NO: 17132 - DNA, 22 bp, Homo sapiens
tctaatcctatggtggggaggg

SEQ ID NO: 17133 - DNA, 22 bp, Homo sapiens
atgggttcaagtgattctcctg

SEQ ID NO: 17134 - DNA, 22 bp, Homo sapiens
agcacctgtcaagtccaggctg

SEQ ID NO: 17135 - DNA, 22 bp, Homo sapiens
tcgcttgaacccaggaagtgga

SEQ ID NO: 17136 - DNA, 22 bp, Homo sapiens
attgcactccggcctgggtgac

SEQ ID NO: 17137 - DNA, 22 bp, Homo sapiens
tagcccctgcctttgaacctgg

SEQ ID NO: 17138 - DNA, 22 bp, Homo sapiens
tgcactactgtgatacacagcc

SEQ ID NO: 17139 - DNA, 22 bp, Homo sapiens
tagctcaaaggttaagtgtgga

SEQ ID NO: 17140 - DNA, 22 bp, Homo sapiens
gagctcattcattcattgcctg

SEQ ID NO: 17141 - DNA, 22 bp, Homo sapiens
tagtgccctcccctttgggata

SEQ ID NO: 17142 - DNA, 22 bp, Homo sapiens
tgaagactcagaagctaagata

SEQ ID NO: 17143 - DNA, 22 bp, Homo sapiens
aaagaaatagatggcatttaaa

SEQ ID NO: 17144 - DNA, 22 bp, Homo sapiens
tggaatgcagtgggagcttacc

SEQ ID NO: 17145 - DNA, 22 bp, Homo sapiens
gcactgcaggtgggtggagagg

SEQ ID NO: 17146 - DNA, 22 bp, Homo sapiens
cgcaccactgaattccagcctg

SEQ ID NO: 17147 - DNA, 23 bp, Homo sapiens
tcgttgaatagcaatagcacaac

SEQ ID NO: 17148 - DNA, 22 bp, Homo sapiens
ggggccttggatctgtgccccg

SEQ ID NO: 17149 - DNA, 22 bp, Homo sapiens
aagaggttgtctgtgatgagtt

SEQ ID NO: 17150 - DNA, 22 bp, Homo sapiens
aagacttgaccaggttgaaggc

SEQ ID NO: 17151 - DNA, 22 bp, Homo sapiens
gttgagtgggttaggatgctga

SEQ ID NO: 17152 - DNA, 22 bp, Homo sapiens
tgggaagctgcattttaacaag

SEQ ID NO: 17153 - DNA, 22 bp, Homo sapiens
caggaggttgagggtgcagtga

SEQ ID NO: 17154 - DNA, 22 bp, Homo sapiens
ctcttagtaatgccatgaagca

SEQ ID NO: 17155 - DNA, 22 bp, Homo sapiens
actgcactcctgcctgggtaac

SEQ ID NO: 17156 - DNA, 22 bp, Homo sapiens
gtctttcttaaacaacagaaca

SEQ ID NO: 17157 - DNA, 22 bp, Homo sapiens
catctgctgttccttggactca

SEQ ID NO: 17158 - DNA, 22 bp, Homo sapiens
acctgcaggcacaggtgtgcgc

SEQ ID NO: 17159 - DNA, 22 bp, Homo sapiens
gtgcacatcgtgcaggtttgtt

SEQ ID NO: 17160 - DNA, 22 bp, Homo sapiens
tgggaagggtcaacagctggaa

SEQ ID NO: 17161 - DNA, 18 bp, Homo sapiens
cagcctctgattggttgc

SEQ ID NO: 17162 - DNA, 22 bp, Homo sapiens
ctgtggctctcagaggctgctg

SEQ ID NO: 17163 - DNA, 22 bp, Homo sapiens
cagtgcccgccgccgttcctgg

SEQ ID NO: 17164 - DNA, 22 bp, Homo sapiens
gctgctctccaagcctccttga

SEQ ID NO: 17165 - DNA, 22 bp, Homo sapiens
ctgccaggattctgtgaacccc

SEQ ID NO: 17166 - DNA, 22 bp, Homo sapiens
tgatattttatgagctttcata

SEQ ID NO: 17167 - DNA, 18 bp, Homo sapiens
ccgggctttggtgacaca

SEQ ID NO: 17168 - DNA, 22 bp, Homo sapiens
ttgcactccagcccgagcaaca

SEQ ID NO: 17169 - DNA, 23 bp, Homo sapiens
actgattcttgaagttgacaagt

SEQ ID NO: 17170 - DNA, 22 bp, Homo sapiens
ctcgggtaccatgctaggcact

SEQ ID NO: 17171 - DNA, 22 bp, Homo sapiens
cactgcactccatcctgggaaa

SEQ ID NO: 17172 - DNA, 22 bp, Homo sapiens
tagattcagatatttaggacaa

SEQ ID NO: 17173 - DNA, 21 bp, Homo sapiens
cactccacttagaacagggtt

SEQ ID NO: 17174 - DNA, 22 bp, Homo sapiens
gagatggagtctttttctgtca

SEQ ID NO: 17175 - DNA, 22 bp, Homo sapiens
tcctccccaaagcccagcctgg

SEQ ID NO: 17176 - DNA, 22 bp, Homo sapiens
actgcacttcaccctgggtgac

SEQ ID NO: 17177 - DNA, 22 bp, Homo sapiens
cagagagaatcttggcagctga

SEQ ID NO: 17178 - DNA, 20 bp, Homo sapiens
gaaatgtacacattaccaca

SEQ ID NO: 17179 - DNA, 21 bp, Homo sapiens
tagcccttctccacctcgccc

SEQ ID NO: 17180 - DNA, 19 bp, Homo sapiens
gcctcatttccacctcccc

SEQ ID NO: 17181 - DNA, 22 bp, Homo sapiens
tccggactcacctgacaatggc

SEQ ID NO: 17182 - DNA, 22 bp, Homo sapiens
acccgggaggcaggagtcatag

SEQ ID NO: 17183 - DNA, 22 bp, Homo sapiens
tctcctggagcccagatgctgg

SEQ ID NO: 17184 - DNA, 21 bp, Homo sapiens
cgtgactgggtccgtctggct

SEQ ID NO: 17185 - DNA, 22 bp, Homo sapiens
gtaggtcagacataagaggaca

SEQ ID NO: 17186 - DNA, 22 bp, Homo sapiens
ggcatagatttctttaggttta

SEQ ID NO: 17187 - DNA, 22 bp, Homo sapiens
attgcactccagcctgggtgac

SEQ ID NO: 17188 - DNA, 21 bp, Homo sapiens
atctcgggcttctcgcccagc

SEQ ID NO: 17189 - DNA, 22 bp, Homo sapiens
gggaagagggagctggaatgat

SEQ ID NO: 17190 - DNA, 22 bp, Homo sapiens
ctggcaagaaatatatatctta

SEQ ID NO: 17191 - DNA, 18 bp, Homo sapiens
tgtccctgcaaataacat

SEQ ID NO: 17192 - DNA, 22 bp, Homo sapiens
ggttccccaggcggcccttgga

SEQ ID NO: 17193 - DNA, 22 bp, Homo sapiens
ggcgctcagtgttgccccagag

SEQ ID NO: 17194 - DNA, 22 bp, Homo sapiens
gagatcggtaaagagcatgcac

SEQ ID NO: 17195 - DNA, 22 bp, Homo sapiens
agtcttagaactacagtgccta

SEQ ID NO: 17196 - DNA, 22 bp, Homo sapiens
atttcccagggcctgggatttg

SEQ ID NO: 17197 - DNA, 18 bp, Homo sapiens
tcctttctccctcatctt

SEQ ID NO: 17198 - DNA, 22 bp, Homo sapiens
acccacgaagatgagcggcatg

SEQ ID NO: 17199 - DNA, 22 bp, Homo sapiens
agccaggatggtctcgatcggc

SEQ ID NO: 17200 - DNA, 22 bp, Homo sapiens
gtgctgacaggagcctggcggt

SEQ ID NO: 17201 - DNA, 22 bp, Homo sapiens
cactgcactccagcctgggaga

SEQ ID NO: 17202 - DNA, 22 bp, Homo sapiens
gctcttgtcaaaaattagttga

SEQ ID NO: 17203 - DNA, 22 bp, Homo sapiens
atttgtgggactataatgcagg

SEQ ID NO: 17204 - DNA, 22 bp, Homo sapiens
aacccgggaggcagaggttgtg

SEQ ID NO: 17205 - DNA, 22 bp, Homo sapiens
ggggtactggctggagccccac

SEQ ID NO: 17206 - DNA, 22 bp, Homo sapiens
gtagatgagctcacatgacctt

SEQ ID NO: 17207 - DNA, 21 bp, Homo sapiens
ttagaagctaatgcagctggt

SEQ ID NO: 17208 - DNA, 22 bp, Homo sapiens
tcccctttgtcttcctgtgggt

SEQ ID NO: 17209 - DNA, 22 bp, Homo sapiens
gcgctgaggctggaggcgcacg

SEQ ID NO: 17210 - DNA, 22 bp, Homo sapiens
tgacttgtctctttgggagaca

SEQ ID NO: 17211 - DNA, 21 bp, Homo sapiens
tgtaagtttcatctgaattgg

SEQ ID NO: 17212 - DNA, 21 bp, Homo sapiens
tgcaatccagcctgggcgaca

SEQ ID NO: 17213 - DNA, 22 bp, Homo sapiens
gatgaatgatggcttgtttctg

SEQ ID NO: 17214 - DNA, 22 bp, Homo sapiens
actgcactccagcctgggtaac

SEQ ID NO: 17215 - DNA, 22 bp, Homo sapiens
actgcactccaacctgggtgac

SEQ ID NO: 17216 - DNA, 22 bp, Homo sapiens
ataaaaactgacccatcctttg

SEQ ID NO: 17217 - DNA, 22 bp, Homo sapiens
gcaaaagtacagccggatttct

SEQ ID NO: 17218 - DNA, 22 bp, Homo sapiens
gggaagatagtgttgagggccc

SEQ ID NO: 17219 - DNA, 22 bp, Homo sapiens
ttttcatttttgtagatgcaag

SEQ ID NO: 17220 - DNA, 20 bp, Homo sapiens
aaaatatgtataactcttct

SEQ ID NO: 17221 - DNA, 22 bp, Homo sapiens
ctgggaggcagaggttgcagtg

SEQ ID NO: 17222 - DNA, 22 bp, Homo sapiens
cactgcactccagcctgggtca

SEQ ID NO: 17223 - DNA, 22 bp, Homo sapiens
gcctgcagggcctgggcctacc

SEQ ID NO: 17224 - DNA, 22 bp, Homo sapiens
gctgcagggagctggaaggctc

SEQ ID NO: 17225 - DNA, 22 bp, Homo sapiens
aactcactttgtggcttctgaa

SEQ ID NO: 17226 - DNA, 22 bp, Homo sapiens
acttcttcttcagctgggggat

SEQ ID NO: 17227 - DNA, 22 bp, Homo sapiens
tagtcccggaactccttcaggt

SEQ ID NO: 17228 - DNA, 22 bp, Homo sapiens
cacagcctcctctggctcacgg

SEQ ID NO: 17229 - DNA, 22 bp, Homo sapiens
gtagtcccagctaccccggagg

SEQ ID NO: 17230 - DNA, 22 bp, Homo sapiens
tcgcaccattgcactccagcca

SEQ ID NO: 17231 - DNA, 22 bp, Homo sapiens
agactgttgtgtgaagtagggt

SEQ ID NO: 17232 - DNA, 22 bp, Homo sapiens
ggctccaccctgcttccagaag

SEQ ID NO: 17233 - DNA, 22 bp, Homo sapiens
attgcactccagcctgggggac

SEQ ID NO: 17234 - DNA, 22 bp, Homo sapiens
gtcactgtatccaggttccagc

SEQ ID NO: 17235 - DNA, 22 bp, Homo sapiens
attgcacttcagcctgggtgac

SEQ ID NO: 17236 - DNA, 22 bp, Homo sapiens
agtgggtgtagtcttcctcctg

SEQ ID NO: 17237 - DNA, 22 bp, Homo sapiens
aggttatcatcagttgagcact

SEQ ID NO: 17238 - DNA, 22 bp, Homo sapiens
agcctgggcaacagagcaaaac

SEQ ID NO: 17239 - DNA, 22 bp, Homo sapiens
accctcaacaaattcactctat

SEQ ID NO: 17240 - DNA, 22 bp, Homo sapiens
aaaatcttgtgacttaggaagg

SEQ ID NO: 17241 - DNA, 22 bp, Homo sapiens
tcattgccatggcatttgcaga

SEQ ID NO: 17242 - DNA, 22 bp, Homo sapiens
tccgggagctgaacgtcttgcg

SEQ ID NO: 17243 - DNA, 22 bp, Homo sapiens
ggctcctgggggtgctcctgcc

SEQ ID NO: 17244 - DNA, 22 bp, Homo sapiens
gagcctggagctggaacgaagc

SEQ ID NO: 17245 - DNA, 22 bp, Homo sapiens
ccaggggttggaggttgcagtg

SEQ ID NO: 17246 - DNA, 19 bp, Homo sapiens
ccagagagctaggtacaga

SEQ ID NO: 17247 - DNA, 22 bp, Homo sapiens
ccagaggtgctctttggaagtg

SEQ ID NO: 17248 - DNA, 22 bp, Homo sapiens
tgctcgccccacatgccctcat

SEQ ID NO: 17249 - DNA, 22 bp, Homo sapiens
tggtagtcggcctcggtggctc

SEQ ID NO: 17250 - DNA, 22 bp, Homo sapiens
tgcactccaggctgggtgacag

SEQ ID NO: 17251 - DNA, 22 bp, Homo sapiens
ccttttgctctcccatccagaa

SEQ ID NO: 17252 - DNA, 22 bp, Homo sapiens
atctgggagcggaggttgcagt

SEQ ID NO: 17253 - DNA, 22 bp, Homo sapiens
actgcacttcagcctgggtgtc

SEQ ID NO: 17254 - DNA, 22 bp, Homo sapiens
caccctcaagcagtggcacgtg

SEQ ID NO: 17255 - DNA, 22 bp, Homo sapiens
tctgtggcccaagtgatggctg

SEQ ID NO: 17256 - DNA, 22 bp, Homo sapiens
atagagtgatgtaaggtatgtg

SEQ ID NO: 17257 - DNA, 22 bp, Homo sapiens
tccttaggcaatttgggagagt

SEQ ID NO: 17258 - DNA, 22 bp, Homo sapiens
aacccgggaggcggaggttgtg

SEQ ID NO: 17259 - DNA, 22 bp, Homo sapiens
ctgtaatcccagctactcggga

SEQ ID NO: 17260 - DNA, 22 bp, Homo sapiens
ttacctaaaatagctcaattta

SEQ ID NO: 17261 - DNA, 22 bp, Homo sapiens
gggtccctggaattacttgaca

SEQ ID NO: 17262 - DNA, 22 bp, Homo sapiens
ctgggaggcggaggttgcagtg

SEQ ID NO: 17263 - DNA, 22 bp, Homo sapiens
cactgcactccagcttgggtga

SEQ ID NO: 17264 - DNA, 22 bp, Homo sapiens
aggcaatcccctgaggatactt

SEQ ID NO: 17265 - DNA, 22 bp, Homo sapiens
gttcaagaccagcctggccaac

SEQ ID NO: 17266 - DNA, 22 bp, Homo sapiens
actgcactccagcctgggtgac

SEQ ID NO: 17267 - DNA, 22 bp, Homo sapiens
ggtgagaaagggattcctgttc

SEQ ID NO: 17268 - DNA, 22 bp, Homo sapiens
agtacccttttcactgtcacaa

SEQ ID NO: 17269 - DNA, 22 bp, Homo sapiens
ccctttagcccctgcagagact

SEQ ID NO: 17270 - DNA, 22 bp, Homo sapiens
ccctgccttgtctgggctaggt

SEQ ID NO: 17271 - DNA, 22 bp, Homo sapiens
agtgaaaacctaatcatgcagt

SEQ ID NO: 17272 - DNA, 22 bp, Homo sapiens
actgcactccagcctgggtgat

SEQ ID NO: 17273 - DNA, 22 bp, Homo sapiens
ctgtggctctttagttgagcac

SEQ ID NO: 17274 - DNA, 22 bp, Homo sapiens
aataaaatggtcagttttctca

SEQ ID NO: 17275 - DNA, 22 bp, Homo sapiens
aggggaccaaaatgtcctgcct

SEQ ID NO: 17276 - DNA, 22 bp, Homo sapiens
aaaatatgtataactcttctgc

SEQ ID NO: 17277 - DNA, 22 bp, Homo sapiens
cctcccctcagacagagactgg

SEQ ID NO: 17278 - DNA, 22 bp, Homo sapiens
attaggtcatggggaggcccta

SEQ ID NO: 17279 - DNA, 22 bp, Homo sapiens
tgtgtgattgcaggagatgtgg

SEQ ID NO: 17280 - DNA, 22 bp, Homo sapiens
ctccttctgggcctggcagtgg

SEQ ID NO: 17281 - DNA, 22 bp, Homo sapiens
acatatgcgatcataggatgca

SEQ ID NO: 17282 - DNA, 22 bp, Homo sapiens
gggaggttgaggctgcagtgag

SEQ ID NO: 17283 - DNA, 22 bp, Homo sapiens
cactgcacttcagcctgggtga

SEQ ID NO: 17284 - DNA, 22 bp, Homo sapiens
ctccagttggccccagttggtt

SEQ ID NO: 17285 - DNA, 22 bp, Homo sapiens
cactgcactccagcctgggtga

SEQ ID NO: 17286 - DNA, 22 bp, Homo sapiens
tgttgcccaggttctctcctgc

SEQ ID NO: 17287 - DNA, 22 bp, Homo sapiens
gctgacccctacaggttgtgtt

SEQ ID NO: 17288 - DNA, 22 bp, Homo sapiens
tgtctcttttcaagctaccctt

SEQ ID NO: 17289 - DNA, 22 bp, Homo sapiens
cttgtcagccaattgtggattt

SEQ ID NO: 17290 - DNA, 22 bp, Homo sapiens
agagtactgcctcagttatgaa

SEQ ID NO: 17291 - DNA, 22 bp, Homo sapiens
gtagctctgtttaaagttcttt

SEQ ID NO: 17292 - DNA, 22 bp, Homo sapiens
acccagggctcaagcgtaggca

SEQ ID NO: 17293 - DNA, 22 bp, Homo sapiens
tttaatgtagcgtgaaatgatt

SEQ ID NO: 17294 - DNA, 22 bp, Homo sapiens
gccctgccctctcggcactcgc

SEQ ID NO: 17295 - DNA, 22 bp, Homo sapiens
accatgttggccaagctggtct

SEQ ID NO: 17296 - DNA, 22 bp, Homo sapiens
tatccaattcaccattgatggg

SEQ ID NO: 17297 - DNA, 22 bp, Homo sapiens
tgtatattctgcctaaaagctt

SEQ ID NO: 17298 - DNA, 18 bp, Homo sapiens
actctttctgcccacagg

SEQ ID NO: 17299 - DNA, 22 bp, Homo sapiens
ccacgacgagtcatcagggcga

SEQ ID NO: 17300 - DNA, 22 bp, Homo sapiens
acaggggaatttactgtcatta

SEQ ID NO: 17301 - DNA, 22 bp, Homo sapiens
cactgttttacatgttatttaa

SEQ ID NO: 17302 - DNA, 22 bp, Homo sapiens
atatattttttgagacagagtc

SEQ ID NO: 17303 - DNA, 22 bp, Homo sapiens
ccggctactcgggaggctgacg

SEQ ID NO: 17304 - DNA, 22 bp, Homo sapiens
cccacgtcgaacttgctccaga

SEQ ID NO: 17305 - DNA, 22 bp, Homo sapiens
ctgtggctcaggcctgtaagcc

SEQ ID NO: 17306 - DNA, 22 bp, Homo sapiens
ccttctcagccccagctcccgc

SEQ ID NO: 17307 - DNA, 22 bp, Homo sapiens
aaagttctctatggtgtaaaaa

SEQ ID NO: 17308 - DNA, 22 bp, Homo sapiens
gagacctcttggtatcgctagg

SEQ ID NO: 17309 - DNA, 22 bp, Homo sapiens
agggaagaggaccagagtctct

SEQ ID NO: 17310 - DNA, 22 bp, Homo sapiens
gctgctctcagagctcatgctg

SEQ ID NO: 17311 - DNA, 22 bp, Homo sapiens
ggtagtcggccttgccctgggc

SEQ ID NO: 17312 - DNA, 22 bp, Homo sapiens
atcttggggaatcctctgtgta

SEQ ID NO: 17313 - DNA, 22 bp, Homo sapiens
tccgaggccaaagctgtgaata

SEQ ID NO: 17314 - DNA, 22 bp, Homo sapiens
actgcacttcagcctgggtgac

SEQ ID NO: 17315 - DNA, 22 bp, Homo sapiens
ataggtccaaggagaggtcttt

SEQ ID NO: 17316 - DNA, 22 bp, Homo sapiens
tcctgggaggcggaggttgcag

SEQ ID NO: 17317 - DNA, 22 bp, Homo sapiens
tctaatccttgctacctgggtg

SEQ ID NO: 17318 - DNA, 22 bp, Homo sapiens
gggagcttaagacagttccaat

SEQ ID NO: 17319 - DNA, 22 bp, Homo sapiens
gggcagatcacctgaggtcagg

SEQ ID NO: 17320 - DNA, 22 bp, Homo sapiens
gagccaggtcgggccgcggcga

SEQ ID NO: 17321 - DNA, 22 bp, Homo sapiens
ctgaggctggagtgcagtggtg

SEQ ID NO: 17322 - DNA, 22 bp, Homo sapiens
gtgggccttcaaccctgtctgg

SEQ ID NO: 17323 - DNA, 22 bp, Homo sapiens
ggggtggatttcaggcggtgtc

SEQ ID NO: 17324 - DNA, 22 bp, Homo sapiens
tgataaacttagaaagaatgtt

SEQ ID NO: 17325 - DNA, 22 bp, Homo sapiens
tttaggttttttcacgtggcta

SEQ ID NO: 17326 - DNA, 22 bp, Homo sapiens
gggttactgcttcaaaaaatta

SEQ ID NO: 17327 - DNA, 18 bp, Homo sapiens
gaggatggaaggagatgc

SEQ ID NO: 17328 - DNA, 18 bp, Homo sapiens
tcactgggtgtatgtggc

SEQ ID NO: 17329 - DNA, 22 bp, Homo sapiens
accactgcccatggtgaaaact

SEQ ID NO: 17330 - DNA, 22 bp, Homo sapiens
gcaggcaggcttccttgaactg

SEQ ID NO: 17331 - DNA, 22 bp, Homo sapiens
aggcaggaggatcatggatgca

SEQ ID NO: 17332 - DNA, 22 bp, Homo sapiens
tgggaggccgaggcaggtggat

SEQ ID NO: 17333 - DNA, 22 bp, Homo sapiens
ggaggtgggctaaggactctct

SEQ ID NO: 17334 - DNA, 21 bp, Homo sapiens
ctcccagggtgactgttcaac

SEQ ID NO: 17335 - DNA, 22 bp, Homo sapiens
aaaaatcacttttataggcagc

SEQ ID NO: 17336 - DNA, 19 bp, Homo sapiens
ccctcttgcacaaagcaaa

SEQ ID NO: 17337 - DNA, 22 bp, Homo sapiens
actgggcctacccagattggca

SEQ ID NO: 17338 - DNA, 22 bp, Homo sapiens
taagcctgcatgaaccatgaga

SEQ ID NO: 17339 - DNA, 22 bp, Homo sapiens
gtggcctggctggcaccacctc

SEQ ID NO: 17340 - DNA, 22 bp, Homo sapiens
cccacgtcgaacttgctccaga

SEQ ID NO: 17341 - DNA, 23 bp, Homo sapiens
ctggggctttcaaatctgggcag

SEQ ID NO: 17342 - DNA, 22 bp, Homo sapiens
ggaggcagaatagagtgtgggt

SEQ ID NO: 17343 - DNA, 22 bp, Homo sapiens
caggctggagtgcaatgacgcc

SEQ ID NO: 17344 - DNA, 22 bp, Homo sapiens
ctgccctggggggcctccttgc

SEQ ID NO: 17345 - DNA, 22 bp, Homo sapiens
gggccctgggattcagagcaag

SEQ ID NO: 17346 - DNA, 22 bp, Homo sapiens
agaaaatttaaagagacacaca

SEQ ID NO: 17347 - DNA, 22 bp, Homo sapiens
ttttggctctgtctgtatcttt

SEQ ID NO: 17348 - DNA, 22 bp, Homo sapiens
ccaggaggttgaggctgcagtg

SEQ ID NO: 17349 - DNA, 22 bp, Homo sapiens
ttggagttctgggcacagctgc

SEQ ID NO: 17350 - DNA, 22 bp, Homo sapiens
gggagaagaatgtgtcaattgt

SEQ ID NO: 17351 - DNA, 22 bp, Homo sapiens
gaggctggacgtgcatttctac

SEQ ID NO: 17352 - DNA, 22 bp, Homo sapiens
ggaggaggggtgactgaatgct

SEQ ID NO: 17353 - DNA, 22 bp, Homo sapiens
ccaggctggagtgcagtggcac

SEQ ID NO: 17354 - DNA, 22 bp, Homo sapiens
agagagcccgggccagggcaca

SEQ ID NO: 17355 - DNA, 22 bp, Homo sapiens
gaaagacatagttgcaagatgg

SEQ ID NO: 17356 - DNA, 22 bp, Homo sapiens
tgttcttgagcctttagaccta

SEQ ID NO: 17357 - DNA, 22 bp, Homo sapiens
gtcttgggacccgcactgtggg

SEQ ID NO: 17358 - DNA, 22 bp, Homo sapiens
aggaatgtgaaacaggtggctg

SEQ ID NO: 17359 - DNA, 22 bp, Homo sapiens
ttgtttaatccttgtacccatg

SEQ ID NO: 17360 - DNA, 22 bp, Homo sapiens
tggctgtgtccctgtccagagt

SEQ ID NO: 17361 - DNA, 22 bp, Homo sapiens
gaagaaagatcaaatagtttcc

SEQ ID NO: 17362 - DNA, 22 bp, Homo sapiens
cctgagtagctggaattaaagg

SEQ ID NO: 17363 - DNA, 22 bp, Homo sapiens
cgtggggcgggtggacacttgc

SEQ ID NO: 17364 - DNA, 22 bp, Homo sapiens
aggacttagaacattatgtact

SEQ ID NO: 17365 - DNA, 22 bp, Homo sapiens
gggaggcacgaggcgcgcagtg

SEQ ID NO: 17366 - DNA, 22 bp, Homo sapiens
gcagggcacaaggacgcacagg

SEQ ID NO: 17367 - DNA, 22 bp, Homo sapiens
gaggcaggaggattgcttgagc

SEQ ID NO: 17368 - DNA, 22 bp, Homo sapiens
cattgcaacttcaaactcctgg

SEQ ID NO: 17369 - DNA, 22 bp, Homo sapiens
aggagggagcttaagccaggca

SEQ ID NO: 17370 - DNA, 22 bp, Homo sapiens
gcctcctggggtgccatcatct

SEQ ID NO: 17371 - DNA, 22 bp, Homo sapiens
gccctgccctctcggcactcgc

SEQ ID NO: 17372 - DNA, 22 bp, Homo sapiens
cctggcctttgaacgctagact

SEQ ID NO: 17373 - DNA, 22 bp, Homo sapiens
tccaagatctacagcagtttag

SEQ ID NO: 17374 - DNA, 22 bp, Homo sapiens
tcacccctccattctctcatgt

SEQ ID NO: 17375 - DNA, 22 bp, Homo sapiens
tagaaaagccccagctggaggg

SEQ ID NO: 17376 - DNA, 22 bp, Homo sapiens
ctttggaacacccagctctgtg

SEQ ID NO: 17377 - DNA, 22 bp, Homo sapiens
gctgggctgcgtcggggaagcc

SEQ ID NO: 17378 - DNA, 22 bp, Homo sapiens
ctgtggctctcagaggctgctg

SEQ ID NO: 17379 - DNA, 22 bp, Homo sapiens
cacagggcttctcatggggtgc

SEQ ID NO: 17380 - DNA, 22 bp, Homo sapiens
agtgcaggccccaggccaggcc

SEQ ID NO: 17381 - DNA, 22 bp, Homo sapiens
tctgctggaaaaccagggaatt

SEQ ID NO: 17382 - DNA, 22 bp, Homo sapiens
acgtgcaggatctggttggcga

SEQ ID NO: 17383 - DNA, 22 bp, Homo sapiens
ggcaaggggtcaggctgagaca

SEQ ID NO: 17384 - DNA, 22 bp, Homo sapiens
ggaggctgagaggtcgcagtgg

SEQ ID NO: 17385 - DNA, 22 bp, Homo sapiens
ttgcttcttagatattcctctc

SEQ ID NO: 17386 - DNA, 22 bp, Homo sapiens
ctttggagaaaagttcttgggc

SEQ ID NO: 17387 - DNA, 22 bp, Homo sapiens
ctgcaccctcaaactcctgggc

SEQ ID NO: 17388 - DNA, 22 bp, Homo sapiens
tcctggtgctgacacccatagc

SEQ ID NO: 17389 - DNA, 22 bp, Homo sapiens
gagccaggggtcagctccgagg

SEQ ID NO: 17390 - DNA, 22 bp, Homo sapiens
cctggcaggtggcgccctcggc

SEQ ID NO: 17391 - DNA, 22 bp, Homo sapiens
gggcatggtggcaggcacctgt

SEQ ID NO: 17392 - DNA, 22 bp, Homo sapiens
actgggcctgattgggtcggag

SEQ ID NO: 17393 - DNA, 22 bp, Homo sapiens
ctcattgcagctgcattactgt

SEQ ID NO: 17394 - DNA, 22 bp, Homo sapiens
tagattcagatatttaggacaa

SEQ ID NO: 17395 - DNA, 22 bp, Homo sapiens
ggagagtggattccagctgtat

SEQ ID NO: 17396 - DNA, 22 bp, Homo sapiens
ctggcagagttgggtctcaaat

SEQ ID NO: 17397 - DNA, 22 bp, Homo sapiens
ctggccagatgttacgtccaat

SEQ ID NO: 17398 - DNA, 22 bp, Homo sapiens
ggggccttggatctgtgccccg

SEQ ID NO: 17399 - DNA, 22 bp, Homo sapiens
ccctctacagggaagcgctttc

SEQ ID NO: 17400 - DNA, 22 bp, Homo sapiens
cccagcaggaggaggttgcagt

SEQ ID NO: 17401 - DNA, 22 bp, Homo sapiens
ggtggcagtagcactgggcctg

SEQ ID NO: 17402 - DNA, 22 bp, Homo sapiens
ttgtgttaaggtgcatctagtg

SEQ ID NO: 17403 - DNA, 22 bp, Homo sapiens
caggctggagtgcagtggcgcc

SEQ ID NO: 17404 - DNA, 22 bp, Homo sapiens
gatgtgtttccaggatttgttt

SEQ ID NO: 17405 - DNA, 22 bp, Homo sapiens
ccaggctggagtgcaatggcgt

SEQ ID NO: 17406 - DNA, 21 bp, Homo sapiens
accactgcctccaaggttcag

SEQ ID NO: 17407 - DNA, 22 bp, Homo sapiens
caggaggattgcttgaggccag

SEQ ID NO: 17408 - DNA, 22 bp, Homo sapiens
tagtcagtgcacagacacttgt

SEQ ID NO: 17409 - DNA, 22 bp, Homo sapiens
ggctgggctccgggagcatgcg

SEQ ID NO: 17410 - DNA, 22 bp, Homo sapiens
tgtgggagaaggaagcaagctg

SEQ ID NO: 17411 - DNA, 21 bp, Homo sapiens
tgttttccaccttgaggcaag

SEQ ID NO: 17412 - DNA, 22 bp, Homo sapiens
gagaaatgcatgcatgtcatca

SEQ ID NO: 17413 - DNA, 22 bp, Homo sapiens
taggctgggaagaaagattctc

SEQ ID NO: 17414 - DNA, 22 bp, Homo sapiens
gagggagggactagcattctct

SEQ ID NO: 17415 - DNA, 22 bp, Homo sapiens
ctgcactgacttccccggctgc

SEQ ID NO: 17416 - DNA, 22 bp, Homo sapiens
gcagggtctgaggccacagagg

SEQ ID NO: 17417 - DNA, 22 bp, Homo sapiens
gggctgggattgcttgctgtga

SEQ ID NO: 17418 - DNA, 22 bp, Homo sapiens
ccagtgtatttttgggacctgc

SEQ ID NO: 17419 - DNA, 22 bp, Homo sapiens
ttgggcctctcaaagtgctggg

SEQ ID NO: 17420 - DNA, 22 bp, Homo sapiens
tgtgaccctctccgatgggcag

SEQ ID NO: 17421 - DNA, 22 bp, Homo sapiens
cctgggaggctgaggctgcagt

SEQ ID NO: 17422 - DNA, 22 bp, Homo sapiens
agaaaatgtgaacttgtgaatt

SEQ ID NO: 17423 - DNA, 22 bp, Homo sapiens
gaggcaggcagattgcttgagg

SEQ ID NO: 17424 - DNA, 22 bp, Homo sapiens
ccactgtgcccagcctcatggg

SEQ ID NO: 17425 - DNA, 21 bp, Homo sapiens
gggcctggctgcgcaggacgg

SEQ ID NO: 17426 - DNA, 22 bp, Homo sapiens
ggaggtggaggttgcagtgagc

SEQ ID NO: 17427 - DNA, 22 bp, Homo sapiens
ggaggcggaggttgcagtgagt

SEQ ID NO: 17428 - DNA, 22 bp, Homo sapiens
ggaggagcatgagagggtagtg

SEQ ID NO: 17429 - DNA, 22 bp, Homo sapiens
agcataagttggtacagccact

SEQ ID NO: 17430 - DNA, 22 bp, Homo sapiens
gaggcagaggttgcagtgagct

SEQ ID NO: 17431 - DNA, 22 bp, Homo sapiens
gctgctgggatcctgggtctca

SEQ ID NO: 17432 - DNA, 22 bp, Homo sapiens
gaagcctcaacatctctgcgtc

SEQ ID NO: 17433 - DNA, 22 bp, Homo sapiens
aactctatttaccctactaaac

SEQ ID NO: 17434 - DNA, 22 bp, Homo sapiens
caggctggagtgcagtggggcg

SEQ ID NO: 17435 - DNA, 22 bp, Homo sapiens
actgcaacctccgcctgccagg

SEQ ID NO: 17436 - DNA, 22 bp, Homo sapiens
caaatactacgattcttgcagt

SEQ ID NO: 17437 - DNA, 22 bp, Homo sapiens
ccagatatcactgccgtgttgt

SEQ ID NO: 17438 - DNA, 22 bp, Homo sapiens
ttgccttgttattctctcagaa

SEQ ID NO: 17439 - DNA, 22 bp, Homo sapiens
caggctggagttcagtggtgtg

SEQ ID NO: 17440 - DNA, 22 bp, Homo sapiens
ctgcggctggggacagctgttg

SEQ ID NO: 17441 - DNA, 22 bp, Homo sapiens
ggcgcacaatgtgcaggtttgt

SEQ ID NO: 17442 - DNA, 22 bp, Homo sapiens
ttgcctgtgtcagcaggtggaa

SEQ ID NO: 17443 - DNA, 19 bp, Homo sapiens
agggaatccggctgaggga

SEQ ID NO: 17444 - DNA, 22 bp, Homo sapiens
agatcacagtggcaactccctt

SEQ ID NO: 17445 - DNA, 22 bp, Homo sapiens
tgtgcctgttcccactttgcct

SEQ ID NO: 17446 - DNA, 23 bp, Homo sapiens
ctcaaccctagtaagggagtagg

SEQ ID NO: 17447 - DNA, 22 bp, Homo sapiens
gaggtgggcggatcacaaggtc

SEQ ID NO: 17448 - DNA, 22 bp, Homo sapiens
gggaggcagtgctggaggctgg

SEQ ID NO: 17449 - DNA, 22 bp, Homo sapiens
tcctgggacaagccgtggaagt

SEQ ID NO: 17450 - DNA, 22 bp, Homo sapiens
ggaggtggagctggaagttcca

SEQ ID NO: 17451 - DNA, 22 bp, Homo sapiens
aagaaatgctgatgttggatgg

SEQ ID NO: 17452 - DNA, 22 bp, Homo sapiens
gaattttattactagtcaactg

SEQ ID NO: 17453 - DNA, 22 bp, Homo sapiens
agcctctctgttagtcactggg

SEQ ID NO: 17454 - DNA, 20 bp, Homo sapiens
ataaaataactgccacaaga

SEQ ID NO: 17455 - DNA, 22 bp, Homo sapiens
ggtgcagaggagccagctgggg

SEQ ID NO: 17456 - DNA, 22 bp, Homo sapiens
ccctgccttgtctgggctaggt

SEQ ID NO: 17457 - DNA, 22 bp, Homo sapiens
gcccttctgctgttaggtagcc

SEQ ID NO: 17458 - DNA, 22 bp, Homo sapiens
ggaggcggaggttgcagtgagc

SEQ ID NO: 17459 - DNA, 22 bp, Homo sapiens
tggtatgtaaattgtaactcaa

SEQ ID NO: 17460 - DNA, 22 bp, Homo sapiens
ctttgcttgacactgtgattgt

SEQ ID NO: 17461 - DNA, 22 bp, Homo sapiens
aagaaatgtgaatattgaatag

SEQ ID NO: 17462 - DNA, 22 bp, Homo sapiens
aggaaataggaccagacaaagc

SEQ ID NO: 17463 - DNA, 22 bp, Homo sapiens
tacaggcatgtagcatggtgat

SEQ ID NO: 17464 - DNA, 22 bp, Homo sapiens
tcctgccttgcctgggacatca

SEQ ID NO: 17465 - DNA, 22 bp, Homo sapiens
taacatttaaatttttcacata

SEQ ID NO: 17466 - DNA, 22 bp, Homo sapiens
ctggggtccttgccatgtgtca

SEQ ID NO: 17467 - DNA, 22 bp, Homo sapiens
ctgtcatggtttgaatgctcgc

SEQ ID NO: 17468 - DNA, 22 bp, Homo sapiens
ttgggctcaggagtttgagacc

SEQ ID NO: 17469 - DNA, 22 bp, Homo sapiens
tcctgtgatattgtttgttata

SEQ ID NO: 17470 - DNA, 22 bp, Homo sapiens
ggctggtgttgagtgcctgtag

SEQ ID NO: 17471 - DNA, 22 bp, Homo sapiens
ggctgggcaggtctgcacaggg

SEQ ID NO: 17472 - DNA, 22 bp, Homo sapiens
cctgggaatcggtgcgttgagg

SEQ ID NO: 17473 - DNA, 22 bp, Homo sapiens
attaagtgactaaagtaatgct

SEQ ID NO: 17474 - DNA, 22 bp, Homo sapiens
gcagcctgggcaacagagtgag

SEQ ID NO: 17475 - DNA, 22 bp, Homo sapiens
ttctcttttcaccagttgctaa

SEQ ID NO: 17476 - DNA, 22 bp, Homo sapiens
tcagcctgctccaagtgctgcc

SEQ ID NO: 17477 - DNA, 22 bp, Homo sapiens
gagcccaggaagtggaggctga

SEQ ID NO: 17478 - DNA, 22 bp, Homo sapiens
tggcctcggcatccagcaagag

SEQ ID NO: 17479 - DNA, 22 bp, Homo sapiens
tcctccccaaagcccagcctgg

SEQ ID NO: 17480 - DNA, 22 bp, Homo sapiens
ctctttggatagaattacaaag

SEQ ID NO: 17481 - DNA, 22 bp, Homo sapiens
ggggccttttctgaatgtggaa

SEQ ID NO: 17482 - DNA, 22 bp, Homo sapiens
agtgtattctgcatgggagact

SEQ ID NO: 17483 - DNA, 22 bp, Homo sapiens
ccctgcctacagggttttcttt

SEQ ID NO: 17484 - DNA, 22 bp, Homo sapiens
tgtagatatagaaaaagactga

SEQ ID NO: 17485 - DNA, 17 bp, Homo sapiens
gggcagggactcctggg

SEQ ID NO: 17486 - DNA, 22 bp, Homo sapiens
tttgaagggcacgacaatagtt

SEQ ID NO: 17487 - DNA, 22 bp, Homo sapiens
cttgtttatctctgtagccctg

SEQ ID NO: 17488 - DNA, 22 bp, Homo sapiens
ttacatgtggtgtgaagaagag

SEQ ID NO: 17489 - DNA, 22 bp, Homo sapiens
cagtgcagccaaggacaggcac

SEQ ID NO: 17490 - DNA, 22 bp, Homo sapiens
gaggtggccaagcgaggaaggg

SEQ ID NO: 17491 - DNA, 22 bp, Homo sapiens
gaggttggggctgcagtgagct

SEQ ID NO: 17492 - DNA, 23 bp, Homo sapiens
agagcaaggaaatgaggtgtgat

SEQ ID NO: 17493 - DNA, 21 bp, Homo sapiens
ctgtggtacagctgggacgga

SEQ ID NO: 17494 - DNA, 22 bp, Homo sapiens
aggagaagccaagttgtgagca

SEQ ID NO: 17495 - DNA, 22 bp, Homo sapiens
gcaggaggttgagccaggactg

SEQ ID NO: 17496 - DNA, 22 bp, Homo sapiens
aagcacaatgaacatcttagat

SEQ ID NO: 17497 - DNA, 22 bp, Homo sapiens
ttccagctaactcacatccctt

SEQ ID NO: 17498 - DNA, 22 bp, Homo sapiens
gtacaaatgcaggtttgttaca

SEQ ID NO: 17499 - DNA, 22 bp, Homo sapiens
tatactctgagaaacgtgtcac

SEQ ID NO: 17500 - DNA, 22 bp, Homo sapiens
tcctgggaggcggaggttgcag

SEQ ID NO: 17501 - DNA, 22 bp, Homo sapiens
gatgtagacacttggaggctta

SEQ ID NO: 17502 - DNA, 19 bp, Homo sapiens
ttttggaaatgtgaacagc

SEQ ID NO: 17503 - DNA, 22 bp, Homo sapiens
ggctgccttccctgagccccgg

SEQ ID NO: 17504 - DNA, 22 bp, Homo sapiens
agaggaagtaatcaggacctgc

SEQ ID NO: 17505 - DNA, 22 bp, Homo sapiens
gaggcgggcagatcacctgagg

SEQ ID NO: 17506 - DNA, 22 bp, Homo sapiens
tgctgggggtagctctgcgtag

SEQ ID NO: 17507 - DNA, 22 bp, Homo sapiens
atgccactgcacttcagcttgg

SEQ ID NO: 17508 - DNA, 22 bp, Homo sapiens
atgacaagagtgttcagggaga

SEQ ID NO: 17509 - DNA, 22 bp, Homo sapiens
gggagtgggtttggcctaggcc

SEQ ID NO: 17510 - DNA, 22 bp, Homo sapiens
attctacatgatagaagggaga

SEQ ID NO: 17511 - DNA, 22 bp, Homo sapiens
aaagaaatagatggcatttaaa

SEQ ID NO: 17512 - DNA, 20 bp, Homo sapiens
aaaatatgtataactcttct

SEQ ID NO: 17513 - DNA, 22 bp, Homo sapiens
caggctggagtgcagtggcgct

SEQ ID NO: 17514 - DNA, 22 bp, Homo sapiens
ttatgatttgccacagattggt

SEQ ID NO: 17515 - DNA, 22 bp, Homo sapiens
gggatcgtcatggaaagtgcta

SEQ ID NO: 17516 - DNA, 22 bp, Homo sapiens
tacaaaaaattgatactgacga

SEQ ID NO: 17517 - DNA, 20 bp, Homo sapiens
gggcagagccagccagtccc

SEQ ID NO: 17518 - DNA, 22 bp, Homo sapiens
agagggtgggcacgtgatggat

SEQ ID NO: 17519 - DNA, 22 bp, Homo sapiens
tgtgaaagatactaggcagagg

SEQ ID NO: 17520 - DNA, 22 bp, Homo sapiens
atccaccctgtggtggctttct

SEQ ID NO: 17521 - DNA, 22 bp, Homo sapiens
ggggaaggaaagttattagcag

SEQ ID NO: 17522 - DNA, 22 bp, Homo sapiens
aagcgccatggttcctgcgcag

SEQ ID NO: 17523 - DNA, 22 bp, Homo sapiens
tacagtgcttggtatctagtaa

SEQ ID NO: 17524 - DNA, 22 bp, Homo sapiens
ggggatggaggcgtgtggtcct

SEQ ID NO: 17525 - DNA, 22 bp, Homo sapiens
gcaaatacatgttgagcaccta

SEQ ID NO: 17526 - DNA, 22 bp, Homo sapiens
taggctgggggtaggaattgag

SEQ ID NO: 17527 - DNA, 20 bp, Homo sapiens
gtctccactgggggttaacc

SEQ ID NO: 17528 - DNA, 22 bp, Homo sapiens
cacattccttacattcatagag

SEQ ID NO: 17529 - DNA, 23 bp, Homo sapiens
tgcatggggctatactgctgttc

SEQ ID NO: 17530 - DNA, 22 bp, Homo sapiens
ctgggaggcggagcttgcagtg

SEQ ID NO: 17531 - DNA, 22 bp, Homo sapiens
gaggcagaggttgttgcagtga

SEQ ID NO: 17532 - DNA, 22 bp, Homo sapiens
agggctggagccacagctggga

SEQ ID NO: 17533 - DNA, 20 bp, Homo sapiens
tcacatcctctcccaacatg

SEQ ID NO: 17534 - DNA, 23 bp, Homo sapiens
tgagctgggcctgcaggggtctc

SEQ ID NO: 17535 - DNA, 22 bp, Homo sapiens
gtaggtcagacataagaggaca

SEQ ID NO: 17536 - DNA, 22 bp, Homo sapiens
tttctcttcactgtgtgcctca

SEQ ID NO: 17537 - DNA, 22 bp, Homo sapiens
gctggcagacttcctctggaac

SEQ ID NO: 17538 - DNA, 22 bp, Homo sapiens
ttatttttaaaagttcacacag

SEQ ID NO: 17539 - DNA, 22 bp, Homo sapiens
cttctcttcctttgtcaactga

SEQ ID NO: 17540 - DNA, 22 bp, Homo sapiens
tcagtgcagggtgggagagaga

SEQ ID NO: 17541 - DNA, 22 bp, Homo sapiens
aggggagagttaatgtgaatgt

SEQ ID NO: 17542 - DNA, 22 bp, Homo sapiens
cactgggcgtgtcctgggtgag

SEQ ID NO: 17543 - DNA, 20 bp, Homo sapiens
tgacctcctgggctcaagcc

SEQ ID NO: 17544 - DNA, 22 bp, Homo sapiens
ggcctctcttgggacagctgtc

SEQ ID NO: 17545 - DNA, 22 bp, Homo sapiens
caagatcttcctcaatagacct

SEQ ID NO: 17546 - DNA, 22 bp, Homo sapiens
ctggctggagtgcaggtgagtg

SEQ ID NO: 17547 - DNA, 22 bp, Homo sapiens
atatgggggggcgtgcagagga

SEQ ID NO: 17548 - DNA, 22 bp, Homo sapiens
tcccgtcttgctgttgtctgcg

SEQ ID NO: 17549 - DNA, 18 bp, Homo sapiens
tcctttctccctcatctt

SEQ ID NO: 17550 - DNA, 22 bp, Homo sapiens
tgccttagtgactaaagcacac

SEQ ID NO: 17551 - DNA, 22 bp, Homo sapiens
cgtgccctgcgcaagtgctgct

SEQ ID NO: 17552 - DNA, 22 bp, Homo sapiens
ttgcccagagtcacccagctca

SEQ ID NO: 17553 - DNA, 22 bp, Homo sapiens
gcaggagaacaaagcaagctgc

SEQ ID NO: 17554 - DNA, 22 bp, Homo sapiens
aagattttcagtgcctaaaaca

SEQ ID NO: 17555 - DNA, 22 bp, Homo sapiens
gtggggtagatctttctcagga

SEQ ID NO: 17556 - DNA, 23 bp, Homo sapiens
aaataggagtatctggatcatga

SEQ ID NO: 17557 - DNA, 22 bp, Homo sapiens
caggctggagtacaattgtgtg

SEQ ID NO: 17558 - DNA, 22 bp, Homo sapiens
cctgctggctctgttgctcggc

SEQ ID NO: 17559 - DNA, 22 bp, Homo sapiens
tgggcaggggccctgcttccgt

SEQ ID NO: 17560 - DNA, 22 bp, Homo sapiens
caaaatgcatctgagaccaggc

SEQ ID NO: 17561 - DNA, 22 bp, Homo sapiens
gcagaggacacaggagggcaag

SEQ ID NO: 17562 - DNA, 22 bp, Homo sapiens
aaagcagaggttgcagtgagct

SEQ ID NO: 17563 - DNA, 22 bp, Homo sapiens
acccatggtctggtggggccct

SEQ ID NO: 17564 - DNA, 22 bp, Homo sapiens
gccaggcgggtctcaaactcct

SEQ ID NO: 17565 - DNA, 22 bp, Homo sapiens
caggcagaagaagtggaaggac

SEQ ID NO: 17566 - DNA, 22 bp, Homo sapiens
gaggagggagctggaagctctt

SEQ ID NO: 17567 - DNA, 22 bp, Homo sapiens
ggcagggagtggagactcccta

SEQ ID NO: 17568 - DNA, 22 bp, Homo sapiens
ggagtgctttgaagccttcatt

SEQ ID NO: 17569 - DNA, 21 bp, Homo sapiens
tgtaagtttcatctgaattgg

SEQ ID NO: 17570 - DNA, 22 bp, Homo sapiens
actttaaaactgatcatcagag

SEQ ID NO: 17571 - DNA, 22 bp, Homo sapiens
cccaggaggtcgaagctgcagt

SEQ ID NO: 17572 - DNA, 20 bp, Homo sapiens
ggcagagggcctgggagaag

SEQ ID NO: 17573 - DNA, 21 bp, Homo sapiens
aggcatgagccctgcatggac

SEQ ID NO: 17574 - DNA, 22 bp, Homo sapiens
atacctgtgtatccacaagcgt

SEQ ID NO: 17575 - DNA, 22 bp, Homo sapiens
gcccatgcactttctgtgatgg

SEQ ID NO: 17576 - DNA, 22 bp, Homo sapiens
aactcagatgtttggctacctt

SEQ ID NO: 17577 - DNA, 22 bp, Homo sapiens
ctgtcctgccagtcctggactc

SEQ ID NO: 17578 - DNA, 22 bp, Homo sapiens
gggcaggggtcagtggccccaa

SEQ ID NO: 17579 - DNA, 22 bp, Homo sapiens
taaggcaggaactggctgtttt

SEQ ID NO: 17580 - DNA, 22 bp, Homo sapiens
cctgccctgctcactgtcggta

SEQ ID NO: 17581 - DNA, 22 bp, Homo sapiens
gcaggtggatcacctgaggtca

SEQ ID NO: 17582 - DNA, 22 bp, Homo sapiens
tcaggctcaggttaggggccaa

SEQ ID NO: 17583 - DNA, 22 bp, Homo sapiens
ctgcactgagcatctaacctta

SEQ ID NO: 17584 - DNA, 22 bp, Homo sapiens
aggcaggaaaatcgcttgaacc

SEQ ID NO: 17585 - DNA, 22 bp, Homo sapiens
agcccaggttgaggctgcagtg

SEQ ID NO: 17586 - DNA, 22 bp, Homo sapiens
cagtgacgtaaactgcatgtgc

SEQ ID NO: 17587 - DNA, 22 bp, Homo sapiens
taggcaagtggaccagaggttt

SEQ ID NO: 17588 - DNA, 22 bp, Homo sapiens
gctcaagccttctgcccacctc

SEQ ID NO: 17589 - DNA, 22 bp, Homo sapiens
aaagcctcccaggttatgagta

SEQ ID NO: 17590 - DNA, 22 bp, Homo sapiens
agtggcctggagccccgcctgg

SEQ ID NO: 17591 - DNA, 19 bp, Homo sapiens
tcctgcctggggccgcctg

SEQ ID NO: 17592 - DNA, 22 bp, Homo sapiens
ggaggcggaggctgcagtgagc

SEQ ID NO: 17593 - DNA, 22 bp, Homo sapiens
ccaggcagcctgctccattctg

SEQ ID NO: 17594 - DNA, 19 bp, Homo sapiens
catggtgaaaccccgtctc

SEQ ID NO: 17595 - DNA, 22 bp, Homo sapiens
gggcagagactcagaaacagaa

SEQ ID NO: 17596 - DNA, 22 bp, Homo sapiens
ggctgggcctctccctcagctg

SEQ ID NO: 17597 - DNA, 20 bp, Homo sapiens
tggcctctgagatgccacgg

SEQ ID NO: 17598 - DNA, 22 bp, Homo sapiens
ctggctgggagcgagctgctca

SEQ ID NO: 17599 - DNA, 22 bp, Homo sapiens
tttggtattgcacactgtcttc

SEQ ID NO: 17600 - DNA, 22 bp, Homo sapiens
ctgcggctctgcgggcagctgg

SEQ ID NO: 17601 - DNA, 22 bp, Homo sapiens
caggctggagtgcagtggtgcc

SEQ ID NO: 17602 - DNA, 22 bp, Homo sapiens
ggtgacctcacctggtcccacc

SEQ ID NO: 17603 - DNA, 22 bp, Homo sapiens
tcttttgtgattcttcagttac

SEQ ID NO: 17604 - DNA, 22 bp, Homo sapiens
aggccaggaatccttgtcccag

SEQ ID NO: 17605 - DNA, 22 bp, Homo sapiens
ggctgcaggttggttggcagct

SEQ ID NO: 17606 - DNA, 22 bp, Homo sapiens
ctggcaggtggaggttgcagtg

SEQ ID NO: 17607 - DNA, 22 bp, Homo sapiens
ctgggcacagcgttgggctctt

SEQ ID NO: 17608 - DNA, 22 bp, Homo sapiens
aggctcagatccttgtgtcctg

SEQ ID NO: 17609 - DNA, 22 bp, Homo sapiens
aaaaaattatcatagttcctga

SEQ ID NO: 17610 - DNA, 22 bp, Homo sapiens
cctgtcatatacatacctcctc

SEQ ID NO: 17611 - DNA, 22 bp, Homo sapiens
actgggccaggtgtgggtgagt

SEQ ID NO: 17612 - DNA, 22 bp, Homo sapiens
ctgaggagaggtggcctgtgtt

SEQ ID NO: 17613 - DNA, 22 bp, Homo sapiens
aggtggggaggagtgtctcttt

SEQ ID NO: 17614 - DNA, 22 bp, Homo sapiens
acaaacagagttgaaaaatagg

SEQ ID NO: 17615 - DNA, 22 bp, Homo sapiens
acaggatcgccctgttgcccag

SEQ ID NO: 17616 - DNA, 22 bp, Homo sapiens
ggagcagggaattacagcgcag

SEQ ID NO: 17617 - DNA, 22 bp, Homo sapiens
gaggtgggtgtatcacaggtca

SEQ ID NO: 17618 - DNA, 23 bp, Homo sapiens
ttgcttagagacctcctcatcag

SEQ ID NO: 17619 - DNA, 22 bp, Homo sapiens
caggaggacatactggctcaca

SEQ ID NO: 17620 - DNA, 18 bp, Homo sapiens
cagggctgtggggtcact

SEQ ID NO: 17621 - DNA, 22 bp, Homo sapiens
acttgtgttaccaaggtttggt

SEQ ID NO: 17622 - DNA, 22 bp, Homo sapiens
tgcctgtggaaaggctggtgct

SEQ ID NO: 17623 - DNA, 18 bp, Homo sapiens
aggtttggtggaaacata

SEQ ID NO: 17624 - DNA, 22 bp, Homo sapiens
ctggcttttttcccattatgca

SEQ ID NO: 17625 - DNA, 22 bp, Homo sapiens
gaggtggctgcttgctgggaaa

SEQ ID NO: 17626 - DNA, 22 bp, Homo sapiens
cttgcctttgtcttcaaaggct

SEQ ID NO: 17627 - DNA, 22 bp, Homo sapiens
accatgttggccaagctggtct

SEQ ID NO: 17628 - DNA, 22 bp, Homo sapiens
ccgaggctggagtgcagtggcg

SEQ ID NO: 17629 - DNA, 22 bp, Homo sapiens
gtcagaggggcagctgccaggc

SEQ ID NO: 17630 - DNA, 22 bp, Homo sapiens
ctgctccccagcctgcgccttt

SEQ ID NO: 17631 - DNA, 22 bp, Homo sapiens
tggttaagtccagaaaggaagc

SEQ ID NO: 17632 - DNA, 19 bp, Homo sapiens
acacagggatcagagggtt

SEQ ID NO: 17633 - DNA, 23 bp, Homo sapiens
gttttacaggtgagaaaatggag

SEQ ID NO: 17634 - DNA, 22 bp, Homo sapiens
gggaagtgagctggaatcaagg

SEQ ID NO: 17635 - DNA, 22 bp, Homo sapiens
tctcgctctgtcgcccaggctg

SEQ ID NO: 17636 - DNA, 22 bp, Homo sapiens
ccctgctgtcaggtgctgggag

SEQ ID NO: 17637 - DNA, 22 bp, Homo sapiens
gaggcagaagttgcagtgagca

SEQ ID NO: 17638 - DNA, 22 bp, Homo sapiens
tggaggctggagtgcagtggcg

SEQ ID NO: 17639 - DNA, 18 bp, Homo sapiens
agcctgtcccttctcctg

SEQ ID NO: 17640 - DNA, 21 bp, Homo sapiens
tggcggggacttgtggctgcc

SEQ ID NO: 17641 - DNA, 22 bp, Homo sapiens
ttatttaaaagtggtaagattc

SEQ ID NO: 17642 - DNA, 22 bp, Homo sapiens
tgggaggccaaggcaggcggat

SEQ ID NO: 17643 - DNA, 22 bp, Homo sapiens
ctcctgggaaaggctggacaca

SEQ ID NO: 17644 - DNA, 22 bp, Homo sapiens
tgagtcatgtaataatgctgct

SEQ ID NO: 17645 - DNA, 22 bp, Homo sapiens
atattacacacggtatcacggg

SEQ ID NO: 17646 - DNA, 16 bp, Homo sapiens
gcagaggaaaggggag

SEQ ID NO: 17647 - DNA, 22 bp, Homo sapiens
ggaggcggaagttgcagtgagc

SEQ ID NO: 17648 - DNA, 22 bp, Homo sapiens
acattcccaccaacagtgtaaa

SEQ ID NO: 17649 - DNA, 22 bp, Homo sapiens
ccaggctggagtatagtggcgc

SEQ ID NO: 17650 - DNA, 22 bp, Homo sapiens
gagaggtggaggttgcagtgag

SEQ ID NO: 17651 - DNA, 22 bp, Homo sapiens
gagacacaggcacagaagaggc

SEQ ID NO: 17652 - DNA, 22 bp, Homo sapiens
gtgggggcaggcagtgctagga

SEQ ID NO: 17653 - DNA, 22 bp, Homo sapiens
tcaggaggtccgcccgggaggg

SEQ ID NO: 17654 - DNA, 22 bp, Homo sapiens
cgcggtggcggcctccagcgcc

SEQ ID NO: 17655 - DNA, 22 bp, Homo sapiens
aggggatgcctagtggagtctc

SEQ ID NO: 17656 - DNA, 22 bp, Homo sapiens
tcagcctggcaggatggcctgg

SEQ ID NO: 17657 - DNA, 22 bp, Homo sapiens
atgccactgcacttcagcctgg

SEQ ID NO: 17658 - DNA, 19 bp, Homo sapiens
ttcacattggaagaagtag

SEQ ID NO: 17659 - DNA, 22 bp, Homo sapiens
ctggcctcggcagcaggaacag

SEQ ID NO: 17660 - DNA, 22 bp, Homo sapiens
agtgccctttacaacttcttga

SEQ ID NO: 17661 - DNA, 22 bp, Homo sapiens
aaaatatgtataactcttctgc

SEQ ID NO: 17662 - DNA, 22 bp, Homo sapiens
gcctgcagggcctgggcctacc

SEQ ID NO: 17663 - DNA, 22 bp, Homo sapiens
ctctgcctgtctcatcctgcaa

SEQ ID NO: 17664 - DNA, 20 bp, Homo sapiens
tcactgtaacatttgggggg

SEQ ID NO: 17665 - DNA, 22 bp, Homo sapiens
ccaggctggagtgcaatggcat

SEQ ID NO: 17666 - DNA, 22 bp, Homo sapiens
gtgcaaaagtaattgtggtttt

SEQ ID NO: 17667 - DNA, 22 bp, Homo sapiens
tgtttcttacgtttttagaggc

SEQ ID NO: 17668 - DNA, 22 bp, Homo sapiens
gggaagagggagctggaatgat

SEQ ID NO: 17669 - DNA, 22 bp, Homo sapiens
aaagatcacgtcccaggactcg

SEQ ID NO: 17670 - DNA, 22 bp, Homo sapiens
ttgcttcagagggagacacttt

SEQ ID NO: 17671 - DNA, 22 bp, Homo sapiens
cccaggccctggcagagcttgt

SEQ ID NO: 17672 - DNA, 22 bp, Homo sapiens
cctgggacttggtctggggttt

SEQ ID NO: 17673 - DNA, 22 bp, Homo sapiens
atgggctgtccattgctggctg

SEQ ID NO: 17674 - DNA, 22 bp, Homo sapiens
catgagatttgggaggggccag

SEQ ID NO: 17675 - DNA, 22 bp, Homo sapiens
tgacaagaaagcgtcttctttt

SEQ ID NO: 17676 - DNA, 22 bp, Homo sapiens
ctctccattccctacagttttc

SEQ ID NO: 17677 - DNA, 22 bp, Homo sapiens
aatggaatacctaggtggccca

SEQ ID NO: 17678 - DNA, 21 bp, Homo sapiens
gccatttcacacagacatttg

SEQ ID NO: 17679 - DNA, 22 bp, Homo sapiens
aagaggttgtctgtgatgagtt

SEQ ID NO: 17680 - DNA, 22 bp, Homo sapiens
aggcgcacagggtgttgatgtg

SEQ ID NO: 17681 - DNA, 22 bp, Homo sapiens
aagccaggttccatggaggagc

SEQ ID NO: 17682 - DNA, 22 bp, Homo sapiens
ataccaccatctatgaaaggta

SEQ ID NO: 17683 - DNA, 22 bp, Homo sapiens
cgaggaggaaacgcggagaact

SEQ ID NO: 17684 - DNA, 22 bp, Homo sapiens
cctgtggcgggggccagtgcct

SEQ ID NO: 17685 - DNA, 21 bp, Homo sapiens
gctcctggtgctgcgtggcgc

SEQ ID NO: 17686 - DNA, 22 bp, Homo sapiens
ggaatgaatttccagctgggtc

SEQ ID NO: 17687 - DNA, 22 bp, Homo sapiens
ggagagtgggagcaactgttgc

SEQ ID NO: 17688 - DNA, 22 bp, Homo sapiens
gccggggctggggagagacatg

SEQ ID NO: 17689 - DNA, 22 bp, Homo sapiens
ctgctgagccgcacccaggagc

SEQ ID NO: 17690 - DNA, 22 bp, Homo sapiens
ctgagggtcaacttgattgtat

SEQ ID NO: 17691 - DNA, 22 bp, Homo sapiens
tccagcagtccatgtgagacac

SEQ ID NO: 17692 - DNA, 22 bp, Homo sapiens
gcttctcaattctcaccctcca

SEQ ID NO: 17693 - DNA, 22 bp, Homo sapiens
aagtctctcacatatctggtcc

SEQ ID NO: 17694 - DNA, 22 bp, Homo sapiens
actgctggggctcattcatctc

SEQ ID NO: 17695 - DNA, 22 bp, Homo sapiens
gggctgagacgatggggtcttc

SEQ ID NO: 17696 - DNA, 22 bp, Homo sapiens
aggacagagggaccagagccca

SEQ ID NO: 17697 - DNA, 22 bp, Homo sapiens
aatgaattgcagtactgacttg

SEQ ID NO: 17698 - DNA, 22 bp, Homo sapiens
tttaaaaaactagtctgagtct

SEQ ID NO: 17699 - DNA, 21 bp, Homo sapiens
aggcttggatctagacaggcc

SEQ ID NO: 17700 - DNA, 22 bp, Homo sapiens
tcaactaactctattatttgaa

SEQ ID NO: 17701 - DNA, 22 bp, Homo sapiens
ggcagggcaggaaagtcaggaa

SEQ ID NO: 17702 - DNA, 18 bp, Homo sapiens
gtcaggcatgaatctggg

SEQ ID NO: 17703 - DNA, 22 bp, Homo sapiens
ctgggcctggggctgttgagag

SEQ ID NO: 17704 - DNA, 22 bp, Homo sapiens
gggaggaggaatgttttgtgta

SEQ ID NO: 17705 - DNA, 22 bp, Homo sapiens
ggtgccctggaagctgctgcat

SEQ ID NO: 17706 - DNA, 22 bp, Homo sapiens
agccagggacgctgcaggctac

SEQ ID NO: 17707 - DNA, 22 bp, Homo sapiens
atttacaggtagaattttaagt

SEQ ID NO: 17708 - DNA, 22 bp, Homo sapiens
tatctatgtgctctgacctctc

SEQ ID NO: 17709 - DNA, 22 bp, Homo sapiens
gcaggcagaggtggaggagaca

SEQ ID NO: 17710 - DNA, 22 bp, Homo sapiens
aggcaaggtgctacagacagtg

SEQ ID NO: 17711 - DNA, 22 bp, Homo sapiens
gcctgtgtctgggtggccagag

SEQ ID NO: 17712 - DNA, 22 bp, Homo sapiens
agtccaaagcagatgagggcca

SEQ ID NO: 17713 - DNA, 22 bp, Homo sapiens
gaggtaggtgtaggaggcctgc

SEQ ID NO: 17714 - DNA, 22 bp, Homo sapiens
ccatgtacatgaacacggcggc

SEQ ID NO: 17715 - DNA, 22 bp, Homo sapiens
gtgaaatatttaacgtccaggt

SEQ ID NO: 17716 - DNA, 20 bp, Homo sapiens
tgagacccgctgacaagttc

SEQ ID NO: 17717 - DNA, 22 bp, Homo sapiens
gagcccgagcgcgtacccggcg

SEQ ID NO: 17718 - DNA, 22 bp, Homo sapiens
ttcctttctctggactgcagcc

SEQ ID NO: 17719 - DNA, 20 bp, Homo sapiens
atcggcttgcctggaaacaa

SEQ ID NO: 17720 - DNA, 22 bp, Homo sapiens
tgcgatgcaacagcttggcgga

SEQ ID NO: 17721 - DNA, 22 bp, Homo sapiens
gcagagctcatgcctgcacctc

SEQ ID NO: 17722 - DNA, 21 bp, Homo sapiens
ccaggccaggcctacggggat

SEQ ID NO: 17723 - DNA, 22 bp, Homo sapiens
tttgaagactactgggagtgaa

SEQ ID NO: 17724 - DNA, 22 bp, Homo sapiens
tgcctgtggaaaggctggtgct

SEQ ID NO: 17725 - DNA, 22 bp, Homo sapiens
gtgctgacaggagcctggcggt

SEQ ID NO: 17726 - DNA, 22 bp, Homo sapiens
gggaggttctgttcgcacttga

SEQ ID NO: 17727 - DNA, 22 bp, Homo sapiens
gtccccgacgtttggcttgatg

SEQ ID NO: 17728 - DNA, 22 bp, Homo sapiens
atacttctttagcatattgaac

SEQ ID NO: 17729 - DNA, 22 bp, Homo sapiens
ggaggagacagtaaaaagcacg

SEQ ID NO: 17730 - DNA, 22 bp, Homo sapiens
tccacgtgagcttcgtgtgcag

SEQ ID NO: 17731 - DNA, 20 bp, Homo sapiens
attagagctacatggctaca

SEQ ID NO: 17732 - DNA, 22 bp, Homo sapiens
ttccgagggctcggcggccgcc

SEQ ID NO: 17733 - DNA, 22 bp, Homo sapiens
ggagttgattttggatatatta

SEQ ID NO: 17734 - DNA, 22 bp, Homo sapiens
cactgcactccagcccgggcaa

SEQ ID NO: 17735 - DNA, 22 bp, Homo sapiens
gaactttgcgcagttcccgggg

SEQ ID NO: 17736 - DNA, 22 bp, Homo sapiens
taatactgtatactgcaaattt

SEQ ID NO: 17737 - DNA, 22 bp, Homo sapiens
ggcagcactgcagcttgttggg

SEQ ID NO: 17738 - DNA, 22 bp, Homo sapiens
gcagcctcaaactccccagctc

SEQ ID NO: 17739 - DNA, 22 bp, Homo sapiens
taatggtgtttttctgtaattt

SEQ ID NO: 17740 - DNA, 22 bp, Homo sapiens
ccaggctggagtgcaatggcat

SEQ ID NO: 17741 - DNA, 22 bp, Homo sapiens
aagtgatgctacgactttgaca

SEQ ID NO: 17742 - DNA, 22 bp, Homo sapiens
caggaaggcgcggctgtgcctg

SEQ ID NO: 17743 - DNA, 22 bp, Homo sapiens
ctgggaggcagaggttgcagtg

SEQ ID NO: 17744 - DNA, 22 bp, Homo sapiens
attttctatgttgtaattgtta

SEQ ID NO: 17745 - DNA, 22 bp, Homo sapiens
tggcatgcatctgttgtcctag

SEQ ID NO: 17746 - DNA, 22 bp, Homo sapiens
agattctaccagagctagtttg

SEQ ID NO: 17747 - DNA, 22 bp, Homo sapiens
tggaagggagctggaatttgga

SEQ ID NO: 17748 - DNA, 23 bp, Homo sapiens
gacagagtgagaccttgtcttac

SEQ ID NO: 17749 - DNA, 22 bp, Homo sapiens
cttgtgcttttatgaatgcaga

SEQ ID NO: 17750 - DNA, 22 bp, Homo sapiens
cagaggatatactatctggaaa

SEQ ID NO: 17751 - DNA, 22 bp, Homo sapiens
agcccaggctggagtgcagtgg

SEQ ID NO: 17752 - DNA, 22 bp, Homo sapiens
aggggcgtgctcttccccgacg

SEQ ID NO: 17753 - DNA, 22 bp, Homo sapiens
agccaggatggtctcgatcggc

SEQ ID NO: 17754 - DNA, 22 bp, Homo sapiens
actgattgcattcatagggttt

SEQ ID NO: 17755 - DNA, 22 bp, Homo sapiens
agtccggggtctggacacctgg

SEQ ID NO: 17756 - DNA, 22 bp, Homo sapiens
gtgagccgagtatagttcatag

SEQ ID NO: 17757 - DNA, 23 bp, Homo sapiens
atgtttgcagtaacccatcctgg

SEQ ID NO: 17758 - DNA, 22 bp, Homo sapiens
ccaggctgctgttggtgtccgc

SEQ ID NO: 17759 - DNA, 22 bp, Homo sapiens
actgcactcctgcctgggtaac

SEQ ID NO: 17760 - DNA, 22 bp, Homo sapiens
attgagaagaaaatctaatata

SEQ ID NO: 17761 - DNA, 22 bp, Homo sapiens
tttaatcataagaaggaaaata

SEQ ID NO: 17762 - DNA, 19 bp, Homo sapiens
ggagccgccgcccttcatt

SEQ ID NO: 17763 - DNA, 23 bp, Homo sapiens
atgacactcctgtgcgcaccctg

SEQ ID NO: 17764 - DNA, 22 bp, Homo sapiens
ggccgctctccggtgtggatct

SEQ ID NO: 17765 - DNA, 22 bp, Homo sapiens
cctccccacagcccaggagact

SEQ ID NO: 17766 - DNA, 22 bp, Homo sapiens
atggtggacgggagacaggact

SEQ ID NO: 17767 - DNA, 21 bp, Homo sapiens
tggtacaccttgcctgtcaga

SEQ ID NO: 17768 - DNA, 22 bp, Homo sapiens
aggctggagtgcagtggtgtga

SEQ ID NO: 17769 - DNA, 22 bp, Homo sapiens
atcacaaaggtctcagagcaca

SEQ ID NO: 17770 - DNA, 22 bp, Homo sapiens
gtggtgagattgctggatcaaa

SEQ ID NO: 17771 - DNA, 22 bp, Homo sapiens
ttcacagtggtagtgcatttag

SEQ ID NO: 17772 - DNA, 22 bp, Homo sapiens
cataatttctaccagggccata

SEQ ID NO: 17773 - DNA, 19 bp, Homo sapiens
acacagggatcagagggtt

SEQ ID NO: 17774 - DNA, 22 bp, Homo sapiens
ttttaatactgctattgtagga

SEQ ID NO: 17775 - DNA, 22 bp, Homo sapiens
tggaatgtcagctacaagaggg

SEQ ID NO: 17776 - DNA, 22 bp, Homo sapiens
gcttggccagcagccgggatgc

SEQ ID NO: 17777 - DNA, 20 bp, Homo sapiens
tatttctgggcaaccattta

SEQ ID NO: 17778 - DNA, 22 bp, Homo sapiens
acatcctcccgatctactggct

SEQ ID NO: 17779 - DNA, 22 bp, Homo sapiens
ttgtctaatgagctccacttca

SEQ ID NO: 17780 - DNA, 22 bp, Homo sapiens
cagctggttgaagaggagctgg

SEQ ID NO: 17781 - DNA, 22 bp, Homo sapiens
ccagtgtatttttgggacctgc

SEQ ID NO: 17782 - DNA, 21 bp, Homo sapiens
cccagaagttccatggggggc

SEQ ID NO: 17783 - DNA, 22 bp, Homo sapiens
ggggccttggatctgtgccccg

SEQ ID NO: 17784 - DNA, 22 bp, Homo sapiens
cggggccctggggctgaaggtc

SEQ ID NO: 17785 - DNA, 22 bp, Homo sapiens
agcccttagtacatttctcaag

SEQ ID NO: 17786 - DNA, 22 bp, Homo sapiens
ccaggctggagtgcagtggcac

SEQ ID NO: 17787 - DNA, 22 bp, Homo sapiens
ccaccgccatggcgttgtacag

SEQ ID NO: 17788 - DNA, 22 bp, Homo sapiens
ttccagttcactccatttctgg

SEQ ID NO: 17789 - DNA, 22 bp, Homo sapiens
actgcaacctccgcctgccagg

SEQ ID NO: 17790 - DNA, 22 bp, Homo sapiens
cctctgtgtgatgcgcaaagta

SEQ ID NO: 17791 - DNA, 22 bp, Homo sapiens
tcaccttgtgatctccctgcct

SEQ ID NO: 17792 - DNA, 19 bp, Homo sapiens
tctcacagctctactatgt

SEQ ID NO: 17793 - DNA, 22 bp, Homo sapiens
atccaccctgtggtggctttct

SEQ ID NO: 17794 - DNA, 22 bp, Homo sapiens
gaagcctcaacatctctgcgtc

SEQ ID NO: 17795 - DNA, 22 bp, Homo sapiens
taggcatgcaaataaatgtgca

SEQ ID NO: 17796 - DNA, 23 bp, Homo sapiens
gcgtccggcctctctcgctcccg

SEQ ID NO: 17797 - DNA, 22 bp, Homo sapiens
atgtgagctggggcccggccag

SEQ ID NO: 17798 - DNA, 22 bp, Homo sapiens
actgcaacctccacctcctggg

SEQ ID NO: 17799 - DNA, 22 bp, Homo sapiens
gaaagacatagttgcaagatgg

SEQ ID NO: 17800 - DNA, 22 bp, Homo sapiens
cgctccttgagcgtgtcggcct

SEQ ID NO: 17801 - DNA, 22 bp, Homo sapiens
acttgccccagaattgctgctg

SEQ ID NO: 17802 - DNA, 22 bp, Homo sapiens
tgggaagggtcaacagctggaa

SEQ ID NO: 17803 - DNA, 17 bp, Homo sapiens
cgggcatggagggcagg

SEQ ID NO: 17804 - DNA, 19 bp, Homo sapiens
taggaccctggtggccccc

SEQ ID NO: 17805 - DNA, 22 bp, Homo sapiens
ctgtcatggtttgaatgctcgc

SEQ ID NO: 17806 - DNA, 22 bp, Homo sapiens
cagctggtgtcaggcactgcag

SEQ ID NO: 17807 - DNA, 22 bp, Homo sapiens
tgactctgataagacatatggc

SEQ ID NO: 17808 - DNA, 22 bp, Homo sapiens
ttatttaatgtgatctgaagag

SEQ ID NO: 17809 - DNA, 18 bp, Homo sapiens
ccatcaccctaactagtg

SEQ ID NO: 17810 - DNA, 22 bp, Homo sapiens
tccaggtgggctgcacccaggc

SEQ ID NO: 17811 - DNA, 22 bp, Homo sapiens
tcacaacgcctctgcaaatcct

SEQ ID NO: 17812 - DNA, 22 bp, Homo sapiens
atccatttgacataatttcagc

SEQ ID NO: 17813 - DNA, 22 bp, Homo sapiens
tgcgatggcgtagacaaatccc

SEQ ID NO: 17814 - DNA, 22 bp, Homo sapiens
cactgcacttcagcctgggtga

SEQ ID NO: 17815 - DNA, 18 bp, Homo sapiens
ggaaggtgattcagtttt

SEQ ID NO: 17816 - DNA, 22 bp, Homo sapiens
atttcagcagcccatgtttgga

SEQ ID NO: 17817 - DNA, 22 bp, Homo sapiens
cgtgtgttgaaagatgtacatc

SEQ ID NO: 17818 - DNA, 22 bp, Homo sapiens
tgaacatgctgttgatggcctg

SEQ ID NO: 17819 - DNA, 22 bp, Homo sapiens
atcacagttttaccatttggta

SEQ ID NO: 17820 - DNA, 22 bp, Homo sapiens
tagtatagattgaagcagatca

SEQ ID NO: 17821 - DNA, 22 bp, Homo sapiens
cgggagcctctgggtcacactg

SEQ ID NO: 17822 - DNA, 21 bp, Homo sapiens
acacaggcagtgtcccgaggt

SEQ ID NO: 17823 - DNA, 22 bp, Homo sapiens
aagacacaatgtagcccagcac

SEQ ID NO: 17824 - DNA, 22 bp, Homo sapiens
agtaatcaatttttcggtggat

SEQ ID NO: 17825 - DNA, 22 bp, Homo sapiens
tgcgccatgtgctctcggccct

SEQ ID NO: 17826 - DNA, 22 bp, Homo sapiens
cagccagtgtgaccgaggagga

SEQ ID NO: 17827 - DNA, 22 bp, Homo sapiens
cctctgtgtctccaagaggcct

SEQ ID NO: 17828 - DNA, 22 bp, Homo sapiens
gcggggggaggaacatcttgca

SEQ ID NO: 17829 - DNA, 22 bp, Homo sapiens
gagcacgttgaagcgcactgtc

SEQ ID NO: 17830 - DNA, 22 bp, Homo sapiens
ttggatccatctcaggcatagg

SEQ ID NO: 17831 - DNA, 22 bp, Homo sapiens
tcctccccaaagcccagcctgg

SEQ ID NO: 17832 - DNA, 22 bp, Homo sapiens
gccatcatatcccctgtgacct

SEQ ID NO: 17833 - DNA, 22 bp, Homo sapiens
gagcctggagctggaacgaagc

SEQ ID NO: 17834 - DNA, 22 bp, Homo sapiens
ctggtctggctacccagcgaat

SEQ ID NO: 17835 - DNA, 22 bp, Homo sapiens
caggctggagtgcagtggtgcc

SEQ ID NO: 17836 - DNA, 20 bp, Homo sapiens
aaaatatgtataactcttct

SEQ ID NO: 17837 - DNA, 21 bp, Homo sapiens
aggcttggatctagacaggcc

SEQ ID NO: 17838 - DNA, 22 bp, Homo sapiens
tagtggatgttcagagatttga

SEQ ID NO: 17839 - DNA, 22 bp, Homo sapiens
aggtggagaagagatgggcagt

SEQ ID NO: 17840 - DNA, 22 bp, Homo sapiens
taccagggaacagggatattaa

SEQ ID NO: 17841 - DNA, 22 bp, Homo sapiens
gcaggctgtctaaagttagagt

SEQ ID NO: 17842 - DNA, 22 bp, Homo sapiens
ggtgccaggctgtagtcagggt

SEQ ID NO: 17843 - DNA, 22 bp, Homo sapiens
tcaccagatctctctgtaatgg

SEQ ID NO: 17844 - DNA, 22 bp, Homo sapiens
tgttatatctaaatagccacat

SEQ ID NO: 17845 - DNA, 22 bp, Homo sapiens
gattcactcatattttacgttt

SEQ ID NO: 17846 - DNA, 22 bp, Homo sapiens
ggaggggatttagtagatgcta

SEQ ID NO: 17847 - DNA, 22 bp, Homo sapiens
aatcacttagaacccaggaagt

SEQ ID NO: 17848 - DNA, 22 bp, Homo sapiens
atgagttgaagctacaagaggc

SEQ ID NO: 17849 - DNA, 22 bp, Homo sapiens
tgcctgtgtcagcaggtggaag

SEQ ID NO: 17850 - DNA, 22 bp, Homo sapiens
agtgtgttgtaggctcaaatgg

SEQ ID NO: 17851 - DNA, 22 bp, Homo sapiens
atgattgaccatctgctgggct

SEQ ID NO: 17852 - DNA, 22 bp, Homo sapiens
acaggggattgattggaagtct

SEQ ID NO: 17853 - DNA, 23 bp, Homo sapiens
gtcacagtgggtggtgcctacat

SEQ ID NO: 17854 - DNA, 22 bp, Homo sapiens
ttcccaggaagcctctccaagc

SEQ ID NO: 17855 - DNA, 22 bp, Homo sapiens
gaaggagccgagctcttcccca

SEQ ID NO: 17856 - DNA, 22 bp, Homo sapiens
cactgcactccagcctgggtca

SEQ ID NO: 17857 - DNA, 22 bp, Homo sapiens
cgttggtctgtcccctggcacc

SEQ ID NO: 17858 - DNA, 22 bp, Homo sapiens
ctatggtctggaccgaggtcct

SEQ ID NO: 17859 - DNA, 22 bp, Homo sapiens
ggggaccctcaggactgcgtct

SEQ ID NO: 17860 - DNA, 22 bp, Homo sapiens
atttaagggatttggagaccaa

SEQ ID NO: 17861 - DNA, 23 bp, Homo sapiens
acagcaagaggaccagatgtgag

SEQ ID NO: 17862 - DNA, 22 bp, Homo sapiens
tcacccaggctggagtgcagtg

SEQ ID NO: 17863 - DNA, 22 bp, Homo sapiens
tctcccaggcaggagtgcagtg

SEQ ID NO: 17864 - DNA, 22 bp, Homo sapiens
gtggggtagatctttctcagga

SEQ ID NO: 17865 - DNA, 22 bp, Homo sapiens
actgcactccagcctgggtaac

SEQ ID NO: 17866 - DNA, 22 bp, Homo sapiens
aaaaatcacttttataggcagc

SEQ ID NO: 17867 - DNA, 22 bp, Homo sapiens
ggacaagcctgtgagtgggttt

SEQ ID NO: 17868 - DNA, 22 bp, Homo sapiens
tagagtgtcataacagtgccca

SEQ ID NO: 17869 - DNA, 22 bp, Homo sapiens
caggcaggtcagtgaagaagga

SEQ ID NO: 17870 - DNA, 22 bp, Homo sapiens
ctgggaggcggaggttgcagtg

SEQ ID NO: 17871 - DNA, 22 bp, Homo sapiens
gtgctccctccttcctcaagga

SEQ ID NO: 17872 - DNA, 22 bp, Homo sapiens
cactgcactccagcctgggtga

SEQ ID NO: 17873 - DNA, 22 bp, Homo sapiens
gcaggtggatcacctgaggtca

SEQ ID NO: 17874 - DNA, 22 bp, Homo sapiens
actgtgaacggactgaagccca

SEQ ID NO: 17875 - DNA, 22 bp, Homo sapiens
agagcagctcgctacctctcta

SEQ ID NO: 17876 - DNA, 22 bp, Homo sapiens
ctggagtagccggacgggtctg

SEQ ID NO: 17877 - DNA, 22 bp, Homo sapiens
cacagggcttctcatggggtgc

SEQ ID NO: 17878 - DNA, 22 bp, Homo sapiens
tgtgacctcatcttaactggaa

SEQ ID NO: 17879 - DNA, 22 bp, Homo sapiens
ctgatagacaatcaccatggga

SEQ ID NO: 17880 - DNA, 22 bp, Homo sapiens
taatttcagtgcaagctcacgg

SEQ ID NO: 17881 - DNA, 22 bp, Homo sapiens
aatgtgaggccttggtagttat

SEQ ID NO: 17882 - DNA, 22 bp, Homo sapiens
aggggatggagctggaaggcag

SEQ ID NO: 17883 - DNA, 21 bp, Homo sapiens
aaactgaccttgcctgagaca

SEQ ID NO: 17884 - DNA, 22 bp, Homo sapiens
tgaaggtgggaattcaccaggt

SEQ ID NO: 17885 - DNA, 22 bp, Homo sapiens
aaggtagggatgtattcagctt

SEQ ID NO: 17886 - DNA, 22 bp, Homo sapiens
ggtgtccgcgctgtagaaggtc

SEQ ID NO: 17887 - DNA, 20 bp, Homo sapiens
cctgtcatcccagcattttg

SEQ ID NO: 17888 - DNA, 22 bp, Homo sapiens
atgtacataaaatgtataatga

SEQ ID NO: 17889 - DNA, 22 bp, Homo sapiens
cctgtgcttggccagagaggtt

SEQ ID NO: 17890 - DNA, 22 bp, Homo sapiens
tgagtgtggggaatgtcatgag

SEQ ID NO: 17891 - DNA, 22 bp, Homo sapiens
tccacgctgtgtgaccttgggc

SEQ ID NO: 17892 - DNA, 22 bp, Homo sapiens
gccctgagaagaagtcggaggg

SEQ ID NO: 17893 - DNA, 22 bp, Homo sapiens
gaggttggggctgcagtgagct

SEQ ID NO: 17894 - DNA, 19 bp, Homo sapiens
gagtattttccaacttggt

SEQ ID NO: 17895 - DNA, 22 bp, Homo sapiens
acctggacacctgctgtcatct

SEQ ID NO: 17896 - DNA, 22 bp, Homo sapiens
ccagatatcactgccgtgttgt

SEQ ID NO: 17897 - DNA, 22 bp, Homo sapiens
agggctggagccacagctggga

SEQ ID NO: 17898 - DNA, 22 bp, Homo sapiens
tttaatcaggcaaagcataata

SEQ ID NO: 17899 - DNA, 22 bp, Homo sapiens
tgtcaatatgtaataactgaat

SEQ ID NO: 17900 - DNA, 22 bp, Homo sapiens
tcagcctccgaaagtgctggga

SEQ ID NO: 17901 - DNA, 22 bp, Homo sapiens
atgtgagctctcttctgattgg

SEQ ID NO: 17902 - DNA, 22 bp, Homo sapiens
ggtcgctgtgtaggttcagcta

SEQ ID NO: 17903 - DNA, 22 bp, Homo sapiens
gggtccctggaattacttgaca

SEQ ID NO: 17904 - DNA, 22 bp, Homo sapiens
tctgctcagccgatctgctccg

SEQ ID NO: 17905 - DNA, 22 bp, Homo sapiens
caattctgaggcctgctttgtt

SEQ ID NO: 17906 - DNA, 22 bp, Homo sapiens
agctggtgtgccagttccagtt

SEQ ID NO: 17907 - DNA, 22 bp, Homo sapiens
accagctagggtagcacatctc

SEQ ID NO: 17908 - DNA, 22 bp, Homo sapiens
tcactcaggctggagtgcagtg

SEQ ID NO: 17909 - DNA, 22 bp, Homo sapiens
cggagcgctgggggactctgca

SEQ ID NO: 17910 - DNA, 22 bp, Homo sapiens
tgtgtgagtaaggctgagagag

SEQ ID NO: 17911 - DNA, 22 bp, Homo sapiens
gacctggttgactgtgagcagg

SEQ ID NO: 17912 - DNA, 22 bp, Homo sapiens
cacaaaccttctgcagcctgta

SEQ ID NO: 17913 - DNA, 22 bp, Homo sapiens
acccgatgttggtgctctagta

SEQ ID NO: 17914 - DNA, 22 bp, Homo sapiens
atataatttttggttagctcaa

SEQ ID NO: 17915 - DNA, 22 bp, Homo sapiens
ttgcaattgctatggagagcgt

SEQ ID NO: 17916 - DNA, 22 bp, Homo sapiens
tcgcccaggctggaagtgcagt

SEQ ID NO: 17917 - DNA, 22 bp, Homo sapiens
ggctcactgcaacttccgcctc

SEQ ID NO: 17918 - DNA, 22 bp, Homo sapiens
agtgcaggccccaggccaggcc

SEQ ID NO: 17919 - DNA, 22 bp, Homo sapiens
atgctgtttgcttttagtctgc

SEQ ID NO: 17920 - DNA, 23 bp, Homo sapiens
ctcctcgtaactctgtggtgggt

SEQ ID NO: 17921 - DNA, 22 bp, Homo sapiens
cgtctggcttctccacggtaaa

SEQ ID NO: 17922 - DNA, 22 bp, Homo sapiens
caggtgagaggcggtcctgcat

SEQ ID NO: 17923 - DNA, 22 bp, Homo sapiens
tagatacctgctggacctcatt

SEQ ID NO: 17924 - DNA, 22 bp, Homo sapiens
tctggacaggggcgctttgggg

SEQ ID NO: 17925 - DNA, 22 bp, Homo sapiens
ttgtggttaaccgcacattttt

SEQ ID NO: 17926 - DNA, 22 bp, Homo sapiens
catggcggtcaggatgtaggtg

SEQ ID NO: 17927 - DNA, 22 bp, Homo sapiens
aaatgcctcattttctctcact

SEQ ID NO: 17928 - DNA, 22 bp, Homo sapiens
ggctctgcttgaggccagcctg

SEQ ID NO: 17929 - DNA, 22 bp, Homo sapiens
gcagcctgggcaacagagtgag

SEQ ID NO: 17930 - DNA, 21 bp, Homo sapiens
acatggactgtgaatggggac

SEQ ID NO: 17931 - DNA, 22 bp, Homo sapiens
ctgcaagctacccctagcatca

SEQ ID NO: 17932 - DNA, 22 bp, Homo sapiens
ccactattactgtgtggcagtc

SEQ ID NO: 17933 - DNA, 22 bp, Homo sapiens
ggctccaccctgcttccagaag

SEQ ID NO: 17934 - DNA, 22 bp, Homo sapiens
tagcatgtcagtcgccacacgt

SEQ ID NO: 17935 - DNA, 22 bp, Homo sapiens
gattccacagcttcgaggtctt

SEQ ID NO: 17936 - DNA, 22 bp, Homo sapiens
tgcagcctggcttcgcgcctcc

SEQ ID NO: 17937 - DNA, 22 bp, Homo sapiens
caggctggagtacaattgtgtg

SEQ ID NO: 17938 - DNA, 22 bp, Homo sapiens
caccaagaatcttcacttttta

SEQ ID NO: 17939 - DNA, 22 bp, Homo sapiens
tttatgtagttacggactatca

SEQ ID NO: 17940 - DNA, 22 bp, Homo sapiens
tgtcatggggttgttttgtaca

SEQ ID NO: 17941 - DNA, 19 bp, Homo sapiens
atcccaaggagctgggact

SEQ ID NO: 17942 - DNA, 22 bp, Homo sapiens
ccaggtgtgctctgcagtggat

SEQ ID NO: 17943 - DNA, 22 bp, Homo sapiens
tgacaggaaacatgcagtgatt

SEQ ID NO: 17944 - DNA, 22 bp, Homo sapiens
gtctatatattgcttgaataat

SEQ ID NO: 17945 - DNA, 18 bp, Homo sapiens
tggcgatggtcatttttc

SEQ ID NO: 17946 - DNA, 22 bp, Homo sapiens
gggatcgtcatggaaagtgcta

SEQ ID NO: 17947 - DNA, 22 bp, Homo sapiens
aaaactgaaatacgatccaatg

SEQ ID NO: 17948 - DNA, 18 bp, Homo sapiens
tttctcagactctctttc

SEQ ID NO: 17949 - DNA, 22 bp, Homo sapiens
caggaaagggatgggctgccac

SEQ ID NO: 17950 - DNA, 22 bp, Homo sapiens
gccaggttgctgacgacgatct

SEQ ID NO: 17951 - DNA, 22 bp, Homo sapiens
cccacgtcgaacttgctccaga

SEQ ID NO: 17952 - DNA, 22 bp, Homo sapiens
ataaaatttgctactgttaaat

SEQ ID NO: 17953 - DNA, 22 bp, Homo sapiens
tccatgaggaccaaattcgtag

SEQ ID NO: 17954 - DNA, 22 bp, Homo sapiens
agtgaggggcagctgagtgggc

SEQ ID NO: 17955 - DNA, 19 bp, Homo sapiens
agtgagtgtacagtagaat

SEQ ID NO: 17956 - DNA, 22 bp, Homo sapiens
gaaagcatccgcctggaggtgg

SEQ ID NO: 17957 - DNA, 18 bp, Homo sapiens
tgtccctgcaaataacat

SEQ ID NO: 17958 - DNA, 22 bp, Homo sapiens
ttgagcatctgaggattttcct

SEQ ID NO: 17959 - DNA, 22 bp, Homo sapiens
gcgtctcaaggcccccaggcca

SEQ ID NO: 17960 - DNA, 22 bp, Homo sapiens
gagacacaggcacagaagaggc

SEQ ID NO: 17961 - DNA, 22 bp, Homo sapiens
cagcagcagtggctgcagaaca

SEQ ID NO: 17962 - DNA, 21 bp, Homo sapiens
taagagcctaacacagaaagg

SEQ ID NO: 17963 - DNA, 22 bp, Homo sapiens
tgtgttaaggtgcatctagtgc

SEQ ID NO: 17964 - DNA, 22 bp, Homo sapiens
gtctctatcatagctgaaccct

SEQ ID NO: 17965 - DNA, 22 bp, Homo sapiens
acccgggaggcaggagtcatag

SEQ ID NO: 17966 - DNA, 22 bp, Homo sapiens
gaggtggatgttgcagtgagct

SEQ ID NO: 17967 - DNA, 18 bp, Homo sapiens
gaccccgggatctgtcga

SEQ ID NO: 17968 - DNA, 22 bp, Homo sapiens
ggagtgcagtggcgtgagctcg

SEQ ID NO: 17969 - DNA, 22 bp, Homo sapiens
cttgtagaattgaaatggtctc

SEQ ID NO: 17970 - DNA, 22 bp, Homo sapiens
caggccagggttgagaagagaa

SEQ ID NO: 17971 - DNA, 22 bp, Homo sapiens
ttggccatctaagcccagccac

SEQ ID NO: 17972 - DNA, 22 bp, Homo sapiens
atggggggatgaaggagtccaa

SEQ ID NO: 17973 - DNA, 22 bp, Homo sapiens
caggcagggagctggaaaggat

SEQ ID NO: 17974 - DNA, 22 bp, Homo sapiens
tatactctgagaaacgtgtcac

SEQ ID NO: 17975 - DNA, 22 bp, Homo sapiens
gtgtgggctgcagaggcacagc

SEQ ID NO: 17976 - DNA, 22 bp, Homo sapiens
agaaaacataggagacaggaaa

SEQ ID NO: 17977 - DNA, 22 bp, Homo sapiens
agggccagcactcctggcagga

SEQ ID NO: 17978 - DNA, 22 bp, Homo sapiens
gctcccaggatgaggagccagg

SEQ ID NO: 17979 - DNA, 22 bp, Homo sapiens
ggccttggcctagccctccagg

SEQ ID NO: 17980 - DNA, 22 bp, Homo sapiens
cactgcactccagcctgggaga

SEQ ID NO: 17981 - DNA, 22 bp, Homo sapiens
attgctaggaacaggttgcacc

SEQ ID NO: 17982 - DNA, 22 bp, Homo sapiens
cttgatctacatagtgaaaccc

SEQ ID NO: 17983 - DNA, 22 bp, Homo sapiens
ctgagcatcatggcagaatctt

SEQ ID NO: 17984 - DNA, 22 bp, Homo sapiens
agccagtgcagctggaaattca

SEQ ID NO: 17985 - DNA, 22 bp, Homo sapiens
cactgcactccatcctgggaaa

SEQ ID NO: 17986 - DNA, 22 bp, Homo sapiens
caggctggagttcagtggtgtg

SEQ ID NO: 17987 - DNA, 22 bp, Homo sapiens
ccaggctggagtatagtggcgc

SEQ ID NO: 17988 - DNA, 22 bp, Homo sapiens
ttgggctcaggagtttgagacc

SEQ ID NO: 17989 - DNA, 22 bp, Homo sapiens
agaagccaccagctgaggaaga

SEQ ID NO: 17990 - DNA, 22 bp, Homo sapiens
atgagctagaaaaccatgtgga

SEQ ID NO: 17991 - DNA, 22 bp, Homo sapiens
ttccatttggcacttcactgag

SEQ ID NO: 17992 - DNA, 22 bp, Homo sapiens
agggctgcccagtgtgagagct

SEQ ID NO: 17993 - DNA, 22 bp, Homo sapiens
tgtttcttacgtttttagaggc

SEQ ID NO: 17994 - DNA, 22 bp, Homo sapiens
tgggaaggggagctggaaagga

SEQ ID NO: 17995 - DNA, 22 bp, Homo sapiens
actcccagaacatgctcttctt

SEQ ID NO: 17996 - DNA, 22 bp, Homo sapiens
cagcccaggactgcaggtgttt

SEQ ID NO: 17997 - DNA, 22 bp, Homo sapiens
ggcagggagtggagactcccta

SEQ ID NO: 17998 - DNA, 22 bp, Homo sapiens
acgtagcactgagagatgcagg

SEQ ID NO: 17999 - DNA, 22 bp, Homo sapiens
ccaggctggagtgcaatggcgt

SEQ ID NO: 18000 - DNA, 22 bp, Homo sapiens
tctttgttattgtgaatagggt

SEQ ID NO: 18001 - DNA, 22 bp, Homo sapiens
agcccggcttccccggttgcta

SEQ ID NO: 18002 - DNA, 22 bp, Homo sapiens
caggtgttggaagggcagtggg

SEQ ID NO: 18003 - DNA, 22 bp, Homo sapiens
taaagggtaggttttactgtaa

SEQ ID NO: 18004 - DNA, 22 bp, Homo sapiens
agcctctcagagtgctgggatt

SEQ ID NO: 18005 - DNA, 22 bp, Homo sapiens
gcctcactgcagccccaggaag

SEQ ID NO: 18006 - DNA, 22 bp, Homo sapiens
gtggcccaggctggagtgcagt

SEQ ID NO: 18007 - DNA, 22 bp, Homo sapiens
gtggcatgaaagcatctgtgat

SEQ ID NO: 18008 - DNA, 22 bp, Homo sapiens
tgagagcctgtgttcaaatgcc

SEQ ID NO: 18009 - DNA, 22 bp, Homo sapiens
gatgcgggcccgctccactgcc

SEQ ID NO: 18010 - DNA, 22 bp, Homo sapiens
tcaacagtggcaaagaggcacg

SEQ ID NO: 18011 - DNA, 22 bp, Homo sapiens
tggagggcatgctgtccatggg

SEQ ID NO: 18012 - DNA, 22 bp, Homo sapiens
atgattgaaaatgacattgcca

SEQ ID NO: 18013 - DNA, 22 bp, Homo sapiens
agcatgcgcttgatcagctcca

SEQ ID NO: 18014 - DNA, 22 bp, Homo sapiens
gccgggaccaaggccacggagc

SEQ ID NO: 18015 - DNA, 22 bp, Homo sapiens
gggaggttgaggctgcagtgag

SEQ ID NO: 18016 - DNA, 22 bp, Homo sapiens
aacagactccattacctggctt

SEQ ID NO: 18017 - DNA, 22 bp, Homo sapiens
tcaatactaatcttgctggaag

SEQ ID NO: 18018 - DNA, 22 bp, Homo sapiens
ccgtggtcacctgagctccttg

SEQ ID NO: 18019 - DNA, 22 bp, Homo sapiens
gtagtcccagctaccccggagg

SEQ ID NO: 18020 - DNA, 22 bp, Homo sapiens
gaagccttgaactgcaaacccc

SEQ ID NO: 18021 - DNA, 22 bp, Homo sapiens
gtacactccccctgtgaagttg

SEQ ID NO: 18022 - DNA, 22 bp, Homo sapiens
tgtcatagtgtggtagcagtgg

SEQ ID NO: 18023 - DNA, 22 bp, Homo sapiens
ctgctgagccgcacccaggagc

SEQ ID NO: 18024 - DNA, 22 bp, Homo sapiens
ccaggaggcggaaggtacagtg

SEQ ID NO: 18025 - DNA, 22 bp, Homo sapiens
tttagcgtagctgacagctaat

SEQ ID NO: 18026 - DNA, 21 bp, Homo sapiens
acagcctccatctcctgggct

SEQ ID NO: 18027 - DNA, 22 bp, Homo sapiens
gttgacagtgaccctgaaagca

SEQ ID NO: 18028 - DNA, 22 bp, Homo sapiens
gattgagtctgaggatgctgca

SEQ ID NO: 18029 - DNA, 23 bp, Homo sapiens
ccagtgattgcctggaaggaggt

SEQ ID NO: 18030 - DNA, 22 bp, Homo sapiens
ctgatcctcctttaagtagctg

SEQ ID NO: 18031 - DNA, 22 bp, Homo sapiens
tcagcagtgagaattaatgttg

SEQ ID NO: 18032 - DNA, 22 bp, Homo sapiens
agatttatgtggtcacactcag

SEQ ID NO: 18033 - DNA, 22 bp, Homo sapiens
tgtggcccgatcttgggagaca

SEQ ID NO: 18034 - DNA, 22 bp, Homo sapiens
ttcaatatgatattagctgtgg

SEQ ID NO: 18035 - DNA, 22 bp, Homo sapiens
gccaggacctcagatgcagggc

SEQ ID NO: 18036 - DNA, 22 bp, Homo sapiens
tcgtgaggctctgcatcgcaca

SEQ ID NO: 18037 - DNA, 22 bp, Homo sapiens
tttgaagggcacgacaatagtt

SEQ ID NO: 18038 - DNA, 22 bp, Homo sapiens
tttcataatactgtacatgaaa

SEQ ID NO: 18039 - DNA, 22 bp, Homo sapiens
cccaggaattggaggctgcagt

SEQ ID NO: 18040 - DNA, 22 bp, Homo sapiens
agaagcagaaactgggcttgtg

SEQ ID NO: 18041 - DNA, 22 bp, Homo sapiens
cttcctcctccatctcgaaggc

SEQ ID NO: 18042 - DNA, 22 bp, Homo sapiens
tctgttgcaatgtgcatggtga

SEQ ID NO: 18043 - DNA, 22 bp, Homo sapiens
cctacagttatattcttgattg

SEQ ID NO: 18044 - DNA, 22 bp, Homo sapiens
ttgtgtgtactggttatgggca

SEQ ID NO: 18045 - DNA, 22 bp, Homo sapiens
cagatgtacatgaagggcaatg

SEQ ID NO: 18046 - DNA, 22 bp, Homo sapiens
acccaggagacggaggtgcagt

SEQ ID NO: 18047 - DNA, 22 bp, Homo sapiens
atgaccagccgagataaacaga

SEQ ID NO: 18048 - DNA, 22 bp, Homo sapiens
cggggacacactggcagctcct

SEQ ID NO: 18049 - DNA, 22 bp, Homo sapiens
atatattttttgagacagagtc

SEQ ID NO: 18050 - DNA, 22 bp, Homo sapiens
cccctcgcctgcagagcacagc

SEQ ID NO: 18051 - DNA, 22 bp, Homo sapiens
agcgccactgcactccagcctg

SEQ ID NO: 18052 - DNA, 22 bp, Homo sapiens
tctcttgagctcagttctgatg

SEQ ID NO: 18053 - DNA, 22 bp, Homo sapiens
tatttcttttcgtgacttattg

SEQ ID NO: 18054 - DNA, 22 bp, Homo sapiens
ggcctcgcggcttctggtggct

SEQ ID NO: 18055 - DNA, 22 bp, Homo sapiens
ggagtgcagtggtgggatctca

SEQ ID NO: 18056 - DNA, 22 bp, Homo sapiens
catgcacttacctgaaattcaa

SEQ ID NO: 18057 - DNA, 22 bp, Homo sapiens
ttatttttaaaagttcacacag

SEQ ID NO: 18058 - DNA, 22 bp, Homo sapiens
cagagctggtgtgtcctggcat

SEQ ID NO: 18059 - DNA, 22 bp, Homo sapiens
agcctggtttaagcattttata

SEQ ID NO: 18060 - DNA, 20 bp, Homo sapiens
tgttgattggtgtcatctca

SEQ ID NO: 18061 - DNA, 22 bp, Homo sapiens
ggagggcagagtcccctgctga

SEQ ID NO: 18062 - DNA, 21 bp, Homo sapiens
cactccacttagaacagggtt

SEQ ID NO: 18063 - DNA, 22 bp, Homo sapiens
cccatgaggtggaggttgcagt

SEQ ID NO: 18064 - DNA, 22 bp, Homo sapiens
tgggaagctgcattttaacaag

SEQ ID NO: 18065 - DNA, 22 bp, Homo sapiens
attgcaggctctgacaccaggc

SEQ ID NO: 18066 - DNA, 22 bp, Homo sapiens
gtggcccaggttggagtgcagt

SEQ ID NO: 18067 - DNA, 22 bp, Homo sapiens
acatttatataactcactagga

SEQ ID NO: 18068 - DNA, 21 bp, Homo sapiens
agaaggcaaaagcagacatct

SEQ ID NO: 18069 - DNA, 21 bp, Homo sapiens
ctgtcatgcaaccattctcca

SEQ ID NO: 18070 - DNA, 22 bp, Homo sapiens
aggaggggttctcgggtgctga

SEQ ID NO: 18071 - DNA, 22 bp, Homo sapiens
tggttcctcaagcgctggcggc

SEQ ID NO: 18072 - DNA, 22 bp, Homo sapiens
cgttttcatgggtagaggttct

SEQ ID NO: 18073 - DNA, 22 bp, Homo sapiens
gcttccggagccaaaaggcccc

SEQ ID NO: 18074 - DNA, 22 bp, Homo sapiens
cgggcagtgtggctccagagtc

SEQ ID NO: 18075 - DNA, 22 bp, Homo sapiens
agcccaggttgaggctgcagtg

SEQ ID NO: 18076 - DNA, 22 bp, Homo sapiens
agttgcagacgcagagatgttg

SEQ ID NO: 18077 - DNA, 22 bp, Homo sapiens
tgtgactgaggctccaagctag

SEQ ID NO: 18078 - DNA, 22 bp, Homo sapiens
gggtctcctaatggaggatgac

SEQ ID NO: 18079 - DNA, 22 bp, Homo sapiens
tttctcctcatgactggttgtg

SEQ ID NO: 18080 - DNA, 22 bp, Homo sapiens
ggcaggaggtgagtggcgggtg

SEQ ID NO: 18081 - DNA, 22 bp, Homo sapiens
cctcgacctccccaggctcagg

SEQ ID NO: 18082 - DNA, 22 bp, Homo sapiens
tgagcaggcgcagcaggaggtc

SEQ ID NO: 18083 - DNA, 22 bp, Homo sapiens
atatatttgagaatattcatga

SEQ ID NO: 18084 - DNA, 22 bp, Homo sapiens
cagtggaggccttgggaccttt

SEQ ID NO: 18085 - DNA, 22 bp, Homo sapiens
ttttaagttggattgctaagta

SEQ ID NO: 18086 - DNA, 22 bp, Homo sapiens
ctctgtagaaagagcccaggtg

SEQ ID NO: 18087 - DNA, 22 bp, Homo sapiens
aggaccatcctaaggtaggcaa

SEQ ID NO: 18088 - DNA, 22 bp, Homo sapiens
atgttatgtctgggaaggggta

SEQ ID NO: 18089 - DNA, 22 bp, Homo sapiens
tgacttcctgcactcaggtgat

SEQ ID NO: 18090 - DNA, 21 bp, Homo sapiens
gctctgtgttacaagttgggg

SEQ ID NO: 18091 - DNA, 22 bp, Homo sapiens
tagcacagcttcttgatgtcac

SEQ ID NO: 18092 - DNA, 22 bp, Homo sapiens
tggagaattctatgttgagggg

SEQ ID NO: 18093 - DNA, 22 bp, Homo sapiens
ctcacagtctgcctttcccttg

SEQ ID NO: 18094 - DNA, 19 bp, Homo sapiens
ctctggagtcattgctccc

SEQ ID NO: 18095 - DNA, 22 bp, Homo sapiens
ggcagggcaggaaagtcaggaa

SEQ ID NO: 18096 - DNA, 20 bp, Homo sapiens
gctctgtggtttgagtctcc

SEQ ID NO: 18097 - DNA, 22 bp, Homo sapiens
agtgctgggctatctactgcta

SEQ ID NO: 18098 - DNA, 23 bp, Homo sapiens
tctgtgtctccacccaaatctca

SEQ ID NO: 18099 - DNA, 22 bp, Homo sapiens
ggggaaagccagccctgcttcc

SEQ ID NO: 18100 - DNA, 21 bp, Homo sapiens
gctcctggtgctgcgtggcgc

SEQ ID NO: 18101 - DNA, 22 bp, Homo sapiens
ccctggaggttgaggctgcagt

SEQ ID NO: 18102 - DNA, 22 bp, Homo sapiens
aggaagatgtgcaaagttggaa

SEQ ID NO: 18103 - DNA, 22 bp, Homo sapiens
cactgcactccagcctgggaga

SEQ ID NO: 18104 - DNA, 22 bp, Homo sapiens
ctgcagggagaggggacagcct

SEQ ID NO: 18105 - DNA, 22 bp, Homo sapiens
tgcagtcttccagctgcacaaa

SEQ ID NO: 18106 - DNA, 22 bp, Homo sapiens
tctttgggccgacactcgtcaa

SEQ ID NO: 18107 - DNA, 22 bp, Homo sapiens
accaggcccgctgctatggtgg

SEQ ID NO: 18108 - DNA, 22 bp, Homo sapiens
gggggactggaccgtcctgggt

SEQ ID NO: 18109 - DNA, 22 bp, Homo sapiens
aggagcagaccgtagtcctgca

SEQ ID NO: 18110 - DNA, 22 bp, Homo sapiens
acccgggaggcaggagtcatag

SEQ ID NO: 18111 - DNA, 22 bp, Homo sapiens
tgcgcgccagctcccaggttcg

SEQ ID NO: 18112 - DNA, 22 bp, Homo sapiens
aggaattggcacggccttctca

SEQ ID NO: 18113 - DNA, 22 bp, Homo sapiens
ttcctttctctggactgcagcc

SEQ ID NO: 18114 - DNA, 22 bp, Homo sapiens
tgttttaagggtcaactgtcac

SEQ ID NO: 18115 - DNA, 22 bp, Homo sapiens
aaggaattcaaattttctctgg

SEQ ID NO: 18116 - DNA, 22 bp, Homo sapiens
tgggaggccgaggcaggtggat

SEQ ID NO: 18117 - DNA, 21 bp, Homo sapiens
ccaccaggtcttctgctcggg

SEQ ID NO: 18118 - DNA, 22 bp, Homo sapiens
gccctgagaagaagtcggaggg

SEQ ID NO: 18119 - DNA, 22 bp, Homo sapiens
ctgccgtgtttttcatgttaaa

SEQ ID NO: 18120 - DNA, 22 bp, Homo sapiens
ctgcgtgcatgtctgcgtgcat

SEQ ID NO: 18121 - DNA, 22 bp, Homo sapiens
gtggcagagccaaggctggagc

SEQ ID NO: 18122 - DNA, 22 bp, Homo sapiens
gtcctggggattatagagtgtt

SEQ ID NO: 18123 - DNA, 22 bp, Homo sapiens
ggctgccttccctgagccccgg

SEQ ID NO: 18124 - DNA, 22 bp, Homo sapiens
actctccttttgatcttcagaa

SEQ ID NO: 18125 - DNA, 22 bp, Homo sapiens
gaccctctagatggaagcactg

SEQ ID NO: 18126 - DNA, 22 bp, Homo sapiens
gcagcctcaaactccccagctc

SEQ ID NO: 18127 - DNA, 22 bp, Homo sapiens
gctcccagtctgatggaggaga

SEQ ID NO: 18128 - DNA, 22 bp, Homo sapiens
tgcttgtgacagaactgtgtcc

SEQ ID NO: 18129 - DNA, 22 bp, Homo sapiens
cctgggaggctgaggctgcagt

SEQ ID NO: 18130 - DNA, 22 bp, Homo sapiens
accgggctaatttttgtatctt

SEQ ID NO: 18131 - DNA, 22 bp, Homo sapiens
cacccaggttggagtgcagtgg

SEQ ID NO: 18132 - DNA, 22 bp, Homo sapiens
tcactcaggctggagtgcagtg

SEQ ID NO: 18133 - DNA, 22 bp, Homo sapiens
agtgcaggccccaggccaggcc

SEQ ID NO: 18134 - DNA, 22 bp, Homo sapiens
agaaagagatgaatgctttaag

SEQ ID NO: 18135 - DNA, 22 bp, Homo sapiens
agcaggaaggggatgatgggca

SEQ ID NO: 18136 - DNA, 22 bp, Homo sapiens
ctgtctgtagacatttttggtt

SEQ ID NO: 18137 - DNA, 22 bp, Homo sapiens
ggagtgactcacagctgggaca

SEQ ID NO: 18138 - DNA, 22 bp, Homo sapiens
atcaacatgtcataaagtgaaa

SEQ ID NO: 18139 - DNA, 22 bp, Homo sapiens
tcagttacttgcttgtttgaaa

SEQ ID NO: 18140 - DNA, 22 bp, Homo sapiens
agaaagtgcttccctttggact

SEQ ID NO: 18141 - DNA, 22 bp, Homo sapiens
cagccagtgtgaccgaggagga

SEQ ID NO: 18142 - DNA, 22 bp, Homo sapiens
tgccacagacaggacagaacag

SEQ ID NO: 18143 - DNA, 22 bp, Homo sapiens
ctacaaaagtaattgtggtttt

SEQ ID NO: 18144 - DNA, 22 bp, Homo sapiens
tgccctggctcttcttgttcca

SEQ ID NO: 18145 - DNA, 22 bp, Homo sapiens
ctgagatctttatacgaggcac

SEQ ID NO: 18146 - DNA, 22 bp, Homo sapiens
ttaggtattttgttatgtcagc

SEQ ID NO: 18147 - DNA, 22 bp, Homo sapiens
acaccatactcatgttggttcc

SEQ ID NO: 18148 - DNA, 22 bp, Homo sapiens
tagatacctgctggacctcatt

SEQ ID NO: 18149 - DNA, 22 bp, Homo sapiens
ttatgatttgccacagattggt

SEQ ID NO: 18150 - DNA, 22 bp, Homo sapiens
cagggtgctgcaccatccctca

SEQ ID NO: 18151 - DNA, 22 bp, Homo sapiens
aaaagcaattgcagttcttgcc

SEQ ID NO: 18152 - DNA, 22 bp, Homo sapiens
ttcgggaggcggagcttgcagt

SEQ ID NO: 18153 - DNA, 22 bp, Homo sapiens
attgctaggaacaggttgcacc

SEQ ID NO: 18154 - DNA, 22 bp, Homo sapiens
gggagctgagctggaagagaat

SEQ ID NO: 18155 - DNA, 22 bp, Homo sapiens
tcagcctccgaaagtgctggga

SEQ ID NO: 18156 - DNA, 22 bp, Homo sapiens
attttctctttgtatatgctag

SEQ ID NO: 18157 - DNA, 22 bp, Homo sapiens
tgtccccacctaaatcttatct

SEQ ID NO: 18158 - DNA, 22 bp, Homo sapiens
tatgaggtaggtattatactta

SEQ ID NO: 18159 - DNA, 18 bp, Homo sapiens
ccgggctttggtgacaca

SEQ ID NO: 18160 - DNA, 18 bp, Homo sapiens
ccatcaccctaactagtg

SEQ ID NO: 18161 - DNA, 22 bp, Homo sapiens
atttacaggtagaattttaagt

SEQ ID NO: 18162 - DNA, 22 bp, Homo sapiens
gtgagccgagtatagttcatag

SEQ ID NO: 18163 - DNA, 22 bp, Homo sapiens
ccagagctgattcctgggactt

SEQ ID NO: 18164 - DNA, 22 bp, Homo sapiens
gagatggagtctttttctgtca

SEQ ID NO: 18165 - DNA, 22 bp, Homo sapiens
caagcgtggctgctctgatgga

SEQ ID NO: 18166 - DNA, 22 bp, Homo sapiens
tgcgggcgttcgttaccacttt

SEQ ID NO: 18167 - DNA, 22 bp, Homo sapiens
tcagccagccagctacaggctt

SEQ ID NO: 18168 - DNA, 22 bp, Homo sapiens
aactcactttgtggcttctgaa

SEQ ID NO: 18169 - DNA, 22 bp, Homo sapiens
tgaacatgctgttgatggcctg

SEQ ID NO: 18170 - DNA, 22 bp, Homo sapiens
gcctcctgagtagctgggattg

SEQ ID NO: 18171 - DNA, 22 bp, Homo sapiens
gcaggagaacaaagcaagctgc

SEQ ID NO: 18172 - DNA, 22 bp, Homo sapiens
cttgtagaattgaaatggtctc

SEQ ID NO: 18173 - DNA, 22 bp, Homo sapiens
ctgcatgtttacatttttgaga

SEQ ID NO: 18174 - DNA, 22 bp, Homo sapiens
ggctcctggcaatgtaacttta

SEQ ID NO: 18175 - DNA, 22 bp, Homo sapiens
cattctgcgatcctcaagcaca

SEQ ID NO: 18176 - DNA, 22 bp, Homo sapiens
cccaggagttagaggttgtggt

SEQ ID NO: 18177 - DNA, 22 bp, Homo sapiens
ctgctttggacaactattcttg

SEQ ID NO: 18178 - DNA, 22 bp, Homo sapiens
cactgcaacctccacctcctgg

SEQ ID NO: 18179 - DNA, 22 bp, Homo sapiens
tatactacgcaccaaacaaagg

SEQ ID NO: 18180 - DNA, 19 bp, Homo sapiens
tccaaagaagttcacattt

SEQ ID NO: 18181 - DNA, 23 bp, Homo sapiens
aggcgagctcttctccagcacgt

SEQ ID NO: 18182 - DNA, 22 bp, Homo sapiens
gtgctggggagataggaagaga

SEQ ID NO: 18183 - DNA, 22 bp, Homo sapiens
gagcacgttgaagcgcactgtc

SEQ ID NO: 18184 - DNA, 22 bp, Homo sapiens
atgcacctgaactccatcagct

SEQ ID NO: 18185 - DNA, 22 bp, Homo sapiens
ctccttctgggcctggcagtgg

SEQ ID NO: 18186 - DNA, 22 bp, Homo sapiens
ttgcactccagcccgagcaaca

SEQ ID NO: 18187 - DNA, 22 bp, Homo sapiens
attgtggtgtcagttataggca

SEQ ID NO: 18188 - DNA, 22 bp, Homo sapiens
tctcctggtacccttcctagca

SEQ ID NO: 18189 - DNA, 22 bp, Homo sapiens
ttccatttggcacttcactgag

SEQ ID NO: 18190 - DNA, 22 bp, Homo sapiens
atacaaaatatatactggagac

SEQ ID NO: 18191 - DNA, 22 bp, Homo sapiens
caggagatgacagggaagaacc

SEQ ID NO: 18192 - DNA, 22 bp, Homo sapiens
atctggttttggctgtgtccct

SEQ ID NO: 18193 - DNA, 22 bp, Homo sapiens
tctcccaggcaggagtgcagtg

SEQ ID NO: 18194 - DNA, 22 bp, Homo sapiens
atacttctttagcatattgaac

SEQ ID NO: 18195 - DNA, 22 bp, Homo sapiens
tggaatgtcagctacaagaggg

SEQ ID NO: 18196 - DNA, 21 bp, Homo sapiens
tctctttctggaagcttccct

SEQ ID NO: 18197 - DNA, 22 bp, Homo sapiens
tggaagaatatgggggtacaga

SEQ ID NO: 18198 - DNA, 22 bp, Homo sapiens
tctgctacaaatacgctgggag

SEQ ID NO: 18199 - DNA, 22 bp, Homo sapiens
aaaactgaaatacgatccaatg

SEQ ID NO: 18200 - DNA, 22 bp, Homo sapiens
atctggttcttcttaggcatca

SEQ ID NO: 18201 - DNA, 22 bp, Homo sapiens
ccagatatcactgccgtgttgt

SEQ ID NO: 18202 - DNA, 22 bp, Homo sapiens
aactcaaagatgcatgacgctt

SEQ ID NO: 18203 - DNA, 22 bp, Homo sapiens
tttaaaaaactagtctgagtct

SEQ ID NO: 18204 - DNA, 22 bp, Homo sapiens
aaaatatgtataactcttctgc

SEQ ID NO: 18205 - DNA, 22 bp, Homo sapiens
gcgtctcaaggcccccaggcca

SEQ ID NO: 18206 - DNA, 22 bp, Homo sapiens
ggtcactttaccccttggagcc

SEQ ID NO: 18207 - DNA, 22 bp, Homo sapiens
tgggaaggggagctggaaagga

SEQ ID NO: 18208 - DNA, 22 bp, Homo sapiens
actgtgaacggactgaagccca

SEQ ID NO: 18209 - DNA, 22 bp, Homo sapiens
tgtatatacacactcccatgtt

SEQ ID NO: 18210 - DNA, 22 bp, Homo sapiens
gagagaagggggatatgagcct

SEQ ID NO: 18211 - DNA, 22 bp, Homo sapiens
atatatttgagaatattcatga

SEQ ID NO: 18212 - DNA, 22 bp, Homo sapiens
gtgcgggcctgggggtttctct

SEQ ID NO: 18213 - DNA, 22 bp, Homo sapiens
ttccaactttgtcatatattat

SEQ ID NO: 18214 - DNA, 22 bp, Homo sapiens
catgtgtgtctccaccagctgc

SEQ ID NO: 18215 - DNA, 22 bp, Homo sapiens
taaaatttgtccctgagtgttg

SEQ ID NO: 18216 - DNA, 22 bp, Homo sapiens
tggctgtgtccctgtccagagt

SEQ ID NO: 18217 - DNA, 22 bp, Homo sapiens
tattcatagtaaacaaaagtgg

SEQ ID NO: 18218 - DNA, 19 bp, Homo sapiens
ggagccgccgcccttcatt

SEQ ID NO: 18219 - DNA, 22 bp, Homo sapiens
ggtgttgcagttgaagactggt

SEQ ID NO: 18220 - DNA, 22 bp, Homo sapiens
cagtgacgtaaactgcatgtgc

SEQ ID NO: 18221 - DNA, 22 bp, Homo sapiens
agagctccagggttttgtagtg

SEQ ID NO: 18222 - DNA, 22 bp, Homo sapiens
cagctgctgttcagttttgttt

SEQ ID NO: 18223 - DNA, 21 bp, Homo sapiens
ctacttaagtaggggattagg

SEQ ID NO: 18224 - DNA, 22 bp, Homo sapiens
ggagggcagagtcccctgctga

SEQ ID NO: 18225 - DNA, 22 bp, Homo sapiens
tgtcatagtgtggtagcagtgg

SEQ ID NO: 18226 - DNA, 22 bp, Homo sapiens
tctcgctctgtcgcccaggctg

SEQ ID NO: 18227 - DNA, 22 bp, Homo sapiens
tttattctgtgctacatgaaga

SEQ ID NO: 18228 - DNA, 20 bp, Homo sapiens
agacagtgtggagattcctt

SEQ ID NO: 18229 - DNA, 22 bp, Homo sapiens
acttttaaatgagtttcagttg

SEQ ID NO: 18230 - DNA, 22 bp, Homo sapiens
atctggggtgaataggttatgt

SEQ ID NO: 18231 - DNA, 23 bp, Homo sapiens
catgatgttaactttgttatgct

SEQ ID NO: 18232 - DNA, 22 bp, Homo sapiens
attgtgaatagtgctgcaataa

SEQ ID NO: 18233 - DNA, 22 bp, Homo sapiens
cttagagatgggttttacttag

SEQ ID NO: 18234 - DNA, 19 bp, Homo sapiens
gagtattttccaacttggt

SEQ ID NO: 18235 - DNA, 20 bp, Homo sapiens
gggtgtgtgcagggcctggt

SEQ ID NO: 18236 - DNA, 22 bp, Homo sapiens
ccatgaattcactccatgctag

SEQ ID NO: 18237 - DNA, 22 bp, Homo sapiens
atgaaatatcttgaagaaattc

SEQ ID NO: 18238 - DNA, 22 bp, Homo sapiens
tgctcattggcgatctgaggga

SEQ ID NO: 18239 - DNA, 22 bp, Homo sapiens
tgcaagtaattccagctactga

SEQ ID NO: 18240 - DNA, 22 bp, Homo sapiens
ggagtagctgcattccgagcac

SEQ ID NO: 18241 - DNA, 22 bp, Homo sapiens
gggaaggaaagttattagcaga

SEQ ID NO: 18242 - DNA, 22 bp, Homo sapiens
tgggcaggggccctgcttccgt

SEQ ID NO: 18243 - DNA, 22 bp, Homo sapiens
acaaagtgctgacattacaggc

SEQ ID NO: 18244 - DNA, 22 bp, Homo sapiens
gacctcgtgatccgcccgcttt

SEQ ID NO: 18245 - DNA, 22 bp, Homo sapiens
ggggtgggcgtgcagggacacc

SEQ ID NO: 18246 - DNA, 22 bp, Homo sapiens
cctggggccccgagccagaagc

SEQ ID NO: 18247 - DNA, 22 bp, Homo sapiens
agaaaacataggagacaggaaa

SEQ ID NO: 18248 - DNA, 17 bp, Homo sapiens
ccctcactcctgccggg

SEQ ID NO: 18249 - DNA, 22 bp, Homo sapiens
ggtcattatagtggggaggtgg

SEQ ID NO: 18250 - DNA, 22 bp, Homo sapiens
ttggaaacgtcaccttttcctt

SEQ ID NO: 18251 - DNA, 17 bp, Homo sapiens
tggttgtgggaactgaa

SEQ ID NO: 18252 - DNA, 22 bp, Homo sapiens
cagggatggcgctggctgcccg

SEQ ID NO: 18253 - DNA, 22 bp, Homo sapiens
ctggcaggtggaggttgcagtg

SEQ ID NO: 18254 - DNA, 22 bp, Homo sapiens
gctggaggatggactggaagaa

SEQ ID NO: 18255 - DNA, 19 bp, Homo sapiens
atctgccttagtgctgctg

SEQ ID NO: 18256 - DNA, 17 bp, Homo sapiens
ggcctgcacctcctgct

SEQ ID NO: 18257 - DNA, 22 bp, Homo sapiens
gcttaattctggctcagtttcc

SEQ ID NO: 18258 - DNA, 22 bp, Homo sapiens
aggaatggtgctcagcagaaat

SEQ ID NO: 18259 - DNA, 22 bp, Homo sapiens
taatatctacttcatagagttt

SEQ ID NO: 18260 - DNA, 22 bp, Homo sapiens
gatttttatataaagtgagaaa

SEQ ID NO: 18261 - DNA, 23 bp, Homo sapiens
aggatgtaggatgtatggcagag

SEQ ID NO: 18262 - DNA, 22 bp, Homo sapiens
ctgcttctccctgagatagtgt

SEQ ID NO: 18263 - DNA, 22 bp, Homo sapiens
gctgggtgattcatttccataa

SEQ ID NO: 18264 - DNA, 22 bp, Homo sapiens
ttttaatactgctattgtagga

SEQ ID NO: 18265 - DNA, 22 bp, Homo sapiens
gtttctggagtgactataactg

SEQ ID NO: 18266 - DNA, 22 bp, Homo sapiens
tctcttgagctcagttctgatg

SEQ ID NO: 18267 - DNA, 23 bp, Homo sapiens
gtgtggccccagggcctcctcgc

SEQ ID NO: 18268 - DNA, 22 bp, Homo sapiens
ttgaaattttaggccttgcaat

SEQ ID NO: 18269 - DNA, 22 bp, Homo sapiens
tacatttataaggcttctctgt

SEQ ID NO: 18270 - DNA, 22 bp, Homo sapiens
tacaaaaaattgatactgacga

SEQ ID NO: 18271 - DNA, 22 bp, Homo sapiens
tgagctgtatattgttttaata

SEQ ID NO: 18272 - DNA, 22 bp, Homo sapiens
cagcagcagtggctgcagaaca

SEQ ID NO: 18273 - DNA, 22 bp, Homo sapiens
tgatctcctgaccttgtaatcc

SEQ ID NO: 18274 - DNA, 22 bp, Homo sapiens
gtgaccatcatctcagctagtt

SEQ ID NO: 18275 - DNA, 22 bp, Homo sapiens
tctgctctgtggcttcagctaa

SEQ ID NO: 18276 - DNA, 22 bp, Homo sapiens
tttggggatgtctgagttgttg

SEQ ID NO: 18277 - DNA, 20 bp, Homo sapiens
aaaatatgtataactcttct

SEQ ID NO: 18278 - DNA, 22 bp, Homo sapiens
tgagagcaacacgcagtagtat

SEQ ID NO: 18279 - DNA, 22 bp, Homo sapiens
ctgggaggtggaggttgcattg

SEQ ID NO: 18280 - DNA, 22 bp, Homo sapiens
ggctcactgcaacttccgcctc

SEQ ID NO: 18281 - DNA, 22 bp, Homo sapiens
caccaggctggagtgcagtggc

SEQ ID NO: 18282 - DNA, 22 bp, Homo sapiens
tggggagaaatgtctttgttcc

SEQ ID NO: 18283 - DNA, 22 bp, Homo sapiens
tacaaagtcttgggttctaggc

SEQ ID NO: 18284 - DNA, 22 bp, Homo sapiens
cccgagtgtctactcactccca

SEQ ID NO: 18285 - DNA, 22 bp, Homo sapiens
cacggccagggctgtgggtgcg

SEQ ID NO: 18286 - DNA, 22 bp, Homo sapiens
cagtggaggccttgggaccttt

SEQ ID NO: 18287 - DNA, 22 bp, Homo sapiens
tgtgtctgtgtatacacggcat

SEQ ID NO: 18288 - DNA, 22 bp, Homo sapiens
ttttatctgtgacatctggcag

SEQ ID NO: 18289 - DNA, 22 bp, Homo sapiens
acaactttgacccttgttctta

SEQ ID NO: 18290 - DNA, 22 bp, Homo sapiens
tgaagttgttaaggttgccatt

SEQ ID NO: 18291 - DNA, 22 bp, Homo sapiens
caggaagctgtgaaggagacgg

SEQ ID NO: 18292 - DNA, 22 bp, Homo sapiens
tgaactcctgacctcatgatcc

SEQ ID NO: 18293 - DNA, 22 bp, Homo sapiens
caaatactacgattcttgcagt

SEQ ID NO: 18294 - DNA, 22 bp, Homo sapiens
tctgttgactcctagcagccat

SEQ ID NO: 18295 - DNA, 22 bp, Homo sapiens
tttgagatggagtcttgctctg

SEQ ID NO: 18296 - DNA, 19 bp, Homo sapiens
tctgaagaattagagagca

SEQ ID NO: 18297 - DNA, 19 bp, Homo sapiens
gcagacaggtccagagagg

SEQ ID NO: 18298 - DNA, 22 bp, Homo sapiens
cccactgtttccctgaggctct

SEQ ID NO: 18299 - DNA, 22 bp, Homo sapiens
cttcagctgcagttatgtttag

SEQ ID NO: 18300 - DNA, 22 bp, Homo sapiens
aggtcaccatggcatgctccac

SEQ ID NO: 18301 - DNA, 22 bp, Homo sapiens
aatgtgaggccttggtagttat

SEQ ID NO: 18302 - DNA, 22 bp, Homo sapiens
tagtttaggatccaatctaaga

SEQ ID NO: 18303 - DNA, 22 bp, Homo sapiens
agagctgggtggacttgtagtt

SEQ ID NO: 18304 - DNA, 22 bp, Homo sapiens
tcaccagatctctctgtaatgg

SEQ ID NO: 18305 - DNA, 22 bp, Homo sapiens
cacttgttggtggtgaaatcac

SEQ ID NO: 18306 - DNA, 22 bp, Homo sapiens
ctgggatgcggaggttgcggtg

SEQ ID NO: 18307 - DNA, 22 bp, Homo sapiens
attcgcgggcctggagggtggg

SEQ ID NO: 18308 - DNA, 22 bp, Homo sapiens
tgatattttatgagctttcata

SEQ ID NO: 18309 - DNA, 22 bp, Homo sapiens
gtagttctgcagtgtcacctga

SEQ ID NO: 18310 - DNA, 22 bp, Homo sapiens
cacccaggctggagtgcagtga

SEQ ID NO: 18311 - DNA, 22 bp, Homo sapiens
cacccaggctggaatgcagtgg

SEQ ID NO: 18312 - DNA, 22 bp, Homo sapiens
atcttcccaggctggggagagg

SEQ ID NO: 18313 - DNA, 22 bp, Homo sapiens
cggaggttgaggctgcagtgag

SEQ ID NO: 18314 - DNA, 22 bp, Homo sapiens
ctctgcctgtctcatcctgcaa

SEQ ID NO: 18315 - DNA, 22 bp, Homo sapiens
tctccgatcacaggttttcaat

SEQ ID NO: 18316 - DNA, 22 bp, Homo sapiens
ataaaatttgctactgttaaat

SEQ ID NO: 18317 - DNA, 22 bp, Homo sapiens
agattctaccagagctagtttg

SEQ ID NO: 18318 - DNA, 22 bp, Homo sapiens
ctgctgtttctcaaaattaagt

SEQ ID NO: 18319 - DNA, 22 bp, Homo sapiens
tttgaagggcacgacaatagtt

SEQ ID NO: 18320 - DNA, 22 bp, Homo sapiens
gtgctttgttaagtctgaaatt

SEQ ID NO: 18321 - DNA, 22 bp, Homo sapiens
ataccaccatctatgaaaggta

SEQ ID NO: 18322 - DNA, 22 bp, Homo sapiens
aaattacagccttgggtagctt

SEQ ID NO: 18323 - DNA, 22 bp, Homo sapiens
gattcactcatattttacgttt

SEQ ID NO: 18324 - DNA, 22 bp, Homo sapiens
ctgctgaggtggagattgcagt

SEQ ID NO: 18325 - DNA, 22 bp, Homo sapiens
catataaatacaacatgtgtta

SEQ ID NO: 18326 - DNA, 22 bp, Homo sapiens
gccactgtggtcctcccatgat

SEQ ID NO: 18327 - DNA, 22 bp, Homo sapiens
tactgtgtgcccagccgagctg

SEQ ID NO: 18328 - DNA, 20 bp, Homo sapiens
gttaggaggttggacatgga

SEQ ID NO: 18329 - DNA, 22 bp, Homo sapiens
tggtattacttctagacacaag

SEQ ID NO: 18330 - DNA, 22 bp, Homo sapiens
aggtcacccgtttgactatcca

SEQ ID NO: 18331 - DNA, 22 bp, Homo sapiens
atgctctctgtcctgctcagag

SEQ ID NO: 18332 - DNA, 22 bp, Homo sapiens
tctggtgtcagtattctttgaa

SEQ ID NO: 18333 - DNA, 22 bp, Homo sapiens
gcctccggagtcacagtgtctt

SEQ ID NO: 18334 - DNA, 20 bp, Homo sapiens
aactcctagcctcaagtgat

SEQ ID NO: 18335 - DNA, 22 bp, Homo sapiens
tcaaatctcatcttgaattgta

SEQ ID NO: 18336 - DNA, 22 bp, Homo sapiens
tgtccccacccaaatctcatct

SEQ ID NO: 18337 - DNA, 22 bp, Homo sapiens
gcctccggagttgcagtgtctt

SEQ ID NO: 18338 - DNA, 22 bp, Homo sapiens
tgacttgtctctttgggagaca

SEQ ID NO: 18339 - DNA, 22 bp, Homo sapiens
taagaaatttagttatagaatg

SEQ ID NO: 18340 - DNA, 22 bp, Homo sapiens
agttaagaatacacatcataat

SEQ ID NO: 18341 - DNA, 22 bp, Homo sapiens
gtggggacgggatggctcactg

SEQ ID NO: 18342 - DNA, 22 bp, Homo sapiens
agtgaggggcagctgagtgggc

SEQ ID NO: 18343 - DNA, 22 bp, Homo sapiens
aagaataagaggatttagaaca

SEQ ID NO: 18344 - DNA, 22 bp, Homo sapiens
tcctttgcttctgtcattctcc

SEQ ID NO: 18345 - DNA, 22 bp, Homo sapiens
tgagatgtaaggtatgcttact

SEQ ID NO: 18346 - DNA, 22 bp, Homo sapiens
ctttgctactgtgaatagtgcc

SEQ ID NO: 18347 - DNA, 22 bp, Homo sapiens
tttctttatcatagcatctttg

SEQ ID NO: 18348 - DNA, 22 bp, Homo sapiens
tcattgccatggcatttgcaga

SEQ ID NO: 18349 - DNA, 22 bp, Homo sapiens
cccagcaggtcggtgctgcctg

SEQ ID NO: 18350 - DNA, 22 bp, Homo sapiens
ttttcatttttgtagatgcaag

SEQ ID NO: 18351 - DNA, 22 bp, Homo sapiens
tgtgaaagatactaggcagagg

SEQ ID NO: 18352 - DNA, 22 bp, Homo sapiens
agtccaaagcagatgagggcca

SEQ ID NO: 18353 - DNA, 22 bp, Homo sapiens
gaggagctgcccgtgtgtctgc

SEQ ID NO: 18354 - DNA, 22 bp, Homo sapiens
agtgagagtattaatgtgaact

SEQ ID NO: 18355 - DNA, 22 bp, Homo sapiens
actttatttcctattgcatcca

SEQ ID NO: 18356 - DNA, 22 bp, Homo sapiens
tcagaacatgtttgagtaagac

SEQ ID NO: 18357 - DNA, 22 bp, Homo sapiens
tattagttgcaaaacattgact

SEQ ID NO: 18358 - DNA, 22 bp, Homo sapiens
aggtgactggtttatctggcag

SEQ ID NO: 18359 - DNA, 22 bp, Homo sapiens
cttccccaggacctctgctaaa

SEQ ID NO: 18360 - DNA, 22 bp, Homo sapiens
atttttctctttccactgagat

SEQ ID NO: 18361 - DNA, 22 bp, Homo sapiens
atatcactagagaagttgttaa

SEQ ID NO: 18362 - DNA, 20 bp, Homo sapiens
ttgcaactgtaagaagcagg

SEQ ID NO: 18363 - DNA, 23 bp, Homo sapiens
gggtccagccaattccaaggaaa

SEQ ID NO: 18364 - DNA, 22 bp, Homo sapiens
tcctggcttgtcacatctacgt

SEQ ID NO: 18365 - DNA, 21 bp, Homo sapiens
ggccgccgccttgtgctctgc

SEQ ID NO: 18366 - DNA, 22 bp, Homo sapiens
ttttctgtttgcttcaagacat

SEQ ID NO: 18367 - DNA, 22 bp, Homo sapiens
tcagcctgctccaagtgctgcc

SEQ ID NO: 18368 - DNA, 22 bp, Homo sapiens
ggtgtagctctgtgtcccactg

SEQ ID NO: 18369 - DNA, 22 bp, Homo sapiens
aagaaatgctgatgttggatgg

SEQ ID NO: 18370 - DNA, 22 bp, Homo sapiens
agtccggggtctggacacctgg

SEQ ID NO: 18371 - DNA, 22 bp, Homo sapiens
gaggagggagctggaagctctt

SEQ ID NO: 18372 - DNA, 22 bp, Homo sapiens
tggattcacaccattctcctgc

SEQ ID NO: 18373 - DNA, 22 bp, Homo sapiens
caggctggagtgcaatgacgcc

SEQ ID NO: 18374 - DNA, 22 bp, Homo sapiens
aaatggaagctatttatgattc

SEQ ID NO: 18375 - DNA, 22 bp, Homo sapiens
gtctgttttctcttctgtggga

SEQ ID NO: 18376 - DNA, 22 bp, Homo sapiens
atgtccttcctgagatccctgt

SEQ ID NO: 18377 - DNA, 22 bp, Homo sapiens
tcctgagataaatctcatgtga

SEQ ID NO: 18378 - DNA, 22 bp, Homo sapiens
ttcagcttgctgactgcggcag

SEQ ID NO: 18379 - DNA, 22 bp, Homo sapiens
acaatgaagctccactgagctt

SEQ ID NO: 18380 - DNA, 22 bp, Homo sapiens
cagggtttcaccatgttagcag

SEQ ID NO: 18381 - DNA, 22 bp, Homo sapiens
aaggagtctgggccattcagag

SEQ ID NO: 18382 - DNA, 22 bp, Homo sapiens
tacaaaggaggtgcatagaaca

SEQ ID NO: 18383 - DNA, 22 bp, Homo sapiens
tttttgggtccaggctgtatct

SEQ ID NO: 18384 - DNA, 22 bp, Homo sapiens
tcgtctgtgaaattgggataag

SEQ ID NO: 18385 - DNA, 22 bp, Homo sapiens
tggcccgaagatccgagggtca

SEQ ID NO: 18386 - DNA, 16 bp, Homo sapiens
tggggatggggaagag

SEQ ID NO: 18387 - DNA, 22 bp, Homo sapiens
tgctgagcccagaacggcctgg

SEQ ID NO: 18388 - DNA, 22 bp, Homo sapiens
gattgagtctgaggatgctgca

SEQ ID NO: 18389 - DNA, 22 bp, Homo sapiens
gaacgggtgcagccatgggccc

SEQ ID NO: 18390 - DNA, 22 bp, Homo sapiens
gtatgtgaggttggtttccagg

SEQ ID NO: 18391 - DNA, 22 bp, Homo sapiens
aagaaggcggaccagaagggag

SEQ ID NO: 18392 - DNA, 22 bp, Homo sapiens
gtgcatgtgtctttatagtagc

SEQ ID NO: 18393 - DNA, 22 bp, Homo sapiens
tgtgtgattgcaggagatgtgg

SEQ ID NO: 18394 - DNA, 22 bp, Homo sapiens
atgtatatgcatgcattcaaag

SEQ ID NO: 18395 - DNA, 22 bp, Homo sapiens
gcagggtctgaggccacagagg

SEQ ID NO: 18396 - DNA, 22 bp, Homo sapiens
aagggggcggcagccagtggaa

SEQ ID NO: 18397 - DNA, 22 bp, Homo sapiens
gaccttgtgctccgaggcgggc

SEQ ID NO: 18398 - DNA, 22 bp, Homo sapiens
cttagatgaagtcacagaaccc

SEQ ID NO: 18399 - DNA, 22 bp, Homo sapiens
tggaatggaaacaaactgagga

SEQ ID NO: 18400 - DNA, 22 bp, Homo sapiens
tgcctgtggaaaggctggtgct

SEQ ID NO: 18401 - DNA, 22 bp, Homo sapiens
aaatatcttaggagtatatgag

SEQ ID NO: 18402 - DNA, 22 bp, Homo sapiens
tgacttcctgcactcaggtgat

SEQ ID NO: 18403 - DNA, 22 bp, Homo sapiens
aaggagcgcttagggggcagaa

SEQ ID NO: 18404 - DNA, 22 bp, Homo sapiens
gggacgacaggctctgtggtag

SEQ ID NO: 18405 - DNA, 22 bp, Homo sapiens
ctggggaccagtgtctgtttgt

SEQ ID NO: 18406 - DNA, 20 bp, Homo sapiens
aggaaaaatggaaactggag

SEQ ID NO: 18407 - DNA, 22 bp, Homo sapiens
tgtctgggagactgatcacccg

SEQ ID NO: 18408 - DNA, 22 bp, Homo sapiens
agatttatgtggtcacactcag

SEQ ID NO: 18409 - DNA, 22 bp, Homo sapiens
gggaggttctgttcgcacttga

SEQ ID NO: 18410 - DNA, 22 bp, Homo sapiens
ggagagcttggagtgcgatttt

SEQ ID NO: 18411 - DNA, 22 bp, Homo sapiens
ggaagaaaggtggacaacaggt

SEQ ID NO: 18412 - DNA, 22 bp, Homo sapiens
tatactctgagaaacgtgtcac

SEQ ID NO: 18413 - DNA, 22 bp, Homo sapiens
gggtaaatctcttttcatggct

SEQ ID NO: 18414 - DNA, 22 bp, Homo sapiens
aacccaggagttggaggctgtg

SEQ ID NO: 18415 - DNA, 22 bp, Homo sapiens
cccacgtcgaacttgctccaga

SEQ ID NO: 18416 - DNA, 22 bp, Homo sapiens
ttacctaaaatagctcaattta

SEQ ID NO: 18417 - DNA, 22 bp, Homo sapiens
tgtaccactctactaagggttc

SEQ ID NO: 18418 - DNA, 22 bp, Homo sapiens
gtcacccgtttgactatccacc

SEQ ID NO: 18419 - DNA, 22 bp, Homo sapiens
tcatcagggatattggcctgaa

SEQ ID NO: 18420 - DNA, 22 bp, Homo sapiens
atggggggatgaaggagtccaa

SEQ ID NO: 18421 - DNA, 22 bp, Homo sapiens
aaagagactggtggcattttgc

SEQ ID NO: 18422 - DNA, 22 bp, Homo sapiens
ctaggtgatccactgctctctt

SEQ ID NO: 18423 - DNA, 22 bp, Homo sapiens
gtctgaatacgtacttgtgaag

SEQ ID NO: 18424 - DNA, 22 bp, Homo sapiens
gatttctctgcacccactcagg

SEQ ID NO: 18425 - DNA, 22 bp, Homo sapiens
caccagcagcggtgtgagggtg

SEQ ID NO: 18426 - DNA, 22 bp, Homo sapiens
gggaaagaccttcctggggtgt

SEQ ID NO: 18427 - DNA, 22 bp, Homo sapiens
aaattctgatttaataagtgta

SEQ ID NO: 18428 - DNA, 22 bp, Homo sapiens
attgagaagaaaatctaatata

SEQ ID NO: 18429 - DNA, 22 bp, Homo sapiens
ggagttgattttggatatatta

SEQ ID NO: 18430 - DNA, 22 bp, Homo sapiens
ggcatcttgttgctcaaatcta

SEQ ID NO: 18431 - DNA, 22 bp, Homo sapiens
ttcctgttcaggaaagttgtgt

SEQ ID NO: 18432 - DNA, 22 bp, Homo sapiens
ttgtctaatgagctccacttca

SEQ ID NO: 18433 - DNA, 22 bp, Homo sapiens
cccaggcttttctcttgcccca

SEQ ID NO: 18434 - DNA, 22 bp, Homo sapiens
gcctggattccttgtttctcag

SEQ ID NO: 18435 - DNA, 22 bp, Homo sapiens
tgggaaagtctttatttctctt

SEQ ID NO: 18436 - DNA, 22 bp, Homo sapiens
tgccgcagtgcggggagggccc

SEQ ID NO: 18437 - DNA, 22 bp, Homo sapiens
gggaagagggagctggaatgat

SEQ ID NO: 18438 - DNA, 22 bp, Homo sapiens
tgagaaattacttcagtgatgg

SEQ ID NO: 18439 - DNA, 22 bp, Homo sapiens
cggcatgggcgtccccctcact

SEQ ID NO: 18440 - DNA, 22 bp, Homo sapiens
caggcaggtcagtgaagaagga

SEQ ID NO: 18441 - DNA, 22 bp, Homo sapiens
atgtacataaaatgtataatga

SEQ ID NO: 18442 - DNA, 22 bp, Homo sapiens
gaagaaagatcaaatagtttcc

SEQ ID NO: 18443 - DNA, 22 bp, Homo sapiens
gcttccggagccaaaaggcccc

SEQ ID NO: 18444 - DNA, 22 bp, Homo sapiens
atacaaaaattagccgggagta

SEQ ID NO: 18445 - DNA, 22 bp, Homo sapiens
gcaggctgtctaaagttagagt

SEQ ID NO: 18446 - DNA, 22 bp, Homo sapiens
tacagtgcttggtatctagtaa

SEQ ID NO: 18447 - DNA, 22 bp, Homo sapiens
gccagcagcttcttctcatcct

SEQ ID NO: 18448 - DNA, 22 bp, Homo sapiens
cacccaggctggagtgcagtgg

SEQ ID NO: 18449 - DNA, 22 bp, Homo sapiens
cacatttttactgccaacttaa

SEQ ID NO: 18450 - DNA, 22 bp, Homo sapiens
tttacacagaggacactgggct

SEQ ID NO: 18451 - DNA, 22 bp, Homo sapiens
tcctgccgtcctccggggcctc

SEQ ID NO: 18452 - DNA, 22 bp, Homo sapiens
gcctcctggggtgccatcatct

SEQ ID NO: 18453 - DNA, 22 bp, Homo sapiens
ataaaaactgacccatcctttg

SEQ ID NO: 18454 - DNA, 22 bp, Homo sapiens
aggggatgcctagtggagtctc

SEQ ID NO: 18455 - DNA, 22 bp, Homo sapiens
ctgtgggatcccatgactttcc

SEQ ID NO: 18456 - DNA, 22 bp, Homo sapiens
ccgcccacactaaatatgagcg

SEQ ID NO: 18457 - DNA, 22 bp, Homo sapiens
caggaaggggctcactctggcc

SEQ ID NO: 18458 - DNA, 22 bp, Homo sapiens
tggaagggagctggaatttgga

SEQ ID NO: 18459 - DNA, 22 bp, Homo sapiens
cctactctgagcgcctccgcat

SEQ ID NO: 18460 - DNA, 22 bp, Homo sapiens
tgctgagcgcatccggcggccg

SEQ ID NO: 18461 - DNA, 22 bp, Homo sapiens
tgggcagggagctggaaccaca

SEQ ID NO: 18462 - DNA, 22 bp, Homo sapiens
tttgttttcaatgtgtcattca

SEQ ID NO: 18463 - DNA, 22 bp, Homo sapiens
actgccaatggtagtttgatgg

SEQ ID NO: 18464 - DNA, 18 bp, Homo sapiens
ggtgagggagctggaagc

SEQ ID NO: 18465 - DNA, 22 bp, Homo sapiens
ggacagaaaccatatgagtgta

SEQ ID NO: 18466 - DNA, 22 bp, Homo sapiens
gcaccaggtgcagccgggcccc

SEQ ID NO: 18467 - DNA, 22 bp, Homo sapiens
gcccagcacctctctcagggtt

SEQ ID NO: 18468 - DNA, 22 bp, Homo sapiens
gggacatctttctagtcagggt

SEQ ID NO: 18469 - DNA, 22 bp, Homo sapiens
tcagcaatcctcccacaggtgg

SEQ ID NO: 18470 - DNA, 22 bp, Homo sapiens
agaagccaccagctgaggaaga

SEQ ID NO: 18471 - DNA, 22 bp, Homo sapiens
tcagggattgcaaaattcatcc

SEQ ID NO: 18472 - DNA, 22 bp, Homo sapiens
agccaggatggtctcgatcggc

SEQ ID NO: 18473 - DNA, 22 bp, Homo sapiens
ttgctgttgatgatgtgataca

SEQ ID NO: 18474 - DNA, 22 bp, Homo sapiens
tgacatttcctagtgctttgtg

SEQ ID NO: 18475 - DNA, 22 bp, Homo sapiens
gggaagtgatggagccaggatt

SEQ ID NO: 18476 - DNA, 22 bp, Homo sapiens
ttcaatatgatattagctgtgg

SEQ ID NO: 18477 - DNA, 22 bp, Homo sapiens
ttgtgaaacattcatggatttg

SEQ ID NO: 18478 - DNA, 22 bp, Homo sapiens
tttcataatactgtacatgaaa

SEQ ID NO: 18479 - DNA, 22 bp, Homo sapiens
tgttcagaacaaaggtaaatga

SEQ ID NO: 18480 - DNA, 19 bp, Homo sapiens
tggctctgtcgaaggcaca

SEQ ID NO: 18481 - DNA, 22 bp, Homo sapiens
gagaaatgcatgcatgtcatca

SEQ ID NO: 18482 - DNA, 22 bp, Homo sapiens
ttggatgggcattaggaaagtc

SEQ ID NO: 18483 - DNA, 22 bp, Homo sapiens
tgtgactgaggctccaagctag

SEQ ID NO: 18484 - DNA, 22 bp, Homo sapiens
catcagaacgtgagctccttgt

SEQ ID NO: 18485 - DNA, 23 bp, Homo sapiens
tactatggttattatccctctcc

SEQ ID NO: 18486 - DNA, 22 bp, Homo sapiens
ggggatggaggcgtgtggtcct

SEQ ID NO: 18487 - DNA, 22 bp, Homo sapiens
taggcatgcaaataaatgtgca

SEQ ID NO: 18488 - DNA, 22 bp, Homo sapiens
ttgcatgttccaaagaattttg

SEQ ID NO: 18489 - DNA, 22 bp, Homo sapiens
gaggctggacgtgcatttctac

SEQ ID NO: 18490 - DNA, 22 bp, Homo sapiens
aagaggttgtctgtgatgagtt

SEQ ID NO: 18491 - DNA, 22 bp, Homo sapiens
agacccaggattggggctgccg

SEQ ID NO: 18492 - DNA, 23 bp, Homo sapiens
acagcaagaggaccagatgtgag

SEQ ID NO: 18493 - DNA, 22 bp, Homo sapiens
gatctgtgtgattggatgcatt

SEQ ID NO: 18494 - DNA, 22 bp, Homo sapiens
tcctcctgtctaccagttcctg

SEQ ID NO: 18495 - DNA, 22 bp, Homo sapiens
aggtggagaagagatgggcagt

SEQ ID NO: 18496 - DNA, 22 bp, Homo sapiens
ttccagttcactccatttctgg

SEQ ID NO: 18497 - DNA, 22 bp, Homo sapiens
gacaggaggcagagctcaggtg

SEQ ID NO: 18498 - DNA, 20 bp, Homo sapiens
tatttctgggcaaccattta

SEQ ID NO: 18499 - DNA, 22 bp, Homo sapiens
tgatctggtcctactgtgggca

SEQ ID NO: 18500 - DNA, 22 bp, Homo sapiens
ctgatcctcctttaagtagctg

SEQ ID NO: 18501 - DNA, 22 bp, Homo sapiens
tttacttcatttccagtgagga

SEQ ID NO: 18502 - DNA, 23 bp, Homo sapiens
gctcatcaggcttagagtcaagg

SEQ ID NO: 18503 - DNA, 22 bp, Homo sapiens
gactggaaagcctgtcctcaga

SEQ ID NO: 18504 - DNA, 22 bp, Homo sapiens
tgtgagactttctttggcctct

SEQ ID NO: 18505 - DNA, 22 bp, Homo sapiens
agcggcgccgagcttggccagg

SEQ ID NO: 18506 - DNA, 22 bp, Homo sapiens
accatgttggccaagctggtct

SEQ ID NO: 18507 - DNA, 22 bp, Homo sapiens
tggagaattctatgttgagggg

SEQ ID NO: 18508 - DNA, 22 bp, Homo sapiens
tcgtgaggctctgcatcgcaca

SEQ ID NO: 18509 - DNA, 22 bp, Homo sapiens
cattctgaccctatgatttaag

SEQ ID NO: 18510 - DNA, 22 bp, Homo sapiens
gaccaaggaagaggggagccag

SEQ ID NO: 18511 - DNA, 22 bp, Homo sapiens
tagtggatgttcagagatttga

SEQ ID NO: 18512 - DNA, 22 bp, Homo sapiens
tcacaacgcctctgcaaatcct

SEQ ID NO: 18513 - DNA, 22 bp, Homo sapiens
tgggaatgcaaggaaagctgtt

SEQ ID NO: 18514 - DNA, 22 bp, Homo sapiens
cctggcaggtggcgccctcggc

SEQ ID NO: 18515 - DNA, 22 bp, Homo sapiens
tgatctttggtaatctggcaca

SEQ ID NO: 18516 - DNA, 22 bp, Homo sapiens
cgtcacttcttagtctattttc

SEQ ID NO: 18517 - DNA, 22 bp, Homo sapiens
aggagggagcttaagccaggca

SEQ ID NO: 18518 - DNA, 22 bp, Homo sapiens
atgaaaacggaccagagctatt

SEQ ID NO: 18519 - DNA, 22 bp, Homo sapiens
gaagccttgaactgcaaacccc

SEQ ID NO: 18520 - DNA, 22 bp, Homo sapiens
tctgttgcaatgtgcatggtga

SEQ ID NO: 18521 - DNA, 23 bp, Homo sapiens
aatggtcttcctccacccctctg

SEQ ID NO: 18522 - DNA, 22 bp, Homo sapiens
gtgctgtttgggagaaggttct

SEQ ID NO: 18523 - DNA, 22 bp, Homo sapiens
cccaggaggcctgcctggccgg

SEQ ID NO: 18524 - DNA, 22 bp, Homo sapiens
tccgggcaactgaagggaggtt

SEQ ID NO: 18525 - DNA, 22 bp, Homo sapiens
ctgggaggcagaggttgcagtg

SEQ ID NO: 18526 - DNA, 22 bp, Homo sapiens
agtgtgttgtaggctcaaatgg

SEQ ID NO: 18527 - DNA, 22 bp, Homo sapiens
cggctggtgtcgggcacagcaa

SEQ ID NO: 18528 - DNA, 22 bp, Homo sapiens
ttgcactataggaaaatgtgtc

SEQ ID NO: 18529 - DNA, 22 bp, Homo sapiens
aagtgatgctacgactttgaca

SEQ ID NO: 18530 - DNA, 22 bp, Homo sapiens
gtgtgacctcatcttaactgga

SEQ ID NO: 18531 - DNA, 22 bp, Homo sapiens
cagtggcgtgatctctgctcac

SEQ ID NO: 18532 - DNA, 22 bp, Homo sapiens
tcagtctttccctccctcagtt

SEQ ID NO: 18533 - DNA, 22 bp, Homo sapiens
ctgaggctggagtgcagtggtg

SEQ ID NO: 18534 - DNA, 22 bp, Homo sapiens
tggtgccatcatagctcactgc

SEQ ID NO: 18535 - DNA, 22 bp, Homo sapiens
agagcacggccaccatttacaa

SEQ ID NO: 18536 - DNA, 22 bp, Homo sapiens
tttagcgtagctgacagctaat

SEQ ID NO: 18537 - DNA, 22 bp, Homo sapiens
cactgcactccagcccgggcaa

SEQ ID NO: 18538 - DNA, 19 bp, Homo sapiens
cataatacagtggatctga

SEQ ID NO: 18539 - DNA, 22 bp, Homo sapiens
tgggaagggtcaacagctggaa

SEQ ID NO: 18540 - DNA, 22 bp, Homo sapiens
ttgctgacctttgctctccgtt

SEQ ID NO: 18541 - DNA, 22 bp, Homo sapiens
aaggcaggatgggaaaagattt

SEQ ID NO: 18542 - DNA, 22 bp, Homo sapiens
gccgggttcaagccattctcct

SEQ ID NO: 18543 - DNA, 22 bp, Homo sapiens
ctggacacactggagtctggca

SEQ ID NO: 18544 - DNA, 22 bp, Homo sapiens
cagagagaatcttggcagctga

SEQ ID NO: 18545 - DNA, 22 bp, Homo sapiens
taacaaagtattgtttgtgtat

SEQ ID NO: 18546 - DNA, 22 bp, Homo sapiens
caggccagggttgagaagagaa

SEQ ID NO: 18547 - DNA, 22 bp, Homo sapiens
gtcaggactctgacccgtcccg

SEQ ID NO: 18548 - DNA, 22 bp, Homo sapiens
gccaggctgaggctctggaaga

SEQ ID NO: 18549 - DNA, 22 bp, Homo sapiens
atacaaagtattgatcctgagt

SEQ ID NO: 18550 - DNA, 23 bp, Homo sapiens
gtgcatgtgtctttacagtagca

SEQ ID NO: 18551 - DNA, 22 bp, Homo sapiens
ggctgtggagctgcagagttgg

SEQ ID NO: 18552 - DNA, 22 bp, Homo sapiens
agcctgcgatcccacctggcct

SEQ ID NO: 18553 - DNA, 22 bp, Homo sapiens
ttcgactctgtgcctgaagagc

SEQ ID NO: 18554 - DNA, 22 bp, Homo sapiens
gggcaggaacaaatcaaatgat

SEQ ID NO: 18555 - DNA, 22 bp, Homo sapiens
gccttgtttcattacacgtggt

SEQ ID NO: 18556 - DNA, 22 bp, Homo sapiens
gcagcgaggtgatgaaatagct

SEQ ID NO: 18557 - DNA, 21 bp, Homo sapiens
ccgtgctcggctatggaccac

SEQ ID NO: 18558 - DNA, 22 bp, Homo sapiens
gaaagacatagttgcaagatgg

SEQ ID NO: 18559 - DNA, 22 bp, Homo sapiens
ttgtgggatctccctgttgctc

SEQ ID NO: 18560 - DNA, 22 bp, Homo sapiens
cacagagctggaaaggctgggc

SEQ ID NO: 18561 - DNA, 22 bp, Homo sapiens
gttatataagacaaatcagagt

SEQ ID NO: 18562 - DNA, 22 bp, Homo sapiens
atccccctcttggatggcggca

SEQ ID NO: 18563 - DNA, 22 bp, Homo sapiens
caaatgtataaatgtactttct

SEQ ID NO: 18564 - DNA, 19 bp, Homo sapiens
ttcacattggaagaagtag

SEQ ID NO: 18565 - DNA, 22 bp, Homo sapiens
ggtaccaccaattcagctgcca

SEQ ID NO: 18566 - DNA, 22 bp, Homo sapiens
ggctccaccctgcttccagaag

SEQ ID NO: 18567 - DNA, 22 bp, Homo sapiens
tgtcaatatgtaataactgaat

SEQ ID NO: 18568 - DNA, 22 bp, Homo sapiens
gcttcaaactgagcttcaagtg

SEQ ID NO: 18569 - DNA, 22 bp, Homo sapiens
gctgtgtatcagatgccacggg

SEQ ID NO: 18570 - DNA, 22 bp, Homo sapiens
tgtctgttattggtgtataaga

SEQ ID NO: 18571 - DNA, 22 bp, Homo sapiens
tgaagaaacgcagagaggtagg

SEQ ID NO: 18572 - DNA, 22 bp, Homo sapiens
cttgtgcttttatgaatgcaga

SEQ ID NO: 18573 - DNA, 23 bp, Homo sapiens
gttttacaggtgagaaaatggag

SEQ ID NO: 18574 - DNA, 22 bp, Homo sapiens
tgtgactggttgtcccgctttc

SEQ ID NO: 18575 - DNA, 22 bp, Homo sapiens
tgtaagtagtaatggaaggaca

SEQ ID NO: 18576 - DNA, 22 bp, Homo sapiens
gtgtcctttccgggcctggagg

SEQ ID NO: 18577 - DNA, 19 bp, Homo sapiens
aggaatggaattaattctg

SEQ ID NO: 18578 - DNA, 22 bp, Homo sapiens
agaggctgcacttgctcatgat

SEQ ID NO: 18579 - DNA, 22 bp, Homo sapiens
ctagggtcaggggcctgcgtcg

SEQ ID NO: 18580 - DNA, 22 bp, Homo sapiens
gaaggaagtcattagtgcagac

SEQ ID NO: 18581 - DNA, 22 bp, Homo sapiens
aagcagagaatctgggagcgag

SEQ ID NO: 18582 - DNA, 22 bp, Homo sapiens
gggccatgagaggttcatcaac

SEQ ID NO: 18583 - DNA, 20 bp, Homo sapiens
gggcagagccagccagtccc

SEQ ID NO: 18584 - DNA, 22 bp, Homo sapiens
aggggatggagctggaaggcag

SEQ ID NO: 18585 - DNA, 22 bp, Homo sapiens
gtgtctcttagcctgctaatgc

SEQ ID NO: 18586 - DNA, 22 bp, Homo sapiens
tgtggacgtcattaaagcagtg

SEQ ID NO: 18587 - DNA, 22 bp, Homo sapiens
cccaggccccagggcttgtcag

SEQ ID NO: 18588 - DNA, 22 bp, Homo sapiens
tcaaattgtcatcttgataatg

SEQ ID NO: 18589 - DNA, 22 bp, Homo sapiens
cctggagagctcgggccaggca

SEQ ID NO: 18590 - DNA, 22 bp, Homo sapiens
tgtctggtgggttgacaggcag

SEQ ID NO: 18591 - DNA, 22 bp, Homo sapiens
aatggctctgatgttgttgtga

SEQ ID NO: 18592 - DNA, 22 bp, Homo sapiens
atcattatcctcctatttgcct

SEQ ID NO: 18593 - DNA, 22 bp, Homo sapiens
tgacagtgcgggtacatcatag

SEQ ID NO: 18594 - DNA, 22 bp, Homo sapiens
tttcactcagctctcattgtct

SEQ ID NO: 18595 - DNA, 22 bp, Homo sapiens
ttttctcttccctctggacctg

SEQ ID NO: 18596 - DNA, 22 bp, Homo sapiens
gggagaagaatgtgtcaattgt

SEQ ID NO: 18597 - DNA, 22 bp, Homo sapiens
tacaacaatttccacattagaa

SEQ ID NO: 18598 - DNA, 22 bp, Homo sapiens
acatcatttgtctgtagctgaa

SEQ ID NO: 18599 - DNA, 22 bp, Homo sapiens
gacctcgtgatctgccagcctt

SEQ ID NO: 18600 - DNA, 22 bp, Homo sapiens
ttctgtgaatcttttttcccac

SEQ ID NO: 18601 - DNA, 22 bp, Homo sapiens
tctcctggagcccagatgctgg

SEQ ID NO: 18602 - DNA, 22 bp, Homo sapiens
aggagctgtcagagtgccagag

SEQ ID NO: 18603 - DNA, 18 bp, Homo sapiens
tgggaatgctcaaggccc

SEQ ID NO: 18604 - DNA, 22 bp, Homo sapiens
tgtggccattcttgaggtcgac

SEQ ID NO: 18605 - DNA, 18 bp, Homo sapiens
gaggatggaaggagatgc

SEQ ID NO: 18606 - DNA, 22 bp, Homo sapiens
gggatctgggacaacaggtggt

SEQ ID NO: 18607 - DNA, 22 bp, Homo sapiens
aagaagagaactggcatcctaa

SEQ ID NO: 18608 - DNA, 22 bp, Homo sapiens
ttgctctgactggagtgcagtg

SEQ ID NO: 18609 - DNA, 22 bp, Homo sapiens
tgaaatcttcactaagtctctt

SEQ ID NO: 18610 - DNA, 22 bp, Homo sapiens
attgaaaataaggccagaaaca

SEQ ID NO: 18611 - DNA, 22 bp, Homo sapiens
ttcattcttttacatgtgaata

SEQ ID NO: 18612 - DNA, 22 bp, Homo sapiens
gagggggctagcgcagtgccca

SEQ ID NO: 18613 - DNA, 22 bp, Homo sapiens
cctgccctgctcactgtcggta

SEQ ID NO: 18614 - DNA, 22 bp, Homo sapiens
cggtcaggtgcagcgttggcac

SEQ ID NO: 18615 - DNA, 22 bp, Homo sapiens
tttgaaatgtatcagtataggt

SEQ ID NO: 18616 - DNA, 22 bp, Homo sapiens
cctcgacctccccaggctcagg

SEQ ID NO: 18617 - DNA, 22 bp, Homo sapiens
aatataacacagatggcctgtt

SEQ ID NO: 18618 - DNA, 22 bp, Homo sapiens
tggagggcatgctgtccatggg

SEQ ID NO: 18619 - DNA, 22 bp, Homo sapiens
aaggagaaatggtagatgtgca

SEQ ID NO: 18620 - DNA, 22 bp, Homo sapiens
atggtcacaccactgtactcca

SEQ ID NO: 18621 - DNA, 22 bp, Homo sapiens
gggggagagacgagcggctctg

SEQ ID NO: 18622 - DNA, 22 bp, Homo sapiens
atatacacatctttttaaatat

SEQ ID NO: 18623 - DNA, 20 bp, Homo sapiens
ggtcactgtggctgcaggat

SEQ ID NO: 18624 - DNA, 22 bp, Homo sapiens
ttggaagacaatgctgattctc

SEQ ID NO: 18625 - DNA, 22 bp, Homo sapiens
tgagaattacaaatgagtcaca

SEQ ID NO: 18626 - DNA, 22 bp, Homo sapiens
tttgtcttatccaatctctcag

SEQ ID NO: 18627 - DNA, 22 bp, Homo sapiens
agaggaagtaatcaggacctgc

SEQ ID NO: 18628 - DNA, 22 bp, Homo sapiens
gttgcagatgtggaactcgtgc

SEQ ID NO: 18629 - DNA, 22 bp, Homo sapiens
atggatttgcttatacacatgt

SEQ ID NO: 18630 - DNA, 22 bp, Homo sapiens
gggagctggagctggaagactc

SEQ ID NO: 18631 - DNA, 22 bp, Homo sapiens
gtgggggagatgcttaggtccg

SEQ ID NO: 18632 - DNA, 22 bp, Homo sapiens
agcccaggtccagttcactgca

SEQ ID NO: 18633 - DNA, 22 bp, Homo sapiens
cgtgtgttgaaagatgtacatc

SEQ ID NO: 18634 - DNA, 22 bp, Homo sapiens
aaaagttattgatgcaggacaa

SEQ ID NO: 18635 - DNA, 22 bp, Homo sapiens
aaggaaagctgtggttctgaga

SEQ ID NO: 18636 - DNA, 22 bp, Homo sapiens
ctgctctgctgatcagtgtctc

SEQ ID NO: 18637 - DNA, 22 bp, Homo sapiens
tggcactgaagctggaaagcct

SEQ ID NO: 18638 - DNA, 19 bp, Homo sapiens
catctggatgattctcctg

SEQ ID NO: 18639 - DNA, 18 bp, Homo sapiens
tcttcatctcctgagctg

SEQ ID NO: 18640 - DNA, 22 bp, Homo sapiens
aagacacaatgtagcccagcac

SEQ ID NO: 18641 - DNA, 22 bp, Homo sapiens
cccacgttgaaccgcttacaga

SEQ ID NO: 18642 - DNA, 22 bp, Homo sapiens
atgttggagtcgtaaggcatgg

SEQ ID NO: 18643 - DNA, 22 bp, Homo sapiens
cagggcctcctaaggcatctaa

SEQ ID NO: 18644 - DNA, 22 bp, Homo sapiens
tgcgcctgtaagtccagagtcc

SEQ ID NO: 18645 - DNA, 22 bp, Homo sapiens
ggggccgaccgcggttcaggcc

SEQ ID NO: 18646 - DNA, 22 bp, Homo sapiens
ggtccccgtggaggctggagcg

SEQ ID NO: 18647 - DNA, 22 bp, Homo sapiens
tatttcttttcgtgacttattg

SEQ ID NO: 18648 - DNA, 22 bp, Homo sapiens
gaactttgcgcagttcccgggg

SEQ ID NO: 18649 - DNA, 22 bp, Homo sapiens
actttcttggtcccatgtttga

SEQ ID NO: 18650 - DNA, 22 bp, Homo sapiens
gaggggctgccctggtgtcagg

SEQ ID NO: 18651 - DNA, 22 bp, Homo sapiens
caggcagggagctggaaaggat

SEQ ID NO: 18652 - DNA, 22 bp, Homo sapiens
catctgctgttccttggactca

SEQ ID NO: 18653 - DNA, 22 bp, Homo sapiens
attataggcttgagccaccgtg

SEQ ID NO: 18654 - DNA, 22 bp, Homo sapiens
tcctcagcttttatttcacttg

SEQ ID NO: 18655 - DNA, 22 bp, Homo sapiens
agaagcagaaactgggcttgtg

SEQ ID NO: 18656 - DNA, 22 bp, Homo sapiens
gagcctggagctggaacgaagc

SEQ ID NO: 18657 - DNA, 22 bp, Homo sapiens
gttgctcaggcaggagtacagt

SEQ ID NO: 18658 - DNA, 22 bp, Homo sapiens
ggcagcactgcagcttgttggg

SEQ ID NO: 18659 - DNA, 22 bp, Homo sapiens
ctctttggatagaattacaaag

SEQ ID NO: 18660 - DNA, 22 bp, Homo sapiens
atgagttgaagctacaagaggc

SEQ ID NO: 18661 - DNA, 22 bp, Homo sapiens
tgtgcatgtttgttttcagggt

SEQ ID NO: 18662 - DNA, 22 bp, Homo sapiens
gtacagaggttgctggaggctc

SEQ ID NO: 18663 - DNA, 22 bp, Homo sapiens
tggcctcggcatccagcaagag

SEQ ID NO: 18664 - DNA, 22 bp, Homo sapiens
agctcctgaaaatccagactgg

SEQ ID NO: 18665 - DNA, 22 bp, Homo sapiens
tgggctttgagctcggtcacct

SEQ ID NO: 18666 - DNA, 22 bp, Homo sapiens
tggagataggctgaggcagggc

SEQ ID NO: 18667 - DNA, 22 bp, Homo sapiens
tccttcactccctctgcatcca

SEQ ID NO: 18668 - DNA, 22 bp, Homo sapiens
cccagcaggaggaggttgcagt

SEQ ID NO: 18669 - DNA, 22 bp, Homo sapiens
tggccaccaccaatacttgcct

SEQ ID NO: 18670 - DNA, 22 bp, Homo sapiens
ggagaagaggagctggaagcct

SEQ ID NO: 18671 - DNA, 20 bp, Homo sapiens
ttggatgtgcatggccgtgc

SEQ ID NO: 18672 - DNA, 17 bp, Homo sapiens
gagattttcgtcctgaa

SEQ ID NO: 18673 - DNA, 22 bp, Homo sapiens
tccaggctttggggcaggagcg

SEQ ID NO: 18674 - DNA, 22 bp, Homo sapiens
ggaggggatttagtagatgcta

SEQ ID NO: 18675 - DNA, 19 bp, Homo sapiens
agggaatccggctgaggga

SEQ ID NO: 18676 - DNA, 22 bp, Homo sapiens
tgtgcctagttctgtatttaca

SEQ ID NO: 18677 - DNA, 18 bp, Homo sapiens
tttctcagactctctttc

SEQ ID NO: 18678 - DNA, 22 bp, Homo sapiens
gccgggaccaaggccacggagc

SEQ ID NO: 18679 - DNA, 22 bp, Homo sapiens
tggggtacttgtatcaaagcac

SEQ ID NO: 18680 - DNA, 22 bp, Homo sapiens
ttgtgaatagtgctgcaataaa

SEQ ID NO: 18681 - DNA, 22 bp, Homo sapiens
gtccttccacatggccaacttc

SEQ ID NO: 18682 - DNA, 22 bp, Homo sapiens
tgagatgaataactcctgctaa

SEQ ID NO: 18683 - DNA, 22 bp, Homo sapiens
gtttctggcgccggggcaggcc

SEQ ID NO: 18684 - DNA, 22 bp, Homo sapiens
gttaggtagaagtttactttga

SEQ ID NO: 18685 - DNA, 22 bp, Homo sapiens
agcataagttggtacagccact

SEQ ID NO: 18686 - DNA, 22 bp, Homo sapiens
tgtgggtggcatcgtcctggcc

SEQ ID NO: 18687 - DNA, 22 bp, Homo sapiens
aaagaaatagatggcatttaaa

SEQ ID NO: 18688 - DNA, 22 bp, Homo sapiens
cccaggctggagtgtaatggtg

SEQ ID NO: 18689 - DNA, 22 bp, Homo sapiens
aaattgcaaaagtacttttagg

SEQ ID NO: 18690 - DNA, 22 bp, Homo sapiens
gagtggggggtccgtctcagtg

SEQ ID NO: 18691 - DNA, 22 bp, Homo sapiens
tattgtccaataggatgttcct

SEQ ID NO: 18692 - DNA, 22 bp, Homo sapiens
actgcaacctccgcctgccagg

SEQ ID NO: 18693 - DNA, 22 bp, Homo sapiens
atcatccaagcgtagttcttct

SEQ ID NO: 18694 - DNA, 22 bp, Homo sapiens
tgcctgtgtcagcaggtggaag

SEQ ID NO: 18695 - DNA, 22 bp, Homo sapiens
ggtcacgtgaccgcacctgcct

SEQ ID NO: 18696 - DNA, 22 bp, Homo sapiens
agagaagagtcttgtcaaatta

SEQ ID NO: 18697 - DNA, 22 bp, Homo sapiens
attttctatgttgtaattgtta

SEQ ID NO: 18698 - DNA, 22 bp, Homo sapiens
ttctgattgctgatgaggccca

SEQ ID NO: 18699 - DNA, 22 bp, Homo sapiens
gatctggaatctgaaggctgag

SEQ ID NO: 18700 - DNA, 22 bp, Homo sapiens
ctctggcaattgctgctgactc

SEQ ID NO: 18701 - DNA, 22 bp, Homo sapiens
ggaggagcatgagagggtagtg

SEQ ID NO: 18702 - DNA, 22 bp, Homo sapiens
ttgcaattgctatggagagcgt

SEQ ID NO: 18703 - DNA, 22 bp, Homo sapiens
ggccttggttccaaagcaggca

SEQ ID NO: 18704 - DNA, 22 bp, Homo sapiens
tggaaagaaagtaaaggcgtat

SEQ ID NO: 18705 - DNA, 22 bp, Homo sapiens
ggtgtgtctgccaggaactgca

SEQ ID NO: 18706 - DNA, 22 bp, Homo sapiens
tgagtgtggggaatgtcatgag

SEQ ID NO: 18707 - DNA, 18 bp, Homo sapiens
ggctgtggacaagattag

SEQ ID NO: 18708 - DNA, 22 bp, Homo sapiens
cttgatctacatagtgaaaccc

SEQ ID NO: 18709 - DNA, 22 bp, Homo sapiens
cttcctctgtggccagagtgta

SEQ ID NO: 18710 - DNA, 22 bp, Homo sapiens
ataaagtggaggtagtattcat

SEQ ID NO: 18711 - DNA, 22 bp, Homo sapiens
ctggcaggttatagagctgccc

SEQ ID NO: 18712 - DNA, 22 bp, Homo sapiens
acctcctggcctcaagcaatcc

SEQ ID NO: 18713 - DNA, 22 bp, Homo sapiens
aagacttgaccaggttgaaggc

SEQ ID NO: 18714 - DNA, 22 bp, Homo sapiens
agagaggtctcaggagaaacca

SEQ ID NO: 18715 - DNA, 22 bp, Homo sapiens
actgcaacacctcctgggttca

SEQ ID NO: 18716 - DNA, 22 bp, Homo sapiens
agcccttagtacatttctcaag

SEQ ID NO: 18717 - DNA, 22 bp, Homo sapiens
ctggctgggagcgagctgctca

SEQ ID NO: 18718 - DNA, 20 bp, Homo sapiens
acgtggccaccagtggctta

SEQ ID NO: 18719 - DNA, 22 bp, Homo sapiens
agggccagcactcctggcagga

SEQ ID NO: 18720 - DNA, 22 bp, Homo sapiens
cccaggccctggcagagcttgt

SEQ ID NO: 18721 - DNA, 22 bp, Homo sapiens
cggtctcccgtgtgtgtgcgct

SEQ ID NO: 18722 - DNA, 22 bp, Homo sapiens
tcccagaaccctgccaggtcct

SEQ ID NO: 18723 - DNA, 22 bp, Homo sapiens
atatgcagtctcttgcccttct

SEQ ID NO: 18724 - DNA, 22 bp, Homo sapiens
agagcagctcgctacctctcta

SEQ ID NO: 18725 - DNA, 22 bp, Homo sapiens
tgttatatctaaatagccacat

SEQ ID NO: 18726 - DNA, 22 bp, Homo sapiens
acaggggacctaggaccctcgg

SEQ ID NO: 18727 - DNA, 22 bp, Homo sapiens
atgtttcaataatgctgtgagt

SEQ ID NO: 18728 - DNA, 22 bp, Homo sapiens
aggtcacgtcctgtgatgtcat

SEQ ID NO: 18729 - DNA, 22 bp, Homo sapiens
gatgcgggcccgctccactgcc

SEQ ID NO: 18730 - DNA, 22 bp, Homo sapiens
aacccgagggccccaggctcgg

SEQ ID NO: 18731 - DNA, 22 bp, Homo sapiens
tctgctcagccgatctgctccg

SEQ ID NO: 18732 - DNA, 22 bp, Homo sapiens
tatttgtctggtctaaggaggg

SEQ ID NO: 18733 - DNA, 22 bp, Homo sapiens
gtgcatgtcggggtgcatgtca

SEQ ID NO: 18734 - DNA, 22 bp, Homo sapiens
gggaggttgaggctgcagtgag

SEQ ID NO: 18735 - DNA, 19 bp, Homo sapiens
ctgtccttggctgcactgt

SEQ ID NO: 18736 - DNA, 22 bp, Homo sapiens
gtgtttgttcgtgactccaaag

SEQ ID NO: 18737 - DNA, 22 bp, Homo sapiens
gcttggaagtaggattgggaga

SEQ ID NO: 18738 - DNA, 22 bp, Homo sapiens
gttactcctggttgagcttggt

SEQ ID NO: 18739 - DNA, 22 bp, Homo sapiens
ctccagttggccccagttggtt

SEQ ID NO: 18740 - DNA, 22 bp, Homo sapiens
gtgtttggtcagacgtccgggg

SEQ ID NO: 18741 - DNA, 22 bp, Homo sapiens
ggctcactgcaaactgtgcctc

SEQ ID NO: 18742 - DNA, 18 bp, Homo sapiens
cagctgccagctcatgga

SEQ ID NO: 18743 - DNA, 22 bp, Homo sapiens
aatgtgagccaatgcccgtggg

SEQ ID NO: 18744 - DNA, 22 bp, Homo sapiens
gtggatggccctgcacacaggt

SEQ ID NO: 18745 - DNA, 21 bp, Homo sapiens
acagcctccatctcctgggct

SEQ ID NO: 18746 - DNA, 22 bp, Homo sapiens
atggggaagcaattggatttcc

SEQ ID NO: 18747 - DNA, 22 bp, Homo sapiens
gctggggaggcagcagagaaca

SEQ ID NO: 18748 - DNA, 22 bp, Homo sapiens
atctagattaggtataagagct

SEQ ID NO: 18749 - DNA, 22 bp, Homo sapiens
actcatgtaagcggaatgtagt

SEQ ID NO: 18750 - DNA, 22 bp, Homo sapiens
tggacaacatagtgagacctca

SEQ ID NO: 18751 - DNA, 22 bp, Homo sapiens
tttaagaagttatgttataaat

SEQ ID NO: 18752 - DNA, 22 bp, Homo sapiens
attgtgaataatgctgcaataa

SEQ ID NO: 18753 - DNA, 22 bp, Homo sapiens
ccaggattggaggctgtggtga

SEQ ID NO: 18754 - DNA, 22 bp, Homo sapiens
gcctcactgcagccccaggaag

SEQ ID NO: 18755 - DNA, 22 bp, Homo sapiens
ggcctgtaatcccagctactca

SEQ ID NO: 18756 - DNA, 22 bp, Homo sapiens
ttcctgggattattgtcaagca

SEQ ID NO: 18757 - DNA, 22 bp, Homo sapiens
tcccgttgatgacggtgcatcc

SEQ ID NO: 18758 - DNA, 22 bp, Homo sapiens
atccccctgtatctggaagaat

SEQ ID NO: 18759 - DNA, 22 bp, Homo sapiens
cactgcactccatcctgggaaa

SEQ ID NO: 18760 - DNA, 22 bp, Homo sapiens
gtctctatcatagctgaaccct

SEQ ID NO: 18761 - DNA, 22 bp, Homo sapiens
ctgggaggcggagcttgcagtg

SEQ ID NO: 18762 - DNA, 22 bp, Homo sapiens
ctccccattatgcagtcattat

SEQ ID NO: 18763 - DNA, 22 bp, Homo sapiens
agcgccactgcactccagcctg

SEQ ID NO: 18764 - DNA, 22 bp, Homo sapiens
caattcccagctgccgggctgc

SEQ ID NO: 18765 - DNA, 22 bp, Homo sapiens
gagctctgactgctgggtgaca

SEQ ID NO: 18766 - DNA, 22 bp, Homo sapiens
ctcttcctagtgtgcagcgtgg

SEQ ID NO: 18767 - DNA, 22 bp, Homo sapiens
cagctacaaatacttttgtatg

SEQ ID NO: 18768 - DNA, 22 bp, Homo sapiens
gcagcctgggcaacagagtgag

SEQ ID NO: 18769 - DNA, 22 bp, Homo sapiens
tgagccagaggaggctgtgtgg

SEQ ID NO: 18770 - DNA, 22 bp, Homo sapiens
tattgagaccagtgcttgctta

SEQ ID NO: 18771 - DNA, 22 bp, Homo sapiens
tgtgttgtgacattcttggatg

SEQ ID NO: 18772 - DNA, 22 bp, Homo sapiens
atcacaaaggtctcagagcaca

SEQ ID NO: 18773 - DNA, 22 bp, Homo sapiens
atcaagtgaagggctcttgaag

SEQ ID NO: 18774 - DNA, 23 bp, Homo sapiens
tcagaacagttcttggtgcatag

SEQ ID NO: 18775 - DNA, 22 bp, Homo sapiens
ttccgctgtttagttgaagttt

SEQ ID NO: 18776 - DNA, 22 bp, Homo sapiens
gggccctgggattcagagcaag

SEQ ID NO: 18777 - DNA, 22 bp, Homo sapiens
gctcgcgccgcaccggtccacc

SEQ ID NO: 18778 - DNA, 20 bp, Homo sapiens
agcagagtgcccatcccgga

SEQ ID NO: 18779 - DNA, 22 bp, Homo sapiens
agggaagaggaccagagtctct

SEQ ID NO: 18780 - DNA, 22 bp, Homo sapiens
aaaaaattatcatagttcctga

SEQ ID NO: 18781 - DNA, 21 bp, Homo sapiens
taaacataaccttgtatggct

SEQ ID NO: 18782 - DNA, 22 bp, Homo sapiens
aggccttaccatagctgtagca

SEQ ID NO: 18783 - DNA, 22 bp, Homo sapiens
aacctcaaactcttgggcttaa

SEQ ID NO: 18784 - DNA, 22 bp, Homo sapiens
gagagagctctgtgcctgggat

SEQ ID NO: 18785 - DNA, 22 bp, Homo sapiens
cagccacttgtgatgctgggga

SEQ ID NO: 18786 - DNA, 22 bp, Homo sapiens
aggtcaagagtaaatttgggta

SEQ ID NO: 18787 - DNA, 22 bp, Homo sapiens
tgacatctgtcataaaatgtat

SEQ ID NO: 18788 - DNA, 22 bp, Homo sapiens
gttttgaatactactagaactt

SEQ ID NO: 18789 - DNA, 22 bp, Homo sapiens
tcttatacccctaaactgcagc

SEQ ID NO: 18790 - DNA, 22 bp, Homo sapiens
aagtcattggtagcttgatagg

SEQ ID NO: 18791 - DNA, 22 bp, Homo sapiens
gggaagatagtgttgagggccc

SEQ ID NO: 18792 - DNA, 22 bp, Homo sapiens
tgaagctttaggatgggttcat

SEQ ID NO: 18793 - DNA, 22 bp, Homo sapiens
gtgttaaccagctaaactttgc

SEQ ID NO: 18794 - DNA, 22 bp, Homo sapiens
tgctcgccccacatgccctcat

SEQ ID NO: 18795 - DNA, 22 bp, Homo sapiens
gaggcagaggttgcagtgagct

SEQ ID NO: 18796 - DNA, 22 bp, Homo sapiens
acagattcactgcactggccat

SEQ ID NO: 18797 - DNA, 22 bp, Homo sapiens
attcttcctcatcaatctgtag

SEQ ID NO: 18798 - DNA, 22 bp, Homo sapiens
tatgcttattgtctcatccact

SEQ ID NO: 18799 - DNA, 22 bp, Homo sapiens
ggaggagacagtaaaaagcacg

SEQ ID NO: 18800 - DNA, 22 bp, Homo sapiens
ggctgtggcagctggaagtggt

SEQ ID NO: 18801 - DNA, 22 bp, Homo sapiens
gagctcatccccatggtccgtc

SEQ ID NO: 18802 - DNA, 22 bp, Homo sapiens
atggtcaccttgggagcctgct

SEQ ID NO: 18803 - DNA, 22 bp, Homo sapiens
acaattctgatggtttcccagt

SEQ ID NO: 18804 - DNA, 22 bp, Homo sapiens
gggaagtgagctggaatcaagg

SEQ ID NO: 18805 - DNA, 22 bp, Homo sapiens
ggagtgtcccgattttccaggt

SEQ ID NO: 18806 - DNA, 22 bp, Homo sapiens
ctgctttgcatagctgccagag

SEQ ID NO: 18807 - DNA, 22 bp, Homo sapiens
gtgtgcacagagctccagtgtt

SEQ ID NO: 18808 - DNA, 22 bp, Homo sapiens
tacatagctcctagtgatgcat

SEQ ID NO: 18809 - DNA, 22 bp, Homo sapiens
tccttgtaaaggagctctaaca

SEQ ID NO: 18810 - DNA, 22 bp, Homo sapiens
cagccccacacggtctagctct

SEQ ID NO: 18811 - DNA, 22 bp, Homo sapiens
caggtgagaggcggtcctgcat

SEQ ID NO: 18812 - DNA, 22 bp, Homo sapiens
ttctttgcccatgtttcctaag

SEQ ID NO: 18813 - DNA, 22 bp, Homo sapiens
cccaggctggagtgcagtggcg

SEQ ID NO: 18814 - DNA, 22 bp, Homo sapiens
tgcagcctggcttcgcgcctcc

SEQ ID NO: 18815 - DNA, 22 bp, Homo sapiens
gacctcgtgatccgccctcctt

SEQ ID NO: 18816 - DNA, 22 bp, Homo sapiens
tattttgtgccatgcactgcct

SEQ ID NO: 18817 - DNA, 22 bp, Homo sapiens
cccccagctctgctgggtcccg

SEQ ID NO: 18818 - DNA, 22 bp, Homo sapiens
acatgtttaagtttgttatatg

SEQ ID NO: 18819 - DNA, 22 bp, Homo sapiens
caggagctcaagaccaccctgg

SEQ ID NO: 18820 - DNA, 22 bp, Homo sapiens
agcctattccaggatgagctca

SEQ ID NO: 18821 - DNA, 22 bp, Homo sapiens
ggggcaggagcccttcttcagc

SEQ ID NO: 18822 - DNA, 22 bp, Homo sapiens
tggtacacatgtccaaggtcag

SEQ ID NO: 18823 - DNA, 22 bp, Homo sapiens
gctctctgcagcctccttggag

SEQ ID NO: 18824 - DNA, 22 bp, Homo sapiens
cagaccagaaggaagccgacaa

SEQ ID NO: 18825 - DNA, 22 bp, Homo sapiens
ttttctaacatctagtaatttg

SEQ ID NO: 18826 - DNA, 22 bp, Homo sapiens
aagaggagaaaggctggctttg

SEQ ID NO: 18827 - DNA, 19 bp, Homo sapiens
gtaatatgtgctgagtcct

SEQ ID NO: 18828 - DNA, 22 bp, Homo sapiens
ctgcgttctgcctggcggccta

SEQ ID NO: 18829 - DNA, 22 bp, Homo sapiens
gtggcatgaaagcatctgtgat

SEQ ID NO: 18830 - DNA, 22 bp, Homo sapiens
ttgtgtgtactggttatgggca

SEQ ID NO: 18831 - DNA, 22 bp, Homo sapiens
ttgctttgtttaaaagtggtat

SEQ ID NO: 18832 - DNA, 22 bp, Homo sapiens
tttgaagactactgggagtgaa

SEQ ID NO: 18833 - DNA, 22 bp, Homo sapiens
gtgcgtcctgggggctgggtcg

SEQ ID NO: 18834 - DNA, 22 bp, Homo sapiens
tctgctttcttactaaaaatga

SEQ ID NO: 18835 - DNA, 22 bp, Homo sapiens
aacatagaataaatgagttagg

SEQ ID NO: 18836 - DNA, 22 bp, Homo sapiens
ggctttgacatgctgaattaaa

SEQ ID NO: 18837 - DNA, 20 bp, Homo sapiens
ttcatgggagcaaagaggcc

SEQ ID NO: 18838 - DNA, 22 bp, Homo sapiens
taggatttaataaaagaataga

SEQ ID NO: 18839 - DNA, 22 bp, Homo sapiens
caggagctcagatgacatctca

SEQ ID NO: 18840 - DNA, 18 bp, Homo sapiens
cttgttcttctcttggcg

SEQ ID NO: 18841 - DNA, 22 bp, Homo sapiens
gtcctaccatgaattcactcca

SEQ ID NO: 18842 - DNA, 22 bp, Homo sapiens
tttgtgaataggttggcttcca

SEQ ID NO: 18843 - DNA, 22 bp, Homo sapiens
agccagggacgctgcaggctac

SEQ ID NO: 18844 - DNA, 22 bp, Homo sapiens
tctgtagtaggttgtagttctt

SEQ ID NO: 18845 - DNA, 22 bp, Homo sapiens
ggtcgctgtgtaggttcagcta

SEQ ID NO: 18846 - DNA, 22 bp, Homo sapiens
tataaactcctcttgcattcct

SEQ ID NO: 18847 - DNA, 22 bp, Homo sapiens
cttggggaagccactgatccct

SEQ ID NO: 18848 - DNA, 22 bp, Homo sapiens
tgagatcattgacttgttcctg

SEQ ID NO: 18849 - DNA, 22 bp, Homo sapiens
atacagggacatccagtttttc

SEQ ID NO: 18850 - DNA, 20 bp, Homo sapiens
tgttgattggtgtcatctca

SEQ ID NO: 18851 - DNA, 22 bp, Homo sapiens
tgggaaagctgcagaaattctc

SEQ ID NO: 18852 - DNA, 22 bp, Homo sapiens
atattgaaccctacagactgta

SEQ ID NO: 18853 - DNA, 22 bp, Homo sapiens
tgccgctccaggtctcgcggtg

SEQ ID NO: 18854 - DNA, 22 bp, Homo sapiens
ctggcaagaaatatatatctta

SEQ ID NO: 18855 - DNA, 22 bp, Homo sapiens
tctgcatattgttaatggaatg

SEQ ID NO: 18856 - DNA, 22 bp, Homo sapiens
aggctatttccactcttctcat

SEQ ID NO: 18857 - DNA, 22 bp, Homo sapiens
acccgatgttggtgctctagta

SEQ ID NO: 18858 - DNA, 22 bp, Homo sapiens
gtctgctcatgctaccgcgggc

SEQ ID NO: 18859 - DNA, 22 bp, Homo sapiens
agaccactaaaactttctctat

SEQ ID NO: 18860 - DNA, 22 bp, Homo sapiens
ccaggcaggcgatggtgcagtg

SEQ ID NO: 18861 - DNA, 22 bp, Homo sapiens
taacatttaaatttttcacata

SEQ ID NO: 18862 - DNA, 22 bp, Homo sapiens
tcctccccaaagcccagcctgg

SEQ ID NO: 18863 - DNA, 22 bp, Homo sapiens
gaaaggatttggtgccaagcgt

SEQ ID NO: 18864 - DNA, 23 bp, Homo sapiens
aacgacagctacaggcatcccac

SEQ ID NO: 18865 - DNA, 22 bp, Homo sapiens
tctgccgtgcgaggtcccacca

SEQ ID NO: 18866 - DNA, 22 bp, Homo sapiens
tcatgttgaattatcgttccca

SEQ ID NO: 18867 - DNA, 22 bp, Homo sapiens
taatactgtatactgcaaattt

SEQ ID NO: 18868 - DNA, 22 bp, Homo sapiens
aataaacaaatccttccttccc

SEQ ID NO: 18869 - DNA, 22 bp, Homo sapiens
atttaagggatttggagaccaa

SEQ ID NO: 18870 - DNA, 22 bp, Homo sapiens
agggagcattgtgacatatcac

SEQ ID NO: 18871 - DNA, 22 bp, Homo sapiens
aggggtgacacatatcagtgca

SEQ ID NO: 18872 - DNA, 22 bp, Homo sapiens
atttactttgctgagatccatc

SEQ ID NO: 18873 - DNA, 22 bp, Homo sapiens
tgtttcttacgtttttagaggc

SEQ ID NO: 18874 - DNA, 22 bp, Homo sapiens
cgtgtggtcccggcaaggcaag

SEQ ID NO: 18875 - DNA, 22 bp, Homo sapiens
cagcagagaaattacatatttg

SEQ ID NO: 18876 - DNA, 22 bp, Homo sapiens
agctacctgatccttcttctga

SEQ ID NO: 18877 - DNA, 20 bp, Homo sapiens
ataaaataactgccacaaga

SEQ ID NO: 18878 - DNA, 20 bp, Homo sapiens
atcggcttgcctggaaacaa

SEQ ID NO: 18879 - DNA, 21 bp, Homo sapiens
atcagggatgggttggacacc

SEQ ID NO: 18880 - DNA, 22 bp, Homo sapiens
agaaaatttaaagagacacaca

SEQ ID NO: 18881 - DNA, 22 bp, Homo sapiens
gagcccaggaagtggaggctga

SEQ ID NO: 18882 - DNA, 23 bp, Homo sapiens
ggagtgcaatggcgccatctcgg

SEQ ID NO: 18883 - DNA, 22 bp, Homo sapiens
ttgttcttgtctttgccttcac

SEQ ID NO: 18884 - DNA, 22 bp, Homo sapiens
gtgtatgttctacttaatatta

SEQ ID NO: 18885 - DNA, 22 bp, Homo sapiens
agtgaaaacctaatcatgcagt

SEQ ID NO: 18886 - DNA, 22 bp, Homo sapiens
ttaaatattatgttgtctgcaa

SEQ ID NO: 18887 - DNA, 22 bp, Homo sapiens
cgattgtcatattctgttggat

SEQ ID NO: 18888 - DNA, 21 bp, Homo sapiens
ctcccagggtgactgttcaac

SEQ ID NO: 18889 - DNA, 22 bp, Homo sapiens
gtgctccctccttcctcaagga

SEQ ID NO: 18890 - DNA, 22 bp, Homo sapiens
aagggcatgagaagcttgaaag

SEQ ID NO: 18891 - DNA, 22 bp, Homo sapiens
agtgctgtctccttcccccggg

SEQ ID NO: 18892 - DNA, 22 bp, Homo sapiens
aggacagagggaccagagccca

SEQ ID NO: 18893 - DNA, 22 bp, Homo sapiens
actaggggctcaggcccaggga

SEQ ID NO: 18894 - DNA, 22 bp, Homo sapiens
gtgtgtctcccaagaaggccca

SEQ ID NO: 18895 - DNA, 22 bp, Homo sapiens
acatttatataactcactagga

SEQ ID NO: 18896 - DNA, 22 bp, Homo sapiens
cttgcctttgtcttcaaaggct

SEQ ID NO: 18897 - DNA, 22 bp, Homo sapiens
ctcctggaggatagtgactggg

SEQ ID NO: 18898 - DNA, 22 bp, Homo sapiens
ctgggaggcggaggttgcagtg

SEQ ID NO: 18899 - DNA, 22 bp, Homo sapiens
taccagggaacagggatattaa

SEQ ID NO: 18900 - DNA, 23 bp, Homo sapiens
tgagtgtgaaaatcctggagatg

SEQ ID NO: 18901 - DNA, 22 bp, Homo sapiens
gggcaggggtcagtggccccaa

SEQ ID NO: 18902 - DNA, 22 bp, Homo sapiens
ggtccccccatggtgagcactg

SEQ ID NO: 18903 - DNA, 18 bp, Homo sapiens
ggaaaaggagtgtctagc

SEQ ID NO: 18904 - DNA, 22 bp, Homo sapiens
gtctatgatattttgttatagc

SEQ ID NO: 18905 - DNA, 22 bp, Homo sapiens
gaggcagaagttgcagtgagca

SEQ ID NO: 18906 - DNA, 22 bp, Homo sapiens
actgcaacctccacctcctggg

SEQ ID NO: 18907 - DNA, 21 bp, Homo sapiens
agctgcctccacttctgaggc

SEQ ID NO: 18908 - DNA, 22 bp, Homo sapiens
tgtacttcacctggtccactag

SEQ ID NO: 18909 - DNA, 22 bp, Homo sapiens
gggacctcgcatgcacgaagcc

SEQ ID NO: 18910 - DNA, 22 bp, Homo sapiens
agagcccctgggtcacacagcc

SEQ ID NO: 18911 - DNA, 22 bp, Homo sapiens
aggggcacgagtagagctctag

SEQ ID NO: 18912 - DNA, 22 bp, Homo sapiens
gtttgtgcgggacatgatccgg

SEQ ID NO: 18913 - DNA, 22 bp, Homo sapiens
gaggttggggctgcagtgagct

SEQ ID NO: 18914 - DNA, 22 bp, Homo sapiens
actgcgctccagcctgggtgac

SEQ ID NO: 18915 - DNA, 22 bp, Homo sapiens
caggcagaagaagtggaaggac

SEQ ID NO: 18916 - DNA, 22 bp, Homo sapiens
cccgggttgtccgcgcgtccgg

SEQ ID NO: 18917 - DNA, 22 bp, Homo sapiens
ggccagaagttggaaaagagcc

SEQ ID NO: 18918 - DNA, 22 bp, Homo sapiens
agatgtttataactcatgagtg

SEQ ID NO: 18919 - DNA, 23 bp, Homo sapiens
gacagagtgagaccttgtcttac

SEQ ID NO: 18920 - DNA, 22 bp, Homo sapiens
tacagggattgttttaatcacc

SEQ ID NO: 18921 - DNA, 22 bp, Homo sapiens
ataaaagatcccttctgagctc

SEQ ID NO: 18922 - DNA, 22 bp, Homo sapiens
gaaaggagagggttaaggagct

SEQ ID NO: 18923 - DNA, 22 bp, Homo sapiens
agttacagaatgtacagaggtt

SEQ ID NO: 18924 - DNA, 21 bp, Homo sapiens
ttgctgttttcccaatgcagt

SEQ ID NO: 18925 - DNA, 22 bp, Homo sapiens
aatgccttggagagcctagagg

SEQ ID NO: 18926 - DNA, 22 bp, Homo sapiens
aacaattactaccaaggcctgt

SEQ ID NO: 18927 - DNA, 22 bp, Homo sapiens
tgctcttcacagtttcagcatc

SEQ ID NO: 18928 - DNA, 22 bp, Homo sapiens
ctacccttaagtttctgtgggg

SEQ ID NO: 18929 - DNA, 22 bp, Homo sapiens
agctttggttgccatgatctga

SEQ ID NO: 18930 - DNA, 22 bp, Homo sapiens
tctgtgttgagaaggatcatga

SEQ ID NO: 18931 - DNA, 22 bp, Homo sapiens
ctcattgcaacctccgcctccc

SEQ ID NO: 18932 - DNA, 22 bp, Homo sapiens
cagcagcattgctctggattcc

SEQ ID NO: 18933 - DNA, 16 bp, Homo sapiens
atgctgctattagagg

SEQ ID NO: 18934 - DNA, 21 bp, Homo sapiens
tccctgagcccaaggggctcc

SEQ ID NO: 18935 - DNA, 22 bp, Homo sapiens
tcaccttgtgatctccctgcct

SEQ ID NO: 18936 - DNA, 22 bp, Homo sapiens
ctgtgttctccaggggcagctg

SEQ ID NO: 18937 - DNA, 22 bp, Homo sapiens
ctgtgcgtaagtagccaaaata

SEQ ID NO: 18938 - DNA, 22 bp, Homo sapiens
gctgacccctacaggttgtgtt

SEQ ID NO: 18939 - DNA, 22 bp, Homo sapiens
tgcgcctctaatctcgggcgtc

SEQ ID NO: 18940 - DNA, 22 bp, Homo sapiens
gccagggttgccaatgggggca

SEQ ID NO: 18941 - DNA, 22 bp, Homo sapiens
gcccccgaggaggtgatgtcgc

SEQ ID NO: 18942 - DNA, 22 bp, Homo sapiens
gaggtgctgctgtacttcttgc

SEQ ID NO: 18943 - DNA, 22 bp, Homo sapiens
aggaattgtgttgtagtggaga

SEQ ID NO: 18944 - DNA, 22 bp, Homo sapiens
gtctttcttaaacaacagaaca

SEQ ID NO: 18945 - DNA, 22 bp, Homo sapiens
ctggagggctgcagcgaggctg

SEQ ID NO: 18946 - DNA, 20 bp, Homo sapiens
tgtttgtgtggggccttggc

SEQ ID NO: 18947 - DNA, 22 bp, Homo sapiens
caagaggattattaataaataa

SEQ ID NO: 18948 - DNA, 22 bp, Homo sapiens
aagatattcaaagatttattag

SEQ ID NO: 18949 - DNA, 22 bp, Homo sapiens
gtcttgatctcctgaccttgtg

SEQ ID NO: 18950 - DNA, 22 bp, Homo sapiens
tagagagtcgggaacttacctg

SEQ ID NO: 18951 - DNA, 22 bp, Homo sapiens
gagctgggcctgcgagtgctgc

SEQ ID NO: 18952 - DNA, 22 bp, Homo sapiens
gacctcgtgatctgccggcctt

SEQ ID NO: 18953 - DNA, 22 bp, Homo sapiens
agctacagtcggaaggacagac

SEQ ID NO: 18954 - DNA, 22 bp, Homo sapiens
tgtccttcttgtcttgcccaaa

SEQ ID NO: 18955 - DNA, 22 bp, Homo sapiens
taaagggtaggttttactgtaa

SEQ ID NO: 18956 - DNA, 22 bp, Homo sapiens
aaggtagggatgtattcagctt

SEQ ID NO: 18957 - DNA, 22 bp, Homo sapiens
gacctcatgatccacctgcctt

SEQ ID NO: 18958 - DNA, 22 bp, Homo sapiens
gccaggacctcagatgcagggc

SEQ ID NO: 18959 - DNA, 22 bp, Homo sapiens
tgccttgtccttcgtcagggct

SEQ ID NO: 18960 - DNA, 20 bp, Homo sapiens
acctcctggcgggcatcctc

SEQ ID NO: 18961 - DNA, 22 bp, Homo sapiens
tgggcgacagagcaagactccg

SEQ ID NO: 18962 - DNA, 22 bp, Homo sapiens
gcctcctgtcccaggctgagga

SEQ ID NO: 18963 - DNA, 22 bp, Homo sapiens
cttgtcagccaattgtggattt

SEQ ID NO: 18964 - DNA, 22 bp, Homo sapiens
tgtgcatgtgtctttatagtag

SEQ ID NO: 18965 - DNA, 22 bp, Homo sapiens
tcaatactaatcttgctggaag

SEQ ID NO: 18966 - DNA, 22 bp, Homo sapiens
atgtctgtttgctgagcccggc

SEQ ID NO: 18967 - DNA, 23 bp, Homo sapiens
ctggggctttcaaatctgggcag

SEQ ID NO: 18968 - DNA, 22 bp, Homo sapiens
ctcattgcccagatccccacag

SEQ ID NO: 18969 - DNA, 22 bp, Homo sapiens
gaccttgtgatccgcccgcctt

SEQ ID NO: 18970 - DNA, 22 bp, Homo sapiens
aggaccatcctaaggtaggcaa

SEQ ID NO: 18971 - DNA, 22 bp, Homo sapiens
gctgtggcctggcgcagagctg

SEQ ID NO: 18972 - DNA, 22 bp, Homo sapiens
gactactcaaactttctctata

SEQ ID NO: 18973 - DNA, 22 bp, Homo sapiens
aaaaagtattggccatggttga

SEQ ID NO: 18974 - DNA, 22 bp, Homo sapiens
tgcactccaggctgggtgacag

SEQ ID NO: 18975 - DNA, 22 bp, Homo sapiens
aaccaccattctctcctcttcc

SEQ ID NO: 18976 - DNA, 22 bp, Homo sapiens
ttccacaatggttaagctcgtt

SEQ ID NO: 18977 - DNA, 22 bp, Homo sapiens
atgtttaaagggttgagaaata

SEQ ID NO: 18978 - DNA, 22 bp, Homo sapiens
gccatcatatcccctgtgacct

SEQ ID NO: 18979 - DNA, 22 bp, Homo sapiens
gatggaggagatggcagggtgc

SEQ ID NO: 18980 - DNA, 20 bp, Homo sapiens
tctgcggaaagggagggtgg

SEQ ID NO: 18981 - DNA, 22 bp, Homo sapiens
tgcagattcaaatgaaatgcaa

SEQ ID NO: 18982 - DNA, 22 bp, Homo sapiens
cagagcccctcgtctccaccac

SEQ ID NO: 18983 - DNA, 22 bp, Homo sapiens
ttgggctgcagcaattattagt

SEQ ID NO: 18984 - DNA, 17 bp, Homo sapiens
gacctcaggtgatctgc

SEQ ID NO: 18985 - DNA, 22 bp, Homo sapiens
atggtcacttcacccatgagct

SEQ ID NO: 18986 - DNA, 22 bp, Homo sapiens
aggacctactgatatcttagca

SEQ ID NO: 18987 - DNA, 18 bp, Homo sapiens
tggtcactgtggatagtg

SEQ ID NO: 18988 - DNA, 22 bp, Homo sapiens
tgggaggccaaggcaggcggat

SEQ ID NO: 18989 - DNA, 22 bp, Homo sapiens
ctgtggctctcagaggctgctg

SEQ ID NO: 18990 - DNA, 21 bp, Homo sapiens
agggttttatagatctcttcc

SEQ ID NO: 18991 - DNA, 17 bp, Homo sapiens
ttcttttctgagccttg

SEQ ID NO: 18992 - DNA, 21 bp, Homo sapiens
cagaggcctatcacagactcc

SEQ ID NO: 18993 - DNA, 22 bp, Homo sapiens
tctgaaaactccatgagctcgt

SEQ ID NO: 18994 - DNA, 22 bp, Homo sapiens
tgtggtgccgagagtctggacg

SEQ ID NO: 18995 - DNA, 23 bp, Homo sapiens
aggtaggttattgctgctacctg

SEQ ID NO: 18996 - DNA, 19 bp, Homo sapiens
gggaatgatggaagacttc

SEQ ID NO: 18997 - DNA, 22 bp, Homo sapiens
gggcggatcacctgaggtcagg

SEQ ID NO: 18998 - DNA, 22 bp, Homo sapiens
caggaagaccagggctgtggct

SEQ ID NO: 18999 - DNA, 22 bp, Homo sapiens
ttggagatatcacaccttcaca

SEQ ID NO: 19000 - DNA, 22 bp, Homo sapiens
cttccgtgtcagttccaggtgg

SEQ ID NO: 19001 - DNA, 22 bp, Homo sapiens
aggctctcaccctctgaccaga

SEQ ID NO: 19002 - DNA, 22 bp, Homo sapiens
cttctgagatgttgttttacag

SEQ ID NO: 19003 - DNA, 22 bp, Homo sapiens
aagaagcattctttcattggtt

SEQ ID NO: 19004 - DNA, 22 bp, Homo sapiens
tttctggcagcgggacaggggt

SEQ ID NO: 19005 - DNA, 22 bp, Homo sapiens
agcactgatttaaactggattt

SEQ ID NO: 19006 - DNA, 22 bp, Homo sapiens
cagcctggtccccggctcaccc

SEQ ID NO: 19007 - DNA, 22 bp, Homo sapiens
cgggttcacgccattctcctgc

SEQ ID NO: 19008 - DNA, 22 bp, Homo sapiens
ttatttttaaaagttcacacag

SEQ ID NO: 19009 - DNA, 23 bp, Homo sapiens
tctacaaagctgtgtcaggaccc

SEQ ID NO: 19010 - DNA, 22 bp, Homo sapiens
actggggactctggccttttga

SEQ ID NO: 19011 - DNA, 22 bp, Homo sapiens
gggccagtgaacaatgagggaa

SEQ ID NO: 19012 - DNA, 22 bp, Homo sapiens
tgtctcttttcaagctaccctt

SEQ ID NO: 19013 - DNA, 22 bp, Homo sapiens
tccattatacttctgattcaaa

SEQ ID NO: 19014 - DNA, 22 bp, Homo sapiens
atagagtgatgtaaggtatgtg

SEQ ID NO: 19015 - DNA, 22 bp, Homo sapiens
aatattatcaaaagctttttca

SEQ ID NO: 19016 - DNA, 22 bp, Homo sapiens
ttgggctcaggagtttgagacc

SEQ ID NO: 19017 - DNA, 22 bp, Homo sapiens
ggcaggaggtgagtggcgggtg

SEQ ID NO: 19018 - DNA, 16 bp, Homo sapiens
gcgcctcctcggcctc

SEQ ID NO: 19019 - DNA, 22 bp, Homo sapiens
atatccagcagcaggtgagtat

SEQ ID NO: 19020 - DNA, 22 bp, Homo sapiens
gagtgtgtcggtcagcgtggcg

SEQ ID NO: 19021 - DNA, 22 bp, Homo sapiens
tttaatgtagcgtgaaatgatt

SEQ ID NO: 19022 - DNA, 22 bp, Homo sapiens
ttatttgtggcatatgagacga

SEQ ID NO: 19023 - DNA, 22 bp, Homo sapiens
cttttgattgagcagtttcaaa

SEQ ID NO: 19024 - DNA, 22 bp, Homo sapiens
tttgctttgtttaaaagtggta

SEQ ID NO: 19025 - DNA, 22 bp, Homo sapiens
aagagggctgcaatcttattgc

SEQ ID NO: 19026 - DNA, 22 bp, Homo sapiens
tgctcgaggtccccaccggctc

SEQ ID NO: 19027 - DNA, 22 bp, Homo sapiens
gtcctgtgagattcatgctcaa

SEQ ID NO: 19028 - DNA, 22 bp, Homo sapiens
gcccaggctggagtgcagtggt

SEQ ID NO: 19029 - DNA, 22 bp, Homo sapiens
gtggatggagctggaagccatt

SEQ ID NO: 19030 - DNA, 22 bp, Homo sapiens
atatattttttgagacagagtc

SEQ ID NO: 19031 - DNA, 22 bp, Homo sapiens
tcacttagatggggatcatcac

SEQ ID NO: 19032 - DNA, 22 bp, Homo sapiens
tggatctcggcaatgcgggact

SEQ ID NO: 19033 - DNA, 22 bp, Homo sapiens
agggctggagccacagctggga

SEQ ID NO: 19034 - DNA, 18 bp, Homo sapiens
atgagaggtgtcagaaga

SEQ ID NO: 19035 - DNA, 22 bp, Homo sapiens
gtgagactcgcctttgtgtagc

SEQ ID NO: 19036 - DNA, 22 bp, Homo sapiens
ggctcctgggggtgctcctgcc

SEQ ID NO: 19037 - DNA, 22 bp, Homo sapiens
cgggcagtgtggctccagagtc

SEQ ID NO: 19038 - DNA, 22 bp, Homo sapiens
ttcttttaattgtgggggagtg

SEQ ID NO: 19039 - DNA, 22 bp, Homo sapiens
gcccaggctggagtgcagtggc

SEQ ID NO: 19040 - DNA, 17 bp, Homo sapiens
cgggcatggagggcagg

SEQ ID NO: 19041 - DNA, 22 bp, Homo sapiens
ctttaattgtagctcccataat

SEQ ID NO: 19042 - DNA, 22 bp, Homo sapiens
aaaaatcacttttataggcagc

SEQ ID NO: 19043 - DNA, 22 bp, Homo sapiens
attaagactgcccatgttttta

SEQ ID NO: 19044 - DNA, 22 bp, Homo sapiens
tgtgttaaggtgcatctagtgc

SEQ ID NO: 19045 - DNA, 22 bp, Homo sapiens
ttggcgcccaggacgccgccgc

SEQ ID NO: 19046 - DNA, 21 bp, Homo sapiens
aaactgaccttgcctgagaca

SEQ ID NO: 19047 - DNA, 22 bp, Homo sapiens
gagctactgaaatattgatttt

SEQ ID NO: 19048 - DNA, 18 bp, Homo sapiens
actctttctgcccacagg

SEQ ID NO: 19049 - DNA, 22 bp, Homo sapiens
tgtgagacgtaggccatcgagg

SEQ ID NO: 19050 - DNA, 22 bp, Homo sapiens
ctagggtgtgcagattttgcct

SEQ ID NO: 19051 - DNA, 22 bp, Homo sapiens
ggatgtcgaggatggggtagca

SEQ ID NO: 19052 - DNA, 19 bp, Homo sapiens
tcattgtgctgagcaaggt

SEQ ID NO: 19053 - DNA, 22 bp, Homo sapiens
ttgaagactaatttagataatg

SEQ ID NO: 19054 - DNA, 22 bp, Homo sapiens
catctttgcccatccacttcca

SEQ ID NO: 19055 - DNA, 22 bp, Homo sapiens
gtgtcgtatgtaatatggtcca

SEQ ID NO: 19056 - DNA, 22 bp, Homo sapiens
acgtagcactgagagatgcagg

SEQ ID NO: 19057 - DNA, 22 bp, Homo sapiens
gccagggttcgaatccgtatgg

SEQ ID NO: 19058 - DNA, 22 bp, Homo sapiens
gggcggatcatttgaggtcagg

SEQ ID NO: 19059 - DNA, 18 bp, Homo sapiens
atggtctcatactgggag

SEQ ID NO: 19060 - DNA, 22 bp, Homo sapiens
ggagctcctggcagtgacagag

SEQ ID NO: 19061 - DNA, 22 bp, Homo sapiens
ctcactgcaacctctgccccca

SEQ ID NO: 19062 - DNA, 22 bp, Homo sapiens
cttgtgcatttcattcctcagg

SEQ ID NO: 19063 - DNA, 22 bp, Homo sapiens
atggtggacgggagacaggact

SEQ ID NO: 19064 - DNA, 22 bp, Homo sapiens
ttccagctaactcacatccctt

SEQ ID NO: 19065 - DNA, 22 bp, Homo sapiens
tgtcctcatcctccagtctgtc

SEQ ID NO: 19066 - DNA, 22 bp, Homo sapiens
aggcaaggtgctacagacagtg

SEQ ID NO: 19067 - DNA, 22 bp, Homo sapiens
actgattgcattcatagggttt

SEQ ID NO: 19068 - DNA, 22 bp, Homo sapiens
aagaagcaggtcacagacaggg

SEQ ID NO: 19069 - DNA, 22 bp, Homo sapiens
cggagcctgcttgttgcagctg

SEQ ID NO: 19070 - DNA, 22 bp, Homo sapiens
ccctggctgataccggaaaggc

SEQ ID NO: 19071 - DNA, 22 bp, Homo sapiens
atgtgtattacctcgattgtga

SEQ ID NO: 19072 - DNA, 22 bp, Homo sapiens
tgggggtgtcctggtgcacaca

SEQ ID NO: 19073 - DNA, 22 bp, Homo sapiens
tgggtgtgtccatattttgact

SEQ ID NO: 19074 - DNA, 22 bp, Homo sapiens
tgagcaggcgcagcaggaggtc

SEQ ID NO: 19075 - DNA, 22 bp, Homo sapiens
tggtatgaccgtggtgcaagca

SEQ ID NO: 19076 - DNA, 21 bp, Homo sapiens
tctgatggtagatgagatgtg

SEQ ID NO: 19077 - DNA, 20 bp, Homo sapiens
aaattactgccacacatttc

SEQ ID NO: 19078 - DNA, 22 bp, Homo sapiens
atgggttcaagtgattctcctg

SEQ ID NO: 19079 - DNA, 22 bp, Homo sapiens
gggagctgaaggagccggcggg

SEQ ID NO: 19080 - DNA, 21 bp, Homo sapiens
agcgtcaatatcgtcaacagg

SEQ ID NO: 19081 - DNA, 22 bp, Homo sapiens
ctctttggatagaattacaaag

SEQ ID NO: 19082 - DNA, 22 bp, Homo sapiens
cagtggcgtgatctctgctcac

SEQ ID NO: 19083 - DNA, 22 bp, Homo sapiens
ctcgcatgccctgcctcatcca

SEQ ID NO: 19084 - DNA, 22 bp, Homo sapiens
ccaggctggagtgcagtggcac

SEQ ID NO: 19085 - DNA, 22 bp, Homo sapiens
tgggcagggagctggaaccaca

SEQ ID NO: 19086 - DNA, 22 bp, Homo sapiens
caggctggagtgcagtggtgcc

SEQ ID NO: 19087 - DNA, 22 bp, Homo sapiens
cccacgtcgaacttgctccaga

SEQ ID NO: 19088 - DNA, 22 bp, Homo sapiens
gccccagcctcccgagtagctg

SEQ ID NO: 19089 - DNA, 22 bp, Homo sapiens
cccaggctggagtgcagtggcg

SEQ ID NO: 19090 - DNA, 22 bp, Homo sapiens
tatgccactgctctccatccta

SEQ ID NO: 19091 - DNA, 19 bp, Homo sapiens
ccagagagctaggtacaga

SEQ ID NO: 19092 - DNA, 22 bp, Homo sapiens
cacagagatggtctggcaggtg

SEQ ID NO: 19093 - DNA, 22 bp, Homo sapiens
ggcctcgcggcttctggtggct

SEQ ID NO: 19094 - DNA, 22 bp, Homo sapiens
cagagagaatcttggcagctga

SEQ ID NO: 19095 - DNA, 22 bp, Homo sapiens
gagagagctctgtgcctgggat

SEQ ID NO: 19096 - DNA, 22 bp, Homo sapiens
tggttcctcaagcgctggcggc

SEQ ID NO: 19097 - DNA, 22 bp, Homo sapiens
gtggggtagatctttctcagga

SEQ ID NO: 19098 - DNA, 22 bp, Homo sapiens
tggcacaggatctcagcggcca

SEQ ID NO: 19099 - DNA, 22 bp, Homo sapiens
caggctggagtgcagtggcgct

SEQ ID NO: 19100 - DNA, 22 bp, Homo sapiens
ttgcaattgctatggagagcgt

SEQ ID NO: 19101 - DNA, 22 bp, Homo sapiens
gcccagagttcaaggctgcagt

SEQ ID NO: 19102 - DNA, 22 bp, Homo sapiens
ttccagagagttattcccctgg

SEQ ID NO: 19103 - DNA, 22 bp, Homo sapiens
agcgggtctgcaagccttccct

SEQ ID NO: 19104 - DNA, 22 bp, Homo sapiens
cagccccatggtgtgctccagc

SEQ ID NO: 19105 - DNA, 22 bp, Homo sapiens
gcaggcagaggtggaggagaca

SEQ ID NO: 19106 - DNA, 22 bp, Homo sapiens
gggccatgagaggttcatcaac

SEQ ID NO: 19107 - DNA, 22 bp, Homo sapiens
caggctggagttcagtggtgtg

SEQ ID NO: 19108 - DNA, 22 bp, Homo sapiens
gcaggcggaggttgcagtgagc

SEQ ID NO: 19109 - DNA, 22 bp, Homo sapiens
acctggacacctgctgtcatct

SEQ ID NO: 19110 - DNA, 22 bp, Homo sapiens
gagccaggaggcagagactgca

SEQ ID NO: 19111 - DNA, 22 bp, Homo sapiens
ctcagccccagcccagatagca

SEQ ID NO: 19112 - DNA, 22 bp, Homo sapiens
aggtcaccatggcatgctccac

SEQ ID NO: 19113 - DNA, 22 bp, Homo sapiens
ggggccttttctgaatgtggaa

SEQ ID NO: 19114 - DNA, 22 bp, Homo sapiens
ggcgtgggcgaggtgctctatc

SEQ ID NO: 19115 - DNA, 22 bp, Homo sapiens
ctggcaagaaatatatatctta

SEQ ID NO: 19116 - DNA, 22 bp, Homo sapiens
gacgagagactccatccaccac

SEQ ID NO: 19117 - DNA, 22 bp, Homo sapiens
ggggccttggatctgtgccccg

SEQ ID NO: 19118 - DNA, 22 bp, Homo sapiens
tgggaagggtcaacagctggaa

SEQ ID NO: 19119 - DNA, 22 bp, Homo sapiens
agaggccggccgagcccatggg

SEQ ID NO: 19120 - DNA, 22 bp, Homo sapiens
tgggaaggggagctggaaagga

SEQ ID NO: 19121 - DNA, 22 bp, Homo sapiens
gcaggcagatcacctgtcagga

SEQ ID NO: 19122 - DNA, 22 bp, Homo sapiens
gggacttaatgcagagagggac

SEQ ID NO: 19123 - DNA, 22 bp, Homo sapiens
aatttcggttcaaggcccagtt

SEQ ID NO: 19124 - DNA, 22 bp, Homo sapiens
atgttatgtctgggaaggggta

SEQ ID NO: 19125 - DNA, 22 bp, Homo sapiens
agagagcccgggccagggcaca

SEQ ID NO: 19126 - DNA, 22 bp, Homo sapiens
agccaggatggtctcgatcggc

SEQ ID NO: 19127 - DNA, 22 bp, Homo sapiens
gcggccttgtggcggagcaggc

SEQ ID NO: 19128 - DNA, 22 bp, Homo sapiens
actaggggctcaggcccaggga

SEQ ID NO: 19129 - DNA, 22 bp, Homo sapiens
caggcagggagctggaaaggat

SEQ ID NO: 19130 - DNA, 22 bp, Homo sapiens
caggctggagtgcagtggcgcc

SEQ ID NO: 19131 - DNA, 22 bp, Homo sapiens
cgggcaaggcgagactaggccc

SEQ ID NO: 19132 - DNA, 22 bp, Homo sapiens
cccaaaggttgaggctgcagtg

SEQ ID NO: 19133 - DNA, 22 bp, Homo sapiens
atgccaggaacaaacagtggtg

SEQ ID NO: 19134 - DNA, 22 bp, Homo sapiens
cccagctcttcaagtcaccccc

SEQ ID NO: 19135 - DNA, 22 bp, Homo sapiens
tctgcaacattcctctccccac

SEQ ID NO: 19136 - DNA, 22 bp, Homo sapiens
agttgcagacgcagagatgttg

SEQ ID NO: 19137 - DNA, 22 bp, Homo sapiens
gagcccaggcagaggttgcagt

SEQ ID NO: 19138 - DNA, 22 bp, Homo sapiens
tgctgagcgcatccggcggccg

SEQ ID NO: 19139 - DNA, 22 bp, Homo sapiens
gaatttaagaggatgaatctgt

SEQ ID NO: 19140 - DNA, 22 bp, Homo sapiens
caggaaagggatgggctgccac

SEQ ID NO: 19141 - DNA, 22 bp, Homo sapiens
gggtccctggaattacttgaca

SEQ ID NO: 19142 - DNA, 22 bp, Homo sapiens
gcacggctaatttttgtatttt

SEQ ID NO: 19143 - DNA, 22 bp, Homo sapiens
gccccaagtccctatgtttcca

SEQ ID NO: 19144 - DNA, 19 bp, Homo sapiens
ggcttgtctcggcagccgc

SEQ ID NO: 19145 - DNA, 22 bp, Homo sapiens
ttcctgcgcccttctcgcccgc

SEQ ID NO: 19146 - DNA, 22 bp, Homo sapiens
ttctatttttgtggaactgtag

SEQ ID NO: 19147 - DNA, 22 bp, Homo sapiens
ataatacatggttgatcttttc

SEQ ID NO: 19148 - DNA, 22 bp, Homo sapiens
gcctcaaatgtggagcactatt

SEQ ID NO: 19149 - DNA, 22 bp, Homo sapiens
tcagtttttctatactttgtag

SEQ ID NO: 19150 - DNA, 22 bp, Homo sapiens
tatgacagtttcgtaggggttg

SEQ ID NO: 19151 - DNA, 22 bp, Homo sapiens
tacaaaaaattgatactgacga

SEQ ID NO: 19152 - DNA, 22 bp, Homo sapiens
atttacaggtagaattttaagt

SEQ ID NO: 19153 - DNA, 22 bp, Homo sapiens
agatggggtttcatcatgttgg

SEQ ID NO: 19154 - DNA, 22 bp, Homo sapiens
accctggacatcttgtcatagc

SEQ ID NO: 19155 - DNA, 22 bp, Homo sapiens
ttagatttacaagcactgttta

SEQ ID NO: 19156 - DNA, 22 bp, Homo sapiens
tggctcatgcctgtaatcttag

SEQ ID NO: 19157 - DNA, 22 bp, Homo sapiens
aggcactgtgcagtcccaagca

SEQ ID NO: 19158 - DNA, 22 bp, Homo sapiens
gtcagatctttggggatgctgt

SEQ ID NO: 19159 - DNA, 22 bp, Homo sapiens
tttctaatctgattctcctacc

SEQ ID NO: 19160 - DNA, 22 bp, Homo sapiens
ctctttggatagaattacaaag

SEQ ID NO: 19161 - DNA, 19 bp, Homo sapiens
catctggatgattctcctg

SEQ ID NO: 19162 - DNA, 22 bp, Homo sapiens
ctcattgcaacctccgcctccc

SEQ ID NO: 19163 - DNA, 22 bp, Homo sapiens
ttcatagtgtttccttccagtg

SEQ ID NO: 19164 - DNA, 22 bp, Homo sapiens
tttgaagactactgggagtgaa

SEQ ID NO: 19165 - DNA, 22 bp, Homo sapiens
ggagttgattttggatatatta

SEQ ID NO: 19166 - DNA, 21 bp, Homo sapiens
gttcaaatcctgacactacac

SEQ ID NO: 19167 - DNA, 22 bp, Homo sapiens
taagggttcagaatgcagtggt

SEQ ID NO: 19168 - DNA, 22 bp, Homo sapiens
actgcactcctgcctgggtaac

SEQ ID NO: 19169 - DNA, 22 bp, Homo sapiens
gaatgcttggaacctgaagttc

SEQ ID NO: 19170 - DNA, 22 bp, Homo sapiens
ctatgaccccagcatgaataag

SEQ ID NO: 19171 - DNA, 22 bp, Homo sapiens
cctgggctctgtcagaattggg

SEQ ID NO: 19172 - DNA, 22 bp, Homo sapiens
aaggttcctctctccacccagc

SEQ ID NO: 19173 - DNA, 22 bp, Homo sapiens
atgaggcaggagtgcagtggca

SEQ ID NO: 19174 - DNA, 22 bp, Homo sapiens
ggggcaggagcccttcttcagc

SEQ ID NO: 19175 - DNA, 22 bp, Homo sapiens
aggatttctgtgcctggaaaat

SEQ ID NO: 19176 - DNA, 22 bp, Homo sapiens
actggacagaggaaatatggag

SEQ ID NO: 19177 - DNA, 22 bp, Homo sapiens
ttttaatactgctattgtagga

SEQ ID NO: 19178 - DNA, 22 bp, Homo sapiens
aactatgttaataagtttcatt

SEQ ID NO: 19179 - DNA, 22 bp, Homo sapiens
ctgtggctctcagaggctgctg

SEQ ID NO: 19180 - DNA, 22 bp, Homo sapiens
cagctgcccctccagggctggg

SEQ ID NO: 19181 - DNA, 22 bp, Homo sapiens
ccaagcagagcagcctctctgg

SEQ ID NO: 19182 - DNA, 18 bp, Homo sapiens
gctgtggaagtctttata

SEQ ID NO: 19183 - DNA, 22 bp, Homo sapiens
ttgtggaactcatctgcctggt

SEQ ID NO: 19184 - DNA, 22 bp, Homo sapiens
gaattttattactagtcaactg

SEQ ID NO: 19185 - DNA, 22 bp, Homo sapiens
ttcattcttcagagctgcgctt

SEQ ID NO: 19186 - DNA, 22 bp, Homo sapiens
ttcaggcccagcacagcgcgtg

SEQ ID NO: 19187 - DNA, 22 bp, Homo sapiens
aaagaaatagatggcatttaaa

SEQ ID NO: 19188 - DNA, 22 bp, Homo sapiens
gcaggcattagcccccatggct

SEQ ID NO: 19189 - DNA, 22 bp, Homo sapiens
ttacatgtttatgtggtacatg

SEQ ID NO: 19190 - DNA, 22 bp, Homo sapiens
ttatatgtttctgtttggaggc

SEQ ID NO: 19191 - DNA, 22 bp, Homo sapiens
aggacaaaggaccagatctgga

SEQ ID NO: 19192 - DNA, 22 bp, Homo sapiens
aagaaatgtgaatattgaatag

SEQ ID NO: 19193 - DNA, 22 bp, Homo sapiens
tctgagctgggtcttgacagct

SEQ ID NO: 19194 - DNA, 22 bp, Homo sapiens
tagtggatgttcagagatttga

SEQ ID NO: 19195 - DNA, 22 bp, Homo sapiens
gtcgtggagctcacagtgtgcc

SEQ ID NO: 19196 - DNA, 22 bp, Homo sapiens
gaaaattattgaaaatggctct

SEQ ID NO: 19197 - DNA, 22 bp, Homo sapiens
agcaggagtttgatgcttttat

SEQ ID NO: 19198 - DNA, 22 bp, Homo sapiens
agggcactctgcagggaccacc

SEQ ID NO: 19199 - DNA, 21 bp, Homo sapiens
cttccccaggctggtctgtat

SEQ ID NO: 19200 - DNA, 22 bp, Homo sapiens
tttaagaagttatgttataaat

SEQ ID NO: 19201 - DNA, 22 bp, Homo sapiens
tcctggatggcctgcaggcggt

SEQ ID NO: 19202 - DNA, 22 bp, Homo sapiens
aagaatgagctcaaagatctta

SEQ ID NO: 19203 - DNA, 16 bp, Homo sapiens
aggcgaaggttcattt

SEQ ID NO: 19204 - DNA, 22 bp, Homo sapiens
ttaggatttgaaaaggggcaga

SEQ ID NO: 19205 - DNA, 22 bp, Homo sapiens
gtggctcacgcctgtaatccca

SEQ ID NO: 19206 - DNA, 22 bp, Homo sapiens
tcttaattctgtgtcttcacta

SEQ ID NO: 19207 - DNA, 22 bp, Homo sapiens
tctacatgcagcgaggggactt

SEQ ID NO: 19208 - DNA, 22 bp, Homo sapiens
accctggaggtggaggtgcagt

SEQ ID NO: 19209 - DNA, 22 bp, Homo sapiens
tgtgagttcttagaaagtcagt

SEQ ID NO: 19210 - DNA, 22 bp, Homo sapiens
ccctttagcccctgcagagact

SEQ ID NO: 19211 - DNA, 22 bp, Homo sapiens
aaattgtaatgacttcacttga

SEQ ID NO: 19212 - DNA, 18 bp, Homo sapiens
cagctgccagctcatgga

SEQ ID NO: 19213 - DNA, 22 bp, Homo sapiens
ggtttattgttaataagtttga

SEQ ID NO: 19214 - DNA, 22 bp, Homo sapiens
actgcactccagcctgggtaac

SEQ ID NO: 19215 - DNA, 22 bp, Homo sapiens
taggtgcctgcacgacccaaac

SEQ ID NO: 19216 - DNA, 22 bp, Homo sapiens
taattgtaaagtagtagtacag

SEQ ID NO: 19217 - DNA, 22 bp, Homo sapiens
atatattttttgagacagagtc

SEQ ID NO: 19218 - DNA, 22 bp, Homo sapiens
ggagagtggattccagctgtat

SEQ ID NO: 19219 - DNA, 17 bp, Homo sapiens
ggctgcagtccaggagg

SEQ ID NO: 19220 - DNA, 19 bp, Homo sapiens
gccttcccaccacccgtcc

SEQ ID NO: 19221 - DNA, 19 bp, Homo sapiens
ccctcttgcacaaagcaaa

SEQ ID NO: 19222 - DNA, 22 bp, Homo sapiens
ttgtggaatgtggctgtcaatt

SEQ ID NO: 19223 - DNA, 20 bp, Homo sapiens
caaatccctgctctgtgctg

SEQ ID NO: 19224 - DNA, 22 bp, Homo sapiens
ttaaattttagaaacagactct

SEQ ID NO: 19225 - DNA, 22 bp, Homo sapiens
gaagatgttatggagagctcag

SEQ ID NO: 19226 - DNA, 22 bp, Homo sapiens
tgcaccctcatcagtcaaatgg

SEQ ID NO: 19227 - DNA, 22 bp, Homo sapiens
ctcctgagctctgaggaagctt

SEQ ID NO: 19228 - DNA, 22 bp, Homo sapiens
acagatgttgcttgtcattctc

SEQ ID NO: 19229 - DNA, 22 bp, Homo sapiens
gggagaagaatgtgtcaattgt

SEQ ID NO: 19230 - DNA, 20 bp, Homo sapiens
tatttctgggcaaccattta

SEQ ID NO: 19231 - DNA, 22 bp, Homo sapiens
gttcagtcacgtgcccaagttc

SEQ ID NO: 19232 - DNA, 22 bp, Homo sapiens
ataaaaactgacccatcctttg

SEQ ID NO: 19233 - DNA, 22 bp, Homo sapiens
tggtccttctgtcttccgcacc

SEQ ID NO: 19234 - DNA, 22 bp, Homo sapiens
ttcttctttccaattacatggt

SEQ ID NO: 19235 - DNA, 22 bp, Homo sapiens
taggcactgtgtttgtaggagt

SEQ ID NO: 19236 - DNA, 22 bp, Homo sapiens
ttaataaagtatgaattggaaa

SEQ ID NO: 19237 - DNA, 22 bp, Homo sapiens
aggacgctctcgctgaacttct

SEQ ID NO: 19238 - DNA, 22 bp, Homo sapiens
gtggcattgccttctgcaggaa

SEQ ID NO: 19239 - DNA, 18 bp, Homo sapiens
ccctcttgcacaaagcaa

SEQ ID NO: 19240 - DNA, 22 bp, Homo sapiens
aagatgcggttgaccatggtgt

SEQ ID NO: 19241 - DNA, 22 bp, Homo sapiens
acccgggaggcaggagtcatag

SEQ ID NO: 19242 - DNA, 22 bp, Homo sapiens
tgtgtttctgagaatcccacct

SEQ ID NO: 19243 - DNA, 22 bp, Homo sapiens
actgggctcaagtgattgtcct

SEQ ID NO: 19244 - DNA, 22 bp, Homo sapiens
gttgaggtgatgccagccctgc

SEQ ID NO: 19245 - DNA, 22 bp, Homo sapiens
cactgggcgtgtcctgggtgag

SEQ ID NO: 19246 - DNA, 22 bp, Homo sapiens
aaaatatgtataactcttctgc

SEQ ID NO: 19247 - DNA, 22 bp, Homo sapiens
cactgcaacctccacctcctgg

SEQ ID NO: 19248 - DNA, 22 bp, Homo sapiens
gtagtctgaacagtaattttgt

SEQ ID NO: 19249 - DNA, 22 bp, Homo sapiens
ggacacgtggctgaaggcggcc

SEQ ID NO: 19250 - DNA, 22 bp, Homo sapiens
tcgtggaatatggatgcttgtc

SEQ ID NO: 19251 - DNA, 22 bp, Homo sapiens
gagaggaagccttctgtacttg

SEQ ID NO: 19252 - DNA, 22 bp, Homo sapiens
tttcttctatgtgtgatatttt

SEQ ID NO: 19253 - DNA, 22 bp, Homo sapiens
cagggtttcaccatgttagcag

SEQ ID NO: 19254 - DNA, 22 bp, Homo sapiens
atggccaggcacctctggctga

SEQ ID NO: 19255 - DNA, 22 bp, Homo sapiens
ggcttctctccagtatgcattc

SEQ ID NO: 19256 - DNA, 22 bp, Homo sapiens
attttctatgttgtaattgtta

SEQ ID NO: 19257 - DNA, 22 bp, Homo sapiens
ggagaggcttccagagtcgtgc

SEQ ID NO: 19258 - DNA, 22 bp, Homo sapiens
gctgggctgcgtcggggaagcc

SEQ ID NO: 19259 - DNA, 22 bp, Homo sapiens
gtgagactcgcctttgtgtagc

SEQ ID NO: 19260 - DNA, 22 bp, Homo sapiens
tgacttcctgcactcaggtgat

SEQ ID NO: 19261 - DNA, 22 bp, Homo sapiens
caggtgcctcaggatgagacaa

SEQ ID NO: 19262 - DNA, 22 bp, Homo sapiens
gatgaggcataaacacagtcac

SEQ ID NO: 19263 - DNA, 22 bp, Homo sapiens
acatatgcgatcataggatgca

SEQ ID NO: 19264 - DNA, 18 bp, Homo sapiens
tctggaacaacttcatgt

SEQ ID NO: 19265 - DNA, 22 bp, Homo sapiens
tgaagaaacgcagagaggtagg

SEQ ID NO: 19266 - DNA, 22 bp, Homo sapiens
gggagaggttacccgagcaact

SEQ ID NO: 19267 - DNA, 22 bp, Homo sapiens
tcatctaagagtcttacattta

SEQ ID NO: 19268 - DNA, 22 bp, Homo sapiens
ttgtctaatgagctccacttca

SEQ ID NO: 19269 - DNA, 22 bp, Homo sapiens
taggtagctttggcgtttcttg

SEQ ID NO: 19270 - DNA, 19 bp, Homo sapiens
accttctgggaaacattcc

SEQ ID NO: 19271 - DNA, 22 bp, Homo sapiens
aggggagagttaatgtgaatgt

SEQ ID NO: 19272 - DNA, 22 bp, Homo sapiens
aaggagtctgggccattcagag

SEQ ID NO: 19273 - DNA, 22 bp, Homo sapiens
aaggccttgccgaaggatgcca

SEQ ID NO: 19274 - DNA, 22 bp, Homo sapiens
cagtgacgtaaactgcatgtgc

SEQ ID NO: 19275 - DNA, 22 bp, Homo sapiens
tccttaggcaatttgggagagt

SEQ ID NO: 19276 - DNA, 22 bp, Homo sapiens
ccttgctcaagctagtgacggg

SEQ ID NO: 19277 - DNA, 22 bp, Homo sapiens
attggtagttttgtatttctct

SEQ ID NO: 19278 - DNA, 22 bp, Homo sapiens
atatatttgagaatattcatga

SEQ ID NO: 19279 - DNA, 22 bp, Homo sapiens
tagcaaaggatgactatgtacc

SEQ ID NO: 19280 - DNA, 22 bp, Homo sapiens
gaactcattagcctgctttcag

SEQ ID NO: 19281 - DNA, 22 bp, Homo sapiens
ctctccattccctacagttttc

SEQ ID NO: 19282 - DNA, 22 bp, Homo sapiens
cagggagtgtacaccatgtgta

SEQ ID NO: 19283 - DNA, 22 bp, Homo sapiens
ttctcatgaaactcgcttcctc

SEQ ID NO: 19284 - DNA, 22 bp, Homo sapiens
gtggctcacacctgtaatccca

SEQ ID NO: 19285 - DNA, 22 bp, Homo sapiens
atgctatgtaactggcagatag

SEQ ID NO: 19286 - DNA, 22 bp, Homo sapiens
gttacagtcaggagatattttg

SEQ ID NO: 19287 - DNA, 22 bp, Homo sapiens
attgtactacaccatagtactg

SEQ ID NO: 19288 - DNA, 22 bp, Homo sapiens
gtggctcacgtctgtcatctca

SEQ ID NO: 19289 - DNA, 22 bp, Homo sapiens
ggggccttggatctgtgccccg

SEQ ID NO: 19290 - DNA, 17 bp, Homo sapiens
tactgaggggtctggag

SEQ ID NO: 19291 - DNA, 22 bp, Homo sapiens
tgtgagttattttcaggagttt

SEQ ID NO: 19292 - DNA, 22 bp, Homo sapiens
acatttatataactcactagga

SEQ ID NO: 19293 - DNA, 22 bp, Homo sapiens
atctgggagcggaggttgcagt

SEQ ID NO: 19294 - DNA, 22 bp, Homo sapiens
atgaggcaggtggaggctgcca

SEQ ID NO: 19295 - DNA, 20 bp, Homo sapiens
gttaggaggttggacatgga

SEQ ID NO: 19296 - DNA, 18 bp, Homo sapiens
tggttccttgaaggggca

SEQ ID NO: 19297 - DNA, 22 bp, Homo sapiens
tgtcttcaggagtaaatatcat

SEQ ID NO: 19298 - DNA, 22 bp, Homo sapiens
tatactctgagaaacgtgtcac

SEQ ID NO: 19299 - DNA, 22 bp, Homo sapiens
ttcaaatgatggcagtcctggc

SEQ ID NO: 19300 - DNA, 22 bp, Homo sapiens
aggattgtgcctccagtcagaa

SEQ ID NO: 19301 - DNA, 22 bp, Homo sapiens
gctaggttggggaagttctcct

SEQ ID NO: 19302 - DNA, 23 bp, Homo sapiens
caccactttctccttctccttgg

SEQ ID NO: 19303 - DNA, 22 bp, Homo sapiens
gcaaacaaggacatacatcctg

SEQ ID NO: 19304 - DNA, 22 bp, Homo sapiens
tagagtgtcataacagtgccca

SEQ ID NO: 19305 - DNA, 21 bp, Homo sapiens
tggtttatgtgcttagggtct

SEQ ID NO: 19306 - DNA, 22 bp, Homo sapiens
ttcattcttttacatgtgaata

SEQ ID NO: 19307 - DNA, 22 bp, Homo sapiens
tagcagtgtctaggtaggccat

SEQ ID NO: 19308 - DNA, 19 bp, Homo sapiens
agggaatccggctgaggga

SEQ ID NO: 19309 - DNA, 22 bp, Homo sapiens
cttgggaggcagaggttgcagt

SEQ ID NO: 19310 - DNA, 22 bp, Homo sapiens
cgtcagtttactgttgccatgg

SEQ ID NO: 19311 - DNA, 22 bp, Homo sapiens
tggttaagtccagaaaggaagc

SEQ ID NO: 19312 - DNA, 22 bp, Homo sapiens
ttcacagtggtagtgcatttag

SEQ ID NO: 19313 - DNA, 20 bp, Homo sapiens
ctgtggaattttaccatgcg

SEQ ID NO: 19314 - DNA, 22 bp, Homo sapiens
ctgagggtcaacttgattgtat

SEQ ID NO: 19315 - DNA, 22 bp, Homo sapiens
ggcatcgtcctgggcataggga

SEQ ID NO: 19316 - DNA, 22 bp, Homo sapiens
agcctattccaggatgagctca

SEQ ID NO: 19317 - DNA, 22 bp, Homo sapiens
ccaaggtgggaggattgcttga

SEQ ID NO: 19318 - DNA, 20 bp, Homo sapiens
aggccccaggtggacactag

SEQ ID NO: 19319 - DNA, 22 bp, Homo sapiens
acctcctggcctcaagcaatcc

SEQ ID NO: 19320 - DNA, 22 bp, Homo sapiens
atttagtagagaaattaagaaa

SEQ ID NO: 19321 - DNA, 22 bp, Homo sapiens
aatggcactttataaatgttaa

SEQ ID NO: 19322 - DNA, 22 bp, Homo sapiens
caccatgcctggctaatttttt

SEQ ID NO: 19323 - DNA, 22 bp, Homo sapiens
ggggcattgtgtctgggttcct

SEQ ID NO: 19324 - DNA, 22 bp, Homo sapiens
ctgatcctcctttaagtagctg

SEQ ID NO: 19325 - DNA, 22 bp, Homo sapiens
caggaagaccagggctgtggct

SEQ ID NO: 19326 - DNA, 22 bp, Homo sapiens
atatacacatctttttaaatat

SEQ ID NO: 19327 - DNA, 22 bp, Homo sapiens
agcctggtttaagcattttata

SEQ ID NO: 19328 - DNA, 22 bp, Homo sapiens
tctcctggagcccagatgctgg

SEQ ID NO: 19329 - DNA, 22 bp, Homo sapiens
gcttggccagcagccgggatgc

SEQ ID NO: 19330 - DNA, 22 bp, Homo sapiens
acatcatttgtctgtagctgaa

SEQ ID NO: 19331 - DNA, 22 bp, Homo sapiens
aggactgggtgcagagggcatc

SEQ ID NO: 19332 - DNA, 22 bp, Homo sapiens
gatctggaatctgaaggctgag

SEQ ID NO: 19333 - DNA, 22 bp, Homo sapiens
tggagaattctatgttgagggg

SEQ ID NO: 19334 - DNA, 22 bp, Homo sapiens
aggagggagcttaagccaggca

SEQ ID NO: 19335 - DNA, 22 bp, Homo sapiens
aggaggcagtctgtcccttagc

SEQ ID NO: 19336 - DNA, 19 bp, Homo sapiens
accttctgggaaacattcc

SEQ ID NO: 19337 - DNA, 22 bp, Homo sapiens
aatggcactttataaatgttaa

SEQ ID NO: 19338 - DNA, 22 bp, Homo sapiens
gctcaagccttctgcccacctc

SEQ ID NO: 19339 - DNA, 22 bp, Homo sapiens
attaaagctatccagtcatgaa

SEQ ID NO: 19340 - DNA, 22 bp, Homo sapiens
actttatttcctattgcatcca

SEQ ID NO: 19341 - DNA, 22 bp, Homo sapiens
cattgcaacttcaaactcctgg

SEQ ID NO: 19342 - DNA, 22 bp, Homo sapiens
taggcaagtggaccagaggttt

SEQ ID NO: 19343 - DNA, 22 bp, Homo sapiens
gccagccagaaacgtcacactg

SEQ ID NO: 19344 - DNA, 22 bp, Homo sapiens
tacaaaaaattgatactgacga

SEQ ID NO: 19345 - DNA, 22 bp, Homo sapiens
tgaggcaggagaatcaccggaa

SEQ ID NO: 19346 - DNA, 22 bp, Homo sapiens
ttagctcagaaaatttaaactt

SEQ ID NO: 19347 - DNA, 22 bp, Homo sapiens
ctagttctagatccctgaggaa

SEQ ID NO: 19348 - DNA, 22 bp, Homo sapiens
gaagatgttatggagagctcag

SEQ ID NO: 19349 - DNA, 22 bp, Homo sapiens
cccacgtcgaacttgctccaga

SEQ ID NO: 19350 - DNA, 22 bp, Homo sapiens
tgagatgaataactcctgctaa

SEQ ID NO: 19351 - DNA, 22 bp, Homo sapiens
gggagtgggtttggcctaggcc

SEQ ID NO: 19352 - DNA, 22 bp, Homo sapiens
tgttatcctcagctcacctcta

SEQ ID NO: 19353 - DNA, 22 bp, Homo sapiens
ttgtgaatagtgccacaataaa

SEQ ID NO: 19354 - DNA, 22 bp, Homo sapiens
tcatcagggatattggcctgaa

SEQ ID NO: 19355 - DNA, 22 bp, Homo sapiens
ctgaggaggctaatttgaggat

SEQ ID NO: 19356 - DNA, 23 bp, Homo sapiens
ggatggacgtgatgccttagcca

SEQ ID NO: 19357 - DNA, 22 bp, Homo sapiens
tggttcagttgcacaggctgtt

SEQ ID NO: 19358 - DNA, 22 bp, Homo sapiens
gaatgcttggaacctgaagttc

SEQ ID NO: 19359 - DNA, 22 bp, Homo sapiens
tgtctggtgggttgacaggcag

SEQ ID NO: 19360 - DNA, 22 bp, Homo sapiens
gacctcgtgatccgccctcctt

SEQ ID NO: 19361 - DNA, 22 bp, Homo sapiens
tggagtgcaatagtaataaggt

SEQ ID NO: 19362 - DNA, 22 bp, Homo sapiens
aatggctctgatgttgttgtga

SEQ ID NO: 19363 - DNA, 22 bp, Homo sapiens
gaagattgaaggctgggaatta

SEQ ID NO: 19364 - DNA, 22 bp, Homo sapiens
agaagccaccagctgaggaaga

SEQ ID NO: 19365 - DNA, 22 bp, Homo sapiens
cactgctacctctgcctcccgg

SEQ ID NO: 19366 - DNA, 22 bp, Homo sapiens
gaggtggccaagcgaggaaggg

SEQ ID NO: 19367 - DNA, 22 bp, Homo sapiens
cagccccacacggtctagctct

SEQ ID NO: 19368 - DNA, 22 bp, Homo sapiens
tttgaagactactgggagtgaa

SEQ ID NO: 19369 - DNA, 22 bp, Homo sapiens
gccttgtttcattacacgtggt

SEQ ID NO: 19370 - DNA, 22 bp, Homo sapiens
cagttccctccgccagcacttc

SEQ ID NO: 19371 - DNA, 22 bp, Homo sapiens
aaacttttttaggttcataggc

SEQ ID NO: 19372 - DNA, 22 bp, Homo sapiens
gaggggcacagtaaagggtccc

SEQ ID NO: 19373 - DNA, 22 bp, Homo sapiens
tccttagacaaagagtgggctt

SEQ ID NO: 19374 - DNA, 22 bp, Homo sapiens
catataaatacaacatgtgtta

SEQ ID NO: 19375 - DNA, 22 bp, Homo sapiens
gacctcatgatccacctgcctt

SEQ ID NO: 19376 - DNA, 22 bp, Homo sapiens
actcatgtaagcggaatgtagt

SEQ ID NO: 19377 - DNA, 22 bp, Homo sapiens
tgtttcttacgtttttagaggc

SEQ ID NO: 19378 - DNA, 22 bp, Homo sapiens
aaggtagggatgtattcagctt

SEQ ID NO: 19379 - DNA, 22 bp, Homo sapiens
tagcccctgcctttgaacctgg

SEQ ID NO: 19380 - DNA, 22 bp, Homo sapiens
ggcaggactgatcagtgggatg

SEQ ID NO: 19381 - DNA, 22 bp, Homo sapiens
aggtggggaggagtgtctcttt

SEQ ID NO: 19382 - DNA, 22 bp, Homo sapiens
ccctcccggcgtgctgggctcg

SEQ ID NO: 19383 - DNA, 22 bp, Homo sapiens
aggaaggactccatggtccgtc

SEQ ID NO: 19384 - DNA, 22 bp, Homo sapiens
aaccaccattctctcctcttcc

SEQ ID NO: 19385 - DNA, 22 bp, Homo sapiens
cccaggagttagaggttgtggt

SEQ ID NO: 19386 - DNA, 22 bp, Homo sapiens
actccacaccacgggggccgcc

SEQ ID NO: 19387 - DNA, 22 bp, Homo sapiens
aaattagtcatgttgtattact

SEQ ID NO: 19388 - DNA, 22 bp, Homo sapiens
attggtagttttgtatttctct

SEQ ID NO: 19389 - DNA, 22 bp, Homo sapiens
tttgaagggcacgacaatagtt

SEQ ID NO: 19390 - DNA, 22 bp, Homo sapiens
tggtggggccagacttcagctc

SEQ ID NO: 19391 - DNA, 22 bp, Homo sapiens
ttccaaagaagttcacatttac

SEQ ID NO: 19392 - DNA, 22 bp, Homo sapiens
gctgctctcagagctcatgctg

SEQ ID NO: 19393 - DNA, 22 bp, Homo sapiens
gagcccaggaagtggaggctga

SEQ ID NO: 19394 - DNA, 22 bp, Homo sapiens
gtcatcttgctgttttagatct

SEQ ID NO: 19395 - DNA, 22 bp, Homo sapiens
agcccaggagtttgaggctgtg

SEQ ID NO: 19396 - DNA, 22 bp, Homo sapiens
tccacagtggttgaactagttt

SEQ ID NO: 19397 - DNA, 22 bp, Homo sapiens
tggcgcgacgtgccccctgctt

SEQ ID NO: 19398 - DNA, 22 bp, Homo sapiens
tgctgagcgcatccggcggccg

SEQ ID NO: 19399 - DNA, 22 bp, Homo sapiens
ggggaccctcaggactgcgtct

SEQ ID NO: 19400 - DNA, 22 bp, Homo sapiens
gaaggtggcgagcggattgctg

SEQ ID NO: 19401 - DNA, 22 bp, Homo sapiens
tcagggattgcaaaattcatcc

SEQ ID NO: 19402 - DNA, 22 bp, Homo sapiens
agttggcactgagctgtgattg

SEQ ID NO: 19403 - DNA, 22 bp, Homo sapiens
gagccaggttggaggctgcagt

SEQ ID NO: 19404 - DNA, 22 bp, Homo sapiens
ggcatcgtcctgggcataggga

SEQ ID NO: 19405 - DNA, 22 bp, Homo sapiens
ttgcccaggctggagtgcagta

SEQ ID NO: 19406 - DNA, 22 bp, Homo sapiens
ggcatcttgttgctcaaatcta

SEQ ID NO: 19407 - DNA, 22 bp, Homo sapiens
caccatgcccggctaattttgg

SEQ ID NO: 19408 - DNA, 22 bp, Homo sapiens
ttgctcagtggcagggctggta

SEQ ID NO: 19409 - DNA, 22 bp, Homo sapiens
aagagggaaattgttggctgct

SEQ ID NO: 19410 - DNA, 22 bp, Homo sapiens
cttgtcttgcacacggttgcca

SEQ ID NO: 19411 - DNA, 22 bp, Homo sapiens
ctcgtgatccgcccacctcagc

SEQ ID NO: 19412 - DNA, 22 bp, Homo sapiens
tgagacaggcttccttcttggg

SEQ ID NO: 19413 - DNA, 22 bp, Homo sapiens
tctgaatcgttcccatgcagga

SEQ ID NO: 19414 - DNA, 23 bp, Homo sapiens
actctcaggttctttccagcagg

SEQ ID NO: 19415 - DNA, 22 bp, Homo sapiens
gaggcagaagttgcagtgagca

SEQ ID NO: 19416 - DNA, 22 bp, Homo sapiens
gggagcctgtggatgtctgact

SEQ ID NO: 19417 - DNA, 22 bp, Homo sapiens
atcacaaaggtctcagagcaca

SEQ ID NO: 19418 - DNA, 22 bp, Homo sapiens
tagctcaaaggttaagtgtgga

SEQ ID NO: 19419 - DNA, 22 bp, Homo sapiens
caagcgtggctgctctgatgga

SEQ ID NO: 19420 - DNA, 22 bp, Homo sapiens
ggaggcggaggttgcagtgagc

SEQ ID NO: 19421 - DNA, 22 bp, Homo sapiens
ctgcccgcaccatccccgggct

SEQ ID NO: 19422 - DNA, 22 bp, Homo sapiens
aggctgaggcaagaggatcact

SEQ ID NO: 19423 - DNA, 21 bp, Homo sapiens
aagaggaagcattatggcata

SEQ ID NO: 19424 - DNA, 23 bp, Homo sapiens
gctcatcaggcttagagtcaagg

SEQ ID NO: 19425 - DNA, 22 bp, Homo sapiens
cctacagttatattcttgattg

SEQ ID NO: 19426 - DNA, 23 bp, Homo sapiens
tctacaaagctgtgtcaggaccc

SEQ ID NO: 19427 - DNA, 22 bp, Homo sapiens
gtctctcaaaactagaagagaa

SEQ ID NO: 19428 - DNA, 22 bp, Homo sapiens
cgggttcacgccattctcctgc

SEQ ID NO: 19429 - DNA, 22 bp, Homo sapiens
aacccgggaggcagaggttgtg

SEQ ID NO: 19430 - DNA, 23 bp, Homo sapiens
ccatcccttggaagctggtttta

SEQ ID NO: 19431 - DNA, 16 bp, Homo sapiens
gaggagcccctctgcc

SEQ ID NO: 19432 - DNA, 22 bp, Homo sapiens
tctagttctagatccctgagga

SEQ ID NO: 19433 - DNA, 19 bp, Homo sapiens
agggaatccggctgaggga

SEQ ID NO: 19434 - DNA, 22 bp, Homo sapiens
tagcaaaggatgactatgtacc

SEQ ID NO: 19435 - DNA, 22 bp, Homo sapiens
gaggtgggtgtatcacaggtca

SEQ ID NO: 19436 - DNA, 21 bp, Homo sapiens
gggcagaggggcctcctgggt

SEQ ID NO: 19437 - DNA, 22 bp, Homo sapiens
agctacagtcggaaggacagac

SEQ ID NO: 19438 - DNA, 23 bp, Homo sapiens
tgtgtcatggggaaagactcacc

SEQ ID NO: 19439 - DNA, 22 bp, Homo sapiens
aacccgggaggcggaggttgtg

SEQ ID NO: 19440 - DNA, 22 bp, Homo sapiens
gcagggcacaaggacgcacagg

SEQ ID NO: 19441 - DNA, 22 bp, Homo sapiens
cccccagctctgctgggtcccg

SEQ ID NO: 19442 - DNA, 22 bp, Homo sapiens
gaccttgtgatctgcccacctt

SEQ ID NO: 19443 - DNA, 22 bp, Homo sapiens
tcttaattctgtgtcttcacta

SEQ ID NO: 19444 - DNA, 22 bp, Homo sapiens
tgggaggccgaggcaggtggat

SEQ ID NO: 19445 - DNA, 22 bp, Homo sapiens
tgcatctgcctggagtagcgcc

SEQ ID NO: 19446 - DNA, 22 bp, Homo sapiens
ggcgcccccttcaaacagagca

SEQ ID NO: 19447 - DNA, 22 bp, Homo sapiens
ctgggcctggggctgttgagag

SEQ ID NO: 19448 - DNA, 22 bp, Homo sapiens
ttcccttaaattatggcatcta

SEQ ID NO: 19449 - DNA, 22 bp, Homo sapiens
agtactgtcagcagggtgttga

SEQ ID NO: 19450 - DNA, 22 bp, Homo sapiens
gaaggaagtcattagtgcagac

SEQ ID NO: 19451 - DNA, 22 bp, Homo sapiens
gagccaggggtcagctccgagg

SEQ ID NO: 19452 - DNA, 22 bp, Homo sapiens
gttgtgaatagtgccgcaataa

SEQ ID NO: 19453 - DNA, 22 bp, Homo sapiens
gggaggcagtgctggaggctgg

SEQ ID NO: 19454 - DNA, 22 bp, Homo sapiens
tttctcctcatgactggttgtg

SEQ ID NO: 19455 - DNA, 22 bp, Homo sapiens
tgaggcaggagttcaggctgcg

SEQ ID NO: 19456 - DNA, 22 bp, Homo sapiens
gctgctctccaagcctccttga

SEQ ID NO: 19457 - DNA, 22 bp, Homo sapiens
tgaggcaggaggttgagaactg

SEQ ID NO: 19458 - DNA, 22 bp, Homo sapiens
ctcatcagaaatacctgacaaa

SEQ ID NO: 19459 - DNA, 22 bp, Homo sapiens
caagtggtttatgggagttcca

SEQ ID NO: 19460 - DNA, 16 bp, Homo sapiens
gcgcctcctcggcctc

SEQ ID NO: 19461 - DNA, 22 bp, Homo sapiens
ttggaaacgtcaccttttcctt

SEQ ID NO: 19462 - DNA, 21 bp, Homo sapiens
ctacttaagtaggggattagg

SEQ ID NO: 19463 - DNA, 22 bp, Homo sapiens
tacatagctcctagtgatgcat

SEQ ID NO: 19464 - DNA, 22 bp, Homo sapiens
tcatctaagagtcttacattta

SEQ ID NO: 19465 - DNA, 22 bp, Homo sapiens
gcctgctcccagttggcgcctc

SEQ ID NO: 19466 - DNA, 22 bp, Homo sapiens
agcctgcgatcccacctggcct

SEQ ID NO: 19467 - DNA, 22 bp, Homo sapiens
ctgtctgaatcctaagcttcct

SEQ ID NO: 19468 - DNA, 22 bp, Homo sapiens
ggaggtgactggatcatgggca

SEQ ID NO: 19469 - DNA, 22 bp, Homo sapiens
taatggattaacgtccctgtcg

SEQ ID NO: 19470 - DNA, 22 bp, Homo sapiens
ctgaggagaggtggcctgtgtt

SEQ ID NO: 19471 - DNA, 22 bp, Homo sapiens
gaattttattactagtcaactg

SEQ ID NO: 19472 - DNA, 22 bp, Homo sapiens
agcaggagtttgatgcttttat

SEQ ID NO: 19473 - DNA, 22 bp, Homo sapiens
ttctacagtgactgcagccata

SEQ ID NO: 19474 - DNA, 22 bp, Homo sapiens
gaatatcccgctatgcaaagta

SEQ ID NO: 19475 - DNA, 22 bp, Homo sapiens
agcccaggctggagtgcagtgg

SEQ ID NO: 19476 - DNA, 22 bp, Homo sapiens
gcagttaaaaataaaccttcat

SEQ ID NO: 19477 - DNA, 20 bp, Homo sapiens
tatttctgggcaaccattta

SEQ ID NO: 19478 - DNA, 22 bp, Homo sapiens
ggcaagagggcagatggagtgc

SEQ ID NO: 19479 - DNA, 22 bp, Homo sapiens
gggagccccacctcggtgcccg

SEQ ID NO: 19480 - DNA, 22 bp, Homo sapiens
tgatgcgtctcctctttcaggt

SEQ ID NO: 19481 - DNA, 22 bp, Homo sapiens
cttgtagacccctggactcacg

SEQ ID NO: 19482 - DNA, 22 bp, Homo sapiens
tatgccactgctctccatccta

SEQ ID NO: 19483 - DNA, 22 bp, Homo sapiens
attttctatgttgtaattgtta

SEQ ID NO: 19484 - DNA, 22 bp, Homo sapiens
tgcacgtgtgagcattcacatg

SEQ ID NO: 19485 - DNA, 22 bp, Homo sapiens
catttacatttaaggttaatat

SEQ ID NO: 19486 - DNA, 22 bp, Homo sapiens
cccagttgttgccggctctgga

SEQ ID NO: 19487 - DNA, 22 bp, Homo sapiens
tttgtgaataggttggcttcca

SEQ ID NO: 19488 - DNA, 22 bp, Homo sapiens
ccttacactgcctggggccacg

SEQ ID NO: 19489 - DNA, 22 bp, Homo sapiens
ggcagacctctccagccccaca

SEQ ID NO: 19490 - DNA, 22 bp, Homo sapiens
cagccctcctaccctgccaggc

SEQ ID NO: 19491 - DNA, 22 bp, Homo sapiens
aactcactttgtggcttctgaa

SEQ ID NO: 19492 - DNA, 22 bp, Homo sapiens
ggcccaggctggagtgcagtgg

SEQ ID NO: 19493 - DNA, 23 bp, Homo sapiens
ggagtgcaatggcgccatctcgg

SEQ ID NO: 19494 - DNA, 22 bp, Homo sapiens
agagctaagaaacagaattgct

SEQ ID NO: 19495 - DNA, 16 bp, Homo sapiens
tgggtgggaggagcgg

SEQ ID NO: 19496 - DNA, 22 bp, Homo sapiens
ggaggctgaggcaggcggatca

SEQ ID NO: 19497 - DNA, 22 bp, Homo sapiens
actcatgtcctaggagtaaagc

SEQ ID NO: 19498 - DNA, 22 bp, Homo sapiens
gtctttatttgagattgtcatt

SEQ ID NO: 19499 - DNA, 22 bp, Homo sapiens
ggagaagaggagctggaagcct

SEQ ID NO: 19500 - DNA, 22 bp, Homo sapiens
tggacaggcaagcaagacatac

SEQ ID NO: 19501 - DNA, 22 bp, Homo sapiens
agcccaggttgaggctgcagtg

SEQ ID NO: 19502 - DNA, 22 bp, Homo sapiens
caggcagggagctggaaaggat

SEQ ID NO: 19503 - DNA, 22 bp, Homo sapiens
actgcaacctccgcctgccagg

SEQ ID NO: 19504 - DNA, 22 bp, Homo sapiens
ttggatccatctcaggcatagg

SEQ ID NO: 19505 - DNA, 22 bp, Homo sapiens
acatcttttactctggttcggg

SEQ ID NO: 19506 - DNA, 22 bp, Homo sapiens
gaaaattattgaaaatggctct

SEQ ID NO: 19507 - DNA, 22 bp, Homo sapiens
actgttttctgtaaagggccag

SEQ ID NO: 19508 - DNA, 22 bp, Homo sapiens
caagatcttcctcaatagacct

SEQ ID NO: 19509 - DNA, 22 bp, Homo sapiens
gagggagggactagcattctct

SEQ ID NO: 19510 - DNA, 22 bp, Homo sapiens
aggtggcagatgggggtgctcg

SEQ ID NO: 19511 - DNA, 22 bp, Homo sapiens
agggcgacaatggagagcgttt

SEQ ID NO: 19512 - DNA, 22 bp, Homo sapiens
ggccagaagttggaaaagagcc

SEQ ID NO: 19513 - DNA, 18 bp, Homo sapiens
actctttctgcccacagg

SEQ ID NO: 19514 - DNA, 22 bp, Homo sapiens
cagtgacgtaaactgcatgtgc

SEQ ID NO: 19515 - DNA, 22 bp, Homo sapiens
ttcattcttcagagctgcgctt

SEQ ID NO: 19516 - DNA, 22 bp, Homo sapiens
ccccatgaagtagggtctctga

SEQ ID NO: 19517 - DNA, 22 bp, Homo sapiens
cggagcctgcttgttgcagctg

SEQ ID NO: 19518 - DNA, 17 bp, Homo sapiens
gacctcaggtgatctgc

SEQ ID NO: 19519 - DNA, 22 bp, Homo sapiens
catctttgcccatccacttcca

SEQ ID NO: 19520 - DNA, 22 bp, Homo sapiens
tcacagctcactgtagcctcga

SEQ ID NO: 19521 - DNA, 20 bp, Homo sapiens
ttcaggaataagatagcagc

SEQ ID NO: 19522 - DNA, 19 bp, Homo sapiens
gttctttcatagtaagagc

SEQ ID NO: 19523 - DNA, 22 bp, Homo sapiens
gaggcaggaggattgcttgagc

SEQ ID NO: 19524 - DNA, 22 bp, Homo sapiens
gcagctattgtctcctgggccc

SEQ ID NO: 19525 - DNA, 21 bp, Homo sapiens
taaacataaccttgtatggct

SEQ ID NO: 19526 - DNA, 22 bp, Homo sapiens
aggacgctctcgctgaacttct

SEQ ID NO: 19527 - DNA, 22 bp, Homo sapiens
tcaggaggcggaggttgcagtg

SEQ ID NO: 19528 - DNA, 22 bp, Homo sapiens
tagagcaatgctctactccttg

SEQ ID NO: 19529 - DNA, 22 bp, Homo sapiens
gagcccaggagtttgatgctgc

SEQ ID NO: 19530 - DNA, 22 bp, Homo sapiens
ccctggctgataccggaaaggc

SEQ ID NO: 19531 - DNA, 22 bp, Homo sapiens
aggcaaggtgctacagacagtg

SEQ ID NO: 19532 - DNA, 22 bp, Homo sapiens
tgagcctgtcattattcagaga

SEQ ID NO: 19533 - DNA, 22 bp, Homo sapiens
tgcctgtggaaaggctggtgct

SEQ ID NO: 19534 - DNA, 22 bp, Homo sapiens
aaaggggtaatctaaggaattc

SEQ ID NO: 19535 - DNA, 22 bp, Homo sapiens
tggaggcagccgtgaaccacct

SEQ ID NO: 19536 - DNA, 22 bp, Homo sapiens
ttaaactgcttgaattgggttt

SEQ ID NO: 19537 - DNA, 22 bp, Homo sapiens
ggaggcggaggctgcagtgagc

SEQ ID NO: 19538 - DNA, 22 bp, Homo sapiens
ctggctcctgtttaaccagctg

SEQ ID NO: 19539 - DNA, 22 bp, Homo sapiens
ttttctgtttgcttcaagacat

SEQ ID NO: 19540 - DNA, 22 bp, Homo sapiens
gagagttagttgagcagtctga

SEQ ID NO: 19541 - DNA, 20 bp, Homo sapiens
attagctcaggtgaggtcat

SEQ ID NO: 19542 - DNA, 22 bp, Homo sapiens
ttgcccagagtcacccagctca

SEQ ID NO: 19543 - DNA, 22 bp, Homo sapiens
tctgaggctgaatggactccgt

SEQ ID NO: 19544 - DNA, 22 bp, Homo sapiens
tgggtactcctattagttcagt

SEQ ID NO: 19545 - DNA, 22 bp, Homo sapiens
gaatttaagaggatgaatctgt

SEQ ID NO: 19546 - DNA, 22 bp, Homo sapiens
tgggaggccaaggcaggcggat

SEQ ID NO: 19547 - DNA, 22 bp, Homo sapiens
agttggagtgaacatgagattg

SEQ ID NO: 19548 - DNA, 21 bp, Homo sapiens
ggtgctcgctgatgaggagtg

SEQ ID NO: 19549 - DNA, 22 bp, Homo sapiens
tgaactcctgacctcatgatcc

SEQ ID NO: 19550 - DNA, 20 bp, Homo sapiens
aggccccaggtggacactag

SEQ ID NO: 19551 - DNA, 22 bp, Homo sapiens
ttgctttgcagtgcctatagga

SEQ ID NO: 19552 - DNA, 22 bp, Homo sapiens
tagcccaggctggagtgcaggg

SEQ ID NO: 19553 - DNA, 22 bp, Homo sapiens
gagagtctaggaacctcatata

SEQ ID NO: 19554 - DNA, 22 bp, Homo sapiens
ttgggctcaggagtttgagacc

SEQ ID NO: 19555 - DNA, 22 bp, Homo sapiens
tgggcaaggctggagcctgcag

SEQ ID NO: 19556 - DNA, 22 bp, Homo sapiens
attgtgaatagtgccgcagtaa

SEQ ID NO: 19557 - DNA, 20 bp, Homo sapiens
ggcagagggcctgggagaag

SEQ ID NO: 19558 - DNA, 22 bp, Homo sapiens
tgtgggagaaggaagcaagctg

SEQ ID NO: 19559 - DNA, 22 bp, Homo sapiens
aactatgttaataagtttcatt

SEQ ID NO: 19560 - DNA, 22 bp, Homo sapiens
ttgcccaggctggagtgcagtg

SEQ ID NO: 19561 - DNA, 22 bp, Homo sapiens
ctagggtcaggggcctgcgtcg

SEQ ID NO: 19562 - DNA, 22 bp, Homo sapiens
agaggcaggaggttgacttgag

SEQ ID NO: 19563 - DNA, 22 bp, Homo sapiens
gagccaggtcgggccgcggcga

SEQ ID NO: 19564 - DNA, 22 bp, Homo sapiens
attaagtgttttacatacatta

SEQ ID NO: 19565 - DNA, 20 bp, Homo sapiens
gggcagagccagccagtccc

SEQ ID NO: 19566 - DNA, 22 bp, Homo sapiens
agaggcagtatacaatccgagc

SEQ ID NO: 19567 - DNA, 22 bp, Homo sapiens
gagccaggaggcagagactgca

SEQ ID NO: 19568 - DNA, 22 bp, Homo sapiens
tgagtggacacctgcttcttta

SEQ ID NO: 19569 - DNA, 22 bp, Homo sapiens
caggccagggttgagaagagaa

SEQ ID NO: 19570 - DNA, 22 bp, Homo sapiens
gtgggggcaggcagtgctagga

SEQ ID NO: 19571 - DNA, 22 bp, Homo sapiens
gaggcagaggttgcagtgagct

SEQ ID NO: 19572 - DNA, 22 bp, Homo sapiens
agccagactgtgatgtgattaa

SEQ ID NO: 19573 - DNA, 22 bp, Homo sapiens
cttcatcagctggcttactgtt

SEQ ID NO: 19574 - DNA, 22 bp, Homo sapiens
ggagacagggttgaaccacgca

SEQ ID NO: 19575 - DNA, 22 bp, Homo sapiens
ttaaattttagaaacagactct

SEQ ID NO: 19576 - DNA, 22 bp, Homo sapiens
aagtaggtaccgcgcagcaggg

SEQ ID NO: 19577 - DNA, 19 bp, Homo sapiens
taggaccctggtggccccc

SEQ ID NO: 19578 - DNA, 22 bp, Homo sapiens
atgctatgtaactggcagatag

SEQ ID NO: 19579 - DNA, 22 bp, Homo sapiens
ttcacagcttaataaggctcag

SEQ ID NO: 19580 - DNA, 22 bp, Homo sapiens
tgaggcaggtggattacaaggt

SEQ ID NO: 19581 - DNA, 22 bp, Homo sapiens
tgaatgtgatgctaaacatatg

SEQ ID NO: 19582 - DNA, 21 bp, Homo sapiens
ggagtttttctggaagggact

SEQ ID NO: 19583 - DNA, 18 bp, Homo sapiens
gaggatggaaggagatgc

SEQ ID NO: 19584 - DNA, 22 bp, Homo sapiens
tcagacattattttcaagataa

SEQ ID NO: 19585 - DNA, 22 bp, Homo sapiens
aggtgggcggattcatgaggtc

SEQ ID NO: 19586 - DNA, 22 bp, Homo sapiens
tcagtgttaatcagtggtacct

SEQ ID NO: 19587 - DNA, 22 bp, Homo sapiens
gcccgcgccagcctctccatct

SEQ ID NO: 19588 - DNA, 22 bp, Homo sapiens
gactggaaagcctgtcctcaga

SEQ ID NO: 19589 - DNA, 22 bp, Homo sapiens
gtttctctgtctgttacattgg

SEQ ID NO: 19590 - DNA, 22 bp, Homo sapiens
tgtaggagtccaatcaggagac

SEQ ID NO: 19591 - DNA, 22 bp, Homo sapiens
tcgtgatctgtccacctcggcc

SEQ ID NO: 19592 - DNA, 22 bp, Homo sapiens
cagcgtctcgttgtgggcctcg

SEQ ID NO: 19593 - DNA, 22 bp, Homo sapiens
atatatttgagaatattcatga

SEQ ID NO: 19594 - DNA, 22 bp, Homo sapiens
agggactatttacccatctcac

SEQ ID NO: 19595 - DNA, 22 bp, Homo sapiens
attgagaagaaaatctaatata

SEQ ID NO: 19596 - DNA, 22 bp, Homo sapiens
ttgatgagaccattgccgcgtc

SEQ ID NO: 19597 - DNA, 22 bp, Homo sapiens
gagacacaggcacagaagaggc

SEQ ID NO: 19598 - DNA, 22 bp, Homo sapiens
ccaggaggcggaaggtacagtg

SEQ ID NO: 19599 - DNA, 19 bp, Homo sapiens
cggcccctcctctcgcgcc

SEQ ID NO: 19600 - DNA, 22 bp, Homo sapiens
aatgcaatgcagcacctccttg

SEQ ID NO: 19601 - DNA, 22 bp, Homo sapiens
cccagcaggtcggtgctgcctg

SEQ ID NO: 19602 - DNA, 22 bp, Homo sapiens
acgaggttggagagttgtttgg

SEQ ID NO: 19603 - DNA, 22 bp, Homo sapiens
ttttaatactgctattgtagga

SEQ ID NO: 19604 - DNA, 22 bp, Homo sapiens
tcaatcacgtgttccatgttct

SEQ ID NO: 19605 - DNA, 22 bp, Homo sapiens
ggtgggaggactgtttgaggca

SEQ ID NO: 19606 - DNA, 22 bp, Homo sapiens
ctcctctttagccccagctgga

SEQ ID NO: 19607 - DNA, 22 bp, Homo sapiens
tgttaaatgctcagctcgggga

SEQ ID NO: 19608 - DNA, 20 bp, Homo sapiens
tttgagaccagtctgcccaa

SEQ ID NO: 19609 - DNA, 22 bp, Homo sapiens
atttagtagagaaattaagaaa

SEQ ID NO: 19610 - DNA, 22 bp, Homo sapiens
tggaagaatatgggggtacaga

SEQ ID NO: 19611 - DNA, 22 bp, Homo sapiens
atatattttttgagacagagtc

SEQ ID NO: 19612 - DNA, 22 bp, Homo sapiens
tgaggcaggacttgcataaagt

SEQ ID NO: 19613 - DNA, 22 bp, Homo sapiens
ctgcagtcatctgaagattttg

SEQ ID NO: 19614 - DNA, 22 bp, Homo sapiens
ttatcacttatgagctttttgc

SEQ ID NO: 19615 - DNA, 22 bp, Homo sapiens
cagtggcgtgatctctgctcac

SEQ ID NO: 19616 - DNA, 22 bp, Homo sapiens
aggctagaggcttctggcttca

SEQ ID NO: 19617 - DNA, 22 bp, Homo sapiens
acagttaataagtagtaagtca

SEQ ID NO: 19618 - DNA, 23 bp, Homo sapiens
cagtacaatgtggaaaaggagtg

SEQ ID NO: 19619 - DNA, 22 bp, Homo sapiens
cggggacacactggcagctcct

SEQ ID NO: 19620 - DNA, 22 bp, Homo sapiens
tgtgtttctgagaatcccacct

SEQ ID NO: 19621 - DNA, 22 bp, Homo sapiens
tgggactcactcttttggccag

SEQ ID NO: 19622 - DNA, 22 bp, Homo sapiens
tgagaaacttgccaagcatctc

SEQ ID NO: 19623 - DNA, 22 bp, Homo sapiens
gagtgcagtggcgtgatctctg

SEQ ID NO: 19624 - DNA, 22 bp, Homo sapiens
agagggatcaccctgtttctgg

SEQ ID NO: 19625 - DNA, 22 bp, Homo sapiens
cctgccagagcagcttgtcctc

SEQ ID NO: 19626 - DNA, 23 bp, Homo sapiens
tgaggcaggcggatcacgaggtc

SEQ ID NO: 19627 - DNA, 22 bp, Homo sapiens
cccaggaggcggaggttgcagt

SEQ ID NO: 19628 - DNA, 22 bp, Homo sapiens
cctgggtttggagcctgcagaa

SEQ ID NO: 19629 - DNA, 22 bp, Homo sapiens
attataggcttgagccaccgtg

SEQ ID NO: 19630 - DNA, 22 bp, Homo sapiens
ataaaaactgacccatcctttg

SEQ ID NO: 19631 - DNA, 22 bp, Homo sapiens
cggctcactgcagctccgcctc

SEQ ID NO: 19632 - DNA, 22 bp, Homo sapiens
ttccaaaggctgcaccttgccc

SEQ ID NO: 19633 - DNA, 22 bp, Homo sapiens
catccctgtcgtcaagtctctg

SEQ ID NO: 19634 - DNA, 22 bp, Homo sapiens
agtcccaacagcttacaaggaa

SEQ ID NO: 19635 - DNA, 22 bp, Homo sapiens
gtcacaaagcgcggtggtcggt

SEQ ID NO: 19636 - DNA, 22 bp, Homo sapiens
gaagtgtagtcttgagccccca

SEQ ID NO: 19637 - DNA, 22 bp, Homo sapiens
attgcagatgatccccaagtta

SEQ ID NO: 19638 - DNA, 22 bp, Homo sapiens
aggcaggaggatcatggatgca

SEQ ID NO: 19639 - DNA, 21 bp, Homo sapiens
tctgccagctgaagaggtgga

SEQ ID NO: 19640 - DNA, 22 bp, Homo sapiens
gtcttagatttcaccgataatg

SEQ ID NO: 19641 - DNA, 21 bp, Homo sapiens
acgggaatgaacatggtggag

SEQ ID NO: 19642 - DNA, 22 bp, Homo sapiens
taggtaggtggaaaagtaattg

SEQ ID NO: 19643 - DNA, 22 bp, Homo sapiens
tcaggaggtccgcccgggaggg

SEQ ID NO: 19644 - DNA, 22 bp, Homo sapiens
tctcatctgccatttgcaggag

SEQ ID NO: 19645 - DNA, 22 bp, Homo sapiens
aactctatttaccctactaaac

SEQ ID NO: 19646 - DNA, 22 bp, Homo sapiens
gctccccaaaagctccaggaaa

SEQ ID NO: 19647 - DNA, 22 bp, Homo sapiens
gaggcagaggttgttgcagtga

SEQ ID NO: 19648 - DNA, 22 bp, Homo sapiens
ctggtttgtcttgggaggatgt

SEQ ID NO: 19649 - DNA, 22 bp, Homo sapiens
ttagatttacaagcactgttta

SEQ ID NO: 19650 - DNA, 22 bp, Homo sapiens
ccaggctgctgttggtgtccgc

SEQ ID NO: 19651 - DNA, 22 bp, Homo sapiens
cacagctgtgagaagggagcct

SEQ ID NO: 19652 - DNA, 22 bp, Homo sapiens
tcctccccaaagcccagcctgg

SEQ ID NO: 19653 - DNA, 22 bp, Homo sapiens
agaggaagtaatcaggacctgc

SEQ ID NO: 19654 - DNA, 22 bp, Homo sapiens
tttgcattgcattaagtattct

SEQ ID NO: 19655 - DNA, 21 bp, Homo sapiens
tgactgaggcttcttcacaca

SEQ ID NO: 19656 - DNA, 22 bp, Homo sapiens
agagcaattctcaaggaggtgt

SEQ ID NO: 19657 - DNA, 22 bp, Homo sapiens
gcgtctcaaggcccccaggcca

SEQ ID NO: 19658 - DNA, 22 bp, Homo sapiens
tgcaggctcttggtgacgtggg

SEQ ID NO: 19659 - DNA, 22 bp, Homo sapiens
gagcccaggcagaggttgcagt

SEQ ID NO: 19660 - DNA, 22 bp, Homo sapiens
gggaagagggagctggaatgat

SEQ ID NO: 19661 - DNA, 17 bp, Homo sapiens
gtaaggcttgcagatgc

SEQ ID NO: 19662 - DNA, 22 bp, Homo sapiens
tggtccgctcctattcgccgca

SEQ ID NO: 19663 - DNA, 22 bp, Homo sapiens
tgtcttcgctacaatgaaaagg

SEQ ID NO: 19664 - DNA, 22 bp, Homo sapiens
gcaggcagaggtggaggagaca

SEQ ID NO: 19665 - DNA, 22 bp, Homo sapiens
tggacaacatagtgagacctca

SEQ ID NO: 19666 - DNA, 22 bp, Homo sapiens
gtgaaatatttaacgtccaggt

SEQ ID NO: 19667 - DNA, 22 bp, Homo sapiens
ttcattcttttacatgtgaata

SEQ ID NO: 19668 - DNA, 22 bp, Homo sapiens
tagatctgatacaattcatctg

SEQ ID NO: 19669 - DNA, 22 bp, Homo sapiens
tgaagaaacgcagagaggtagg

SEQ ID NO: 19670 - DNA, 22 bp, Homo sapiens
aggccctattcaatggggccca

SEQ ID NO: 19671 - DNA, 22 bp, Homo sapiens
ccccacaactcatgttgaaact

SEQ ID NO: 19672 - DNA, 22 bp, Homo sapiens
tccctagtcgcatctgtggaga

SEQ ID NO: 19673 - DNA, 22 bp, Homo sapiens
cctgtctctgcagggccctgcc

SEQ ID NO: 19674 - DNA, 22 bp, Homo sapiens
tgagcaggcgcagcaggaggtc

SEQ ID NO: 19675 - DNA, 22 bp, Homo sapiens
gaggtgggcggatcacaaggtc

SEQ ID NO: 19676 - DNA, 22 bp, Homo sapiens
gaactcattagcctgctttcag

SEQ ID NO: 19677 - DNA, 23 bp, Homo sapiens
agagcaaggaaatgaggtgtgat

SEQ ID NO: 19678 - DNA, 22 bp, Homo sapiens
tcactgcaacctccacctcctg

SEQ ID NO: 19679 - DNA, 22 bp, Homo sapiens
ctctccattccctacagttttc

SEQ ID NO: 19680 - DNA, 22 bp, Homo sapiens
ggaggaggggtgactgaatgct

SEQ ID NO: 19681 - DNA, 22 bp, Homo sapiens
ggaggcggaagttgcagtgagc

SEQ ID NO: 19682 - DNA, 22 bp, Homo sapiens
ggcaggaggtgagtggcgggtg

SEQ ID NO: 19683 - DNA, 22 bp, Homo sapiens
gccaggaaagggaattccctga

SEQ ID NO: 19684 - DNA, 22 bp, Homo sapiens
ggccactgctctccagcctggg

SEQ ID NO: 19685 - DNA, 22 bp, Homo sapiens
gaagccttgaactgcaaacccc

SEQ ID NO: 19686 - DNA, 22 bp, Homo sapiens
ttggagatatcacaccttcaca

SEQ ID NO: 19687 - DNA, 22 bp, Homo sapiens
aggtaggcctgacgctggggtg

SEQ ID NO: 19688 - DNA, 22 bp, Homo sapiens
aaggagtctgggccattcagag

SEQ ID NO: 19689 - DNA, 22 bp, Homo sapiens
ggctgagtctgtgacccatgcg

SEQ ID NO: 19690 - DNA, 22 bp, Homo sapiens
ccctcaggtgaaaggaaaaatt

SEQ ID NO: 19691 - DNA, 22 bp, Homo sapiens
ggaggcagaatagagtgtgggt

SEQ ID NO: 19692 - DNA, 22 bp, Homo sapiens
ctggtagtttgcaaaatggtgt

SEQ ID NO: 19693 - DNA, 22 bp, Homo sapiens
aggtggaaatggctttcctagg

SEQ ID NO: 19694 - DNA, 22 bp, Homo sapiens
tataaactcctcttgcattcct

SEQ ID NO: 19695 - DNA, 22 bp, Homo sapiens
aagagagtcagtctgagcacca

SEQ ID NO: 19696 - DNA, 22 bp, Homo sapiens
aagccaggttccatggaggagc

SEQ ID NO: 19697 - DNA, 22 bp, Homo sapiens
cccaggaattggaggctgcagt

SEQ ID NO: 19698 - DNA, 22 bp, Homo sapiens
tgaggcaggagaatcacatgaa

SEQ ID NO: 19699 - DNA, 22 bp, Homo sapiens
tttattctgtgctacatgaaga

SEQ ID NO: 19700 - DNA, 22 bp, Homo sapiens
ttatttgtggcatatgagacga

SEQ ID NO: 19701 - DNA, 22 bp, Homo sapiens
gctgtctcatacaaggccctgc

SEQ ID NO: 19702 - DNA, 19 bp, Homo sapiens
ttctggtctggaatcaagg

SEQ ID NO: 19703 - DNA, 22 bp, Homo sapiens
tctcgatctcctgaccttgtga

SEQ ID NO: 19704 - DNA, 22 bp, Homo sapiens
tgaggcaggaggattgcaggat

SEQ ID NO: 19705 - DNA, 22 bp, Homo sapiens
gtgcccagcagcagcgtccccg

SEQ ID NO: 19706 - DNA, 22 bp, Homo sapiens
gggaggcacgaggcgcgcagtg

SEQ ID NO: 19707 - DNA, 23 bp, Homo sapiens
gacagagtgagaccttgtcttac

SEQ ID NO: 19708 - DNA, 22 bp, Homo sapiens
gattcactcatattttacgttt

SEQ ID NO: 19709 - DNA, 22 bp, Homo sapiens
ctggaaggagcccgggcggatc

SEQ ID NO: 19710 - DNA, 22 bp, Homo sapiens
gaggcaggcagattgcttgagg

SEQ ID NO: 19711 - DNA, 22 bp, Homo sapiens
tccacagtggttgaactagtaa

SEQ ID NO: 19712 - DNA, 22 bp, Homo sapiens
tcactgcaacctccacctcccg

SEQ ID NO: 19713 - DNA, 22 bp, Homo sapiens
gagaggaagccttctgtacttg

SEQ ID NO: 19714 - DNA, 22 bp, Homo sapiens
cccagtttcaactttccagtgg

SEQ ID NO: 19715 - DNA, 22 bp, Homo sapiens
tagttcaacgagttggggttgc

SEQ ID NO: 19716 - DNA, 22 bp, Homo sapiens
ataaagtggaggtagtattcat

SEQ ID NO: 19717 - DNA, 22 bp, Homo sapiens
gatggaggagatggcagggtgc

SEQ ID NO: 19718 - DNA, 22 bp, Homo sapiens
ggaggtggagctggaagttcca

SEQ ID NO: 19719 - DNA, 22 bp, Homo sapiens
ctggcaagaaatatatatctta

SEQ ID NO: 19720 - DNA, 22 bp, Homo sapiens
gggcagagactcagaaacagaa

SEQ ID NO: 19721 - DNA, 22 bp, Homo sapiens
aaggaggcctggcagatgaaga

SEQ ID NO: 19722 - DNA, 22 bp, Homo sapiens
aagaaatgtgaatattgaatag

SEQ ID NO: 19723 - DNA, 22 bp, Homo sapiens
ggtcgctgtgtaggttcagcta

SEQ ID NO: 19724 - DNA, 22 bp, Homo sapiens
tagcataacaggtaagagtgag

SEQ ID NO: 19725 - DNA, 22 bp, Homo sapiens
gaggaggcttccgggaggcacg

SEQ ID NO: 19726 - DNA, 22 bp, Homo sapiens
acccatggtctggtggggccct

SEQ ID NO: 19727 - DNA, 22 bp, Homo sapiens
cgcaactcagcaacttaactgc

SEQ ID NO: 19728 - DNA, 22 bp, Homo sapiens
gagctctgactgctgggtgaca

SEQ ID NO: 19729 - DNA, 22 bp, Homo sapiens
gggcagagagctggaactcctt

SEQ ID NO: 19730 - DNA, 22 bp, Homo sapiens
aaagaaggtagggctggtgact

SEQ ID NO: 19731 - DNA, 22 bp, Homo sapiens
aagaagagaactggcatcctaa

SEQ ID NO: 19732 - DNA, 22 bp, Homo sapiens
cacgttaacagctaacagatga

SEQ ID NO: 19733 - DNA, 22 bp, Homo sapiens
tcacaaatgtttgcatgtgtct

SEQ ID NO: 19734 - DNA, 22 bp, Homo sapiens
gaggtaggtgtaggaggcctgc

SEQ ID NO: 19735 - DNA, 22 bp, Homo sapiens
atgagctagaaaaccatgtgga

SEQ ID NO: 19736 - DNA, 22 bp, Homo sapiens
ttctatttttgtggaactgtag

SEQ ID NO: 19737 - DNA, 22 bp, Homo sapiens
ttttggccacatccttttgagt

SEQ ID NO: 19738 - DNA, 22 bp, Homo sapiens
ggaggggatttagtagatgcta

SEQ ID NO: 19739 - DNA, 22 bp, Homo sapiens
ggaggcggaggttgcagtgagt

SEQ ID NO: 19740 - DNA, 22 bp, Homo sapiens
ggaggtggaggttgcagtgagc

SEQ ID NO: 19741 - DNA, 22 bp, Homo sapiens
tgggcagggagctggaaccaca

SEQ ID NO: 19742 - DNA, 22 bp, Homo sapiens
cagctacaaatacttttgtatg

SEQ ID NO: 19743 - DNA, 22 bp, Homo sapiens
tcgcgcccccaagcgtcattgg

SEQ ID NO: 19744 - DNA, 22 bp, Homo sapiens
aagccggctgggccgaggctgc

SEQ ID NO: 19745 - DNA, 22 bp, Homo sapiens
ggggtgggcgtgcagggacacc

SEQ ID NO: 19746 - DNA, 22 bp, Homo sapiens
acatttatataactcactagga

SEQ ID NO: 19747 - DNA, 22 bp, Homo sapiens
ctgccgttgtgaagctcttaga

SEQ ID NO: 19748 - DNA, 22 bp, Homo sapiens
ggagagtggattccagctgtat

SEQ ID NO: 19749 - DNA, 22 bp, Homo sapiens
aagaggagaaaggctggctttg

SEQ ID NO: 19750 - DNA, 22 bp, Homo sapiens
cccaggctggagtgcagtggcg

SEQ ID NO: 19751 - DNA, 22 bp, Homo sapiens
tgctgttagtaaggaacatgac

SEQ ID NO: 19752 - DNA, 22 bp, Homo sapiens
tggtgggctgagtctcatcgga

SEQ ID NO: 19753 - DNA, 22 bp, Homo sapiens
cttctgagatgttgttttacag

SEQ ID NO: 19754 - DNA, 22 bp, Homo sapiens
aacccgggaggtggaggttatg

SEQ ID NO: 19755 - DNA, 22 bp, Homo sapiens
caggcaggtcagtgaagaagga

SEQ ID NO: 19756 - DNA, 22 bp, Homo sapiens
ttaataaagtatgaattggaaa

SEQ ID NO: 19757 - DNA, 20 bp, Homo sapiens
gtctccactgggggttaacc

SEQ ID NO: 19758 - DNA, 22 bp, Homo sapiens
gagagcaggaggcagcgggacg

SEQ ID NO: 19759 - DNA, 22 bp, Homo sapiens
aaaatatgtataactcttctgc

SEQ ID NO: 19760 - DNA, 22 bp, Homo sapiens
ggaggtgggctaaggactctct

SEQ ID NO: 19761 - DNA, 22 bp, Homo sapiens
tttctaatctgattctcctacc

SEQ ID NO: 19762 - DNA, 22 bp, Homo sapiens
cccatgcaccctctaagaagga

SEQ ID NO: 19763 - DNA, 22 bp, Homo sapiens
tttgttttcaatgtgtcattca

SEQ ID NO: 19764 - DNA, 22 bp, Homo sapiens
caggagtccatctggcctggtg

SEQ ID NO: 19765 - DNA, 22 bp, Homo sapiens
caggaaggcgcggctgtgcctg

SEQ ID NO: 19766 - DNA, 22 bp, Homo sapiens
gcaaacaaggacatacatcctg

SEQ ID NO: 19767 - DNA, 22 bp, Homo sapiens
aagcttcctgcatgggactgct

SEQ ID NO: 19768 - DNA, 22 bp, Homo sapiens
ggtgggagagcttgctttgatg

SEQ ID NO: 19769 - DNA, 22 bp, Homo sapiens
tctaaattactttgggcagtat

SEQ ID NO: 19770 - DNA, 22 bp, Homo sapiens
gaggaggcagcctatcccttag

SEQ ID NO: 19771 - DNA, 22 bp, Homo sapiens
agagcacagggttttgtgccgg

SEQ ID NO: 19772 - DNA, 22 bp, Homo sapiens
tcaccgaggctggagtgcagtg

SEQ ID NO: 19773 - DNA, 22 bp, Homo sapiens
gagcaggaaggccagaagggtc

SEQ ID NO: 19774 - DNA, 22 bp, Homo sapiens
tagactggtgaattagggggaa

SEQ ID NO: 19775 - DNA, 22 bp, Homo sapiens
tgagatcattgacttgttcctg

SEQ ID NO: 19776 - DNA, 22 bp, Homo sapiens
cttctttcaagaatggattagg

SEQ ID NO: 19777 - DNA, 22 bp, Homo sapiens
acagttaattgttgttgggtgt

SEQ ID NO: 19778 - DNA, 18 bp, Homo sapiens
ccatcaccctaactagtg

SEQ ID NO: 19779 - DNA, 22 bp, Homo sapiens
atctggttcttcttaggcatca

SEQ ID NO: 19780 - DNA, 22 bp, Homo sapiens
ttgtaagtcacaccagggcagg

SEQ ID NO: 19781 - DNA, 22 bp, Homo sapiens
ggaactgaggaacgaactggga

SEQ ID NO: 19782 - DNA, 22 bp, Homo sapiens
tcacccaggctggactgcagtg

SEQ ID NO: 19783 - DNA, 22 bp, Homo sapiens
aaaagtaattgtggtttttgct

SEQ ID NO: 19784 - DNA, 22 bp, Homo sapiens
gaatatcccgctatgcaaagta

SEQ ID NO: 19785 - DNA, 22 bp, Homo sapiens
atgcacctgaactccatcagct

SEQ ID NO: 19786 - DNA, 22 bp, Homo sapiens
tagatgcttgttcagaaatagg

SEQ ID NO: 19787 - DNA, 22 bp, Homo sapiens
acctgcaggcacaggtgtgcgc

SEQ ID NO: 19788 - DNA, 22 bp, Homo sapiens
atgactagaggagggatggcca

SEQ ID NO: 19789 - DNA, 22 bp, Homo sapiens
agctgattccactttttcccca

SEQ ID NO: 19790 - DNA, 22 bp, Homo sapiens
cgtttagttgtcccttcttaaa

SEQ ID NO: 19791 - DNA, 22 bp, Homo sapiens
aaaagtaattgtggttttggcc

SEQ ID NO: 19792 - DNA, 22 bp, Homo sapiens
gggcgcatcacctgaggtcagg

SEQ ID NO: 19793 - DNA, 22 bp, Homo sapiens
atgaattgaggaaaacagtcgt

SEQ ID NO: 19794 - DNA, 22 bp, Homo sapiens
gggccggagctgggtcccgcgc

SEQ ID NO: 19795 - DNA, 22 bp, Homo sapiens
tgcactccaggctgggtgacag

SEQ ID NO: 19796 - DNA, 22 bp, Homo sapiens
ggggccgaccgcggttcaggcc

SEQ ID NO: 19797 - DNA, 22 bp, Homo sapiens
ggagaggggaacttgttgcttg

SEQ ID NO: 19798 - DNA, 22 bp, Homo sapiens
actttaattaatgaactgtggc

SEQ ID NO: 19799 - DNA, 22 bp, Homo sapiens
cttctttcaagaatggattagg

SEQ ID NO: 19800 - DNA, 22 bp, Homo sapiens
attcgcgggcctggagggtggg

SEQ ID NO: 19801 - DNA, 22 bp, Homo sapiens
tgaaatgattatatggtgtttg

SEQ ID NO: 19802 - DNA, 22 bp, Homo sapiens
tggggagtgatgcctcggataa

SEQ ID NO: 19803 - DNA, 22 bp, Homo sapiens
tattgggtaaagatccagtttt

SEQ ID NO: 19804 - DNA, 22 bp, Homo sapiens
gatttagtggcccttggtacac

SEQ ID NO: 19805 - DNA, 22 bp, Homo sapiens
ctgggggtcttgaaagggagag

SEQ ID NO: 19806 - DNA, 22 bp, Homo sapiens
tcacccaggctggagtgcagtg

SEQ ID NO: 19807 - DNA, 22 bp, Homo sapiens
ggatgctctgtctcttgctgtt

SEQ ID NO: 19808 - DNA, 22 bp, Homo sapiens
tttgaggttagctagcagatca

SEQ ID NO: 19809 - DNA, 22 bp, Homo sapiens
aacttgccaagagctttgctag

SEQ ID NO: 19810 - DNA, 22 bp, Homo sapiens
caaatgaatatttccatgggtt

SEQ ID NO: 19811 - DNA, 22 bp, Homo sapiens
aatgaattgcagtactgacttg

SEQ ID NO: 19812 - DNA, 22 bp, Homo sapiens
aaacatggccattcagactgtg

SEQ ID NO: 19813 - DNA, 22 bp, Homo sapiens
aaaagtaattgcggtttttgct

SEQ ID NO: 19814 - DNA, 22 bp, Homo sapiens
ctccagttggccccagttggtt

SEQ ID NO: 19815 - DNA, 22 bp, Homo sapiens
gtaatctcagctacttgggagg

SEQ ID NO: 19816 - DNA, 22 bp, Homo sapiens
gggacatctttctagtcagggt

SEQ ID NO: 19817 - DNA, 22 bp, Homo sapiens
tcccagtttttctccactaagg

SEQ ID NO: 19818 - DNA, 21 bp, Homo sapiens
tggacttatggagtgtttctt

SEQ ID NO: 19819 - DNA, 22 bp, Homo sapiens
gaaggaagtcattagtgcagac

SEQ ID NO: 19820 - DNA, 21 bp, Homo sapiens
ggccgccgccttgtgctctgc

SEQ ID NO: 19821 - DNA, 22 bp, Homo sapiens
ggcggtctcagcaccctcttgg

SEQ ID NO: 19822 - DNA, 22 bp, Homo sapiens
ccttcattcattaatttagccc

SEQ ID NO: 19823 - DNA, 19 bp, Homo sapiens
ggtatatgggcctcacttg

SEQ ID NO: 19824 - DNA, 22 bp, Homo sapiens
gagggagggactagcattctct

SEQ ID NO: 19825 - DNA, 22 bp, Homo sapiens
agcgctgtgggcgtgcgaggag

SEQ ID NO: 19826 - DNA, 22 bp, Homo sapiens
gggcgccgtgggaaacagccgg

SEQ ID NO: 19827 - DNA, 22 bp, Homo sapiens
tcccccaggctggagtgcagtg

SEQ ID NO: 19828 - DNA, 22 bp, Homo sapiens
aggacttagaacattatgtact

SEQ ID NO: 19829 - DNA, 22 bp, Homo sapiens
gccgtgtcatctgcgggtggca

SEQ ID NO: 19830 - DNA, 22 bp, Homo sapiens
ctccagattccgtttattcagg

SEQ ID NO: 19831 - DNA, 22 bp, Homo sapiens
attataggcttgagccaccgtg

SEQ ID NO: 19832 - DNA, 22 bp, Homo sapiens
tgagatgtaaggtatgcttact

SEQ ID NO: 19833 - DNA, 22 bp, Homo sapiens
aggggaggtgtccccaaatctc

SEQ ID NO: 19834 - DNA, 22 bp, Homo sapiens
ggaactgaatgtctcggtataa

SEQ ID NO: 19835 - DNA, 22 bp, Homo sapiens
tccattatacttctgattcaaa

SEQ ID NO: 19836 - DNA, 22 bp, Homo sapiens
tgatcaaaacattactccacca

SEQ ID NO: 19837 - DNA, 22 bp, Homo sapiens
aggcgcattgaggccctgttgc

SEQ ID NO: 19838 - DNA, 22 bp, Homo sapiens
agaggccggccgagcccatggg

SEQ ID NO: 19839 - DNA, 23 bp, Homo sapiens
gggggccgtcctggggattatag

SEQ ID NO: 19840 - DNA, 21 bp, Homo sapiens
tgggggtcttcacggtgttgt

SEQ ID NO: 19841 - DNA, 22 bp, Homo sapiens
atcctagaatcagcccttgctg

SEQ ID NO: 19842 - DNA, 22 bp, Homo sapiens
ggagagggtaggggtcctgccc

SEQ ID NO: 19843 - DNA, 23 bp, Homo sapiens
gtctctagagtgtggagcaaaga

SEQ ID NO: 19844 - DNA, 22 bp, Homo sapiens
aatattatcaaaagctttttca

SEQ ID NO: 19845 - DNA, 22 bp, Homo sapiens
gcgagcctctggagtcctctgg

SEQ ID NO: 19846 - DNA, 20 bp, Homo sapiens
cattggacttggcttcatgg

SEQ ID NO: 19847 - DNA, 22 bp, Homo sapiens
gggacttaatgcagagagggac

SEQ ID NO: 19848 - DNA, 22 bp, Homo sapiens
tgaagaaacgcagagaggtagg

SEQ ID NO: 19849 - DNA, 23 bp, Homo sapiens
aggttatgattatagagcgagga

SEQ ID NO: 19850 - DNA, 22 bp, Homo sapiens
agaacagaggccttatgtttca

SEQ ID NO: 19851 - DNA, 22 bp, Homo sapiens
gggccgtagaccacgtccgggc

SEQ ID NO: 19852 - DNA, 22 bp, Homo sapiens
agccagatgaagaggtccttaa

SEQ ID NO: 19853 - DNA, 22 bp, Homo sapiens
ttattaggaactcaggattttt

SEQ ID NO: 19854 - DNA, 22 bp, Homo sapiens
aatgagatggaattcccgccta

SEQ ID NO: 19855 - DNA, 22 bp, Homo sapiens
gtgtaagtatctttgtatcttt

SEQ ID NO: 19856 - DNA, 22 bp, Homo sapiens
gtccaagagtcaagaagggggc

SEQ ID NO: 19857 - DNA, 22 bp, Homo sapiens
gtaatagtctcaaactcctgga

SEQ ID NO: 19858 - DNA, 22 bp, Homo sapiens
agtccgtggccagactcaagag

SEQ ID NO: 19859 - DNA, 22 bp, Homo sapiens
cggccgcagcagtgtcggccca

SEQ ID NO: 19860 - DNA, 22 bp, Homo sapiens
cccagtttcaactttccagtgg

SEQ ID NO: 19861 - DNA, 22 bp, Homo sapiens
gttcaagaccagcctggccaac

SEQ ID NO: 19862 - DNA, 22 bp, Homo sapiens
aggattgtgcctccagtcagaa

SEQ ID NO: 19863 - DNA, 22 bp, Homo sapiens
aacttaggaaaataaggcatga

SEQ ID NO: 19864 - DNA, 22 bp, Homo sapiens
tgggaacagaggacttgactgt

SEQ ID NO: 19865 - DNA, 22 bp, Homo sapiens
agttgcagacgcagagatgttg

SEQ ID NO: 19866 - DNA, 22 bp, Homo sapiens
tggaacaagggcgtggcggtcg

SEQ ID NO: 19867 - DNA, 18 bp, Homo sapiens
gatcgggggcgccccaag

SEQ ID NO: 19868 - DNA, 22 bp, Homo sapiens
gccatcatatcccctgtgacct

SEQ ID NO: 19869 - DNA, 22 bp, Homo sapiens
tttattggatatttacaagata

SEQ ID NO: 19870 - DNA, 22 bp, Homo sapiens
ctgctaaacctctctgagagct

SEQ ID NO: 19871 - DNA, 22 bp, Homo sapiens
tactaggaagcagctgcattgg

SEQ ID NO: 19872 - DNA, 22 bp, Homo sapiens
agaacctcaattatttttgcac

SEQ ID NO: 19873 - DNA, 19 bp, Homo sapiens
ggcatggggtccggggacc

SEQ ID NO: 19874 - DNA, 22 bp, Homo sapiens
agggaacatttgcactgttggt

SEQ ID NO: 19875 - DNA, 22 bp, Homo sapiens
gggggagagacgagcggctctg

SEQ ID NO: 19876 - DNA, 22 bp, Homo sapiens
cctgggggccaggaaggtgtga

SEQ ID NO: 19877 - DNA, 22 bp, Homo sapiens
tccgggaggcagaggttgcagt

SEQ ID NO: 19878 - DNA, 22 bp, Homo sapiens
ggttggacactaggtaggagcg

SEQ ID NO: 19879 - DNA, 22 bp, Homo sapiens
gatgaaggggctggtgccctct

SEQ ID NO: 19880 - DNA, 22 bp, Homo sapiens
tgccgcagtgcggggagggccc

SEQ ID NO: 19881 - DNA, 22 bp, Homo sapiens
ctattattagataatctacttg

SEQ ID NO: 19882 - DNA, 22 bp, Homo sapiens
tcctttaaacaaccagctctca

SEQ ID NO: 19883 - DNA, 18 bp, Homo sapiens
tggcgatggtcatttttc

SEQ ID NO: 19884 - DNA, 22 bp, Homo sapiens
acactgtgtgacttctgagact

SEQ ID NO: 19885 - DNA, 22 bp, Homo sapiens
atttttctctttccactgagat

SEQ ID NO: 19886 - DNA, 22 bp, Homo sapiens
cttgtgcttttatgaatgcaga

SEQ ID NO: 19887 - DNA, 22 bp, Homo sapiens
ggggccttttctgaatgtggaa

SEQ ID NO: 19888 - DNA, 22 bp, Homo sapiens
gcaggtccagtcaccagagaga

SEQ ID NO: 19889 - DNA, 22 bp, Homo sapiens
cttgatctacatagtgaaaccc

SEQ ID NO: 19890 - DNA, 22 bp, Homo sapiens
cggccgcagcagtgtcggccca

SEQ ID NO: 19891 - DNA, 22 bp, Homo sapiens
ttcaatatgatattagctgtgg

SEQ ID NO: 19892 - DNA, 22 bp, Homo sapiens
gagtgttccagaaactggccct

SEQ ID NO: 19893 - DNA, 22 bp, Homo sapiens
acccagggctcaagcgtaggca

SEQ ID NO: 19894 - DNA, 22 bp, Homo sapiens
ctgggtggcagagcctgcagtg

SEQ ID NO: 19895 - DNA, 22 bp, Homo sapiens
gagaaagcttctttcccacagg

SEQ ID NO: 19896 - DNA, 22 bp, Homo sapiens
gtggagggtgattgccggctgt

SEQ ID NO: 19897 - DNA, 22 bp, Homo sapiens
gcgtctcaaggcccccaggcca

SEQ ID NO: 19898 - DNA, 22 bp, Homo sapiens
agaagtataactatttgctttc

SEQ ID NO: 19899 - DNA, 22 bp, Homo sapiens
cggggacacactggcagctcct

SEQ ID NO: 19900 - DNA, 21 bp, Homo sapiens
cgtgactgggtccgtctggct

SEQ ID NO: 19901 - DNA, 20 bp, Homo sapiens
gggcaaggaaacagccccca

SEQ ID NO: 19902 - DNA, 22 bp, Homo sapiens
gggccggagctgggtcccgcgc

SEQ ID NO: 19903 - DNA, 22 bp, Homo sapiens
ttgtcgggcttacgcagggcca

SEQ ID NO: 19904 - DNA, 19 bp, Homo sapiens
tccaaagaagttcacattt

SEQ ID NO: 19905 - DNA, 22 bp, Homo sapiens
ggacaagcctgtgagtgggttt

SEQ ID NO: 19906 - DNA, 22 bp, Homo sapiens
tcctccactttgtctagcaaca

SEQ ID NO: 19907 - DNA, 22 bp, Homo sapiens
tcactgcactccagcactcagg

SEQ ID NO: 19908 - DNA, 22 bp, Homo sapiens
gacccggctccaggcccagcag

SEQ ID NO: 19909 - DNA, 22 bp, Homo sapiens
atagagtgatgtaaggtatgtg

SEQ ID NO: 19910 - DNA, 22 bp, Homo sapiens
ggggtgggcgtgcagggacacc

SEQ ID NO: 19911 - DNA, 22 bp, Homo sapiens
ggctcactgcaacttccgcctc

SEQ ID NO: 19912 - DNA, 22 bp, Homo sapiens
cccatgaggtggaggttgcagt

SEQ ID NO: 19913 - DNA, 22 bp, Homo sapiens
caggggcgggtaaaaggcctcc

SEQ ID NO: 19914 - DNA, 22 bp, Homo sapiens
tcagagagcagaacttttttac

SEQ ID NO: 19915 - DNA, 22 bp, Homo sapiens
caagcgtggctgctctgatgga

SEQ ID NO: 19916 - DNA, 22 bp, Homo sapiens
gtacactccccctgtgaagttg

SEQ ID NO: 19917 - DNA, 22 bp, Homo sapiens
cctcttctaggacgtccttgtg

SEQ ID NO: 19918 - DNA, 22 bp, Homo sapiens
gcgagggcacgcggttgaaggc

SEQ ID NO: 19919 - DNA, 22 bp, Homo sapiens
cccaggaggcagagcttgcagt

SEQ ID NO: 19920 - DNA, 22 bp, Homo sapiens
cgtgtgttgaaagatgtacatc

SEQ ID NO: 19921 - DNA, 22 bp, Homo sapiens
tgaaatctttagtttctgtccc

SEQ ID NO: 19922 - DNA, 22 bp, Homo sapiens
atgccacttcattccagcctcg

SEQ ID NO: 19923 - DNA, 22 bp, Homo sapiens
tgttcagaacaaaggtaaatga

SEQ ID NO: 19924 - DNA, 22 bp, Homo sapiens
cattgcactccagcctgggtaa

SEQ ID NO: 19925 - DNA, 22 bp, Homo sapiens
ttgagcccaggaggcctgggtg

SEQ ID NO: 19926 - DNA, 22 bp, Homo sapiens
gggcatgtcccgctgtgcaccg

SEQ ID NO: 19927 - DNA, 22 bp, Homo sapiens
ttatttaatgtgatctgaagag

SEQ ID NO: 19928 - DNA, 22 bp, Homo sapiens
agcctattccaggatgagctca

SEQ ID NO: 19929 - DNA, 22 bp, Homo sapiens
ttatttttaaaagttcacacag

SEQ ID NO: 19930 - DNA, 22 bp, Homo sapiens
aagtgctgggattataggcatg

SEQ ID NO: 19931 - DNA, 22 bp, Homo sapiens
agaggaggctctgggatcgtcc

SEQ ID NO: 19932 - DNA, 22 bp, Homo sapiens
aaacactcatgtgttactctcc

SEQ ID NO: 19933 - DNA, 22 bp, Homo sapiens
ggctctgcttgaggccagcctg

SEQ ID NO: 19934 - DNA, 22 bp, Homo sapiens
gggccatgagaggttcatcaac

SEQ ID NO: 19935 - DNA, 22 bp, Homo sapiens
tgcttgtgacagaactgtgtcc

SEQ ID NO: 19936 - DNA, 22 bp, Homo sapiens
cattgcactccagccttggcaa

SEQ ID NO: 19937 - DNA, 19 bp, Homo sapiens
atgtacccagtgtcaatcc

SEQ ID NO: 19938 - DNA, 22 bp, Homo sapiens
tccggcggccggcctgagcccg

SEQ ID NO: 19939 - DNA, 22 bp, Homo sapiens
tgcagaaacaagccatcattca

SEQ ID NO: 19940 - DNA, 22 bp, Homo sapiens
gtccaggcctgcctctgaggag

SEQ ID NO: 19941 - DNA, 22 bp, Homo sapiens
tctgagaaatttctttgtgatg

SEQ ID NO: 19942 - DNA, 18 bp, Homo sapiens
cagggctgtggggtcact

SEQ ID NO: 19943 - DNA, 23 bp, Homo sapiens
tcatgcccaggctccagatgtca

SEQ ID NO: 19944 - DNA, 22 bp, Homo sapiens
ctgatcctcctttaagtagctg

SEQ ID NO: 19945 - DNA, 22 bp, Homo sapiens
cattgcactccagcctaggcaa

SEQ ID NO: 19946 - DNA, 16 bp, Homo sapiens
ggcaggcgcggagccc

SEQ ID NO: 19947 - DNA, 22 bp, Homo sapiens
ctgcatccatgttgctgcaaag

SEQ ID NO: 19948 - DNA, 22 bp, Homo sapiens
acaaagtgctgacattacaggc

SEQ ID NO: 19949 - DNA, 22 bp, Homo sapiens
tcctccccaaagcccagcctgg

SEQ ID NO: 19950 - DNA, 22 bp, Homo sapiens
gtggcagagccaaggctggagc

SEQ ID NO: 19951 - DNA, 22 bp, Homo sapiens
cgggagcctctgggtcacactg

SEQ ID NO: 19952 - DNA, 22 bp, Homo sapiens
agcccaggctggagtgcagtgg

SEQ ID NO: 19953 - DNA, 22 bp, Homo sapiens
gtctctatcatagctgaaccct

SEQ ID NO: 19954 - DNA, 19 bp, Homo sapiens
aggcttcaggccacatgct

SEQ ID NO: 19955 - DNA, 23 bp, Homo sapiens
tcgttgaatagcaatagcacaac

SEQ ID NO: 19956 - DNA, 22 bp, Homo sapiens
tggcgcgacgtgccccctgctt

SEQ ID NO: 19957 - DNA, 22 bp, Homo sapiens
cccaggggttctgagcagcagc

SEQ ID NO: 19958 - DNA, 22 bp, Homo sapiens
ttcctcaggctgctttcacata

SEQ ID NO: 19959 - DNA, 22 bp, Homo sapiens
gaaaattattgaaaatggctct

SEQ ID NO: 19960 - DNA, 22 bp, Homo sapiens
ccaggaggcggaggttgcagcg

SEQ ID NO: 19961 - DNA, 22 bp, Homo sapiens
gggcatggtggcaggcacctgt

SEQ ID NO: 19962 - DNA, 22 bp, Homo sapiens
gtccaagagtcaagaagggggc

SEQ ID NO: 19963 - DNA, 22 bp, Homo sapiens
cctctgtgtgatgcgcaaagta

SEQ ID NO: 19964 - DNA, 22 bp, Homo sapiens
cagggaaagtcccaccccacac

SEQ ID NO: 19965 - DNA, 22 bp, Homo sapiens
agaggggcccggttctccgtct

SEQ ID NO: 19966 - DNA, 22 bp, Homo sapiens
tgggcagggagctggaaccaca

SEQ ID NO: 19967 - DNA, 22 bp, Homo sapiens
ggccttggcctagccctccagg

SEQ ID NO: 19968 - DNA, 22 bp, Homo sapiens
gggcagagactcagaaacagaa

SEQ ID NO: 19969 - DNA, 18 bp, Homo sapiens
agagtgttctcagtgaaa

SEQ ID NO: 19970 - DNA, 16 bp, Homo sapiens
gatctgaaggtgctgg

SEQ ID NO: 19971 - DNA, 22 bp, Homo sapiens
cggtcaggtgcagcgttggcac

SEQ ID NO: 19972 - DNA, 22 bp, Homo sapiens
tttagcgtagctgacagctaat

SEQ ID NO: 19973 - DNA, 22 bp, Homo sapiens
ccaggctgctgttggtgtccgc

SEQ ID NO: 19974 - DNA, 22 bp, Homo sapiens
taaaatttgtccctgagtgttg

SEQ ID NO: 19975 - DNA, 22 bp, Homo sapiens
gatgggcgtggcgcgtttggtg

SEQ ID NO: 19976 - DNA, 22 bp, Homo sapiens
caggggcggtggctcacgcctg

SEQ ID NO: 19977 - DNA, 22 bp, Homo sapiens
ctgggaggcggaggttgcagtg

SEQ ID NO: 19978 - DNA, 22 bp, Homo sapiens
ttgcaattgctatggagagcgt

SEQ ID NO: 19979 - DNA, 22 bp, Homo sapiens
ttgtgctgtgagaatgctcatt

SEQ ID NO: 19980 - DNA, 21 bp, Homo sapiens
ctctgtttgcctgctgccatc

SEQ ID NO: 19981 - DNA, 22 bp, Homo sapiens
gcagatggatgtggacggcgcc

SEQ ID NO: 19982 - DNA, 22 bp, Homo sapiens
ggtgatccaccagcctcggcct

SEQ ID NO: 19983 - DNA, 22 bp, Homo sapiens
tgtgtcattgccatgaaaaggc

SEQ ID NO: 19984 - DNA, 20 bp, Homo sapiens
gctctgtggtttgagtctcc

SEQ ID NO: 19985 - DNA, 22 bp, Homo sapiens
cagaggctggcggccgccccga

SEQ ID NO: 19986 - DNA, 22 bp, Homo sapiens
cctgtggcgggggccagtgcct

SEQ ID NO: 19987 - DNA, 22 bp, Homo sapiens
ggtgccaggctgtagtcagggt

SEQ ID NO: 19988 - DNA, 22 bp, Homo sapiens
ggggctgaacctggaggtggtc

SEQ ID NO: 19989 - DNA, 22 bp, Homo sapiens
gacccacctcaccaagcatgtg

SEQ ID NO: 19990 - DNA, 22 bp, Homo sapiens
ctgctcttcacactacacccgt

SEQ ID NO: 19991 - DNA, 22 bp, Homo sapiens
ggcttagcaactcctgaggctc

SEQ ID NO: 19992 - DNA, 22 bp, Homo sapiens
cggtctcccgtgtgtgtgcgct

SEQ ID NO: 19993 - DNA, 22 bp, Homo sapiens
actccacatttgaacacagttc

SEQ ID NO: 19994 - DNA, 22 bp, Homo sapiens
taatggtgtttttctgtaattt

SEQ ID NO: 19995 - DNA, 22 bp, Homo sapiens
tactgtgtgcccagccgagctg

SEQ ID NO: 19996 - DNA, 22 bp, Homo sapiens
tgtgacctcatcttaactggaa

SEQ ID NO: 19997 - DNA, 22 bp, Homo sapiens
agcctggtttaagcattttata

SEQ ID NO: 19998 - DNA, 22 bp, Homo sapiens
gctcagaggcacgacctcttgg

SEQ ID NO: 19999 - DNA, 22 bp, Homo sapiens
tgctccagcaccaagagctcca

SEQ ID NO: 20000 - DNA, 22 bp, Homo sapiens
gaagcctcaacatctctgcgtc

SEQ ID NO: 20001 - DNA, 19 bp, Homo sapiens
agtgagtgtacagtagaat

SEQ ID NO: 20002 - DNA, 22 bp, Homo sapiens
cattgcactccagcctgggcca

SEQ ID NO: 20003 - DNA, 22 bp, Homo sapiens
tgagacttaagaggtcatgttg

SEQ ID NO: 20004 - DNA, 22 bp, Homo sapiens
atgccactgcacttcagcttgg

SEQ ID NO: 20005 - DNA, 22 bp, Homo sapiens
ccagaagtcaagtaagatgaag

SEQ ID NO: 20006 - DNA, 22 bp, Homo sapiens
cctcgcggcactcgggccggat

SEQ ID NO: 20007 - DNA, 22 bp, Homo sapiens
tgtcatggggttgttttgtaca

SEQ ID NO: 20008 - DNA, 22 bp, Homo sapiens
ggctccaccctgcttccagaag

SEQ ID NO: 20009 - DNA, 22 bp, Homo sapiens
cgctccttgagcgtgtcggcct

SEQ ID NO: 20010 - DNA, 22 bp, Homo sapiens
gacaggaggcagagctcaggtg

SEQ ID NO: 20011 - DNA, 22 bp, Homo sapiens
ggcaggaggtgagtggcgggtg

SEQ ID NO: 20012 - DNA, 22 bp, Homo sapiens
ctctggaggtggaggttgcagt

SEQ ID NO: 20013 - DNA, 17 bp, Homo sapiens
gggcagggactcctggg

SEQ ID NO: 20014 - DNA, 22 bp, Homo sapiens
ggcaatatggtgaaaccccatc

SEQ ID NO: 20015 - DNA, 22 bp, Homo sapiens
cttcctcctccatctcgaaggc

SEQ ID NO: 20016 - DNA, 22 bp, Homo sapiens
atgccactgcgctccagcctgg

SEQ ID NO: 20017 - DNA, 19 bp, Homo sapiens
tcctggggaggggcatggc

SEQ ID NO: 20018 - DNA, 22 bp, Homo sapiens
cattgcactccagctctgggcg

SEQ ID NO: 20019 - DNA, 22 bp, Homo sapiens
ccaggaggcggaaggtacagtg

SEQ ID NO: 20020 - DNA, 22 bp, Homo sapiens
tttcataatactgtacatgaaa

SEQ ID NO: 20021 - DNA, 22 bp, Homo sapiens
agatgctgggatgcttggatgg

SEQ ID NO: 20022 - DNA, 22 bp, Homo sapiens
tggggccatctcacccactgtt

SEQ ID NO: 20023 - DNA, 22 bp, Homo sapiens
aatttgtataaaatggtgtttt

SEQ ID NO: 20024 - DNA, 22 bp, Homo sapiens
gatgatcatctgtaaagttaga

SEQ ID NO: 20025 - DNA, 20 bp, Homo sapiens
ctgccgaccacagccatgga

SEQ ID NO: 20026 - DNA, 22 bp, Homo sapiens
aagaggagaaaggctggctttg

SEQ ID NO: 20027 - DNA, 22 bp, Homo sapiens
gcctcctgtcccaggctgagga

SEQ ID NO: 20028 - DNA, 22 bp, Homo sapiens
tgtgactgaggctccaagctag

SEQ ID NO: 20029 - DNA, 22 bp, Homo sapiens
gaggtggatgttgcagtgagct

SEQ ID NO: 20030 - DNA, 22 bp, Homo sapiens
cactgggcgtgtcctgggtgag

SEQ ID NO: 20031 - DNA, 22 bp, Homo sapiens
ctcactgcaagttccacctacc

SEQ ID NO: 20032 - DNA, 22 bp, Homo sapiens
gattccacagcttcgaggtctt

SEQ ID NO: 20033 - DNA, 21 bp, Homo sapiens
gaacccagcagcagtgctctg

SEQ ID NO: 20034 - DNA, 22 bp, Homo sapiens
agggctgcccagtgtgagagct

SEQ ID NO: 20035 - DNA, 22 bp, Homo sapiens
tgggaggccgaggcaggtggat

SEQ ID NO: 20036 - DNA, 22 bp, Homo sapiens
gtgcaaaagtaattgtggtttt

SEQ ID NO: 20037 - DNA, 21 bp, Homo sapiens
gccatttcacacagacatttg

SEQ ID NO: 20038 - DNA, 22 bp, Homo sapiens
cgggcagcggcgtggccatggt

SEQ ID NO: 20039 - DNA, 22 bp, Homo sapiens
tcttaagcagagaagaagttga

SEQ ID NO: 20040 - DNA, 22 bp, Homo sapiens
cagcagcagtggctgcagaaca

SEQ ID NO: 20041 - DNA, 22 bp, Homo sapiens
gggccctgcgactcgcggcgga

SEQ ID NO: 20042 - DNA, 22 bp, Homo sapiens
gataccagacagggagggagaa

SEQ ID NO: 20043 - DNA, 22 bp, Homo sapiens
cattgcactcctgcctgggcaa

SEQ ID NO: 20044 - DNA, 22 bp, Homo sapiens
cgttttcatgggtagaggttct

SEQ ID NO: 20045 - DNA, 22 bp, Homo sapiens
taggttttcctaaaattctggt

SEQ ID NO: 20046 - DNA, 22 bp, Homo sapiens
tgaaggtgggaattcaccaggt

SEQ ID NO: 20047 - DNA, 22 bp, Homo sapiens
gggaagtgatggagccaggatt

SEQ ID NO: 20048 - DNA, 22 bp, Homo sapiens
gggaagagggagctggaatgat

SEQ ID NO: 20049 - DNA, 22 bp, Homo sapiens
cattgcacaccagcctgggcaa

SEQ ID NO: 20050 - DNA, 22 bp, Homo sapiens
tttgaagggcacgacaatagtt

SEQ ID NO: 20051 - DNA, 22 bp, Homo sapiens
ggccactgacctacatctgggg

SEQ ID NO: 20052 - DNA, 22 bp, Homo sapiens
ggctgtggcagctggaagtggt

SEQ ID NO: 20053 - DNA, 22 bp, Homo sapiens
cctcgacctccccaggctcagg

SEQ ID NO: 20054 - DNA, 22 bp, Homo sapiens
acctggccagtggggccgcgct

SEQ ID NO: 20055 - DNA, 23 bp, Homo sapiens
tcctcgcaggagggagatgatgc

SEQ ID NO: 20056 - DNA, 22 bp, Homo sapiens
tccgggtgcccacgtgccccta

SEQ ID NO: 20057 - DNA, 22 bp, Homo sapiens
ggccactgctctccagcctggg

SEQ ID NO: 20058 - DNA, 22 bp, Homo sapiens
gcctcactgcagccccaggaag

SEQ ID NO: 20059 - DNA, 20 bp, Homo sapiens
ataaaataactgccacaaga

SEQ ID NO: 20060 - DNA, 22 bp, Homo sapiens
gtgctccctccttcctcaagga

SEQ ID NO: 20061 - DNA, 22 bp, Homo sapiens
aacatacgagcagtttatagag

SEQ ID NO: 20062 - DNA, 22 bp, Homo sapiens
agcatgcgcttgatcagctcca

SEQ ID NO: 20063 - DNA, 22 bp, Homo sapiens
tgacttcctgcactcaggtgat

SEQ ID NO: 20064 - DNA, 22 bp, Homo sapiens
gccaggcgggtctcaaactcct

SEQ ID NO: 20065 - DNA, 22 bp, Homo sapiens
cttagagatgggttttacttag

SEQ ID NO: 20066 - DNA, 22 bp, Homo sapiens
gagcctggagctggaacgaagc

SEQ ID NO: 20067 - DNA, 22 bp, Homo sapiens
acccaggctggagtgcagtgat

SEQ ID NO: 20068 - DNA, 20 bp, Homo sapiens
ccagagctgatggctgcccg

SEQ ID NO: 20069 - DNA, 20 bp, Homo sapiens
ttcgctgggagtggccaggc

SEQ ID NO: 20070 - DNA, 22 bp, Homo sapiens
acctcctccaaggagccatagg

SEQ ID NO: 20071 - DNA, 22 bp, Homo sapiens
tgaagtatggaatgtagaagtg

SEQ ID NO: 20072 - DNA, 22 bp, Homo sapiens
ggaggaggggtgactgaatgct

SEQ ID NO: 20073 - DNA, 22 bp, Homo sapiens
aggggcgtgctcttccccgacg

SEQ ID NO: 20074 - DNA, 22 bp, Homo sapiens
gtctgctcatgctaccgcgggc

SEQ ID NO: 20075 - DNA, 23 bp, Homo sapiens
ccagtgattgcctggaaggaggt

SEQ ID NO: 20076 - DNA, 22 bp, Homo sapiens
aagaagcaggtcacagacaggg

SEQ ID NO: 20077 - DNA, 22 bp, Homo sapiens
gacgagagactccatccaccac

SEQ ID NO: 20078 - DNA, 22 bp, Homo sapiens
gcaggcggaggttgcagtgagc

SEQ ID NO: 20079 - DNA, 22 bp, Homo sapiens
cagggcctcctaaggcatctaa

SEQ ID NO: 20080 - DNA, 22 bp, Homo sapiens
ccagggtggcgtagatgctggg

SEQ ID NO: 20081 - DNA, 22 bp, Homo sapiens
cactgcaacctccacctcctgg

SEQ ID NO: 20082 - DNA, 22 bp, Homo sapiens
ttccccttgataagcagggttg

SEQ ID NO: 20083 - DNA, 22 bp, Homo sapiens
tgattcatcagaataggagttt

SEQ ID NO: 20084 - DNA, 22 bp, Homo sapiens
ccgccgtgtcgacaggccctgg

SEQ ID NO: 20085 - DNA, 21 bp, Homo sapiens
ctggaggcaggtggtgccagg

SEQ ID NO: 20086 - DNA, 22 bp, Homo sapiens
attaagtgactaaagtaatgct

SEQ ID NO: 20087 - DNA, 22 bp, Homo sapiens
ttttcatttttgtagatgcaag

SEQ ID NO: 20088 - DNA, 22 bp, Homo sapiens
caaagtgggtgccctgatgctc

SEQ ID NO: 20089 - DNA, 22 bp, Homo sapiens
aacattgaacttggcacaccca

SEQ ID NO: 20090 - DNA, 22 bp, Homo sapiens
gtccccgacgtttggcttgatg

SEQ ID NO: 20091 - DNA, 22 bp, Homo sapiens
ggcctctgccccgcggggctcg

SEQ ID NO: 20092 - DNA, 22 bp, Homo sapiens
atggatttgcttatacacatgt

SEQ ID NO: 20093 - DNA, 22 bp, Homo sapiens
gcagagccatgggaggtttttg

SEQ ID NO: 20094 - DNA, 22 bp, Homo sapiens
gtgcgcaccctcccggcatccc

SEQ ID NO: 20095 - DNA, 22 bp, Homo sapiens
ggctctgcgcctgcggggactt

SEQ ID NO: 20096 - DNA, 22 bp, Homo sapiens
ttgtggttaaccgcacattttt

SEQ ID NO: 20097 - DNA, 22 bp, Homo sapiens
cctggggccccgagccagaagc

SEQ ID NO: 20098 - DNA, 22 bp, Homo sapiens
ctgggctagaaggaccaggatg

SEQ ID NO: 20099 - DNA, 22 bp, Homo sapiens
taatactgtatactgcaaattt

SEQ ID NO: 20100 - DNA, 22 bp, Homo sapiens
gaggggctgccctggtgtcagg

SEQ ID NO: 20101 - DNA, 22 bp, Homo sapiens
cccaggaattggaggctgcagt

SEQ ID NO: 20102 - DNA, 22 bp, Homo sapiens
tgggggtgtcctggtgcacaca

SEQ ID NO: 20103 - DNA, 22 bp, Homo sapiens
ctgggaggtggaggttgcattg

SEQ ID NO: 20104 - DNA, 22 bp, Homo sapiens
gggtccagtagttggtggccgt

SEQ ID NO: 20105 - DNA, 22 bp, Homo sapiens
cacaaaccttctgcagcctgta

SEQ ID NO: 20106 - DNA, 22 bp, Homo sapiens
ggaggggatttagtagatgcta

SEQ ID NO: 20107 - DNA, 20 bp, Homo sapiens
aggaaaaatggaaactggag

SEQ ID NO: 20108 - DNA, 22 bp, Homo sapiens
tgagaaattacttcagtgatgg

SEQ ID NO: 20109 - DNA, 22 bp, Homo sapiens
cagtcaccttgaggactcagac

SEQ ID NO: 20110 - DNA, 22 bp, Homo sapiens
ccgggcctcgggacaccgggta

SEQ ID NO: 20111 - DNA, 22 bp, Homo sapiens
ataatacatggttgatcttttc

SEQ ID NO: 20112 - DNA, 22 bp, Homo sapiens
agccagtgcagctggaaattca

SEQ ID NO: 20113 - DNA, 18 bp, Homo sapiens
tcctttctccctcatctt

SEQ ID NO: 20114 - DNA, 22 bp, Homo sapiens
tctgctctgtggcttcagctaa

SEQ ID NO: 20115 - DNA, 22 bp, Homo sapiens
gcggcccgagcaggacgggtgg

SEQ ID NO: 20116 - DNA, 22 bp, Homo sapiens
agaaatatgctgattagatgaa

SEQ ID NO: 20117 - DNA, 22 bp, Homo sapiens
gttgacagtgaccctgaaagca

SEQ ID NO: 20118 - DNA, 22 bp, Homo sapiens
gtgtgggctgcagaggcacagc

SEQ ID NO: 20119 - DNA, 22 bp, Homo sapiens
ctgagcatcatggcagaatctt

SEQ ID NO: 20120 - DNA, 22 bp, Homo sapiens
tggaatgtcagctacaagaggg

SEQ ID NO: 20121 - DNA, 22 bp, Homo sapiens
tgtatgaggcatacatcaggca

SEQ ID NO: 20122 - DNA, 22 bp, Homo sapiens
aaaaaattatcatagttcctga

SEQ ID NO: 20123 - DNA, 21 bp, Homo sapiens
tctctttctggaagcttccct

SEQ ID NO: 20124 - DNA, 22 bp, Homo sapiens
tccatgaggaccaaattcgtag

SEQ ID NO: 20125 - DNA, 22 bp, Homo sapiens
tcacccaggctggagtgtagtg

SEQ ID NO: 20126 - DNA, 22 bp, Homo sapiens
acagtgcttagcacagagtaga

SEQ ID NO: 20127 - DNA, 22 bp, Homo sapiens
ggagaagaggagctggaagcct

SEQ ID NO: 20128 - DNA, 22 bp, Homo sapiens
atgagctagaaaaccatgtgga

SEQ ID NO: 20129 - DNA, 22 bp, Homo sapiens
tcgcggggaagtggtgggctaa

SEQ ID NO: 20130 - DNA, 22 bp, Homo sapiens
gtgggggctggaaatcttgcca

SEQ ID NO: 20131 - DNA, 22 bp, Homo sapiens
tgttgcccaggttctctcctgc

SEQ ID NO: 20132 - DNA, 22 bp, Homo sapiens
ggccgctctccggtgtggatct

SEQ ID NO: 20133 - DNA, 22 bp, Homo sapiens
tggagccagcggcctgctgagg

SEQ ID NO: 20134 - DNA, 22 bp, Homo sapiens
gggcttggcacatgggctcagc

SEQ ID NO: 20135 - DNA, 22 bp, Homo sapiens
agggcagagctgtctaaatggc

SEQ ID NO: 20136 - DNA, 22 bp, Homo sapiens
gggatcgtcatggaaagtgcta

SEQ ID NO: 20137 - DNA, 22 bp, Homo sapiens
ggactgggaatcagggagatgc

SEQ ID NO: 20138 - DNA, 22 bp, Homo sapiens
gagatttccatattttgtaaca

SEQ ID NO: 20139 - DNA, 22 bp, Homo sapiens
accctccccaagaggtcgtgcc

SEQ ID NO: 20140 - DNA, 22 bp, Homo sapiens
aagagggctgcaatcttattgc

SEQ ID NO: 20141 - DNA, 22 bp, Homo sapiens
tacgcgaagaaggacctgatgg

SEQ ID NO: 20142 - DNA, 19 bp, Homo sapiens
gcctcatttccacctcccc

SEQ ID NO: 20143 - DNA, 22 bp, Homo sapiens
atgagaaagttaatcatcatga

SEQ ID NO: 20144 - DNA, 22 bp, Homo sapiens
ggagagtgggagcaactgttgc

SEQ ID NO: 20145 - DNA, 22 bp, Homo sapiens
atccttgagccaatgactgatt

SEQ ID NO: 20146 - DNA, 22 bp, Homo sapiens
tgctgtgaggttgagaaggaag

SEQ ID NO: 20147 - DNA, 22 bp, Homo sapiens
ttgtgctcctatgagaatctaa

SEQ ID NO: 20148 - DNA, 22 bp, Homo sapiens
aggtgggcgctgctcccgctgg

SEQ ID NO: 20149 - DNA, 23 bp, Homo sapiens
cagagctggctcagagctgcctg

SEQ ID NO: 20150 - DNA, 22 bp, Homo sapiens
tctgctcagccgatctgctccg

SEQ ID NO: 20151 - DNA, 23 bp, Homo sapiens
tgaggcaggcggatcacgaggtc

SEQ ID NO: 20152 - DNA, 22 bp, Homo sapiens
cgtcagggttgagcaggtagat

SEQ ID NO: 20153 - DNA, 22 bp, Homo sapiens
gagcaggaaggccagaagggtc

SEQ ID NO: 20154 - DNA, 22 bp, Homo sapiens
acagaactgggaaatgcacata

SEQ ID NO: 20155 - DNA, 22 bp, Homo sapiens
agcccggcttccccggttgcta

SEQ ID NO: 20156 - DNA, 22 bp, Homo sapiens
ctgagcagatgaccagccccag

SEQ ID NO: 20157 - DNA, 22 bp, Homo sapiens
gggaaggccttgtcagcggatt

SEQ ID NO: 20158 - DNA, 16 bp, Homo sapiens
atgctgctattagagg

SEQ ID NO: 20159 - DNA, 22 bp, Homo sapiens
gagctgggcctgcgagtgctgc

SEQ ID NO: 20160 - DNA, 22 bp, Homo sapiens
tggccggggctgatggacagtg

SEQ ID NO: 20161 - DNA, 18 bp, Homo sapiens
actctttctgcccacagg

SEQ ID NO: 20162 - DNA, 22 bp, Homo sapiens
atgaattgaggaaaacagtcgt

SEQ ID NO: 20163 - DNA, 22 bp, Homo sapiens
cagaggatatactatctggaaa

SEQ ID NO: 20164 - DNA, 22 bp, Homo sapiens
ctgctctgctgatcagtgtctc

SEQ ID NO: 20165 - DNA, 22 bp, Homo sapiens
gagagtgagatcctcctgggga

SEQ ID NO: 20166 - DNA, 22 bp, Homo sapiens
tggctccacaggccagggtgtg

SEQ ID NO: 20167 - DNA, 22 bp, Homo sapiens
ccaggaggcggaggttgcagtg

SEQ ID NO: 20168 - DNA, 22 bp, Homo sapiens
gagcctgagcaatgtgatgttt

SEQ ID NO: 20169 - DNA, 18 bp, Homo sapiens
cagctgccagctcatgga

SEQ ID NO: 20170 - DNA, 22 bp, Homo sapiens
aatttcggttcaaggcccagtt

SEQ ID NO: 20171 - DNA, 22 bp, Homo sapiens
tgctgtgttactgagatccggc

SEQ ID NO: 20172 - DNA, 22 bp, Homo sapiens
ggctgggcaggtctgcacaggg

SEQ ID NO: 20173 - DNA, 22 bp, Homo sapiens
gtgggctgcccttgaggtcagc

SEQ ID NO: 20174 - DNA, 22 bp, Homo sapiens
ctcagactagcctgtaccgaca

SEQ ID NO: 20175 - DNA, 22 bp, Homo sapiens
tccaccctgcttttgtctttga

SEQ ID NO: 20176 - DNA, 22 bp, Homo sapiens
ctcattgcagctgcattactgt

SEQ ID NO: 20177 - DNA, 22 bp, Homo sapiens
cagtgagctcatggccaagtca

SEQ ID NO: 20178 - DNA, 22 bp, Homo sapiens
caggctggagtgcagtggcgct

SEQ ID NO: 20179 - DNA, 22 bp, Homo sapiens
ctgaggcaggatggcctggctg

SEQ ID NO: 20180 - DNA, 22 bp, Homo sapiens
gcgcactgggcgcacgcgtagg

SEQ ID NO: 20181 - DNA, 22 bp, Homo sapiens
tgggctgcaggggttgagagct

SEQ ID NO: 20182 - DNA, 22 bp, Homo sapiens
tggcaccagggaacaagcattt

SEQ ID NO: 20183 - DNA, 22 bp, Homo sapiens
cggccaggcacagtggcccacg

SEQ ID NO: 20184 - DNA, 22 bp, Homo sapiens
cctgggaggctgaggctgcagt

SEQ ID NO: 20185 - DNA, 22 bp, Homo sapiens
tgactctgataagacatatggc

SEQ ID NO: 20186 - DNA, 22 bp, Homo sapiens
tcaatactaatcttgctggaag

SEQ ID NO: 20187 - DNA, 22 bp, Homo sapiens
aagtgatgctacgactttgaca

SEQ ID NO: 20188 - DNA, 18 bp, Homo sapiens
ggaaggtgattcagtttt

SEQ ID NO: 20189 - DNA, 22 bp, Homo sapiens
ctcaggatattgggctggagca

SEQ ID NO: 20190 - DNA, 22 bp, Homo sapiens
gtggaggagaggcgccttgcgg

SEQ ID NO: 20191 - DNA, 22 bp, Homo sapiens
tgaggatgtctgtattttgcct

SEQ ID NO: 20192 - DNA, 19 bp, Homo sapiens
ctctggagtcattgctccc

SEQ ID NO: 20193 - DNA, 22 bp, Homo sapiens
cactgcactccagcctgggtga

SEQ ID NO: 20194 - DNA, 22 bp, Homo sapiens
cattgcactctagcctgggtga

SEQ ID NO: 20195 - DNA, 22 bp, Homo sapiens
atagaatatgacttttagatcc

SEQ ID NO: 20196 - DNA, 22 bp, Homo sapiens
ggaggagacagtaaaaagcacg

SEQ ID NO: 20197 - DNA, 22 bp, Homo sapiens
agttgcagacgcagagatgttg

SEQ ID NO: 20198 - DNA, 22 bp, Homo sapiens
cccagccaaaagcaagtttacc

SEQ ID NO: 20199 - DNA, 22 bp, Homo sapiens
ttatgggagcaattggggaggt

SEQ ID NO: 20200 - DNA, 22 bp, Homo sapiens
tacatagctcctagtgatgcat

SEQ ID NO: 20201 - DNA, 18 bp, Homo sapiens
ccctgccagctcccagca

SEQ ID NO: 20202 - DNA, 22 bp, Homo sapiens
ggctcaggcctgtaatcctagc

SEQ ID NO: 20203 - DNA, 16 bp, Homo sapiens
aggtggagaagttcac

SEQ ID NO: 20204 - DNA, 22 bp, Homo sapiens
aaatatcttaggagtatatgag

SEQ ID NO: 20205 - DNA, 22 bp, Homo sapiens
cctcggggcaccgcggcctgct

SEQ ID NO: 20206 - DNA, 22 bp, Homo sapiens
acgtagcactgagagatgcagg

SEQ ID NO: 20207 - DNA, 22 bp, Homo sapiens
gcttaattctggctcagtttcc

SEQ ID NO: 20208 - DNA, 22 bp, Homo sapiens
gtgaaatatttaacgtccaggt

SEQ ID NO: 20209 - DNA, 22 bp, Homo sapiens
tgaggcaggaggattgcaggat

SEQ ID NO: 20210 - DNA, 22 bp, Homo sapiens
atgtgtattacctcgattgtga

SEQ ID NO: 20211 - DNA, 22 bp, Homo sapiens
agtgaggggcagctgagtgggc

SEQ ID NO: 20212 - DNA, 22 bp, Homo sapiens
tgtcaatatgtaataactgaat

SEQ ID NO: 20213 - DNA, 22 bp, Homo sapiens
gaggtggccaagcgaggaaggg

SEQ ID NO: 20214 - DNA, 22 bp, Homo sapiens
tctgctacaaatacgctgggag

SEQ ID NO: 20215 - DNA, 22 bp, Homo sapiens
ggggcagagaataaaaacctaa

SEQ ID NO: 20216 - DNA, 22 bp, Homo sapiens
gggaggttctgttcgcacttga

SEQ ID NO: 20217 - DNA, 22 bp, Homo sapiens
gaactttgcgcagttcccgggg

SEQ ID NO: 20218 - DNA, 22 bp, Homo sapiens
gcaggctgtctaaagttagagt

SEQ ID NO: 20219 - DNA, 21 bp, Homo sapiens
tgctgggtttgcccatcaggc

SEQ ID NO: 20220 - DNA, 22 bp, Homo sapiens
gcaggcagatcacctgtcagga

SEQ ID NO: 20221 - DNA, 22 bp, Homo sapiens
tctggctctggagtccacctgc

SEQ ID NO: 20222 - DNA, 22 bp, Homo sapiens
aaaatcttgtgacttaggaagg

SEQ ID NO: 20223 - DNA, 22 bp, Homo sapiens
ggaggctgaggcaggcggatca

SEQ ID NO: 20224 - DNA, 22 bp, Homo sapiens
gctgtgtatcagatgccacggg

SEQ ID NO: 20225 - DNA, 22 bp, Homo sapiens
ggcgggacggggcgtgcacaga

SEQ ID NO: 20226 - DNA, 22 bp, Homo sapiens
ttgtgctcctgtgagaatctag

SEQ ID NO: 20227 - DNA, 22 bp, Homo sapiens
cagcctgtagtctggtccaggt

SEQ ID NO: 20228 - DNA, 22 bp, Homo sapiens
cagccctcctaccctgccaggc

SEQ ID NO: 20229 - DNA, 22 bp, Homo sapiens
tgcctgtgtcagcaggtggaag

SEQ ID NO: 20230 - DNA, 22 bp, Homo sapiens
actgcactcctgcctgggtaac

SEQ ID NO: 20231 - DNA, 22 bp, Homo sapiens
ttcccacattctttacattcat

SEQ ID NO: 20232 - DNA, 22 bp, Homo sapiens
gctgaaggcccggaggacaggg

SEQ ID NO: 20233 - DNA, 22 bp, Homo sapiens
cactgcactccagcactccagc

SEQ ID NO: 20234 - DNA, 22 bp, Homo sapiens
atatattttttgagacagagtc

SEQ ID NO: 20235 - DNA, 22 bp, Homo sapiens
cactgcaccctcaaactcctgg

SEQ ID NO: 20236 - DNA, 22 bp, Homo sapiens
gccggggctggggagagacatg

SEQ ID NO: 20237 - DNA, 23 bp, Homo sapiens
gtgcgccaggacaacctgacgga

SEQ ID NO: 20238 - DNA, 22 bp, Homo sapiens
gccccgtcgtggggccagggat

SEQ ID NO: 20239 - DNA, 22 bp, Homo sapiens
cagcagcagtgttctagaatct

SEQ ID NO: 20240 - DNA, 22 bp, Homo sapiens
tcttcctggatgggggttgatg

SEQ ID NO: 20241 - DNA, 22 bp, Homo sapiens
tgtgttgtgacattcttggatg

SEQ ID NO: 20242 - DNA, 22 bp, Homo sapiens
aaggtcatggcaaattactttt

SEQ ID NO: 20243 - DNA, 21 bp, Homo sapiens
acacaggcagtgtcccgaggt

SEQ ID NO: 20244 - DNA, 22 bp, Homo sapiens
aagtcacttcttaggaaaggag

SEQ ID NO: 20245 - DNA, 22 bp, Homo sapiens
gccgtggggagagagggtgcgt

SEQ ID NO: 20246 - DNA, 22 bp, Homo sapiens
aagcatttcaggtagagatatt

SEQ ID NO: 20247 - DNA, 22 bp, Homo sapiens
gggtaaatctcttttcatggct

SEQ ID NO: 20248 - DNA, 22 bp, Homo sapiens
tgggcaggggccctgcttccgt

SEQ ID NO: 20249 - DNA, 22 bp, Homo sapiens
agagggcgcccaggcccacgcc

SEQ ID NO: 20250 - DNA, 22 bp, Homo sapiens
tgatctttggtaatctggcaca

SEQ ID NO: 20251 - DNA, 22 bp, Homo sapiens
tccacaggtccggcatgaacag

SEQ ID NO: 20252 - DNA, 22 bp, Homo sapiens
cagtggccaacttcctgcctct

SEQ ID NO: 20253 - DNA, 22 bp, Homo sapiens
ggcgcccccttcaaacagagca

SEQ ID NO: 20254 - DNA, 22 bp, Homo sapiens
gagcacgttgaagcgcactgtc

SEQ ID NO: 20255 - DNA, 22 bp, Homo sapiens
tatctattatgttctatgtgtc

SEQ ID NO: 20256 - DNA, 22 bp, Homo sapiens
cctcgtccacaatccttgcaca

SEQ ID NO: 20257 - DNA, 22 bp, Homo sapiens
aatggctctgatgttgttgtga

SEQ ID NO: 20258 - DNA, 22 bp, Homo sapiens
ttacttaaacagaaatgcagaa

SEQ ID NO: 20259 - DNA, 22 bp, Homo sapiens
gggctgtgaggtgagaacttac

SEQ ID NO: 20260 - DNA, 21 bp, Homo sapiens
tgaaggggtggcagtgtgctt

SEQ ID NO: 20261 - DNA, 17 bp, Homo sapiens
cgggcatggagggcagg

SEQ ID NO: 20262 - DNA, 22 bp, Homo sapiens
cgcgctctccttctggcaccca

SEQ ID NO: 20263 - DNA, 22 bp, Homo sapiens
gcaccaggtgcagccgggcccc

SEQ ID NO: 20264 - DNA, 22 bp, Homo sapiens
tgaacatgctgttgatggcctg

SEQ ID NO: 20265 - DNA, 22 bp, Homo sapiens
gagagtctaggaacctcatata

SEQ ID NO: 20266 - DNA, 22 bp, Homo sapiens
agcattccacactgaagtctgc

SEQ ID NO: 20267 - DNA, 22 bp, Homo sapiens
agccaggatggtctcgatcggc

SEQ ID NO: 20268 - DNA, 22 bp, Homo sapiens
tctcagaacctcagtttgctct

SEQ ID NO: 20269 - DNA, 22 bp, Homo sapiens
cggcatgggcgtccccctcact

SEQ ID NO: 20270 - DNA, 22 bp, Homo sapiens
aggctcagatccttgtgtcctg

SEQ ID NO: 20271 - DNA, 22 bp, Homo sapiens
agaaagagatgaatgctttaag

SEQ ID NO: 20272 - DNA, 22 bp, Homo sapiens
ctccggccgcggtgcccagcgc

SEQ ID NO: 20273 - DNA, 22 bp, Homo sapiens
gccctagcgccagctcagcacc

SEQ ID NO: 20274 - DNA, 22 bp, Homo sapiens
taccagggaacagggatattaa

SEQ ID NO: 20275 - DNA, 22 bp, Homo sapiens
tcagccagccagctacaggctt

SEQ ID NO: 20276 - DNA, 19 bp, Homo sapiens
atcccaaggagctgggact

SEQ ID NO: 20277 - DNA, 22 bp, Homo sapiens
tggagggcatgctgtccatggg

SEQ ID NO: 20278 - DNA, 17 bp, Homo sapiens
aggaggccctggcgttt

SEQ ID NO: 20279 - DNA, 22 bp, Homo sapiens
tgaggcaggagttcaggctgcg

SEQ ID NO: 20280 - DNA, 22 bp, Homo sapiens
acccaggctggagtgcagtggc

SEQ ID NO: 20281 - DNA, 22 bp, Homo sapiens
ttcttctcagggtcccacatgg

SEQ ID NO: 20282 - DNA, 22 bp, Homo sapiens
tggcccgaagatccgagggtca

SEQ ID NO: 20283 - DNA, 22 bp, Homo sapiens
tatgtaagttgcaaatgaagga

SEQ ID NO: 20284 - DNA, 23 bp, Homo sapiens
ctggggctttcaaatctgggcag

SEQ ID NO: 20285 - DNA, 22 bp, Homo sapiens
gagccccaccctagacattctg

SEQ ID NO: 20286 - DNA, 22 bp, Homo sapiens
acaagcatgggctttgacatca

SEQ ID NO: 20287 - DNA, 22 bp, Homo sapiens
attgctaggaacaggttgcacc

SEQ ID NO: 20288 - DNA, 22 bp, Homo sapiens
tagagtgtcataacagtgccca

SEQ ID NO: 20289 - DNA, 22 bp, Homo sapiens
agacaaagaaaccgtagaagca

SEQ ID NO: 20290 - DNA, 22 bp, Homo sapiens
aggaaataggaccagacaaagc

SEQ ID NO: 20291 - DNA, 22 bp, Homo sapiens
tgtcttcaggagtaaatatcat

SEQ ID NO: 20292 - DNA, 22 bp, Homo sapiens
tttgaagactactgggagtgaa

SEQ ID NO: 20293 - DNA, 22 bp, Homo sapiens
taacatttaaatttttcacata

SEQ ID NO: 20294 - DNA, 22 bp, Homo sapiens
ctgcaagctacccctagcatca

SEQ ID NO: 20295 - DNA, 22 bp, Homo sapiens
cccacgtcgaacttgctccaga

SEQ ID NO: 20296 - DNA, 22 bp, Homo sapiens
attgcaggctctgacaccaggc

SEQ ID NO: 20297 - DNA, 22 bp, Homo sapiens
gagcccgagcgcgtacccggcg

SEQ ID NO: 20298 - DNA, 22 bp, Homo sapiens
agtgccctttacaacttcttga

SEQ ID NO: 20299 - DNA, 22 bp, Homo sapiens
caggctggagtgcagtggcgcc

SEQ ID NO: 20300 - DNA, 22 bp, Homo sapiens
tgtttcttacgtttttagaggc

SEQ ID NO: 20301 - DNA, 22 bp, Homo sapiens
ttcaccctggaccagaaattgg

SEQ ID NO: 20302 - DNA, 22 bp, Homo sapiens
cctgcgggctgtgctgaagcct

SEQ ID NO: 20303 - DNA, 22 bp, Homo sapiens
acaggggattgattggaagtct

SEQ ID NO: 20304 - DNA, 16 bp, Homo sapiens
cattgcactctagcct

SEQ ID NO: 20305 - DNA, 22 bp, Homo sapiens
ctgaggcaggcagatcacttga

SEQ ID NO: 20306 - DNA, 20 bp, Homo sapiens
atcctctcctgattaattca

SEQ ID NO: 20307 - DNA, 22 bp, Homo sapiens
tttctcttcactgtgtgcctca

SEQ ID NO: 20308 - DNA, 22 bp, Homo sapiens
acatttatataactcactagga

SEQ ID NO: 20309 - DNA, 21 bp, Homo sapiens
cagagctgtccaaaccctgac

SEQ ID NO: 20310 - DNA, 22 bp, Homo sapiens
tctgcgtgaaactagatggcag

SEQ ID NO: 20311 - DNA, 22 bp, Homo sapiens
gttgcagatgtggaactcgtgc

SEQ ID NO: 20312 - DNA, 22 bp, Homo sapiens
gagccaagattgtgtccctgca

SEQ ID NO: 20313 - DNA, 22 bp, Homo sapiens
tcagcagtgagaattaatgttg

SEQ ID NO: 20314 - DNA, 22 bp, Homo sapiens
aggtgggcggattcatgaggtc

SEQ ID NO: 20315 - DNA, 22 bp, Homo sapiens
agggaagaggaccagagtctct

SEQ ID NO: 20316 - DNA, 22 bp, Homo sapiens
gaggcgggcagatcacctgagg

SEQ ID NO: 20317 - DNA, 23 bp, Homo sapiens
aaacttgctatggctgaaatcat

SEQ ID NO: 20318 - DNA, 22 bp, Homo sapiens
ttttctaacatctagtaatttg

SEQ ID NO: 20319 - DNA, 22 bp, Homo sapiens
agtactgtcagcagggtgttga

SEQ ID NO: 20320 - DNA, 22 bp, Homo sapiens
aaagtgctgaaattacaggtgt

SEQ ID NO: 20321 - DNA, 22 bp, Homo sapiens
ggcctcacccatcggtgccttt

SEQ ID NO: 20322 - DNA, 22 bp, Homo sapiens
caggtgagaggcggtcctgcat

SEQ ID NO: 20323 - DNA, 22 bp, Homo sapiens
attgagaagaaaatctaatata

SEQ ID NO: 20324 - DNA, 22 bp, Homo sapiens
ggagagcttggagtgcgatttt

SEQ ID NO: 20325 - DNA, 22 bp, Homo sapiens
ctccaggccatggctgcggagg

SEQ ID NO: 20326 - DNA, 22 bp, Homo sapiens
cctgtctctgcagggccctgcc

SEQ ID NO: 20327 - DNA, 22 bp, Homo sapiens
gggcagagagctggaactcctt

SEQ ID NO: 20328 - DNA, 22 bp, Homo sapiens
gtggggcctgtggcttccgtgg

SEQ ID NO: 20329 - DNA, 22 bp, Homo sapiens
ccaccgccatggcgttgtacag

SEQ ID NO: 20330 - DNA, 22 bp, Homo sapiens
actgtgaacggactgaagccca

SEQ ID NO: 20331 - DNA, 22 bp, Homo sapiens
gcaagacctatctagttgctgt

SEQ ID NO: 20332 - DNA, 22 bp, Homo sapiens
ggcagggagtggagactcccta

SEQ ID NO: 20333 - DNA, 22 bp, Homo sapiens
cgcggctctgcgggccgctgag

SEQ ID NO: 20334 - DNA, 22 bp, Homo sapiens
atacctgtgtatccacaagcgt

SEQ ID NO: 20335 - DNA, 22 bp, Homo sapiens
cattctgaccctatgatttaag

SEQ ID NO: 20336 - DNA, 22 bp, Homo sapiens
ctcagctcattgtggatccggt

SEQ ID NO: 20337 - DNA, 22 bp, Homo sapiens
gagcccaggaagtggaggctga

SEQ ID NO: 20338 - DNA, 21 bp, Homo sapiens
cagggccaatcctgacctcta

SEQ ID NO: 20339 - DNA, 21 bp, Homo sapiens
aaactgaccttgcctgagaca

SEQ ID NO: 20340 - DNA, 22 bp, Homo sapiens
tctggctccaggaccgggcaca

SEQ ID NO: 20341 - DNA, 22 bp, Homo sapiens
agaagccaccagctgaggaaga

SEQ ID NO: 20342 - DNA, 22 bp, Homo sapiens
agattctaccagagctagtttg

SEQ ID NO: 20343 - DNA, 20 bp, Homo sapiens
gctgaggtggaggaaggaga

SEQ ID NO: 20344 - DNA, 22 bp, Homo sapiens
tgcgatggcgtagacaaatccc

SEQ ID NO: 20345 - DNA, 22 bp, Homo sapiens
gagagtctagtgcacctagttt

SEQ ID NO: 20346 - DNA, 22 bp, Homo sapiens
tgttgatttgtgggctgcaaaa

SEQ ID NO: 20347 - DNA, 22 bp, Homo sapiens
tcagaacatgtttgagtaagac

SEQ ID NO: 20348 - DNA, 22 bp, Homo sapiens
gctccccaaaagctccaggaaa

SEQ ID NO: 20349 - DNA, 22 bp, Homo sapiens
aggctctgtcaggcggagcagc

SEQ ID NO: 20350 - DNA, 22 bp, Homo sapiens
tggaggttgggatgcttgtgat

SEQ ID NO: 20351 - DNA, 22 bp, Homo sapiens
ctgggaggcagaggttgtagtg

SEQ ID NO: 20352 - DNA, 22 bp, Homo sapiens
ttccgagggctcggcggccgcc

SEQ ID NO: 20353 - DNA, 22 bp, Homo sapiens
cggggcctcgtcactctttgcg

SEQ ID NO: 20354 - DNA, 21 bp, Homo sapiens
ctgtcatgcaaccattctcca

SEQ ID NO: 20355 - DNA, 20 bp, Homo sapiens
ggccggggagctctccaggg

SEQ ID NO: 20356 - DNA, 22 bp, Homo sapiens
ttagatttgtagtgagttcaga

SEQ ID NO: 20357 - DNA, 22 bp, Homo sapiens
tttaatcataagaaggaaaata

SEQ ID NO: 20358 - DNA, 22 bp, Homo sapiens
gagccaggtcgggccgcggcga

SEQ ID NO: 20359 - DNA, 22 bp, Homo sapiens
ttcccaggaagcctctccaagc

SEQ ID NO: 20360 - DNA, 22 bp, Homo sapiens
aagaagcattctttcattggtt

SEQ ID NO: 20361 - DNA, 22 bp, Homo sapiens
ggggcccctcggacacgtgcgg

SEQ ID NO: 20362 - DNA, 22 bp, Homo sapiens
ctggagtagccggacgggtctg

SEQ ID NO: 20363 - DNA, 22 bp, Homo sapiens
gccatcatatcccctgtgacct

SEQ ID NO: 20364 - DNA, 22 bp, Homo sapiens
tatgcttattgtctcatccact

SEQ ID NO: 20365 - DNA, 22 bp, Homo sapiens
ggcctttgcgtccacgccgctt

SEQ ID NO: 20366 - DNA, 22 bp, Homo sapiens
cattgcactctagtctgggtga

SEQ ID NO: 20367 - DNA, 19 bp, Homo sapiens
gctgaggtggaggaaggag

SEQ ID NO: 20368 - DNA, 22 bp, Homo sapiens
cactgctacctctgcctcccgg

SEQ ID NO: 20369 - DNA, 22 bp, Homo sapiens
tcactgcaacctccacctcccg

SEQ ID NO: 20370 - DNA, 22 bp, Homo sapiens
ggaggcagaatagagtgtgggt

SEQ ID NO: 20371 - DNA, 22 bp, Homo sapiens
ttggccatctaagcccagccac

SEQ ID NO: 20372 - DNA, 22 bp, Homo sapiens
ctgctcctgtccagcagggcca

SEQ ID NO: 20373 - DNA, 22 bp, Homo sapiens
agggatggagtgcggcccggac

SEQ ID NO: 20374 - DNA, 22 bp, Homo sapiens
atgcagaagactgaaaagctga

SEQ ID NO: 20375 - DNA, 22 bp, Homo sapiens
ttttaatactgctattgtagga

SEQ ID NO: 20376 - DNA, 22 bp, Homo sapiens
atgaggcaggagtgcagtggca

SEQ ID NO: 20377 - DNA, 22 bp, Homo sapiens
ctatacagcagcttactagtta

SEQ ID NO: 20378 - DNA, 22 bp, Homo sapiens
tatcacagtaaatctgggtgca

SEQ ID NO: 20379 - DNA, 22 bp, Homo sapiens
ggcccaggctggagtgcagtgg

SEQ ID NO: 20380 - DNA, 22 bp, Homo sapiens
gtctatgatattttgttatagc

SEQ ID NO: 20381 - DNA, 22 bp, Homo sapiens
agtggagacaggacagtcgata

SEQ ID NO: 20382 - DNA, 22 bp, Homo sapiens
gcagagctcatgcctgcacctc

SEQ ID NO: 20383 - DNA, 22 bp, Homo sapiens
aggagggagcttaagccaggca

SEQ ID NO: 20384 - DNA, 22 bp, Homo sapiens
agcaggaaggggatgatgggca

SEQ ID NO: 20385 - DNA, 22 bp, Homo sapiens
acagcagcaatagcagtgacat

SEQ ID NO: 20386 - DNA, 22 bp, Homo sapiens
ggtggcagtagcactgggcctg

SEQ ID NO: 20387 - DNA, 21 bp, Homo sapiens
cactccacttagaacagggtt

SEQ ID NO: 20388 - DNA, 22 bp, Homo sapiens
ggaggcggaggctgcagtgagc

SEQ ID NO: 20389 - DNA, 22 bp, Homo sapiens
tgcgatgcaacagcttggcgga

SEQ ID NO: 20390 - DNA, 22 bp, Homo sapiens
ccaggaggcagaagttgcagtg

SEQ ID NO: 20391 - DNA, 22 bp, Homo sapiens
aacccagggtggaggttgcagt

SEQ ID NO: 20392 - DNA, 22 bp, Homo sapiens
atcatccaagcgtagttcttct

SEQ ID NO: 20393 - DNA, 22 bp, Homo sapiens
tgtgtgagtaaggctgagagag

SEQ ID NO: 20394 - DNA, 22 bp, Homo sapiens
aagacccacaaggctgaatgtt

SEQ ID NO: 20395 - DNA, 22 bp, Homo sapiens
acccaggctggcgtgcagtggc

SEQ ID NO: 20396 - DNA, 22 bp, Homo sapiens
tgagtgtggggaatgtcatgag

SEQ ID NO: 20397 - DNA, 22 bp, Homo sapiens
ccactattactgtgtggcagtc

SEQ ID NO: 20398 - DNA, 21 bp, Homo sapiens
tgttttccaccttgaggcaag

SEQ ID NO: 20399 - DNA, 22 bp, Homo sapiens
atgtatacgtgcaagtcacagg

SEQ ID NO: 20400 - DNA, 22 bp, Homo sapiens
atgccactgcactccagcctgg

SEQ ID NO: 20401 - DNA, 22 bp, Homo sapiens
atataatttttggttagctcaa

SEQ ID NO: 20402 - DNA, 22 bp, Homo sapiens
gggtccctggaattacttgaca

SEQ ID NO: 20403 - DNA, 22 bp, Homo sapiens
aagaatgagctcaaagatctta

SEQ ID NO: 20404 - DNA, 22 bp, Homo sapiens
actcatgtaagcggaatgtagt

SEQ ID NO: 20405 - DNA, 22 bp, Homo sapiens
cagccccacacggtctagctct

SEQ ID NO: 20406 - DNA, 22 bp, Homo sapiens
agaaaacataggagacaggaaa

SEQ ID NO: 20407 - DNA, 22 bp, Homo sapiens
aaacccagggttttgtcttccc

SEQ ID NO: 20408 - DNA, 22 bp, Homo sapiens
aaacttttttaggttcataggc

SEQ ID NO: 20409 - DNA, 22 bp, Homo sapiens
ctcctccacccgctggggccca

SEQ ID NO: 20410 - DNA, 19 bp, Homo sapiens
gctgaaggaggtgcctgca

SEQ ID NO: 20411 - DNA, 22 bp, Homo sapiens
atttcctgcaaggagtgggttt

SEQ ID NO: 20412 - DNA, 22 bp, Homo sapiens
ccaggctggagtatagtggcgc

SEQ ID NO: 20413 - DNA, 22 bp, Homo sapiens
gcatatgatcacgtgtgtcggt

SEQ ID NO: 20414 - DNA, 22 bp, Homo sapiens
cacgcacgctgggtggaggcgc

SEQ ID NO: 20415 - DNA, 21 bp, Homo sapiens
tctgatggtagatgagatgtg

SEQ ID NO: 20416 - DNA, 22 bp, Homo sapiens
ttgggctcaggagtttgagacc

SEQ ID NO: 20417 - DNA, 22 bp, Homo sapiens
tgagggaatattgatagatccg

SEQ ID NO: 20418 - DNA, 22 bp, Homo sapiens
cgcggtggcggcctccagcgcc

SEQ ID NO: 20419 - DNA, 22 bp, Homo sapiens
tccaaatgagctctgccttcca

SEQ ID NO: 20420 - DNA, 22 bp, Homo sapiens
agggccagcactcctggcagga

SEQ ID NO: 20421 - DNA, 22 bp, Homo sapiens
cccacacacatttatgatagga

SEQ ID NO: 20422 - DNA, 22 bp, Homo sapiens
ggaggcggaagttgcagtgagc

SEQ ID NO: 20423 - DNA, 22 bp, Homo sapiens
atttaagggatttggagaccaa

SEQ ID NO: 20424 - DNA, 22 bp, Homo sapiens
ataaaagatcccttctgagctc

SEQ ID NO: 20425 - DNA, 22 bp, Homo sapiens
accaggggatggttggcactgt

SEQ ID NO: 20426 - DNA, 22 bp, Homo sapiens
cctgggggccaggaaggtgtga

SEQ ID NO: 20427 - DNA, 22 bp, Homo sapiens
ttagatttacaagcactgttta

SEQ ID NO: 20428 - DNA, 22 bp, Homo sapiens
gcctggagaaaggaaggtggga

SEQ ID NO: 20429 - DNA, 22 bp, Homo sapiens
agggtcctgggtgcagttgctt

SEQ ID NO: 20430 - DNA, 22 bp, Homo sapiens
tgttcttaggtatttgacagtc

SEQ ID NO: 20431 - DNA, 22 bp, Homo sapiens
gcccagcccagaaaggttcgga

SEQ ID NO: 20432 - DNA, 22 bp, Homo sapiens
ctgctccccagcctgcgccttt

SEQ ID NO: 20433 - DNA, 22 bp, Homo sapiens
ggagttgattttggatatatta

SEQ ID NO: 20434 - DNA, 22 bp, Homo sapiens
acccaggagacggaggtgcagt

SEQ ID NO: 20435 - DNA, 22 bp, Homo sapiens
gcccagccacagtcactttcat

SEQ ID NO: 20436 - DNA, 23 bp, Homo sapiens
gtcacagtgggtggtgcctacat

SEQ ID NO: 20437 - DNA, 19 bp, Homo sapiens
ggggcccggggtctgcgag

SEQ ID NO: 20438 - DNA, 22 bp, Homo sapiens
aagcacaatgaacatcttagat

SEQ ID NO: 20439 - DNA, 22 bp, Homo sapiens
agtgagagtattaatgtgaact

SEQ ID NO: 20440 - DNA, 22 bp, Homo sapiens
taaagggtaggttttactgtaa

SEQ ID NO: 20441 - DNA, 23 bp, Homo sapiens
gacagagtgagaccttgtcttac

SEQ ID NO: 20442 - DNA, 22 bp, Homo sapiens
gctcccagtctgatggaggaga

SEQ ID NO: 20443 - DNA, 22 bp, Homo sapiens
aaagtgcttctctttggtgggt

SEQ ID NO: 20444 - DNA, 22 bp, Homo sapiens
atgccaataaatgttaatatct

SEQ ID NO: 20445 - DNA, 22 bp, Homo sapiens
ccagagtcccttgcagctcagt

SEQ ID NO: 20446 - DNA, 22 bp, Homo sapiens
ggctcctgggggtgctcctgcc

SEQ ID NO: 20447 - DNA, 22 bp, Homo sapiens
acaggcacctgccaccacatct

SEQ ID NO: 20448 - DNA, 22 bp, Homo sapiens
tcagcctccgaaagtgctggga

SEQ ID NO: 20449 - DNA, 22 bp, Homo sapiens
ctgtcatggtttgaatgctcgc

SEQ ID NO: 20450 - DNA, 22 bp, Homo sapiens
aaggtcagagtgagctgtggcc

SEQ ID NO: 20451 - DNA, 22 bp, Homo sapiens
atagggcctaaaaagtattgct

SEQ ID NO: 20452 - DNA, 22 bp, Homo sapiens
ctctggagtgtctggccagggt

SEQ ID NO: 20453 - DNA, 22 bp, Homo sapiens
gcaaatacatgttgagcaccta

SEQ ID NO: 20454 - DNA, 22 bp, Homo sapiens
tcccccaggctggagtgcagtg

SEQ ID NO: 20455 - DNA, 22 bp, Homo sapiens
gcagccagagggggtgtgatca

SEQ ID NO: 20456 - DNA, 22 bp, Homo sapiens
gctgtagtgaatggccgcgttc

SEQ ID NO: 20457 - DNA, 22 bp, Homo sapiens
cggaggttgaggctgcagtgag

SEQ ID NO: 20458 - DNA, 22 bp, Homo sapiens
tgagctgtgtcttggtgagagt

SEQ ID NO: 20459 - DNA, 22 bp, Homo sapiens
gggacatctttctagtcagggt

SEQ ID NO: 20460 - DNA, 22 bp, Homo sapiens
acctggacacctgctgtcatct

SEQ ID NO: 20461 - DNA, 22 bp, Homo sapiens
ctgggaggcagaggttgcagtg

SEQ ID NO: 20462 - DNA, 22 bp, Homo sapiens
agtgctgggctatctactgcta

SEQ ID NO: 20463 - DNA, 22 bp, Homo sapiens
ttcctttctctggactgcagcc

SEQ ID NO: 20464 - DNA, 22 bp, Homo sapiens
tggccgggaagggacagtgtgg

SEQ ID NO: 20465 - DNA, 22 bp, Homo sapiens
ggcctgcctcacagtcagcacc

SEQ ID NO: 20466 - DNA, 22 bp, Homo sapiens
cgtctggcttctccacggtaaa

SEQ ID NO: 20467 - DNA, 22 bp, Homo sapiens
gggcaggaacaaatcaaatgat

SEQ ID NO: 20468 - DNA, 22 bp, Homo sapiens
gggcaggggtcagtggccccaa

SEQ ID NO: 20469 - DNA, 20 bp, Homo sapiens
aggccccaggtggacactag

SEQ ID NO: 20470 - DNA, 22 bp, Homo sapiens
aagacacaatgtagcccagcac

SEQ ID NO: 20471 - DNA, 22 bp, Homo sapiens
gccctgagaagaagtcggaggg

SEQ ID NO: 20472 - DNA, 22 bp, Homo sapiens
gcctccccaagcagcagggatt

SEQ ID NO: 20473 - DNA, 22 bp, Homo sapiens
gtgtaagtatctttgtatcttt

SEQ ID NO: 20474 - DNA, 22 bp, Homo sapiens
gagaggtggaggttgcagtgag

SEQ ID NO: 20475 - DNA, 22 bp, Homo sapiens
caggcgggcaggtgcggcccct

SEQ ID NO: 20476 - DNA, 22 bp, Homo sapiens
agtccaggcattccagccattc

SEQ ID NO: 20477 - DNA, 22 bp, Homo sapiens
gagggaaaggttaatacatgat

SEQ ID NO: 20478 - DNA, 22 bp, Homo sapiens
tgtcatctgcgggtggcactgc

SEQ ID NO: 20479 - DNA, 22 bp, Homo sapiens
gaggtggctgcttgctgggaaa

SEQ ID NO: 20480 - DNA, 22 bp, Homo sapiens
agaggcagtatacaatccgagc

SEQ ID NO: 20481 - DNA, 22 bp, Homo sapiens
tgcctgttgcccacctgataaa

SEQ ID NO: 20482 - DNA, 22 bp, Homo sapiens
aaggagaggttgtccgtgttgt

SEQ ID NO: 20483 - DNA, 22 bp, Homo sapiens
agcccttagtacatttctcaag

SEQ ID NO: 20484 - DNA, 22 bp, Homo sapiens
cctgggccctcaccgccggtgg

SEQ ID NO: 20485 - DNA, 21 bp, Homo sapiens
gctgctcgagatccagtgctt

SEQ ID NO: 20486 - DNA, 19 bp, Homo sapiens
gagtattttccaacttggt

SEQ ID NO: 20487 - DNA, 23 bp, Homo sapiens
atgacactcctgtgcgcaccctg

SEQ ID NO: 20488 - DNA, 22 bp, Homo sapiens
cactgcactccatcctgggaaa

SEQ ID NO: 20489 - DNA, 22 bp, Homo sapiens
ctatggtctggaccgaggtcct

SEQ ID NO: 20490 - DNA, 22 bp, Homo sapiens
gcagggtctgaggccacagagg

SEQ ID NO: 20491 - DNA, 22 bp, Homo sapiens
tgtcatagtgtggtagcagtgg

SEQ ID NO: 20492 - DNA, 22 bp, Homo sapiens
accagctagggtagcacatctc

SEQ ID NO: 20493 - DNA, 22 bp, Homo sapiens
atctggctcccttggaatccgt

SEQ ID NO: 20494 - DNA, 22 bp, Homo sapiens
aagccaggttccatggaggagc

SEQ ID NO: 20495 - DNA, 22 bp, Homo sapiens
accgagttagccaggatggtct

SEQ ID NO: 20496 - DNA, 22 bp, Homo sapiens
aatactgcctgtgaggtaactc

SEQ ID NO: 20497 - DNA, 22 bp, Homo sapiens
aggagatggagctcagtgggca

SEQ ID NO: 20498 - DNA, 22 bp, Homo sapiens
ggagggcagagtcccctgctga

SEQ ID NO: 20499 - DNA, 20 bp, Homo sapiens
aagacaccagtggcagcccc

SEQ ID NO: 20500 - DNA, 22 bp, Homo sapiens
aataatctcactttatgtggaa

SEQ ID NO: 20501 - DNA, 22 bp, Homo sapiens
gcagaagcacaggtgacgggcc

SEQ ID NO: 20502 - DNA, 22 bp, Homo sapiens
atatatttgagaatattcatga

SEQ ID NO: 20503 - DNA, 22 bp, Homo sapiens
ctcccagccttcgccagtctga

SEQ ID NO: 20504 - DNA, 19 bp, Homo sapiens
taggaccctggtggccccc

SEQ ID NO: 20505 - DNA, 20 bp, Homo sapiens
ggtggccgtagcgggcggcg

SEQ ID NO: 20506 - DNA, 23 bp, Homo sapiens
gcctgccgcctggctgagaactg

SEQ ID NO: 20507 - DNA, 22 bp, Homo sapiens
acccagccatgttcagttctct

SEQ ID NO: 20508 - DNA, 22 bp, Homo sapiens
cccccagctctgctgggtcccg

SEQ ID NO: 20509 - DNA, 22 bp, Homo sapiens
gggggagagacgagcggctctg

SEQ ID NO: 20510 - DNA, 22 bp, Homo sapiens
gagaaagctaaataagttgatt

SEQ ID NO: 20511 - DNA, 20 bp, Homo sapiens
gctgaggggtctatggcata

SEQ ID NO: 20512 - DNA, 22 bp, Homo sapiens
agagggcattaactctgtcttg

SEQ ID NO: 20513 - DNA, 23 bp, Homo sapiens
cccagaccttgtgctgcccttgg

SEQ ID NO: 20514 - DNA, 22 bp, Homo sapiens
tggctgtgtccctgtccagagt

SEQ ID NO: 20515 - DNA, 22 bp, Homo sapiens
gcaggaggttgagccaggactg

SEQ ID NO: 20516 - DNA, 22 bp, Homo sapiens
cgctgataaacgtcacgttccc

SEQ ID NO: 20517 - DNA, 22 bp, Homo sapiens
gctggggaggcagcagagaaca

SEQ ID NO: 20518 - DNA, 22 bp, Homo sapiens
atgccactgcacttcagcctgg

SEQ ID NO: 20519 - DNA, 19 bp, Homo sapiens
gccgggcccgggttggccg

SEQ ID NO: 20520 - DNA, 22 bp, Homo sapiens
atgccactgcgctctagcctgg

SEQ ID NO: 20521 - DNA, 22 bp, Homo sapiens
atgaccagccgagataaacaga

SEQ ID NO: 20522 - DNA, 22 bp, Homo sapiens
gaattcttttctttctgaaagt

SEQ ID NO: 20523 - DNA, 22 bp, Homo sapiens
cgcgctgcagacagcggaggcc

SEQ ID NO: 20524 - DNA, 22 bp, Homo sapiens
acactgaaagaagccagcttgt

SEQ ID NO: 20525 - DNA, 22 bp, Homo sapiens
cagctgcccctccagggctggg

SEQ ID NO: 20526 - DNA, 22 bp, Homo sapiens
aactatgttaataagtttcatt

SEQ ID NO: 20527 - DNA, 22 bp, Homo sapiens
ggcaggactgatcagtgggatg

SEQ ID NO: 20528 - DNA, 22 bp, Homo sapiens
ttcacagtggtagtgcatttag

SEQ ID NO: 20529 - DNA, 22 bp, Homo sapiens
agaggctgcacttgctcatgat

SEQ ID NO: 20530 - DNA, 22 bp, Homo sapiens
tttctttatcatagcatctttg

SEQ ID NO: 20531 - DNA, 22 bp, Homo sapiens
atacacgtgccatgttggtgtg

SEQ ID NO: 20532 - DNA, 22 bp, Homo sapiens
ggctccccaggtccaggagctg

SEQ ID NO: 20533 - DNA, 22 bp, Homo sapiens
taaggcaggaactggctgtttt

SEQ ID NO: 20534 - DNA, 22 bp, Homo sapiens
gccactgtggtcctcccatgat

SEQ ID NO: 20535 - DNA, 22 bp, Homo sapiens
caggctggagttcagtggtgtg

SEQ ID NO: 20536 - DNA, 22 bp, Homo sapiens
cagcccaggactgcaggtgttt

SEQ ID NO: 20537 - DNA, 22 bp, Homo sapiens
aggccagcagcatgacggcatc

SEQ ID NO: 20538 - DNA, 22 bp, Homo sapiens
tcagtttttctatactttgtag

SEQ ID NO: 20539 - DNA, 21 bp, Homo sapiens
acagcctccatctcctgggct

SEQ ID NO: 20540 - DNA, 19 bp, Homo sapiens
cataatacagtggatctga

SEQ ID NO: 20541 - DNA, 22 bp, Homo sapiens
ggcaaaaaccataattactttt

SEQ ID NO: 20542 - DNA, 22 bp, Homo sapiens
aataaaatggtcagttttctca

SEQ ID NO: 20543 - DNA, 22 bp, Homo sapiens
ggcgtggggccttctgcccgct

SEQ ID NO: 20544 - DNA, 22 bp, Homo sapiens
tggtgccatcatagctcactgc

SEQ ID NO: 20545 - DNA, 22 bp, Homo sapiens
cccaggaggcctgcctggccgg

SEQ ID NO: 20546 - DNA, 22 bp, Homo sapiens
ccaggtgtgctctgcagtggat

SEQ ID NO: 20547 - DNA, 22 bp, Homo sapiens
aaaactgaaatacgatccaatg

SEQ ID NO: 20548 - DNA, 22 bp, Homo sapiens
ctcactgaaacctccgcctccc

SEQ ID NO: 20549 - DNA, 22 bp, Homo sapiens
tatactctgagaaacgtgtcac

SEQ ID NO: 20550 - DNA, 23 bp, Homo sapiens
ttgcagaagcagacgaccataat

SEQ ID NO: 20551 - DNA, 22 bp, Homo sapiens
cgcggaggaggtcaggaggtga

SEQ ID NO: 20552 - DNA, 22 bp, Homo sapiens
caggcactgtgctgagctctgc

SEQ ID NO: 20553 - DNA, 22 bp, Homo sapiens
ggtgtccgcgctgtagaaggtc

SEQ ID NO: 20554 - DNA, 22 bp, Homo sapiens
gtgctgacaggagcctggcggt

SEQ ID NO: 20555 - DNA, 22 bp, Homo sapiens
tccattatacttctgattcaaa

SEQ ID NO: 20556 - DNA, 21 bp, Homo sapiens
taagagcctaacacagaaagg

SEQ ID NO: 20557 - DNA, 22 bp, Homo sapiens
ttatgatttgccacagattggt

SEQ ID NO: 20558 - DNA, 22 bp, Homo sapiens
ggaggagcatgagagggtagtg

SEQ ID NO: 20559 - DNA, 22 bp, Homo sapiens
gaggtgctgctgtacttcttgc

SEQ ID NO: 20560 - DNA, 22 bp, Homo sapiens
ctgtccctgagcaactcctgtt

SEQ ID NO: 20561 - DNA, 22 bp, Homo sapiens
agtccggggtctggacacctgg

SEQ ID NO: 20562 - DNA, 22 bp, Homo sapiens
gtggcccaggctggagtgcagt

SEQ ID NO: 20563 - DNA, 22 bp, Homo sapiens
cccagggaggcccaggctctgc

SEQ ID NO: 20564 - DNA, 22 bp, Homo sapiens
acagtatagggcttatattgta

SEQ ID NO: 20565 - DNA, 22 bp, Homo sapiens
atctagattaggtataagagct

SEQ ID NO: 20566 - DNA, 22 bp, Homo sapiens
atcctcagagaacgaacacaat

SEQ ID NO: 20567 - DNA, 22 bp, Homo sapiens
tgaaggggttcagcatgggggt

SEQ ID NO: 20568 - DNA, 22 bp, Homo sapiens
catgaaattgtattggcctcaa

SEQ ID NO: 20569 - DNA, 22 bp, Homo sapiens
ggggtcggggcatagccactta

SEQ ID NO: 20570 - DNA, 22 bp, Homo sapiens
gctcccaggatgaggagccagg

SEQ ID NO: 20571 - DNA, 22 bp, Homo sapiens
tcactgcaacctccacctcctg

SEQ ID NO: 20572 - DNA, 22 bp, Homo sapiens
atgccactgcactccagcctag

SEQ ID NO: 20573 - DNA, 22 bp, Homo sapiens
ccgggccccacggtgacctcag

SEQ ID NO: 20574 - DNA, 22 bp, Homo sapiens
accccactcacacatggacctg

SEQ ID NO: 20575 - DNA, 22 bp, Homo sapiens
gcaggcagaggtggaggagaca

SEQ ID NO: 20576 - DNA, 22 bp, Homo sapiens
catgcacttacctgaaattcaa

SEQ ID NO: 20577 - DNA, 22 bp, Homo sapiens
actgcaacctccgcctgccagg

SEQ ID NO: 20578 - DNA, 22 bp, Homo sapiens
catggggcccatgtgctccaag

SEQ ID NO: 20579 - DNA, 22 bp, Homo sapiens
acaattctgatggtttcccagt

SEQ ID NO: 20580 - DNA, 20 bp, Homo sapiens
aatgctgcttctttttgcat

SEQ ID NO: 20581 - DNA, 22 bp, Homo sapiens
caggcagggagctggaaaggat

SEQ ID NO: 20582 - DNA, 22 bp, Homo sapiens
gtagtcccagctaccccggagg

SEQ ID NO: 20583 - DNA, 22 bp, Homo sapiens
tggaagggagctggaatttgga

SEQ ID NO: 20584 - DNA, 22 bp, Homo sapiens
gtctatatattgcttgaataat

SEQ ID NO: 20585 - DNA, 22 bp, Homo sapiens
tgccgcagtgcggggagggccc

SEQ ID NO: 20586 - DNA, 22 bp, Homo sapiens
aggacagagggaccagagccca

SEQ ID NO: 20587 - DNA, 22 bp, Homo sapiens
cccaggaggtggagcttgcagt

SEQ ID NO: 20588 - DNA, 22 bp, Homo sapiens
gaggtgggtgtatcacaggtca

SEQ ID NO: 20589 - DNA, 22 bp, Homo sapiens
tagatacctgctggacctcatt

SEQ ID NO: 20590 - DNA, 22 bp, Homo sapiens
ggcctcgcggcttctggtggct

SEQ ID NO: 20591 - DNA, 22 bp, Homo sapiens
acatgtttaagtttgttatatg

SEQ ID NO: 20592 - DNA, 22 bp, Homo sapiens
cgtgaggggggtaaggcgtccg

SEQ ID NO: 20593 - DNA, 22 bp, Homo sapiens
atacttctttagcatattgaac

SEQ ID NO: 20594 - DNA, 22 bp, Homo sapiens
tgcgggagggcaacgcggcatt

SEQ ID NO: 20595 - DNA, 21 bp, Homo sapiens
agggttttatagatctcttcc

SEQ ID NO: 20596 - DNA, 22 bp, Homo sapiens
gaggaggcttccgggaggcacg

SEQ ID NO: 20597 - DNA, 22 bp, Homo sapiens
ttgtacatttgttcagttctga

SEQ ID NO: 20598 - DNA, 22 bp, Homo sapiens
gagggtggtggcttaaggtgct

SEQ ID NO: 20599 - DNA, 22 bp, Homo sapiens
caggctggagtgcagtggtgcc

SEQ ID NO: 20600 - DNA, 22 bp, Homo sapiens
ggcgtgggcgaggtgctctatc

SEQ ID NO: 20601 - DNA, 22 bp, Homo sapiens
gcagaggacacaggagggcaag

SEQ ID NO: 20602 - DNA, 21 bp, Homo sapiens
gggcctggctgcgcaggacgg

SEQ ID NO: 20603 - DNA, 22 bp, Homo sapiens
tgtgggagaaggaagcaagctg

SEQ ID NO: 20604 - DNA, 22 bp, Homo sapiens
cagcctgccgtcagccaggtag

SEQ ID NO: 20605 - DNA, 22 bp, Homo sapiens
ttgcacatctaataatgctaga

SEQ ID NO: 20606 - DNA, 22 bp, Homo sapiens
ttccagttcactccatttctgg

SEQ ID NO: 20607 - DNA, 22 bp, Homo sapiens
agcctctcagagtgctgggatt

SEQ ID NO: 20608 - DNA, 22 bp, Homo sapiens
gtatagaaacccagaaagatag

SEQ ID NO: 20609 - DNA, 22 bp, Homo sapiens
agtgcaggccccaggccaggcc

SEQ ID NO: 20610 - DNA, 22 bp, Homo sapiens
cggggcgagcagacggcggcaa

SEQ ID NO: 20611 - DNA, 22 bp, Homo sapiens
gcctggattccttgtttctcag

SEQ ID NO: 20612 - DNA, 22 bp, Homo sapiens
tgcctgtggaaaggctggtgct

SEQ ID NO: 20613 - DNA, 22 bp, Homo sapiens
tcaccttgtgatctccctgcct

SEQ ID NO: 20614 - DNA, 22 bp, Homo sapiens
gggctgagacgatggggtcttc

SEQ ID NO: 20615 - DNA, 22 bp, Homo sapiens
aggccgaggcgggcggatcacc

SEQ ID NO: 20616 - DNA, 23 bp, Homo sapiens
ctcctcgtaactctgtggtgggt

SEQ ID NO: 20617 - DNA, 22 bp, Homo sapiens
gaatttcctctaaacccctgag

SEQ ID NO: 20618 - DNA, 18 bp, Homo sapiens
gcactgaggaaaacctct

SEQ ID NO: 20619 - DNA, 22 bp, Homo sapiens
tttccctttagcctgagaatcc

SEQ ID NO: 20620 - DNA, 22 bp, Homo sapiens
ctccaacgaggctggggtacaa

SEQ ID NO: 20621 - DNA, 22 bp, Homo sapiens
ctggggaacgcagcgagcagcg

SEQ ID NO: 20622 - DNA, 22 bp, Homo sapiens
gcaggtggatcacctgaggtca

SEQ ID NO: 20623 - DNA, 22 bp, Homo sapiens
gccgggaccaaggccacggagc

SEQ ID NO: 20624 - DNA, 22 bp, Homo sapiens
taagtcaaggtggcatttgaga

SEQ ID NO: 20625 - DNA, 22 bp, Homo sapiens
ttccatttggcacttcactgag

SEQ ID NO: 20626 - DNA, 23 bp, Homo sapiens
ggctgggagctccgggtgcacgt

SEQ ID NO: 20627 - DNA, 22 bp, Homo sapiens
ggcaggaacacagatggtgccg

SEQ ID NO: 20628 - DNA, 22 bp, Homo sapiens
agacactgttctcacatgcttg

SEQ ID NO: 20629 - DNA, 18 bp, Homo sapiens
ggtgagggagctggaagc

SEQ ID NO: 20630 - DNA, 22 bp, Homo sapiens
ggaggtggaggttgcagtgagc

SEQ ID NO: 20631 - DNA, 22 bp, Homo sapiens
ggaggcggaggttgcagtgagt

SEQ ID NO: 20632 - DNA, 22 bp, Homo sapiens
gcaccctgtcaaaatggaccaa

SEQ ID NO: 20633 - DNA, 22 bp, Homo sapiens
gaggagctgcccgtgtgtctgc

SEQ ID NO: 20634 - DNA, 19 bp, Homo sapiens
gggcttggggctgaagcct

SEQ ID NO: 20635 - DNA, 22 bp, Homo sapiens
atgctgtttgcttttagtctgc

SEQ ID NO: 20636 - DNA, 22 bp, Homo sapiens
actggggctgatgcgttcgtgt

SEQ ID NO: 20637 - DNA, 22 bp, Homo sapiens
tgggaagctgcattttaacaag

SEQ ID NO: 20638 - DNA, 22 bp, Homo sapiens
ttaaatattatgttgtctgcaa

SEQ ID NO: 20639 - DNA, 17 bp, Homo sapiens
acttcccacccctccag

SEQ ID NO: 20640 - DNA, 22 bp, Homo sapiens
tagaaaagccccagctggaggg

SEQ ID NO: 20641 - DNA, 18 bp, Homo sapiens
gaccccgggatctgtcga

SEQ ID NO: 20642 - DNA, 22 bp, Homo sapiens
tgaggcaggtggattacaaggt

SEQ ID NO: 20643 - DNA, 22 bp, Homo sapiens
cactgcacttcagcctgggtga

SEQ ID NO: 20644 - DNA, 22 bp, Homo sapiens
cactgcactccagcccgggcaa

SEQ ID NO: 20645 - DNA, 22 bp, Homo sapiens
tcctcagaatcacctggcagct

SEQ ID NO: 20646 - DNA, 22 bp, Homo sapiens
ctccaggctcgtccaagatcga

SEQ ID NO: 20647 - DNA, 22 bp, Homo sapiens
ttccacaatggttaagctcgtt

SEQ ID NO: 20648 - DNA, 21 bp, Homo sapiens
gctcctggtgctgcgtggcgc

SEQ ID NO: 20649 - DNA, 22 bp, Homo sapiens
tcaaatgaagacagttgacttg

SEQ ID NO: 20650 - DNA, 17 bp, Homo sapiens
ggctgcagtccaggagg

SEQ ID NO: 20651 - DNA, 22 bp, Homo sapiens
gaggcagaagttgcagtgagca

SEQ ID NO: 20652 - DNA, 22 bp, Homo sapiens
gcccgcagagatctttaacaaa

SEQ ID NO: 20653 - DNA, 21 bp, Homo sapiens
gccagcggccgccctccagga

SEQ ID NO: 20654 - DNA, 22 bp, Homo sapiens
acagacaagtagttcagacaag

SEQ ID NO: 20655 - DNA, 22 bp, Homo sapiens
tgaggcaggagaatcaccggaa

SEQ ID NO: 20656 - DNA, 22 bp, Homo sapiens
taatttcagtgcaagctcacgg

SEQ ID NO: 20657 - DNA, 22 bp, Homo sapiens
cagagctgtccaaaccctgaca

SEQ ID NO: 20658 - DNA, 22 bp, Homo sapiens
ggagaggggaacttgttgcttg

SEQ ID NO: 20659 - DNA, 16 bp, Homo sapiens
tgggtgggaggagcgg

SEQ ID NO: 20660 - DNA, 22 bp, Homo sapiens
ctgtcaggttggtctcagagct

SEQ ID NO: 20661 - DNA, 22 bp, Homo sapiens
cagccccatggtgtgctccagc

SEQ ID NO: 20662 - DNA, 22 bp, Homo sapiens
tcccctctttctggaaacacaa

SEQ ID NO: 20663 - DNA, 22 bp, Homo sapiens
tgttatatctaaatagccacat

SEQ ID NO: 20664 - DNA, 22 bp, Homo sapiens
ttgtgttaaggtgcatctagtg

SEQ ID NO: 20665 - DNA, 19 bp, Homo sapiens
tccaggggctccacctcct

SEQ ID NO: 20666 - DNA, 22 bp, Homo sapiens
aggaaggactccatggtccgtc

SEQ ID NO: 20667 - DNA, 22 bp, Homo sapiens
ctggcaggtggaggttgcagtg

SEQ ID NO: 20668 - DNA, 22 bp, Homo sapiens
atcctcagacttcacgttccat

SEQ ID NO: 20669 - DNA, 22 bp, Homo sapiens
gctgctgcttgaaggctcggag

SEQ ID NO: 20670 - DNA, 22 bp, Homo sapiens
ctacattaaattggcttactta

SEQ ID NO: 20671 - DNA, 22 bp, Homo sapiens
agagggtgggcacgtgatggat

SEQ ID NO: 20672 - DNA, 22 bp, Homo sapiens
aggtggggaggagtgtctcttt

SEQ ID NO: 20673 - DNA, 22 bp, Homo sapiens
ccctcaggtgaaaggaaaaatt

SEQ ID NO: 20674 - DNA, 22 bp, Homo sapiens
gtgggggcaggcagtgctagga

SEQ ID NO: 20675 - DNA, 22 bp, Homo sapiens
tagtatagattgaagcagatca

SEQ ID NO: 20676 - DNA, 17 bp, Homo sapiens
tgttccatttgaccacc

SEQ ID NO: 20677 - DNA, 22 bp, Homo sapiens
cccaggggttcaaggctgcagt

SEQ ID NO: 20678 - DNA, 22 bp, Homo sapiens
cggggccctggggctgaaggtc

SEQ ID NO: 20679 - DNA, 22 bp, Homo sapiens
tcaccagatctctctgtaatgg

SEQ ID NO: 20680 - DNA, 22 bp, Homo sapiens
cgggcagtgtggctccagagtc

SEQ ID NO: 20681 - DNA, 22 bp, Homo sapiens
gatggtgcaggtgaagtgctgg

SEQ ID NO: 20682 - DNA, 22 bp, Homo sapiens
tctggacaggggcgctttgggg

SEQ ID NO: 20683 - DNA, 22 bp, Homo sapiens
ccgcggggcgtgggctcttacc

SEQ ID NO: 20684 - DNA, 22 bp, Homo sapiens
cagggatggcgctggctgcccg

SEQ ID NO: 20685 - DNA, 22 bp, Homo sapiens
tgtgaatggacaattaaatcta

SEQ ID NO: 20686 - DNA, 22 bp, Homo sapiens
gttttgaatactactagaactt

SEQ ID NO: 20687 - DNA, 22 bp, Homo sapiens
gggctctcccacaacgtgccag

SEQ ID NO: 20688 - DNA, 22 bp, Homo sapiens
gacggagctggttgctgcggct

SEQ ID NO: 20689 - DNA, 22 bp, Homo sapiens
ggcagacctctccagccccaca

SEQ ID NO: 20690 - DNA, 22 bp, Homo sapiens
tcactcaggctggagtgcagtg

SEQ ID NO: 20691 - DNA, 22 bp, Homo sapiens
atgattgaccatctgctgggct

SEQ ID NO: 20692 - DNA, 22 bp, Homo sapiens
cacagagatggtctggcaggtg

SEQ ID NO: 20693 - DNA, 22 bp, Homo sapiens
aggctggagtgcagtggtgtga

SEQ ID NO: 20694 - DNA, 17 bp, Homo sapiens
tggctctgtcctcagct

SEQ ID NO: 20695 - DNA, 22 bp, Homo sapiens
gcgctgcgcctcctcttccgca

SEQ ID NO: 20696 - DNA, 22 bp, Homo sapiens
ggagagtggattccagctgtat

SEQ ID NO: 20697 - DNA, 22 bp, Homo sapiens
gcgggccaccttggagagcgct

SEQ ID NO: 20698 - DNA, 22 bp, Homo sapiens
ttgctgccttggagaagctcct

SEQ ID NO: 20699 - DNA, 22 bp, Homo sapiens
gaaagcatccgcctggaggtgg

SEQ ID NO: 20700 - DNA, 22 bp, Homo sapiens
ctgggaggcggaggttgtagtg

SEQ ID NO: 20701 - DNA, 22 bp, Homo sapiens
cgggcccgagcacggcacccac

SEQ ID NO: 20702 - DNA, 22 bp, Homo sapiens
agacggattacctgaggtcagg

SEQ ID NO: 20703 - DNA, 22 bp, Homo sapiens
ctgccctggggggcctccttgc

SEQ ID NO: 20704 - DNA, 22 bp, Homo sapiens
gctcgcgccgcaccggtccacc

SEQ ID NO: 20705 - DNA, 22 bp, Homo sapiens
gccccagcctcccgagtagctg

SEQ ID NO: 20706 - DNA, 22 bp, Homo sapiens
actattagcatatcatgaatgg

SEQ ID NO: 20707 - DNA, 22 bp, Homo sapiens
gcctggccgggtcttggatttt

SEQ ID NO: 20708 - DNA, 22 bp, Homo sapiens
atgtgggccgtgcgggtgtcct

SEQ ID NO: 20709 - DNA, 22 bp, Homo sapiens
atatacacatctttttaaatat

SEQ ID NO: 20710 - DNA, 22 bp, Homo sapiens
ccacagtcctggcttctgtctg

SEQ ID NO: 20711 - DNA, 20 bp, Homo sapiens
tgttgattggtgtcatctca

SEQ ID NO: 20712 - DNA, 22 bp, Homo sapiens
gaaacactcaatttagtaattc

SEQ ID NO: 20713 - DNA, 22 bp, Homo sapiens
tctttgttattgtgaatagggt

SEQ ID NO: 20714 - DNA, 23 bp, Homo sapiens
tgcatggggctatactgctgttc

SEQ ID NO: 20715 - DNA, 22 bp, Homo sapiens
gacagctccagctcctccaggc

SEQ ID NO: 20716 - DNA, 22 bp, Homo sapiens
gaagccttgaactgcaaacccc

SEQ ID NO: 20717 - DNA, 22 bp, Homo sapiens
ccaggctggagtgcaatggcat

SEQ ID NO: 20718 - DNA, 22 bp, Homo sapiens
agtggaccagaagactgaagct

SEQ ID NO: 20719 - DNA, 22 bp, Homo sapiens
ggtcgggcactctccagggctg

SEQ ID NO: 20720 - DNA, 22 bp, Homo sapiens
cctgcaccacaaggcttcagag

SEQ ID NO: 20721 - DNA, 22 bp, Homo sapiens
atgaggcaggtggaggctgcca

SEQ ID NO: 20722 - DNA, 22 bp, Homo sapiens
tctttctacatcatttgcttct

SEQ ID NO: 20723 - DNA, 22 bp, Homo sapiens
tccaccatgtaacaagctctgt

SEQ ID NO: 20724 - DNA, 22 bp, Homo sapiens
gcccagcacctctctcagggtt

SEQ ID NO: 20725 - DNA, 22 bp, Homo sapiens
ttccactctacacactgctggc

SEQ ID NO: 20726 - DNA, 22 bp, Homo sapiens
gggctgcatcagcaggacccgg

SEQ ID NO: 20727 - DNA, 22 bp, Homo sapiens
agaaggggcccaaggatgtcag

SEQ ID NO: 20728 - DNA, 22 bp, Homo sapiens
tttatgtagttacggactatca

SEQ ID NO: 20729 - DNA, 22 bp, Homo sapiens
attttctatgttgtaattgtta

SEQ ID NO: 20730 - DNA, 22 bp, Homo sapiens
actgattgcattcatagggttt

SEQ ID NO: 20731 - DNA, 22 bp, Homo sapiens
acctggccaatttttgtatttt

SEQ ID NO: 20732 - DNA, 22 bp, Homo sapiens
ttgcactccagtctgggaacaa

SEQ ID NO: 20733 - DNA, 22 bp, Homo sapiens
gctccggcttggtgtgcagggt

SEQ ID NO: 20734 - DNA, 22 bp, Homo sapiens
ccctgccttgtctgggctaggt

SEQ ID NO: 20735 - DNA, 22 bp, Homo sapiens
aggccagcctcaggcagggacc

SEQ ID NO: 20736 - DNA, 22 bp, Homo sapiens
atggtggacgggagacaggact

SEQ ID NO: 20737 - DNA, 22 bp, Homo sapiens
tctgccttttactagctggatg

SEQ ID NO: 20738 - DNA, 22 bp, Homo sapiens
caggctgctgacaggcttggag

SEQ ID NO: 20739 - DNA, 22 bp, Homo sapiens
gccagccagaaacgtcacactg

SEQ ID NO: 20740 - DNA, 22 bp, Homo sapiens
gaggcagaggttgcagtgagct

SEQ ID NO: 20741 - DNA, 22 bp, Homo sapiens
cttgtagaattgaaatggtctc

SEQ ID NO: 20742 - DNA, 22 bp, Homo sapiens
atgatggttgtcctaggtgcat

SEQ ID NO: 20743 - DNA, 22 bp, Homo sapiens
gaaagacatagttgcaagatgg

SEQ ID NO: 20744 - DNA, 22 bp, Homo sapiens
tgggaaggggagctggaaagga

SEQ ID NO: 20745 - DNA, 22 bp, Homo sapiens
ctgaggagaggtggcctgtgtt

SEQ ID NO: 20746 - DNA, 22 bp, Homo sapiens
ttcaccagcagctcactagtca

SEQ ID NO: 20747 - DNA, 22 bp, Homo sapiens
gcggcaggagtaaaggaggaag

SEQ ID NO: 20748 - DNA, 22 bp, Homo sapiens
ctggagggctgcagcgaggctg

SEQ ID NO: 20749 - DNA, 22 bp, Homo sapiens
ccaggaggttgaggctgcagtg

SEQ ID NO: 20750 - DNA, 22 bp, Homo sapiens
agagcgagtctggggctcggat

SEQ ID NO: 20751 - DNA, 22 bp, Homo sapiens
tttacacagaggacactgggct

SEQ ID NO: 20752 - DNA, 18 bp, Homo sapiens
ccatcaccctaactagtg

SEQ ID NO: 20753 - DNA, 22 bp, Homo sapiens
actctgtcttcatatttgcatt

SEQ ID NO: 20754 - DNA, 22 bp, Homo sapiens
ctctgctgtgccgccagggcct

SEQ ID NO: 20755 - DNA, 22 bp, Homo sapiens
ggtgccagatgaggcccgcgat

SEQ ID NO: 20756 - DNA, 22 bp, Homo sapiens
gcttccggagccaaaaggcccc

SEQ ID NO: 20757 - DNA, 22 bp, Homo sapiens
ccccacaactcatgttgaaact

SEQ ID NO: 20758 - DNA, 22 bp, Homo sapiens
gcggggggaggaacatcttgca

SEQ ID NO: 20759 - DNA, 19 bp, Homo sapiens
acacagggatcagagggtt

SEQ ID NO: 20760 - DNA, 22 bp, Homo sapiens
tcagcaatcctcccacaggtgg

SEQ ID NO: 20761 - DNA, 22 bp, Homo sapiens
cactgcaatatctgcatcctgg

SEQ ID NO: 20762 - DNA, 22 bp, Homo sapiens
tgtgttaaggtgcatctagtgc

SEQ ID NO: 20763 - DNA, 22 bp, Homo sapiens
cagagagaatcttggcagctga

SEQ ID NO: 20764 - DNA, 22 bp, Homo sapiens
actgcaacacctcctgggttca

SEQ ID NO: 20765 - DNA, 16 bp, Homo sapiens
cttggtgttggcagag

SEQ ID NO: 20766 - DNA, 22 bp, Homo sapiens
tagcagaagttgcaaactaggg

SEQ ID NO: 20767 - DNA, 21 bp, Homo sapiens
agaaggcaaaagcagacatct

SEQ ID NO: 20768 - DNA, 22 bp, Homo sapiens
ctgtccgccgacttggccaggc

SEQ ID NO: 20769 - DNA, 22 bp, Homo sapiens
actgcgctccagcctgggtgac

SEQ ID NO: 20770 - DNA, 22 bp, Homo sapiens
gagagagctctgtgcctgggat

SEQ ID NO: 20771 - DNA, 19 bp, Homo sapiens
ccagagagctaggtacaga

SEQ ID NO: 20772 - DNA, 21 bp, Homo sapiens
ccaggccaggcctacggggat

SEQ ID NO: 20773 - DNA, 22 bp, Homo sapiens
agccagggtctctcgctctgtt

SEQ ID NO: 20774 - DNA, 23 bp, Homo sapiens
ctatttctcatagttcaggtctt

SEQ ID NO: 20775 - DNA, 22 bp, Homo sapiens
ggtgcagaggagccagctgggg

SEQ ID NO: 20776 - DNA, 22 bp, Homo sapiens
cagcctggtccccggctcaccc

SEQ ID NO: 20777 - DNA, 18 bp, Homo sapiens
tgtccctgcaaataacat

SEQ ID NO: 20778 - DNA, 22 bp, Homo sapiens
cctccctgccggctggactagt

SEQ ID NO: 20779 - DNA, 22 bp, Homo sapiens
cctacagttatattcttgattg

SEQ ID NO: 20780 - DNA, 20 bp, Homo sapiens
attagagctacatggctaca

SEQ ID NO: 20781 - DNA, 22 bp, Homo sapiens
tggagaattctatgttgagggg

SEQ ID NO: 20782 - DNA, 22 bp, Homo sapiens
ttgagggtctggatctgctgct

SEQ ID NO: 20783 - DNA, 23 bp, Homo sapiens
tcagaacagttcttggtgcatag

SEQ ID NO: 20784 - DNA, 22 bp, Homo sapiens
gggtggagagaaagaaacgtga

SEQ ID NO: 20785 - DNA, 22 bp, Homo sapiens
tttgttttcaatgtgtcattca

SEQ ID NO: 20786 - DNA, 22 bp, Homo sapiens
ttaataaagtatgaattggaaa

SEQ ID NO: 20787 - DNA, 22 bp, Homo sapiens
tccacgtgagcttcgtgtgcag

SEQ ID NO: 20788 - DNA, 22 bp, Homo sapiens
tggttcctcaagcgctggcggc

SEQ ID NO: 20789 - DNA, 21 bp, Homo sapiens
tggcggggacttgtggctgcc

SEQ ID NO: 20790 - DNA, 22 bp, Homo sapiens
ccagatatcactgccgtgttgt

SEQ ID NO: 20791 - DNA, 22 bp, Homo sapiens
ccttctcagccccagctcccgc

SEQ ID NO: 20792 - DNA, 22 bp, Homo sapiens
cagaatcaagtccaattagcac

SEQ ID NO: 20793 - DNA, 22 bp, Homo sapiens
agggtggcactggtggctctat

SEQ ID NO: 20794 - DNA, 22 bp, Homo sapiens
ggcgccgcactcggtgcagccg

SEQ ID NO: 20795 - DNA, 22 bp, Homo sapiens
ctggtctggctacccagcgaat

SEQ ID NO: 20796 - DNA, 22 bp, Homo sapiens
atttactttgctgagatccatc

SEQ ID NO: 20797 - DNA, 22 bp, Homo sapiens
tgtgtctttgttccaggtacga

SEQ ID NO: 20798 - DNA, 23 bp, Homo sapiens
gcgtccggcctctctcgctcccg

SEQ ID NO: 20799 - DNA, 22 bp, Homo sapiens
gctgcagctcgccttccggcct

SEQ ID NO: 20800 - DNA, 21 bp, Homo sapiens
tggtacaccttgcctgtcaga

SEQ ID NO: 20801 - DNA, 22 bp, Homo sapiens
gaaggagccgagctcttcccca

SEQ ID NO: 20802 - DNA, 22 bp, Homo sapiens
tttctcatggaacatcgtttag

SEQ ID NO: 20803 - DNA, 22 bp, Homo sapiens
tgggggagctcagtccagccca

SEQ ID NO: 20804 - DNA, 22 bp, Homo sapiens
ttgtctaatgagctccacttca

SEQ ID NO: 20805 - DNA, 22 bp, Homo sapiens
gatggaggagatggcagggtgc

SEQ ID NO: 20806 - DNA, 22 bp, Homo sapiens
tcgaaggaggcactcagacatg

SEQ ID NO: 20807 - DNA, 22 bp, Homo sapiens
tcgtgaggctctgcatcgcaca

SEQ ID NO: 20808 - DNA, 22 bp, Homo sapiens
tggtgggctgagtctcatcgga

SEQ ID NO: 20809 - DNA, 22 bp, Homo sapiens
cgggaaggtggaggttgcagtg

SEQ ID NO: 20810 - DNA, 22 bp, Homo sapiens
ggaagggcaaaagagatgaact

SEQ ID NO: 20811 - DNA, 22 bp, Homo sapiens
ggcctctcttgggacagctgtc

SEQ ID NO: 20812 - DNA, 22 bp, Homo sapiens
ctgtgctgggtccttcttttga

SEQ ID NO: 20813 - DNA, 22 bp, Homo sapiens
gtgtatgttctacttaatatta

SEQ ID NO: 20814 - DNA, 22 bp, Homo sapiens
caggcgctgtggctcccacctg

SEQ ID NO: 20815 - DNA, 22 bp, Homo sapiens
gagggggctagcgcagtgccca

SEQ ID NO: 20816 - DNA, 22 bp, Homo sapiens
agggagcattgtgacatatcac

SEQ ID NO: 20817 - DNA, 22 bp, Homo sapiens
ccgtggtcacctgagctccttg

SEQ ID NO: 20818 - DNA, 22 bp, Homo sapiens
tctcttgagctcagttctgatg

SEQ ID NO: 20819 - DNA, 22 bp, Homo sapiens
tcaggcaccttcctcttatctg

SEQ ID NO: 20820 - DNA, 22 bp, Homo sapiens
cctggaggcggaggttgcagtg

SEQ ID NO: 20821 - DNA, 22 bp, Homo sapiens
cgttggtctgtcccctggcacc

SEQ ID NO: 20822 - DNA, 22 bp, Homo sapiens
taggcatgcaaataaatgtgca

SEQ ID NO: 20823 - DNA, 22 bp, Homo sapiens
tgaggcaggacttgcataaagt

SEQ ID NO: 20824 - DNA, 22 bp, Homo sapiens
gcacttcaccactgtcctggtt

SEQ ID NO: 20825 - DNA, 22 bp, Homo sapiens
ggctgccttccctgagccccgg

SEQ ID NO: 20826 - DNA, 22 bp, Homo sapiens
ccctggctgataccggaaaggc

SEQ ID NO: 20827 - DNA, 22 bp, Homo sapiens
tacatttataaggcttctctgt

SEQ ID NO: 20828 - DNA, 22 bp, Homo sapiens
atcacaaaggtctcagagcaca

SEQ ID NO: 20829 - DNA, 22 bp, Homo sapiens
ccgccgtgcaggccgcgacgtg

SEQ ID NO: 20830 - DNA, 22 bp, Homo sapiens
gaggtaggtgtaggaggcctgc

SEQ ID NO: 20831 - DNA, 16 bp, Homo sapiens
ccacctgcagctctca

SEQ ID NO: 20832 - DNA, 22 bp, Homo sapiens
tccgatgcttccagggccacct

SEQ ID NO: 20833 - DNA, 22 bp, Homo sapiens
ctgtggctctcagaggctgctg

SEQ ID NO: 20834 - DNA, 22 bp, Homo sapiens
cttttcattgtttgtacatgca

SEQ ID NO: 20835 - DNA, 22 bp, Homo sapiens
ccagatgtccctctcaggtttg

SEQ ID NO: 20836 - DNA, 22 bp, Homo sapiens
gaaggaagtcattagtgcagac

SEQ ID NO: 20837 - DNA, 22 bp, Homo sapiens
tagcatgtcagtcgccacacgt

SEQ ID NO: 20838 - DNA, 22 bp, Homo sapiens
catggtgggtgtagtttccgcc

SEQ ID NO: 20839 - DNA, 22 bp, Homo sapiens
ctttggcaatgtcattttcaat

SEQ ID NO: 20840 - DNA, 22 bp, Homo sapiens
tgtggactggcgggacgcaatg

SEQ ID NO: 20841 - DNA, 22 bp, Homo sapiens
cagctggtgtcaggcactgcag

SEQ ID NO: 20842 - DNA, 22 bp, Homo sapiens
aggtgcttggctcgtgcacaca

SEQ ID NO: 20843 - DNA, 22 bp, Homo sapiens
tctgcaacagtgccctgtaaat

SEQ ID NO: 20844 - DNA, 22 bp, Homo sapiens
catggcggtcaggatgtaggtg

SEQ ID NO: 20845 - DNA, 22 bp, Homo sapiens
gaggggagcccccatcctccag

SEQ ID NO: 20846 - DNA, 22 bp, Homo sapiens
tggatgctgtaggacacgctct

SEQ ID NO: 20847 - DNA, 22 bp, Homo sapiens
gggaggcagtgctggaggctgg

SEQ ID NO: 20848 - DNA, 22 bp, Homo sapiens
cgtcctctagagggaagcactt

SEQ ID NO: 20849 - DNA, 22 bp, Homo sapiens
tccttgactgtgaggaactagc

SEQ ID NO: 20850 - DNA, 22 bp, Homo sapiens
gctgcagtgagccaagatcgtg

SEQ ID NO: 20851 - DNA, 22 bp, Homo sapiens
gggactggagtagaggccggtg

SEQ ID NO: 20852 - DNA, 22 bp, Homo sapiens
ttggagatatcacaccttcaca

SEQ ID NO: 20853 - DNA, 22 bp, Homo sapiens
gaagaaagatcaaatagtttcc

SEQ ID NO: 20854 - DNA, 23 bp, Homo sapiens
gcagaggagcaagctggacacca

SEQ ID NO: 20855 - DNA, 22 bp, Homo sapiens
gatgcgggcccgctccactgcc

SEQ ID NO: 20856 - DNA, 22 bp, Homo sapiens
ctcctctttagccccagctgga

SEQ ID NO: 20857 - DNA, 22 bp, Homo sapiens
gtgagccgagtatagttcatag

SEQ ID NO: 20858 - DNA, 22 bp, Homo sapiens
tcagggattgcaaaattcatcc

SEQ ID NO: 20859 - DNA, 22 bp, Homo sapiens
gaggaggcagcctatcccttag

SEQ ID NO: 20860 - DNA, 22 bp, Homo sapiens
ggaggcggaggttgcagtgagc

SEQ ID NO: 20861 - DNA, 22 bp, Homo sapiens
ttcagacaggcagctgggctgg

SEQ ID NO: 20862 - DNA, 22 bp, Homo sapiens
tttggactgcatgatgatctgg

SEQ ID NO: 20863 - DNA, 22 bp, Homo sapiens
ttctatttttgtggaactgtag

SEQ ID NO: 20864 - DNA, 22 bp, Homo sapiens
cactgcactccagcctgggtca

SEQ ID NO: 20865 - DNA, 22 bp, Homo sapiens
gtctccggccgccctggtgctg

SEQ ID NO: 20866 - DNA, 22 bp, Homo sapiens
cactgcactccagcctgggaga

SEQ ID NO: 20867 - DNA, 22 bp, Homo sapiens
tacatgctccttatgagaatct

SEQ ID NO: 20868 - DNA, 22 bp, Homo sapiens
gggaaggaaagttattagcaga

SEQ ID NO: 20869 - DNA, 23 bp, Homo sapiens
ggggcctgcaccggtctgcgcgg

SEQ ID NO: 20870 - DNA, 22 bp, Homo sapiens
cctcacctcagtctgggcctca

SEQ ID NO: 20871 - DNA, 17 bp, Homo sapiens
tccttcagtgcctctgc

SEQ ID NO: 20872 - DNA, 22 bp, Homo sapiens
cattgcactccagtctgggcca

SEQ ID NO: 20873 - DNA, 22 bp, Homo sapiens
tttcctcttctggcaggcaggg

SEQ ID NO: 20874 - DNA, 22 bp, Homo sapiens
gccgccgctgtgcaatttagca

SEQ ID NO: 20875 - DNA, 22 bp, Homo sapiens
catataaatacaacatgtgtta

SEQ ID NO: 20876 - DNA, 22 bp, Homo sapiens
gcggcggagacagcaggaagcc

SEQ ID NO: 20877 - DNA, 22 bp, Homo sapiens
cctctgtgtctccaagaggcct

SEQ ID NO: 20878 - DNA, 21 bp, Homo sapiens
ggccccgcagacccagcacgt

SEQ ID NO: 20879 - DNA, 22 bp, Homo sapiens
ctctccattccctacagttttc

SEQ ID NO: 20880 - DNA, 22 bp, Homo sapiens
actttcttggtcccatgtttga

SEQ ID NO: 20881 - DNA, 22 bp, Homo sapiens
caaggtgccatgctgggcgggg

SEQ ID NO: 20882 - DNA, 22 bp, Homo sapiens
cttgcctacttgtcaaccagca

SEQ ID NO: 20883 - DNA, 22 bp, Homo sapiens
cagctggttgaagaggagctgg

SEQ ID NO: 20884 - DNA, 22 bp, Homo sapiens
gggaggaggaatgttttgtgta

SEQ ID NO: 20885 - DNA, 22 bp, Homo sapiens
gctctgccagcccaaggcgcag

SEQ ID NO: 20886 - DNA, 22 bp, Homo sapiens
gggctagcctcttccctgctcc

SEQ ID NO: 20887 - DNA, 22 bp, Homo sapiens
aggaaataagggacaagacaaa

SEQ ID NO: 20888 - DNA, 22 bp, Homo sapiens
atgttatgtctgggaaggggta

SEQ ID NO: 20889 - DNA, 22 bp, Homo sapiens
ggggatggaggcgtgtggtcct

SEQ ID NO: 20890 - DNA, 22 bp, Homo sapiens
acccaggctggagtgcagtggg

SEQ ID NO: 20891 - DNA, 22 bp, Homo sapiens
cattgcactccagcctgggtga

SEQ ID NO: 20892 - DNA, 22 bp, Homo sapiens
ttttaagttggattgctaagta

SEQ ID NO: 20893 - DNA, 22 bp, Homo sapiens
aaaagcaattgcagttcttgcc

SEQ ID NO: 20894 - DNA, 22 bp, Homo sapiens
ttgtgggatctccctgttgctc

SEQ ID NO: 20895 - DNA, 22 bp, Homo sapiens
ttcttcagcctaccttgacctc

SEQ ID NO: 20896 - DNA, 22 bp, Homo sapiens
aagtcattggtagcttgatagg

SEQ ID NO: 20897 - DNA, 22 bp, Homo sapiens
gaacgggtgcagccatgggccc

SEQ ID NO: 20898 - DNA, 22 bp, Homo sapiens
caccaagaatcttcacttttta

SEQ ID NO: 20899 - DNA, 22 bp, Homo sapiens
agctggtgtgccagttccagtt

SEQ ID NO: 20900 - DNA, 22 bp, Homo sapiens
ccaggaggtggaggttgcggtg

SEQ ID NO: 20901 - DNA, 22 bp, Homo sapiens
aaggggtgagcagaggcttcgc

SEQ ID NO: 20902 - DNA, 22 bp, Homo sapiens
gaggttggggctgcagtgagct

SEQ ID NO: 20903 - DNA, 22 bp, Homo sapiens
aatcacttagaacccaggaagt

SEQ ID NO: 20904 - DNA, 22 bp, Homo sapiens
ctgcttctccctgagatagtgt

SEQ ID NO: 20905 - DNA, 22 bp, Homo sapiens
taaatgttgtaagtacatctaa

SEQ ID NO: 20906 - DNA, 22 bp, Homo sapiens
tagctgggactactggccctgc

SEQ ID NO: 20907 - DNA, 22 bp, Homo sapiens
tgtattctaaatacatcttacc

SEQ ID NO: 20908 - DNA, 22 bp, Homo sapiens
ggggaccctcaggactgcgtct

SEQ ID NO: 20909 - DNA, 22 bp, Homo sapiens
aaattctgatttaataagtgta

SEQ ID NO: 20910 - DNA, 22 bp, Homo sapiens
tcaggggcttgaggtgcatgtc

SEQ ID NO: 20911 - DNA, 21 bp, Homo sapiens
tgctccaggagggggcagtcc

SEQ ID NO: 20912 - DNA, 22 bp, Homo sapiens
ctcttcctagtgtgcagcgtgg

SEQ ID NO: 20913 - DNA, 20 bp, Homo sapiens
agcggctggcggaggacacg

SEQ ID NO: 20914 - DNA, 22 bp, Homo sapiens
taattataacagttacatctta

SEQ ID NO: 20915 - DNA, 22 bp, Homo sapiens
tttgtgaataggttggcttcca

SEQ ID NO: 20916 - DNA, 22 bp, Homo sapiens
gatgaaggggctggtgccctct

SEQ ID NO: 20917 - DNA, 20 bp, Homo sapiens
tcactgtaacatttgggggg

SEQ ID NO: 20918 - DNA, 22 bp, Homo sapiens
agctggggctgtggttgtgatt

SEQ ID NO: 20919 - DNA, 22 bp, Homo sapiens
atccaccctgtggtggctttct

SEQ ID NO: 20920 - DNA, 22 bp, Homo sapiens
ccaggcaggcgatggtgcagtg

SEQ ID NO: 20921 - DNA, 20 bp, Homo sapiens
cctgtcatcccagcattttg

SEQ ID NO: 20922 - DNA, 22 bp, Homo sapiens
ctgggcgcgtcccctgaggcgg

SEQ ID NO: 20923 - DNA, 22 bp, Homo sapiens
aagtaaatatctgtagtcttta

SEQ ID NO: 20924 - DNA, 16 bp, Homo sapiens
gcagaggaaaggggag

SEQ ID NO: 20925 - DNA, 22 bp, Homo sapiens
tccccagcttgctacttctgct

SEQ ID NO: 20926 - DNA, 22 bp, Homo sapiens
ggctgggctccgggagcatgcg

SEQ ID NO: 20927 - DNA, 22 bp, Homo sapiens
gagggagggactagcattctct

SEQ ID NO: 20928 - DNA, 22 bp, Homo sapiens
gcaggtggatcaccacgtcagg

SEQ ID NO: 20929 - DNA, 22 bp, Homo sapiens
caggaaagggatgggctgccac

SEQ ID NO: 20930 - DNA, 22 bp, Homo sapiens
tgagtggacacctgcttcttta

SEQ ID NO: 20931 - DNA, 22 bp, Homo sapiens
aactcaaagatgcatgacgctt

SEQ ID NO: 20932 - DNA, 22 bp, Homo sapiens
ggcatagatttctttaggttta

SEQ ID NO: 20933 - DNA, 22 bp, Homo sapiens
acgttttctagagaatatgcag

SEQ ID NO: 20934 - DNA, 22 bp, Homo sapiens
cttcagctgcagttatgtttag

SEQ ID NO: 20935 - DNA, 22 bp, Homo sapiens
cagatgtacatgaagggcaatg

SEQ ID NO: 20936 - DNA, 22 bp, Homo sapiens
aagcgccatggttcctgcgcag

SEQ ID NO: 20937 - DNA, 22 bp, Homo sapiens
tgggaagggtcaacagctggaa

SEQ ID NO: 20938 - DNA, 22 bp, Homo sapiens
tgatttatgcattatactgttg

SEQ ID NO: 20939 - DNA, 22 bp, Homo sapiens
acaggcttacaggctgcaagta

SEQ ID NO: 20940 - DNA, 22 bp, Homo sapiens
ccaggctggagtgcagtggcac

SEQ ID NO: 20941 - DNA, 22 bp, Homo sapiens
gtggtgagattgctggatcaaa

SEQ ID NO: 20942 - DNA, 22 bp, Homo sapiens
gccctgggcaaggttctggcca

SEQ ID NO: 20943 - DNA, 22 bp, Homo sapiens
atctggttcttcttaggcatca

SEQ ID NO: 20944 - DNA, 22 bp, Homo sapiens
gctgatagactgaatgttggga

SEQ ID NO: 20945 - DNA, 18 bp, Homo sapiens
cttttcccctttggactc

SEQ ID NO: 20946 - DNA, 21 bp, Homo sapiens
tactgtagccttgcactgtag

SEQ ID NO: 20947 - DNA, 22 bp, Homo sapiens
ccaggcagcctgctccattctg

SEQ ID NO: 20948 - DNA, 22 bp, Homo sapiens
caggaaggggctcactctggcc

SEQ ID NO: 20949 - DNA, 22 bp, Homo sapiens
gcgaggaggggtgctgggcccc

SEQ ID NO: 20950 - DNA, 22 bp, Homo sapiens
ttgtgctgactgcgcccagctc

SEQ ID NO: 20951 - DNA, 22 bp, Homo sapiens
acatcctcccgatctactggct

SEQ ID NO: 20952 - DNA, 23 bp, Homo sapiens
acagcaagaggaccagatgtgag

SEQ ID NO: 20953 - DNA, 19 bp, Homo sapiens
acccagcccaggagtggca

SEQ ID NO: 20954 - DNA, 22 bp, Homo sapiens
cacagggcttctcatggggtgc

SEQ ID NO: 20955 - DNA, 23 bp, Homo sapiens
gttttacaggtgagaaaatggag

SEQ ID NO: 20956 - DNA, 22 bp, Homo sapiens
cactgcaagctctgccacctgg

SEQ ID NO: 20957 - DNA, 22 bp, Homo sapiens
atgtgagctggggcccggccag

SEQ ID NO: 20958 - DNA, 22 bp, Homo sapiens
gctggaggatggactggaagaa

SEQ ID NO: 20959 - DNA, 22 bp, Homo sapiens
gtggggtagatctttctcagga

SEQ ID NO: 20960 - DNA, 22 bp, Homo sapiens
ggaggcccagaaggaagcccag

SEQ ID NO: 20961 - DNA, 22 bp, Homo sapiens
aaatgcctcattttctctcact

SEQ ID NO: 20962 - DNA, 22 bp, Homo sapiens
ggcaaaaagttcccatcagtgt

SEQ ID NO: 20963 - DNA, 22 bp, Homo sapiens
tgcagcactgttcacaatagcc

SEQ ID NO: 20964 - DNA, 22 bp, Homo sapiens
agctcctgaaaatccagactgg

SEQ ID NO: 20965 - DNA, 22 bp, Homo sapiens
tttgtagattttctctccagta

SEQ ID NO: 20966 - DNA, 22 bp, Homo sapiens
aggtctgtttaacaaagtcagg

SEQ ID NO: 20967 - DNA, 22 bp, Homo sapiens
tctagctctgcttatcatggct

SEQ ID NO: 20968 - DNA, 22 bp, Homo sapiens
taaatgttttgtgggttgagtt

SEQ ID NO: 20969 - DNA, 22 bp, Homo sapiens
tgtaagtagtaatggaaggaca

SEQ ID NO: 20970 - DNA, 22 bp, Homo sapiens
gctgcagggagctggaaggctc

SEQ ID NO: 20971 - DNA, 22 bp, Homo sapiens
tttaaaaaactagtctgagtct

SEQ ID NO: 20972 - DNA, 22 bp, Homo sapiens
cctccagagggaagtactttct

SEQ ID NO: 20973 - DNA, 22 bp, Homo sapiens
ctctctgggcccagttggcacc

SEQ ID NO: 20974 - DNA, 22 bp, Homo sapiens
ggcttggcaggtgccctgcgca

SEQ ID NO: 20975 - DNA, 21 bp, Homo sapiens
acatggactgtgaatggggac

SEQ ID NO: 20976 - DNA, 22 bp, Homo sapiens
atgtacataaaatgtataatga

SEQ ID NO: 20977 - DNA, 22 bp, Homo sapiens
tttcactcagctctcattgtct

SEQ ID NO: 20978 - DNA, 22 bp, Homo sapiens
aatgtgaggccttggtagttat

SEQ ID NO: 20979 - DNA, 22 bp, Homo sapiens
tctgcaacattcctctccccac

SEQ ID NO: 20980 - DNA, 22 bp, Homo sapiens
ccaggctggagtgcaatggcgt

SEQ ID NO: 20981 - DNA, 22 bp, Homo sapiens
ttcagacatgcaggctgaggct

SEQ ID NO: 20982 - DNA, 22 bp, Homo sapiens
ccagagctgattcctgggactt

SEQ ID NO: 20983 - DNA, 22 bp, Homo sapiens
cagccagtgtgaccgaggagga

SEQ ID NO: 20984 - DNA, 22 bp, Homo sapiens
tgggctttgagctcggtcacct

SEQ ID NO: 20985 - DNA, 22 bp, Homo sapiens
ccaggaggtggagattgcagtg

SEQ ID NO: 20986 - DNA, 22 bp, Homo sapiens
gatttctctgcacccactcagg

SEQ ID NO: 20987 - DNA, 22 bp, Homo sapiens
ctgatagacaatcaccatggga

SEQ ID NO: 20988 - DNA, 22 bp, Homo sapiens
gccaggttgctgacgacgatct

SEQ ID NO: 20989 - DNA, 22 bp, Homo sapiens
ggctgggcctctccctcagctg

SEQ ID NO: 20990 - DNA, 22 bp, Homo sapiens
caattctgaggcctgctttgtt

SEQ ID NO: 20991 - DNA, 22 bp, Homo sapiens
atccatttgacataatttcagc

SEQ ID NO: 20992 - DNA, 22 bp, Homo sapiens
tcacccaggctggagtgcagtg

SEQ ID NO: 20993 - DNA, 22 bp, Homo sapiens
tctcccaggcaggagtgcagtg

SEQ ID NO: 20994 - DNA, 22 bp, Homo sapiens
ggccggggcctgctcgcctgtg

SEQ ID NO: 20995 - DNA, 22 bp, Homo sapiens
agccacacagcttaatgacaga

SEQ ID NO: 20996 - DNA, 22 bp, Homo sapiens
aactctatttaccctactaaac

SEQ ID NO: 20997 - DNA, 22 bp, Homo sapiens
tccctagtcgcatctgtggaga

SEQ ID NO: 20998 - DNA, 22 bp, Homo sapiens
tatttcttttcgtgacttattg

SEQ ID NO: 20999 - DNA, 22 bp, Homo sapiens
gtaatagtctcaaactcctgga

SEQ ID NO: 21000 - DNA, 22 bp, Homo sapiens
agaagtatcaggaagattctca

SEQ ID NO: 21001 - DNA, 22 bp, Homo sapiens
aaggtagggatgtattcagctt

SEQ ID NO: 21002 - DNA, 22 bp, Homo sapiens
ttggatccatctcaggcatagg

SEQ ID NO: 21003 - DNA, 22 bp, Homo sapiens
ttttctgtttgcttcaagacat

SEQ ID NO: 21004 - DNA, 18 bp, Homo sapiens
agtgtcagctgcagctca

SEQ ID NO: 21005 - DNA, 22 bp, Homo sapiens
tgggcccgcagctgctgctcca

SEQ ID NO: 21006 - DNA, 17 bp, Homo sapiens
caggtgacctggtgatg

SEQ ID NO: 21007 - DNA, 21 bp, Homo sapiens
gcccacagtgaggaggatccc

SEQ ID NO: 21008 - DNA, 22 bp, Homo sapiens
tttaagaagttatgttataaat

SEQ ID NO: 21009 - DNA, 22 bp, Homo sapiens
acacttggagcaacacttatgg

SEQ ID NO: 21010 - DNA, 22 bp, Homo sapiens
cactgcactccagcttgggtga

SEQ ID NO: 21011 - DNA, 22 bp, Homo sapiens
cggagcgctgggggactctgca

SEQ ID NO: 21012 - DNA, 22 bp, Homo sapiens
ggaaggggtgggtgagcctcag

SEQ ID NO: 21013 - DNA, 22 bp, Homo sapiens
agaggcaggaggttgacttgag

SEQ ID NO: 21014 - DNA, 22 bp, Homo sapiens
tagtggatgggtaaagtatttt

SEQ ID NO: 21015 - DNA, 22 bp, Homo sapiens
gggctgggattgcttgctgtga

SEQ ID NO: 21016 - DNA, 22 bp, Homo sapiens
ctgcagggagaggggacagcct

SEQ ID NO: 21017 - DNA, 22 bp, Homo sapiens
tccaggtgggctgcacccaggc

SEQ ID NO: 21018 - DNA, 22 bp, Homo sapiens
ctgaaggatgtgtggtgggagt

SEQ ID NO: 21019 - DNA, 22 bp, Homo sapiens
aaagtgctcggattacaggtat

SEQ ID NO: 21020 - DNA, 22 bp, Homo sapiens
aacccaggagacaggttgcagt

SEQ ID NO: 21021 - DNA, 22 bp, Homo sapiens
ccgggcgggggctctcgtcacc

SEQ ID NO: 21022 - DNA, 22 bp, Homo sapiens
tagaggccgaatgctgagctgg

SEQ ID NO: 21023 - DNA, 22 bp, Homo sapiens
tgctcattggcgatctgaggga

SEQ ID NO: 21024 - DNA, 22 bp, Homo sapiens
tggagataggctgaggcagggc

SEQ ID NO: 21025 - DNA, 22 bp, Homo sapiens
caggaaggcgcggctgtgcctg

SEQ ID NO: 21026 - DNA, 22 bp, Homo sapiens
ggctagggatctagaccaggac

SEQ ID NO: 21027 - DNA, 20 bp, Homo sapiens
aggggcacctgcgacggggc

SEQ ID NO: 21028 - DNA, 22 bp, Homo sapiens
atgtgctgagtgtgtatataca

SEQ ID NO: 21029 - DNA, 22 bp, Homo sapiens
tgagagcctgtgttcaaatgcc

SEQ ID NO: 21030 - DNA, 22 bp, Homo sapiens
caggctggagtacaattgtgtg

SEQ ID NO: 21031 - DNA, 22 bp, Homo sapiens
caagaggattattaataaataa

SEQ ID NO: 21032 - DNA, 22 bp, Homo sapiens
ctctgtagaaagagcccaggtg

SEQ ID NO: 21033 - DNA, 22 bp, Homo sapiens
atgtttcaataatgctgtgagt

SEQ ID NO: 21034 - DNA, 22 bp, Homo sapiens
attgaaaataaggccagaaaca

SEQ ID NO: 21035 - DNA, 22 bp, Homo sapiens
ggagaggcttccagagtcgtgc

SEQ ID NO: 21036 - DNA, 22 bp, Homo sapiens
ggccagcctggggctcccagac

SEQ ID NO: 21037 - DNA, 22 bp, Homo sapiens
ctcagagtcccttccctcgtgg

SEQ ID NO: 21038 - DNA, 22 bp, Homo sapiens
tggggtcccaactctgattgat

SEQ ID NO: 21039 - DNA, 22 bp, Homo sapiens
atgttggccaggctggtcttga

SEQ ID NO: 21040 - DNA, 22 bp, Homo sapiens
cagagcccctcgtctccaccac

SEQ ID NO: 21041 - DNA, 22 bp, Homo sapiens
aaaggtcaaaatcgtgacattg

SEQ ID NO: 21042 - DNA, 18 bp, Homo sapiens
tctggaacaacttcatgt

SEQ ID NO: 21043 - DNA, 23 bp, Homo sapiens
atgtttgcagtaacccatcctgg

SEQ ID NO: 21044 - DNA, 22 bp, Homo sapiens
gggagctgagctggaagagaat

SEQ ID NO: 21045 - DNA, 22 bp, Homo sapiens
gctgtggcctggcgcagagctg

SEQ ID NO: 21046 - DNA, 22 bp, Homo sapiens
aaaaatcacttttataggcagc

SEQ ID NO: 21047 - DNA, 22 bp, Homo sapiens
atgaaaacggaccagagctatt

SEQ ID NO: 21048 - DNA, 22 bp, Homo sapiens
aaagtgctggtattacaggtgt

SEQ ID NO: 21049 - DNA, 20 bp, Homo sapiens
gggcagagccagccagtccc

SEQ ID NO: 21050 - DNA, 19 bp, Homo sapiens
tctcaattctccccactgc

SEQ ID NO: 21051 - DNA, 22 bp, Homo sapiens
gccctgccctctcggcactcgc

SEQ ID NO: 21052 - DNA, 22 bp, Homo sapiens
aggatcctgcgctttgggggag

SEQ ID NO: 21053 - DNA, 22 bp, Homo sapiens
cgaggaggaaacgcggagaact

SEQ ID NO: 21054 - DNA, 22 bp, Homo sapiens
aggggaggtgtccccaaatctc

SEQ ID NO: 21055 - DNA, 22 bp, Homo sapiens
atcacagttttaccatttggta

SEQ ID NO: 21056 - DNA, 22 bp, Homo sapiens
atttcagcagcccatgtttgga

SEQ ID NO: 21057 - DNA, 22 bp, Homo sapiens
aacagactccattacctggctt

SEQ ID NO: 21058 - DNA, 22 bp, Homo sapiens
tcacagacccttgctgagctct

SEQ ID NO: 21059 - DNA, 22 bp, Homo sapiens
ttgaggcaggtccgggtccttc

SEQ ID NO: 21060 - DNA, 20 bp, Homo sapiens
ggcagagggcctgggagaag

SEQ ID NO: 21061 - DNA, 22 bp, Homo sapiens
tagcacagcttcttgatgtcac

SEQ ID NO: 21062 - DNA, 22 bp, Homo sapiens
ggcgccagcactgcagcgcctc

SEQ ID NO: 21063 - DNA, 22 bp, Homo sapiens
tccacttccacgtgtgcagaat

SEQ ID NO: 21064 - DNA, 22 bp, Homo sapiens
aaatggaagctatttatgattc

SEQ ID NO: 21065 - DNA, 21 bp, Homo sapiens
cccagaagttccatggggggc

SEQ ID NO: 21066 - DNA, 22 bp, Homo sapiens
ggagtgcagtggcgtgagctcg

SEQ ID NO: 21067 - DNA, 22 bp, Homo sapiens
tgacaggaaacatgcagtgatt

SEQ ID NO: 21068 - DNA, 21 bp, Homo sapiens
atcagggatgggttggacacc

SEQ ID NO: 21069 - DNA, 22 bp, Homo sapiens
tacagtgcttggtatctagtaa

SEQ ID NO: 21070 - DNA, 22 bp, Homo sapiens
actgggccaggtgtgggtgagt

SEQ ID NO: 21071 - DNA, 22 bp, Homo sapiens
gcccaggctggagtgcagtggc

SEQ ID NO: 21072 - DNA, 22 bp, Homo sapiens
tccacgctgtgtgaccttgggc

SEQ ID NO: 21073 - DNA, 22 bp, Homo sapiens
tcgcaccattgcactccagcca

SEQ ID NO: 21074 - DNA, 22 bp, Homo sapiens
tctgttgcaatgtgcatggtga

SEQ ID NO: 21075 - DNA, 22 bp, Homo sapiens
ctcactgcaagctccacctctt

SEQ ID NO: 21076 - DNA, 22 bp, Homo sapiens
gggaggttgaggctgcagtgag

SEQ ID NO: 21077 - DNA, 22 bp, Homo sapiens
gaggggcacagtaaagggtccc

SEQ ID NO: 21078 - DNA, 22 bp, Homo sapiens
gggagaggttacccgagcaact

SEQ ID NO: 21079 - DNA, 22 bp, Homo sapiens
tgttgattagtgtttagactta

SEQ ID NO: 21080 - DNA, 22 bp, Homo sapiens
gggccctgggattcagagcaag

SEQ ID NO: 21081 - DNA, 22 bp, Homo sapiens
tcaacagtggcaaagaggcacg

SEQ ID NO: 21082 - DNA, 22 bp, Homo sapiens
gggagtgggtttggcctaggcc

SEQ ID NO: 21083 - DNA, 22 bp, Homo sapiens
catgagatttgggaggggccag

SEQ ID NO: 21084 - DNA, 18 bp, Homo sapiens
cccacggtgctgtagggc

SEQ ID NO: 21085 - DNA, 22 bp, Homo sapiens
actgcaacctccacctcctggg

SEQ ID NO: 21086 - DNA, 22 bp, Homo sapiens
ctgcaccctcaaactcctgggc

SEQ ID NO: 21087 - DNA, 22 bp, Homo sapiens
tcacaacgcctctgcaaatcct

SEQ ID NO: 21088 - DNA, 22 bp, Homo sapiens
agtgtgttgtaggctcaaatgg

SEQ ID NO: 21089 - DNA, 19 bp, Homo sapiens
ggagccgccgcccttcatt

SEQ ID NO: 21090 - DNA, 22 bp, Homo sapiens
atatccagcagcaggtgagtat

SEQ ID NO: 21091 - DNA, 22 bp, Homo sapiens
tctccgatcacaggttttcaat

SEQ ID NO: 21092 - DNA, 22 bp, Homo sapiens
cagctgctgttcagttttgttt

SEQ ID NO: 21093 - DNA, 19 bp, Homo sapiens
gcataaatacactattgtc

SEQ ID NO: 21094 - DNA, 22 bp, Homo sapiens
cattgcactccagcctgggcaa

SEQ ID NO: 21095 - DNA, 22 bp, Homo sapiens
gtggcatgaaagcatctgtgat

SEQ ID NO: 21096 - DNA, 22 bp, Homo sapiens
tgctgagcgcatccggcggccg

SEQ ID NO: 21097 - DNA, 22 bp, Homo sapiens
ggggtggatttcaggcggtgtc

SEQ ID NO: 21098 - DNA, 22 bp, Homo sapiens
tgtcactgcagaaattttctcc

SEQ ID NO: 21099 - DNA, 22 bp, Homo sapiens
agaagcagaaactgggcttgtg

SEQ ID NO: 21100 - DNA, 22 bp, Homo sapiens
gcggggcctgactctgacccgc

SEQ ID NO: 21101 - DNA, 21 bp, Homo sapiens
aggtgctggcgccccaggaga

SEQ ID NO: 21102 - DNA, 22 bp, Homo sapiens
cccagcaggaggaggttgcagt

SEQ ID NO: 21103 - DNA, 22 bp, Homo sapiens
gcccaggctggagtgcagtggt

SEQ ID NO: 21104 - DNA, 22 bp, Homo sapiens
agtgggccggacagcccaggcc

SEQ ID NO: 21105 - DNA, 22 bp, Homo sapiens
tggaggccagaggtactgggac

SEQ ID NO: 21106 - DNA, 22 bp, Homo sapiens
tgggcggactcgggcatggaat

SEQ ID NO: 21107 - DNA, 22 bp, Homo sapiens
tttgagatctcaatgaggacta

SEQ ID NO: 21108 - DNA, 22 bp, Homo sapiens
aggggatggagctggaaggcag

SEQ ID NO: 21109 - DNA, 22 bp, Homo sapiens
tgctgggggtagctctgcgtag

SEQ ID NO: 21110 - DNA, 22 bp, Homo sapiens
tgcagtttaaacttggcaactt

SEQ ID NO: 21111 - DNA, 21 bp, Homo sapiens
ggcctcccggaccgcagcgcc

SEQ ID NO: 21112 - DNA, 21 bp, Homo sapiens
gctctgtgttacaagttgggg

SEQ ID NO: 21113 - DNA, 22 bp, Homo sapiens
caggccagggttgagaagagaa

SEQ ID NO: 21114 - DNA, 22 bp, Homo sapiens
tgcgccatgtgctctcggccct

SEQ ID NO: 21115 - DNA, 22 bp, Homo sapiens
aggggtgaaagagggccctcaa

SEQ ID NO: 21116 - DNA, 22 bp, Homo sapiens
gcagcctcaaactccccagctc

SEQ ID NO: 21117 - DNA, 22 bp, Homo sapiens
tgagctgacacccaatcatact

SEQ ID NO: 21118 - DNA, 22 bp, Homo sapiens
gcgctgaggctggaggcgcacg

SEQ ID NO: 21119 - DNA, 22 bp, Homo sapiens
acaggggcaagggctcacggcc

SEQ ID NO: 21120 - DNA, 19 bp, Homo sapiens
ggcatggggtccggggacc

SEQ ID NO: 21121 - DNA, 22 bp, Homo sapiens
gtggagaggaacccagctctgt

SEQ ID NO: 21122 - DNA, 22 bp, Homo sapiens
ataaaatttgctactgttaaat

SEQ ID NO: 21123 - DNA, 22 bp, Homo sapiens
gcgggttgaagggcgcatcgaa

SEQ ID NO: 21124 - DNA, 22 bp, Homo sapiens
ccgcgaggtggaggttgcagtg

SEQ ID NO: 21125 - DNA, 22 bp, Homo sapiens
aggggctcctttgtgctgcgtc

SEQ ID NO: 21126 - DNA, 22 bp, Homo sapiens
cggctgggttcggctgcaggcc

SEQ ID NO: 21127 - DNA, 22 bp, Homo sapiens
gccaccctggacgcactgttcg

SEQ ID NO: 21128 - DNA, 19 bp, Homo sapiens
catctggatgattctcctg

SEQ ID NO: 21129 - DNA, 22 bp, Homo sapiens
cactgcactccagcctgcgcaa

SEQ ID NO: 21130 - DNA, 22 bp, Homo sapiens
caggctggagtgcagtggggcg

SEQ ID NO: 21131 - DNA, 22 bp, Homo sapiens
tgcctcagctgaggccgctcca

SEQ ID NO: 21132 - DNA, 22 bp, Homo sapiens
ctctgcctgtctcatcctgcaa

SEQ ID NO: 21133 - DNA, 22 bp, Homo sapiens
ccctggaggttgaggctgcagt

SEQ ID NO: 21134 - DNA, 22 bp, Homo sapiens
gctactgattgaccttggagag

SEQ ID NO: 21135 - DNA, 22 bp, Homo sapiens
tgcagcctggcttcgcgcctcc

SEQ ID NO: 21136 - DNA, 22 bp, Homo sapiens
gctgaggtggaggaaggagacc

SEQ ID NO: 21137 - DNA, 22 bp, Homo sapiens
gggcggggtggctcatgcctgt

SEQ ID NO: 21138 - DNA, 22 bp, Homo sapiens
agaggaagtaatcaggacctgc

SEQ ID NO: 21139 - DNA, 22 bp, Homo sapiens
cagggccagggacacgctgtca

SEQ ID NO: 21140 - DNA, 22 bp, Homo sapiens
cagtggaggccttgggaccttt

SEQ ID NO: 21141 - DNA, 22 bp, Homo sapiens
gatactcttcaggtcttgcaga

SEQ ID NO: 21142 - DNA, 22 bp, Homo sapiens
gattcactcatattttacgttt

SEQ ID NO: 21143 - DNA, 22 bp, Homo sapiens
gtagggctcagtaaatactttg

SEQ ID NO: 21144 - DNA, 22 bp, Homo sapiens
aggaggggttctcgggtgctga

SEQ ID NO: 21145 - DNA, 22 bp, Homo sapiens
agcgccactgcactccagcctg

SEQ ID NO: 21146 - DNA, 22 bp, Homo sapiens
atttggcagtataaattctggc

SEQ ID NO: 21147 - DNA, 20 bp, Homo sapiens
ctgggtggcaagcaaggggg

SEQ ID NO: 21148 - DNA, 22 bp, Homo sapiens
atacatgcgccatgttggtgtg

SEQ ID NO: 21149 - DNA, 22 bp, Homo sapiens
tgtgctctgactttctcctggt

SEQ ID NO: 21150 - DNA, 22 bp, Homo sapiens
cctcagacccctgctgagcttc

SEQ ID NO: 21151 - DNA, 22 bp, Homo sapiens
tgttaaggcagcaacggatgaa

SEQ ID NO: 21152 - DNA, 22 bp, Homo sapiens
ttctggaaggatgtttctatct

SEQ ID NO: 21153 - DNA, 22 bp, Homo sapiens
ttccccttgggctgtggaggag

SEQ ID NO: 21154 - DNA, 22 bp, Homo sapiens
tgagccaggagtttgaggctgt

SEQ ID NO: 21155 - DNA, 22 bp, Homo sapiens
atttcacttagtgtaatgtctt

SEQ ID NO: 21156 - DNA, 22 bp, Homo sapiens
tgagcaggcgcagcaggaggtc

SEQ ID NO: 21157 - DNA, 22 bp, Homo sapiens
gaatttcacaaggtgaggataa

SEQ ID NO: 21158 - DNA, 22 bp, Homo sapiens
agcccaggttgaggctgcagtg

SEQ ID NO: 21159 - DNA, 22 bp, Homo sapiens
cctggcactgctgaagtcctgg

SEQ ID NO: 21160 - DNA, 22 bp, Homo sapiens
aaagtgctgggattccaggcgt

SEQ ID NO: 21161 - DNA, 22 bp, Homo sapiens
agcccgcatctcgctaaagata

SEQ ID NO: 21162 - DNA, 22 bp, Homo sapiens
catgcctgtaatcccagcactt

SEQ ID NO: 21163 - DNA, 22 bp, Homo sapiens
acgggccttctcttcaggcgag

SEQ ID NO: 21164 - DNA, 18 bp, Homo sapiens
tttctcagactctctttc

SEQ ID NO: 21165 - DNA, 22 bp, Homo sapiens
gcggggcccggacccagcctct

SEQ ID NO: 21166 - DNA, 22 bp, Homo sapiens
gggagaagaatgtgtcaattgt

SEQ ID NO: 21167 - DNA, 22 bp, Homo sapiens
gggttcagtccctcttgctact

SEQ ID NO: 21168 - DNA, 22 bp, Homo sapiens
aggggcacgagtagagctctag

SEQ ID NO: 21169 - DNA, 22 bp, Homo sapiens
cgtctctggcccggcccctggg

SEQ ID NO: 21170 - DNA, 22 bp, Homo sapiens
gcttggccagcagccgggatgc

SEQ ID NO: 21171 - DNA, 22 bp, Homo sapiens
ctgcgggctgtcaggcgtgcca

SEQ ID NO: 21172 - DNA, 19 bp, Homo sapiens
gtaatatgtgctgagtcct

SEQ ID NO: 21173 - DNA, 22 bp, Homo sapiens
catgtgtgtctccaccagctgc

SEQ ID NO: 21174 - DNA, 18 bp, Homo sapiens
gaggatggaaggagatgc

SEQ ID NO: 21175 - DNA, 22 bp, Homo sapiens
tctctcaggctggagtgcagtg

SEQ ID NO: 21176 - DNA, 22 bp, Homo sapiens
agacagggtgatcgcttgagcc

SEQ ID NO: 21177 - DNA, 22 bp, Homo sapiens
tgagcttgcagtgccagccttg

SEQ ID NO: 21178 - DNA, 21 bp, Homo sapiens
gggcagaggggcctcctgggt

SEQ ID NO: 21179 - DNA, 22 bp, Homo sapiens
gaacccggggaggttgcagtga

SEQ ID NO: 21180 - DNA, 22 bp, Homo sapiens
ttgagcatctgaggattttcct

SEQ ID NO: 21181 - DNA, 20 bp, Homo sapiens
gaaatgtacacattaccaca

SEQ ID NO: 21182 - DNA, 22 bp, Homo sapiens
aatgttgcagagtgattgtcca

SEQ ID NO: 21183 - DNA, 23 bp, Homo sapiens
agcttttaggtggaaatggcact

SEQ ID NO: 21184 - DNA, 20 bp, Homo sapiens
aaaatatgtataactcttct

SEQ ID NO: 21185 - DNA, 22 bp, Homo sapiens
gcgggcgggggttcccaggtct

SEQ ID NO: 21186 - DNA, 22 bp, Homo sapiens
aaattgcaaaagtacttttagg

SEQ ID NO: 21187 - DNA, 22 bp, Homo sapiens
tgagatgtaaggtatgcttact

SEQ ID NO: 21188 - DNA, 22 bp, Homo sapiens
ctcacagtctgcctttcccttg

SEQ ID NO: 21189 - DNA, 22 bp, Homo sapiens
gaggcctgggcaagggggtctg

SEQ ID NO: 21190 - DNA, 22 bp, Homo sapiens
ggcagggcaggaaagtcaggaa

SEQ ID NO: 21191 - DNA, 22 bp, Homo sapiens
gcagcctgggcaacagagtgag

SEQ ID NO: 21192 - DNA, 22 bp, Homo sapiens
atggggggatgaaggagtccaa

SEQ ID NO: 21193 - DNA, 22 bp, Homo sapiens
tgctcgccccacatgccctcat

SEQ ID NO: 21194 - DNA, 19 bp, Homo sapiens
tctcacagctctactatgt

SEQ ID NO: 21195 - DNA, 22 bp, Homo sapiens
cattgcactgcagcccgggcaa

SEQ ID NO: 21196 - DNA, 22 bp, Homo sapiens
ataaaaactgacccatcctttg

SEQ ID NO: 21197 - DNA, 20 bp, Homo sapiens
tgagacccgctgacaagttc

SEQ ID NO: 21198 - DNA, 22 bp, Homo sapiens
caggaggattgcttgaggccag

SEQ ID NO: 21199 - DNA, 22 bp, Homo sapiens
ctgctaaacctctctgagagct

SEQ ID NO: 21200 - DNA, 22 bp, Homo sapiens
agaaaatttaaagagacacaca

SEQ ID NO: 21201 - DNA, 22 bp, Homo sapiens
cacccaggctggagagcagtgg

SEQ ID NO: 21202 - DNA, 22 bp, Homo sapiens
agagcagctcgctacctctcta

SEQ ID NO: 21203 - DNA, 22 bp, Homo sapiens
ctggaggtgcttcgctggccac

SEQ ID NO: 21204 - DNA, 22 bp, Homo sapiens
tgtctggatagagcctaggccc

SEQ ID NO: 21205 - DNA, 22 bp, Homo sapiens
gaggtgggcggatcacaaggtc

SEQ ID NO: 21206 - DNA, 22 bp, Homo sapiens
ggggcaggagcccttcttcagc

SEQ ID NO: 21207 - DNA, 22 bp, Homo sapiens
ttccgctgtttagttgaagttt

SEQ ID NO: 21208 - DNA, 19 bp, Homo sapiens
gagaaagcaggcacagcac

SEQ ID NO: 21209 - DNA, 22 bp, Homo sapiens
tccaaggtcagcgagagtcact

SEQ ID NO: 21210 - DNA, 22 bp, Homo sapiens
cagggggctcaaaggagagtgc

SEQ ID NO: 21211 - DNA, 22 bp, Homo sapiens
cccactgtttccctgaggctct

SEQ ID NO: 21212 - DNA, 22 bp, Homo sapiens
caggctggagtgcaatgacgcc

SEQ ID NO: 21213 - DNA, 22 bp, Homo sapiens
gttaaggatcttgagatgagga

SEQ ID NO: 21214 - DNA, 22 bp, Homo sapiens
gagcacagtaaagcagtgtcac

SEQ ID NO: 21215 - DNA, 22 bp, Homo sapiens
tgcgcggctcagtcatctccag

SEQ ID NO: 21216 - DNA, 22 bp, Homo sapiens
ttgtgagtagtgccgcaataaa

SEQ ID NO: 21217 - DNA, 19 bp, Homo sapiens
agggaatccggctgaggga

SEQ ID NO: 21218 - DNA, 22 bp, Homo sapiens
ctgtgggatcccatgactttcc

SEQ ID NO: 21219 - DNA, 22 bp, Homo sapiens
ctgggcagctgtatcagggagt

SEQ ID NO: 21220 - DNA, 23 bp, Homo sapiens
tgtgggcgcattgtaagggtagc

SEQ ID NO: 21221 - DNA, 22 bp, Homo sapiens
ggagcagggaattacagcgcag

SEQ ID NO: 21222 - DNA, 21 bp, Homo sapiens
aggcttggatctagacaggcc

SEQ ID NO: 21223 - DNA, 22 bp, Homo sapiens
tgcaatctcggcactttgggag

SEQ ID NO: 21224 - DNA, 22 bp, Homo sapiens
tttaatcaggcaaagcataata

SEQ ID NO: 21225 - DNA, 22 bp, Homo sapiens
agggctggagccacagctggga

SEQ ID NO: 21226 - DNA, 22 bp, Homo sapiens
tagtggatgttcagagatttga

SEQ ID NO: 21227 - DNA, 22 bp, Homo sapiens
cataatttctaccagggccata

SEQ ID NO: 21228 - DNA, 22 bp, Homo sapiens
aggaccatcctaaggtaggcaa

SEQ ID NO: 21229 - DNA, 22 bp, Homo sapiens
cagggccagcgtctcgggctat

SEQ ID NO: 21230 - DNA, 21 bp, Homo sapiens
cagaggcctatcacagactcc

SEQ ID NO: 21231 - DNA, 22 bp, Homo sapiens
tgggaggccaaggcaggcggat

SEQ ID NO: 21232 - DNA, 22 bp, Homo sapiens
tggtgctgccaggctcctgcca

SEQ ID NO: 21233 - DNA, 22 bp, Homo sapiens
gagggccctggctggctccagc

SEQ ID NO: 21234 - DNA, 22 bp, Homo sapiens
ttgaccactgaatggttctgaa

SEQ ID NO: 21235 - DNA, 22 bp, Homo sapiens
gcaccgccttggaccgcccgct

SEQ ID NO: 21236 - DNA, 22 bp, Homo sapiens
gtggcccaggttggagtgcagt

SEQ ID NO: 21237 - DNA, 22 bp, Homo sapiens
agtgaaaacctaatcatgcagt

SEQ ID NO: 21238 - DNA, 19 bp, Homo sapiens
caggcctcttaccctctct

SEQ ID NO: 21239 - DNA, 22 bp, Homo sapiens
ggggccttggatctgtgccccg

SEQ ID NO: 21240 - DNA, 22 bp, Homo sapiens
agtccaaagcagatgagggcca

SEQ ID NO: 21241 - DNA, 22 bp, Homo sapiens
tacagatgaggaaactgaggca

SEQ ID NO: 21242 - DNA, 22 bp, Homo sapiens
agccacacttgccaggggaagg

SEQ ID NO: 21243 - DNA, 18 bp, Homo sapiens
tcaagccattctcctgcc

SEQ ID NO: 21244 - DNA, 22 bp, Homo sapiens
tcagttacttgcttgtttgaaa

SEQ ID NO: 21245 - DNA, 22 bp, Homo sapiens
gaggagggagctggaagctctt

SEQ ID NO: 21246 - DNA, 22 bp, Homo sapiens
ggagtgcagtggtgggatctca

SEQ ID NO: 21247 - DNA, 22 bp, Homo sapiens
tcagcctgctccaagtgctgcc

SEQ ID NO: 21248 - DNA, 18 bp, Homo sapiens
ggcgggtgttttattcac

SEQ ID NO: 21249 - DNA, 22 bp, Homo sapiens
ggcagcactgcagcttgttggg

SEQ ID NO: 21250 - DNA, 22 bp, Homo sapiens
aaagtgctgggattacaggtgt

SEQ ID NO: 21251 - DNA, 22 bp, Homo sapiens
tctgtagtaggttgtagttctt

SEQ ID NO: 21252 - DNA, 22 bp, Homo sapiens
atctggttttggctgtgtccct

SEQ ID NO: 21253 - DNA, 23 bp, Homo sapiens
aatgggtgcaactatccatgaca

SEQ ID NO: 21254 - DNA, 22 bp, Homo sapiens
gttcagatttgactggtttctc

SEQ ID NO: 21255 - DNA, 22 bp, Homo sapiens
tcgcccaggctggaagtgcagt

SEQ ID NO: 21256 - DNA, 22 bp, Homo sapiens
caggagtgtctccacacagcaa

SEQ ID NO: 21257 - DNA, 22 bp, Homo sapiens
tcaggaggtccgcccgggaggg

SEQ ID NO: 21258 - DNA, 22 bp, Homo sapiens
tccttgaaaggggctgcagggc

SEQ ID NO: 21259 - DNA, 22 bp, Homo sapiens
ccagtgtatttttgggacctgc

SEQ ID NO: 21260 - DNA, 22 bp, Homo sapiens
cgggcgcactccgggcagctgt

SEQ ID NO: 21261 - DNA, 22 bp, Homo sapiens
ttgtgtgtactggttatgggca

SEQ ID NO: 21262 - DNA, 22 bp, Homo sapiens
gacctggttgactgtgagcagg

SEQ ID NO: 21263 - DNA, 22 bp, Homo sapiens
gagtggggggtccgtctcagtg

SEQ ID NO: 21264 - DNA, 22 bp, Homo sapiens
gttgaggagcaagcatgtgtct

SEQ ID NO: 21265 - DNA, 22 bp, Homo sapiens
gctccctggtagccatgctctc

SEQ ID NO: 21266 - DNA, 22 bp, Homo sapiens
agacccaggattggggctgccg

SEQ ID NO: 21267 - DNA, 22 bp, Homo sapiens
acccgatgttggtgctctagta

SEQ ID NO: 21268 - DNA, 22 bp, Homo sapiens
ttcctggaaattatgctcacct

SEQ ID NO: 21269 - DNA, 22 bp, Homo sapiens
cagctgttcattgttgccaccc

SEQ ID NO: 21270 - DNA, 22 bp, Homo sapiens
gcgaatctcagctggtgctgcg

SEQ ID NO: 21271 - DNA, 22 bp, Homo sapiens
tgtggcccgatcttgggagaca

SEQ ID NO: 21272 - DNA, 22 bp, Homo sapiens
ctgaggcaggagagttgcttga

SEQ ID NO: 21273 - DNA, 22 bp, Homo sapiens
ggagagggtaggggtcctgccc

SEQ ID NO: 21274 - DNA, 22 bp, Homo sapiens
gggaggcacgaggcgcgcagtg

SEQ ID NO: 21275 - DNA, 21 bp, Homo sapiens
ggtgctcgctgatgaggagtg

SEQ ID NO: 21276 - DNA, 22 bp, Homo sapiens
gctggccacagatccccaggga

SEQ ID NO: 21277 - DNA, 22 bp, Homo sapiens
cagagctggtgtgtcctggcat

SEQ ID NO: 21278 - DNA, 22 bp, Homo sapiens
ctgctgagccgcacccaggagc

SEQ ID NO: 21279 - DNA, 22 bp, Homo sapiens
gggcttcagttctgaccatctt

SEQ ID NO: 21280 - DNA, 22 bp, Homo sapiens
gcctggccaacgtggtgaaacc

SEQ ID NO: 21281 - DNA, 22 bp, Homo sapiens
agatttatgtggtcacactcag

SEQ ID NO: 21282 - DNA, 16 bp, Homo sapiens
aggctcagaggctgga

SEQ ID NO: 21283 - DNA, 22 bp, Homo sapiens
atgtgagctctcttctgattgg

SEQ ID NO: 21284 - DNA, 20 bp, Homo sapiens
ccaccctgtccggggcggag

SEQ ID NO: 21285 - DNA, 22 bp, Homo sapiens
atgagttgaagctacaagaggc

SEQ ID NO: 21286 - DNA, 22 bp, Homo sapiens
ttctgattgctgatgaggccca

SEQ ID NO: 21287 - DNA, 22 bp, Homo sapiens
cttcctctgtggccagagtgta

SEQ ID NO: 21288 - DNA, 22 bp, Homo sapiens
ccgcggggtcatggctgggccg

SEQ ID NO: 21289 - DNA, 20 bp, Homo sapiens
tatttctgggcaaccattta

SEQ ID NO: 21290 - DNA, 22 bp, Homo sapiens
caggcaggtcagtgaagaagga

SEQ ID NO: 21291 - DNA, 23 bp, Homo sapiens
cgcccagcctcagtgacctgggc

SEQ ID NO: 21292 - DNA, 22 bp, Homo sapiens
ttcccacagtgactccagagaa

SEQ ID NO: 21293 - DNA, 22 bp, Homo sapiens
ccgaggctggagtgcagtggcg

SEQ ID NO: 21294 - DNA, 22 bp, Homo sapiens
tacaacaatttccacattagaa

SEQ ID NO: 21295 - DNA, 22 bp, Homo sapiens
atgattgaaaatgacattgcca

SEQ ID NO: 21296 - DNA, 22 bp, Homo sapiens
tgaaatcttcactaagtctctt

SEQ ID NO: 21297 - DNA, 23 bp, Homo sapiens
agcagccagagatcctcggccct

SEQ ID NO: 21298 - DNA, 22 bp, Homo sapiens
tggggcagttaataaacattct

SEQ ID NO: 21299 - DNA, 22 bp, Homo sapiens
cctgggcctctcaaagtgctgg

SEQ ID NO: 21300 - DNA, 22 bp, Homo sapiens
actgcactccagcctgggtaac

SEQ ID NO: 21301 - DNA, 22 bp, Homo sapiens
ctgtctgcaggatagtaccctc

SEQ ID NO: 21302 - DNA, 22 bp, Homo sapiens
gctatgggatgtgctgtggatg

SEQ ID NO: 21303 - DNA, 22 bp, Homo sapiens
ctggagggtggagagaagtctc

SEQ ID NO: 21304 - DNA, 22 bp, Homo sapiens
gaggctggacgtgcatttctac

SEQ ID NO: 21305 - DNA, 19 bp, Homo sapiens
tggctctgtcgaaggcaca

SEQ ID NO: 21306 - DNA, 23 bp, Homo sapiens
aaataggagtatctggatcatga

SEQ ID NO: 21307 - DNA, 22 bp, Homo sapiens
ttgcatcagaattacttggagg

SEQ ID NO: 21308 - DNA, 20 bp, Homo sapiens
aaattactgccacacatttc

SEQ ID NO: 21309 - DNA, 22 bp, Homo sapiens
aaaactacatttgacattttgt

SEQ ID NO: 21310 - DNA, 22 bp, Homo sapiens
tgcaccctcatcagtcaaatgg

SEQ ID NO: 21311 - DNA, 22 bp, Homo sapiens
atgaaatatcttgaagaaattc

SEQ ID NO: 21312 - DNA, 22 bp, Homo sapiens
gttgctcaggcaggagtacagt

SEQ ID NO: 21313 - DNA, 22 bp, Homo sapiens
gccaggacctcagatgcagggc

SEQ ID NO: 21314 - DNA, 22 bp, Homo sapiens
agtggagcttttcctatcagag

SEQ ID NO: 21315 - DNA, 22 bp, Homo sapiens
gggtggtggccagcagtgggca

SEQ ID NO: 21316 - DNA, 21 bp, Homo sapiens
tctcttcctccgcgccgccgc

SEQ ID NO: 21317 - DNA, 22 bp, Homo sapiens
atgtggcaccgatctttagcca

SEQ ID NO: 21318 - DNA, 22 bp, Homo sapiens
gggcggggggagctggaatgaa

SEQ ID NO: 21319 - DNA, 22 bp, Homo sapiens
gtgtttgttcgtgactccaaag

SEQ ID NO: 21320 - DNA, 22 bp, Homo sapiens
tgaggcaggagaatcacatgaa

SEQ ID NO: 21321 - DNA, 22 bp, Homo sapiens
aggtggagaagagatgggcagt

SEQ ID NO: 21322 - DNA, 22 bp, Homo sapiens
tctgtgttgagaaggatcatga

SEQ ID NO: 21323 - DNA, 22 bp, Homo sapiens
tgctattgtgaacagtgccaca

SEQ ID NO: 21324 - DNA, 22 bp, Homo sapiens
tggcatgcatctgttgtcctag

SEQ ID NO: 21325 - DNA, 20 bp, Homo sapiens
atcggcttgcctggaaacaa

SEQ ID NO: 21326 - DNA, 22 bp, Homo sapiens
ggtcgctgtgtaggttcagcta

SEQ ID NO: 21327 - DNA, 22 bp, Homo sapiens
cctgtgcttggccagagaggtt

SEQ ID NO: 21328 - DNA, 22 bp, Homo sapiens
gtcatcatcaggcagatgctgc

SEQ ID NO: 21329 - DNA, 20 bp, Homo sapiens
ggtcactgtggctgcaggat

SEQ ID NO: 21330 - DNA, 22 bp, Homo sapiens
tgtctgcctgcgggccggcaca

SEQ ID NO: 21331 - DNA, 22 bp, Homo sapiens
tttgcattgcattaagtattct

SEQ ID NO: 21332 - DNA, 22 bp, Homo sapiens
acccgggaggcaggagtcatag

SEQ ID NO: 21333 - DNA, 22 bp, Homo sapiens
acgggctgggacggggaagctc

SEQ ID NO: 21334 - DNA, 22 bp, Homo sapiens
ttgtgaatagtgccgctataaa

SEQ ID NO: 21335 - DNA, 22 bp, Homo sapiens
tgaggcaggaggttgagaactg

SEQ ID NO: 21336 - DNA, 22 bp, Homo sapiens
aggcactgtgcagtcccaagca

SEQ ID NO: 21337 - DNA, 22 bp, Homo sapiens
gagacacaggcacagaagaggc

SEQ ID NO: 21338 - DNA, 22 bp, Homo sapiens
tctgcaggaagctggcggctga

SEQ ID NO: 21339 - DNA, 22 bp, Homo sapiens
caggtgttggaagggcagtggg

SEQ ID NO: 21340 - DNA, 22 bp, Homo sapiens
gattgagtctgaggatgctgca

SEQ ID NO: 21341 - DNA, 23 bp, Homo sapiens
aaacttgctatggctgaaatcat

SEQ ID NO: 21342 - DNA, 22 bp, Homo sapiens
tcccgtaggttgctgtagtcgg

SEQ ID NO: 21343 - DNA, 22 bp, Homo sapiens
ggagttgattttggatatatta

SEQ ID NO: 21344 - DNA, 22 bp, Homo sapiens
agtatgtcagagtgaaaatggt

SEQ ID NO: 21345 - DNA, 22 bp, Homo sapiens
agcctctctgttagtcactggg

SEQ ID NO: 21346 - DNA, 22 bp, Homo sapiens
aaggcaggatgggaaaagattt

SEQ ID NO: 21347 - DNA, 22 bp, Homo sapiens
agggcaaagccagtgactccca

SEQ ID NO: 21348 - DNA, 22 bp, Homo sapiens
tagcataacaggtaagagtgag

SEQ ID NO: 21349 - DNA, 22 bp, Homo sapiens
tctgtagtaggttgtagttctt

SEQ ID NO: 21350 - DNA, 22 bp, Homo sapiens
acccagggctcaagcgtaggca

SEQ ID NO: 21351 - DNA, 20 bp, Homo sapiens
tttgagaccagtctgcccaa

SEQ ID NO: 21352 - DNA, 22 bp, Homo sapiens
acagattcactgcactggccat

SEQ ID NO: 21353 - DNA, 22 bp, Homo sapiens
cactgcactccagcttgggcaa

SEQ ID NO: 21354 - DNA, 19 bp, Homo sapiens
gcataaatacactattgtc

SEQ ID NO: 21355 - DNA, 22 bp, Homo sapiens
cagctcacccatcacgtctgct

SEQ ID NO: 21356 - DNA, 22 bp, Homo sapiens
ggcagcactgcagcttgttggg

SEQ ID NO: 21357 - DNA, 22 bp, Homo sapiens
ctgtcctgccagtcctggactc

SEQ ID NO: 21358 - DNA, 22 bp, Homo sapiens
attttctctttgtatatgctag

SEQ ID NO: 21359 - DNA, 22 bp, Homo sapiens
ttcattcttttacatgtgaata

SEQ ID NO: 21360 - DNA, 22 bp, Homo sapiens
gcataaactccaaaaggcaggg

SEQ ID NO: 21361 - DNA, 22 bp, Homo sapiens
tcactacaacctccgcctcctg

SEQ ID NO: 21362 - DNA, 22 bp, Homo sapiens
tagaataatctgaggaaatgct

SEQ ID NO: 21363 - DNA, 22 bp, Homo sapiens
gctgatagactgaatgttggga

SEQ ID NO: 21364 - DNA, 22 bp, Homo sapiens
gttctgagtcctcctttgaagg

SEQ ID NO: 21365 - DNA, 22 bp, Homo sapiens
gacatagctcagagctcagcac

SEQ ID NO: 21366 - DNA, 22 bp, Homo sapiens
ttatttaatgtgatctgaagag

SEQ ID NO: 21367 - DNA, 22 bp, Homo sapiens
aggccctattcaatggggccca

SEQ ID NO: 21368 - DNA, 22 bp, Homo sapiens
ttgaataatatgcttcgttctc

SEQ ID NO: 21369 - DNA, 22 bp, Homo sapiens
accactgcccatggtgaaaact

SEQ ID NO: 21370 - DNA, 22 bp, Homo sapiens
atggcagaatatctgcatcgca

SEQ ID NO: 21371 - DNA, 22 bp, Homo sapiens
cttagagatgggttttacttag

SEQ ID NO: 21372 - DNA, 22 bp, Homo sapiens
gaccttgtgatccacccgcctt

SEQ ID NO: 21373 - DNA, 21 bp, Homo sapiens
ggtgacacgtggccccgctct

SEQ ID NO: 21374 - DNA, 22 bp, Homo sapiens
tccgaggccaaagctgtgaata

SEQ ID NO: 21375 - DNA, 22 bp, Homo sapiens
ggagctgaggacactacatttt

SEQ ID NO: 21376 - DNA, 22 bp, Homo sapiens
gcaggcagaggtggaggagaca

SEQ ID NO: 21377 - DNA, 22 bp, Homo sapiens
ctggaaggagcccgggcggatc

SEQ ID NO: 21378 - DNA, 22 bp, Homo sapiens
gggtaggcaaagcaatgacgtt

SEQ ID NO: 21379 - DNA, 22 bp, Homo sapiens
gctgcagtgagccaagatcgtg

SEQ ID NO: 21380 - DNA, 20 bp, Homo sapiens
ccagagctgatggctgcccg

SEQ ID NO: 21381 - DNA, 20 bp, Homo sapiens
aactcctagcctcaagtgat

SEQ ID NO: 21382 - DNA, 22 bp, Homo sapiens
atgatgtaaaataagttgtgag

SEQ ID NO: 21383 - DNA, 22 bp, Homo sapiens
aggctgagataggtggatcatt

SEQ ID NO: 21384 - DNA, 22 bp, Homo sapiens
tcctttgcttctgtcattctcc

SEQ ID NO: 21385 - DNA, 22 bp, Homo sapiens
ggctgccttccctgagccccgg

SEQ ID NO: 21386 - DNA, 22 bp, Homo sapiens
gtctctatcatagctgaaccct

SEQ ID NO: 21387 - DNA, 22 bp, Homo sapiens
cattgcactccagcctgggcca

SEQ ID NO: 21388 - DNA, 22 bp, Homo sapiens
cactgcactccatcctgggaaa

SEQ ID NO: 21389 - DNA, 22 bp, Homo sapiens
ttcccttaaattatggcatcta

SEQ ID NO: 21390 - DNA, 22 bp, Homo sapiens
ctgaggcaggagagttgcttga

SEQ ID NO: 21391 - DNA, 22 bp, Homo sapiens
ggggaaggaaagttattagcag

SEQ ID NO: 21392 - DNA, 18 bp, Homo sapiens
gaggatggaaggagatgc

SEQ ID NO: 21393 - DNA, 22 bp, Homo sapiens
tgtgactgaggctccaagctag

SEQ ID NO: 21394 - DNA, 22 bp, Homo sapiens
ccagtgtgcattatcatgtgtc

SEQ ID NO: 21395 - DNA, 22 bp, Homo sapiens
acagcagagcctggtacttact

SEQ ID NO: 21396 - DNA, 22 bp, Homo sapiens
tctgccttgtttgagctttgac

SEQ ID NO: 21397 - DNA, 22 bp, Homo sapiens
taactgattcctttttgaaaat

SEQ ID NO: 21398 - DNA, 22 bp, Homo sapiens
gtgtggaatggagtttttgccc

SEQ ID NO: 21399 - DNA, 22 bp, Homo sapiens
tgagccaagttcacaccattgc

SEQ ID NO: 21400 - DNA, 19 bp, Homo sapiens
actgcactttagcctgggc

SEQ ID NO: 21401 - DNA, 22 bp, Homo sapiens
tggctaggctggtgtcaagctc

SEQ ID NO: 21402 - DNA, 22 bp, Homo sapiens
ggccctgggccctctagcttgt

SEQ ID NO: 21403 - DNA, 22 bp, Homo sapiens
gaccatcctggccaacgtggta

SEQ ID NO: 21404 - DNA, 22 bp, Homo sapiens
tcttcccagaggaggtgccagc

SEQ ID NO: 21405 - DNA, 22 bp, Homo sapiens
aaatgtaagtctttgtttctta

SEQ ID NO: 21406 - DNA, 22 bp, Homo sapiens
tagactggtgaattagggggaa

SEQ ID NO: 21407 - DNA, 22 bp, Homo sapiens
agcccggcttccccggttgcta

SEQ ID NO: 21408 - DNA, 22 bp, Homo sapiens
cccttggggtggaggttgcagt

SEQ ID NO: 21409 - DNA, 22 bp, Homo sapiens
atggtcacaccactgtactcca

SEQ ID NO: 21410 - DNA, 22 bp, Homo sapiens
ttaagtaacttgtccaaatgag

SEQ ID NO: 21411 - DNA, 22 bp, Homo sapiens
gctgcctacgcttgagccctgg

SEQ ID NO: 21412 - DNA, 23 bp, Homo sapiens
cagagctggctcagagctgcctg

SEQ ID NO: 21413 - DNA, 22 bp, Homo sapiens
ctgtccatattcaaggggtagg

SEQ ID NO: 21414 - DNA, 22 bp, Homo sapiens
caattgacaatgacagtgtcaa

SEQ ID NO: 21415 - DNA, 22 bp, Homo sapiens
gtgggggctggaaatcttgcca

SEQ ID NO: 21416 - DNA, 22 bp, Homo sapiens
ctgaggagaggtggcctgtgtt

SEQ ID NO: 21417 - DNA, 22 bp, Homo sapiens
cttagtgacatgtattcttcat

SEQ ID NO: 21418 - DNA, 22 bp, Homo sapiens
tataaactcctcttgcattcct

SEQ ID NO: 21419 - DNA, 22 bp, Homo sapiens
gctcaagccttctgcccacctc

SEQ ID NO: 21420 - DNA, 22 bp, Homo sapiens
tgcaatctcggcactttgggag

SEQ ID NO: 21421 - DNA, 22 bp, Homo sapiens
acgcccggtctccatagttttt

SEQ ID NO: 21422 - DNA, 22 bp, Homo sapiens
tcaaatgaagacagttgacttg

SEQ ID NO: 21423 - DNA, 22 bp, Homo sapiens
actgcactccagcccgagcaac

SEQ ID NO: 21424 - DNA, 22 bp, Homo sapiens
agctcaccacaacctccgcctc

SEQ ID NO: 21425 - DNA, 22 bp, Homo sapiens
tgcctccctggcaagtctctcc

SEQ ID NO: 21426 - DNA, 19 bp, Homo sapiens
acccagcccaggagtggca

SEQ ID NO: 21427 - DNA, 22 bp, Homo sapiens
tcctggatggcctgcaggcggt

SEQ ID NO: 21428 - DNA, 22 bp, Homo sapiens
aaggtcatggcaaattactttt

SEQ ID NO: 21429 - DNA, 22 bp, Homo sapiens
tcaccagatctctctgtaatgg

SEQ ID NO: 21430 - DNA, 22 bp, Homo sapiens
cgggcaaggcgagactaggccc

SEQ ID NO: 21431 - DNA, 22 bp, Homo sapiens
gcccagccacagtcactttcat

SEQ ID NO: 21432 - DNA, 22 bp, Homo sapiens
ggctttgacatgctgaattaaa

SEQ ID NO: 21433 - DNA, 22 bp, Homo sapiens
atattacacacggtatcacggg

SEQ ID NO: 21434 - DNA, 22 bp, Homo sapiens
gtgcagagaggaccttggggag

SEQ ID NO: 21435 - DNA, 22 bp, Homo sapiens
tcactgaaacctccacctctcg

SEQ ID NO: 21436 - DNA, 22 bp, Homo sapiens
ccaaagtgctgagattacaggt

SEQ ID NO: 21437 - DNA, 22 bp, Homo sapiens
gccgggttcaagccattctcct

SEQ ID NO: 21438 - DNA, 22 bp, Homo sapiens
cctggaggcggaggttgcagtg

SEQ ID NO: 21439 - DNA, 22 bp, Homo sapiens
ttaattctgcctttcatgtaac

SEQ ID NO: 21440 - DNA, 22 bp, Homo sapiens
tcagaacatgtttgagtaagac

SEQ ID NO: 21441 - DNA, 22 bp, Homo sapiens
caggccctgtgctgggtgatgt

SEQ ID NO: 21442 - DNA, 22 bp, Homo sapiens
ttgcttcctctagtttcttgaa

SEQ ID NO: 21443 - DNA, 22 bp, Homo sapiens
caaagtgggtgccctgatgctc

SEQ ID NO: 21444 - DNA, 22 bp, Homo sapiens
agttgcagacgcagagatgttg

SEQ ID NO: 21445 - DNA, 21 bp, Homo sapiens
tctgccagctgaagaggtgga

SEQ ID NO: 21446 - DNA, 22 bp, Homo sapiens
tcgtgatctgtccacctcggcc

SEQ ID NO: 21447 - DNA, 22 bp, Homo sapiens
ggtcacgtgaccgcacctgcct

SEQ ID NO: 21448 - DNA, 19 bp, Homo sapiens
ggctgccttctgctcatct

SEQ ID NO: 21449 - DNA, 22 bp, Homo sapiens
tcccgtcttgctgttgtctgcg

SEQ ID NO: 21450 - DNA, 22 bp, Homo sapiens
ccaggaggtggaggttgcggtg

SEQ ID NO: 21451 - DNA, 22 bp, Homo sapiens
atatatttgagaatattcatga

SEQ ID NO: 21452 - DNA, 22 bp, Homo sapiens
gccagggttcaagctattctcc

SEQ ID NO: 21453 - DNA, 22 bp, Homo sapiens
actgcactccagcctgggtaac

SEQ ID NO: 21454 - DNA, 22 bp, Homo sapiens
actgcactccaacctgggtgac

SEQ ID NO: 21455 - DNA, 22 bp, Homo sapiens
caccaagaatcttcacttttta

SEQ ID NO: 21456 - DNA, 22 bp, Homo sapiens
actttcttggtcccatgtttga

SEQ ID NO: 21457 - DNA, 22 bp, Homo sapiens
aagcagaatagaggcccttccc

SEQ ID NO: 21458 - DNA, 22 bp, Homo sapiens
ccaggaggcggaggttgcagtg

SEQ ID NO: 21459 - DNA, 22 bp, Homo sapiens
aaacatctactgtaggctggag

SEQ ID NO: 21460 - DNA, 22 bp, Homo sapiens
gtctgtctgccaggttaggctg

SEQ ID NO: 21461 - DNA, 19 bp, Homo sapiens
accttctgggaaacattcc

SEQ ID NO: 21462 - DNA, 22 bp, Homo sapiens
aaagttctctatggtgtaaaaa

SEQ ID NO: 21463 - DNA, 22 bp, Homo sapiens
gcaggagaacaaagcaagctgc

SEQ ID NO: 21464 - DNA, 22 bp, Homo sapiens
cagcctgtagtctggtccaggt

SEQ ID NO: 21465 - DNA, 22 bp, Homo sapiens
gacggagctggttgctgcggct

SEQ ID NO: 21466 - DNA, 22 bp, Homo sapiens
cattggccttttatcctagagg

SEQ ID NO: 21467 - DNA, 22 bp, Homo sapiens
tccagtttccaatcactgcacg

SEQ ID NO: 21468 - DNA, 22 bp, Homo sapiens
tcactgcaacctccacctcctg

SEQ ID NO: 21469 - DNA, 22 bp, Homo sapiens
cacgcacgctgggtggaggcgc

SEQ ID NO: 21470 - DNA, 22 bp, Homo sapiens
ctggcccaggtggtcgttgagg

SEQ ID NO: 21471 - DNA, 22 bp, Homo sapiens
ttgatacccaagtgttatgggt

SEQ ID NO: 21472 - DNA, 22 bp, Homo sapiens
gaacactgctgttgggttctga

SEQ ID NO: 21473 - DNA, 22 bp, Homo sapiens
agcctgcgatcccacctggcct

SEQ ID NO: 21474 - DNA, 22 bp, Homo sapiens
cggaggttgaggctgcagtgag

SEQ ID NO: 21475 - DNA, 22 bp, Homo sapiens
acaattctgatggtttcccagt

SEQ ID NO: 21476 - DNA, 22 bp, Homo sapiens
ccaagcagagcagcctctctgg

SEQ ID NO: 21477 - DNA, 22 bp, Homo sapiens
tggcctcggcatccagcaagag

SEQ ID NO: 21478 - DNA, 22 bp, Homo sapiens
acatcttttactctggttcggg

SEQ ID NO: 21479 - DNA, 22 bp, Homo sapiens
agtccaaagcagatgagggcca

SEQ ID NO: 21480 - DNA, 22 bp, Homo sapiens
tgaggcaggacttgcataaagt

SEQ ID NO: 21481 - DNA, 22 bp, Homo sapiens
gtggctcacacctgtaatccca

SEQ ID NO: 21482 - DNA, 22 bp, Homo sapiens
cttagatgaagtcacagaaccc

SEQ ID NO: 21483 - DNA, 22 bp, Homo sapiens
atacagggacatccagtttttc

SEQ ID NO: 21484 - DNA, 19 bp, Homo sapiens
gggcaaagtgatcgtcctg

SEQ ID NO: 21485 - DNA, 22 bp, Homo sapiens
cctggaaagagaatgaatgagc

SEQ ID NO: 21486 - DNA, 22 bp, Homo sapiens
tcaccaggctagagtgcagtgg

SEQ ID NO: 21487 - DNA, 22 bp, Homo sapiens
aagcgccatggttcctgcgcag

SEQ ID NO: 21488 - DNA, 22 bp, Homo sapiens
aattgaaaatattgtagaccat

SEQ ID NO: 21489 - DNA, 22 bp, Homo sapiens
tggttgtggtcctccacatcgc

SEQ ID NO: 21490 - DNA, 22 bp, Homo sapiens
tgccatagcaatggtaagctga

SEQ ID NO: 21491 - DNA, 22 bp, Homo sapiens
ggaggagacagtaaaaagcacg

SEQ ID NO: 21492 - DNA, 22 bp, Homo sapiens
gggccctgcgactcgcggcgga

SEQ ID NO: 21493 - DNA, 22 bp, Homo sapiens
atgctatgtaactggcagatag

SEQ ID NO: 21494 - DNA, 22 bp, Homo sapiens
ggaggaggggtgactgaatgct

SEQ ID NO: 21495 - DNA, 21 bp, Homo sapiens
tgtaagtttcatctgaattgg

SEQ ID NO: 21496 - DNA, 22 bp, Homo sapiens
cttcagctgcagttatgtttag

SEQ ID NO: 21497 - DNA, 16 bp, Homo sapiens
atgctgctattagagg

SEQ ID NO: 21498 - DNA, 22 bp, Homo sapiens
aggagggagcttaagccaggca

SEQ ID NO: 21499 - DNA, 22 bp, Homo sapiens
tggtgctgccaggctcctgcca

SEQ ID NO: 21500 - DNA, 22 bp, Homo sapiens
taattagtgtccagcttctgct

SEQ ID NO: 21501 - DNA, 22 bp, Homo sapiens
cagccctcctaccctgccaggc

SEQ ID NO: 21502 - DNA, 22 bp, Homo sapiens
gtgggacaggtcaaatcttaaa

SEQ ID NO: 21503 - DNA, 19 bp, Homo sapiens
tctgaagaattagagagca

SEQ ID NO: 21504 - DNA, 22 bp, Homo sapiens
gggcggatcatttgaggtcagg

SEQ ID NO: 21505 - DNA, 22 bp, Homo sapiens
ggaggcagaatagagtgtgggt

SEQ ID NO: 21506 - DNA, 22 bp, Homo sapiens
ttatagcagcatgatttacaat

SEQ ID NO: 21507 - DNA, 22 bp, Homo sapiens
ttttaatactgctattgtagga

SEQ ID NO: 21508 - DNA, 22 bp, Homo sapiens
tgaaggggttcagcatgggggt

SEQ ID NO: 21509 - DNA, 19 bp, Homo sapiens
tttgatagggcataatata

SEQ ID NO: 21510 - DNA, 22 bp, Homo sapiens
atgttatgtctgggaaggggta

SEQ ID NO: 21511 - DNA, 19 bp, Homo sapiens
ctctggagtcattgctccc

SEQ ID NO: 21512 - DNA, 22 bp, Homo sapiens
cagctgcccctccagggctggg

SEQ ID NO: 21513 - DNA, 22 bp, Homo sapiens
ctgaggcaggatggcctggctg

SEQ ID NO: 21514 - DNA, 22 bp, Homo sapiens
attaaagctatccagtcatgaa

SEQ ID NO: 21515 - DNA, 23 bp, Homo sapiens
ccccactaccgtgatgtgcgagg

SEQ ID NO: 21516 - DNA, 22 bp, Homo sapiens
aaaagtaattgtggttttggcc

SEQ ID NO: 21517 - DNA, 19 bp, Homo sapiens
caggcctcttaccctctct

SEQ ID NO: 21518 - DNA, 22 bp, Homo sapiens
taaaggtagtgtgacatattgt

SEQ ID NO: 21519 - DNA, 22 bp, Homo sapiens
ctgagatctttatacgaggcac

SEQ ID NO: 21520 - DNA, 22 bp, Homo sapiens
gggtccctggaattacttgaca

SEQ ID NO: 21521 - DNA, 22 bp, Homo sapiens
actgcactccagcctgggtgac

SEQ ID NO: 21522 - DNA, 22 bp, Homo sapiens
cctggagagctcgggccaggca

SEQ ID NO: 21523 - DNA, 22 bp, Homo sapiens
ccaggctggagtgcagtggcac

SEQ ID NO: 21524 - DNA, 22 bp, Homo sapiens
ttcacagtggtagtgcatttag

SEQ ID NO: 21525 - DNA, 22 bp, Homo sapiens
cacccaggcaaggattctgcaa

SEQ ID NO: 21526 - DNA, 22 bp, Homo sapiens
atcatgttttaattagcaaact

SEQ ID NO: 21527 - DNA, 22 bp, Homo sapiens
agtgaccgaggcacttggcaac

SEQ ID NO: 21528 - DNA, 22 bp, Homo sapiens
ggaggacaggggctgcagcaca

SEQ ID NO: 21529 - DNA, 22 bp, Homo sapiens
ggggcaggagcccttcttcagc

SEQ ID NO: 21530 - DNA, 22 bp, Homo sapiens
aaccccgctcaggctgggtgag

SEQ ID NO: 21531 - DNA, 22 bp, Homo sapiens
tgcaccctcatcagtcaaatgg

SEQ ID NO: 21532 - DNA, 22 bp, Homo sapiens
agcattccacactgaagtctgc

SEQ ID NO: 21533 - DNA, 22 bp, Homo sapiens
gacaattgcttttgccgaataa

SEQ ID NO: 21534 - DNA, 22 bp, Homo sapiens
caaatgtataaatgtactttct

SEQ ID NO: 21535 - DNA, 22 bp, Homo sapiens
tcagtgtgaattcaggagccta

SEQ ID NO: 21536 - DNA, 22 bp, Homo sapiens
agccagtgcagctggaaattca

SEQ ID NO: 21537 - DNA, 22 bp, Homo sapiens
gaaagacatagttgcaagatgg

SEQ ID NO: 21538 - DNA, 22 bp, Homo sapiens
tggttgcctctcagagattccg

SEQ ID NO: 21539 - DNA, 22 bp, Homo sapiens
ggcgggaagttcttgcccactt

SEQ ID NO: 21540 - DNA, 22 bp, Homo sapiens
gggagctggagctggaagactc

SEQ ID NO: 21541 - DNA, 22 bp, Homo sapiens
gccaccctggacgcactgttcg

SEQ ID NO: 21542 - DNA, 22 bp, Homo sapiens
tgcactccaggctgggtgacag

SEQ ID NO: 21543 - DNA, 22 bp, Homo sapiens
cactgcactccagcctggcgac

SEQ ID NO: 21544 - DNA, 20 bp, Homo sapiens
ttgagcttttagtacagaca

SEQ ID NO: 21545 - DNA, 22 bp, Homo sapiens
cgccccggacgtctgaccaaac

SEQ ID NO: 21546 - DNA, 22 bp, Homo sapiens
tttttgggtccaggctgtatct

SEQ ID NO: 21547 - DNA, 22 bp, Homo sapiens
caggcagaagaagtggaaggac

SEQ ID NO: 21548 - DNA, 22 bp, Homo sapiens
gcccaggctggagtgcagtggc

SEQ ID NO: 21549 - DNA, 22 bp, Homo sapiens
ctctttggatagaattacaaag

SEQ ID NO: 21550 - DNA, 22 bp, Homo sapiens
tcacccaggctggagtgcagtg

SEQ ID NO: 21551 - DNA, 22 bp, Homo sapiens
gtggctcacgtctgtcatctca

SEQ ID NO: 21552 - DNA, 22 bp, Homo sapiens
agaaaatgtgaacttgtgaatt

SEQ ID NO: 21553 - DNA, 22 bp, Homo sapiens
tagcagaagttgcaaactaggg

SEQ ID NO: 21554 - DNA, 22 bp, Homo sapiens
caagtctgacctctgggtgaag

SEQ ID NO: 21555 - DNA, 22 bp, Homo sapiens
taagtcatagattaatggccac

SEQ ID NO: 21556 - DNA, 22 bp, Homo sapiens
tcccagaaacgcatatgttcat

SEQ ID NO: 21557 - DNA, 22 bp, Homo sapiens
tttagcgtagctgacagctaat

SEQ ID NO: 21558 - DNA, 22 bp, Homo sapiens
gaactttataactgtaaatgtc

SEQ ID NO: 21559 - DNA, 22 bp, Homo sapiens
actgcacttcagcctgggtgtc

SEQ ID NO: 21560 - DNA, 22 bp, Homo sapiens
aaggccctggcaggaagcagga

SEQ ID NO: 21561 - DNA, 22 bp, Homo sapiens
gacctccgtgtacacctcccag

SEQ ID NO: 21562 - DNA, 22 bp, Homo sapiens
tcaaattgtcatcttgataatg

SEQ ID NO: 21563 - DNA, 22 bp, Homo sapiens
gacccttagaatgtgatcttat

SEQ ID NO: 21564 - DNA, 22 bp, Homo sapiens
cgcccaggctggagtgcagtgg

SEQ ID NO: 21565 - DNA, 22 bp, Homo sapiens
cattgcactcctgcctgggcaa

SEQ ID NO: 21566 - DNA, 22 bp, Homo sapiens
cccaggaggcggaggttgcagt

SEQ ID NO: 21567 - DNA, 22 bp, Homo sapiens
gaaggaagtcattagtgcagac

SEQ ID NO: 21568 - DNA, 22 bp, Homo sapiens
ggaggagcatgagagggtagtg

SEQ ID NO: 21569 - DNA, 22 bp, Homo sapiens
aacagctttgtatacagtaact

SEQ ID NO: 21570 - DNA, 21 bp, Homo sapiens
cactccacttagaacagggtt

SEQ ID NO: 21571 - DNA, 22 bp, Homo sapiens
cagcctttgggtcagaagattc

SEQ ID NO: 21572 - DNA, 22 bp, Homo sapiens
ttctcaagaacatatgtagggt

SEQ ID NO: 21573 - DNA, 22 bp, Homo sapiens
attgtactacaccatagtactg

SEQ ID NO: 21574 - DNA, 22 bp, Homo sapiens
gtgcttccatctagagggtcac

SEQ ID NO: 21575 - DNA, 22 bp, Homo sapiens
gggcgcatcacctgaggtcagg

SEQ ID NO: 21576 - DNA, 22 bp, Homo sapiens
cgcaccactgaattccagcctg

SEQ ID NO: 21577 - DNA, 22 bp, Homo sapiens
tacataggtacagcctttttta

SEQ ID NO: 21578 - DNA, 20 bp, Homo sapiens
aaattactgccacacatttc

SEQ ID NO: 21579 - DNA, 22 bp, Homo sapiens
tgaggcaggtggattacaaggt

SEQ ID NO: 21580 - DNA, 22 bp, Homo sapiens
acccagccatgttcagttctct

SEQ ID NO: 21581 - DNA, 22 bp, Homo sapiens
gtggctcacgcctgtaatccca

SEQ ID NO: 21582 - DNA, 22 bp, Homo sapiens
tcttgggggactttggcatgga

SEQ ID NO: 21583 - DNA, 22 bp, Homo sapiens
gccagggtcctgaagaccaagt

SEQ ID NO: 21584 - DNA, 22 bp, Homo sapiens
cactgcactccagcctgggtga

SEQ ID NO: 21585 - DNA, 22 bp, Homo sapiens
gcagctgacatctggctgggcc

SEQ ID NO: 21586 - DNA, 22 bp, Homo sapiens
cacttcattgggaccagggctg

SEQ ID NO: 21587 - DNA, 22 bp, Homo sapiens
cttctcttcctttgtcaactga

SEQ ID NO: 21588 - DNA, 22 bp, Homo sapiens
tcagcagtgagaattaatgttg

SEQ ID NO: 21589 - DNA, 22 bp, Homo sapiens
ttgtcgggcttacgcagggcca

SEQ ID NO: 21590 - DNA, 22 bp, Homo sapiens
tgggcgacagagcaagactccg

SEQ ID NO: 21591 - DNA, 22 bp, Homo sapiens
tgaggcaggaggattgcaggat

SEQ ID NO: 21592 - DNA, 22 bp, Homo sapiens
ggcaagagggcagatggagtgc

SEQ ID NO: 21593 - DNA, 22 bp, Homo sapiens
ggccgtgctccaaagtcatcgt

SEQ ID NO: 21594 - DNA, 22 bp, Homo sapiens
cactgcactccagcactccagc

SEQ ID NO: 21595 - DNA, 22 bp, Homo sapiens
cttgccttctctggggtggcag

SEQ ID NO: 21596 - DNA, 22 bp, Homo sapiens
caatagtaaattacggaggaga

SEQ ID NO: 21597 - DNA, 22 bp, Homo sapiens
ctgcactgagcatctaacctta

SEQ ID NO: 21598 - DNA, 23 bp, Homo sapiens
agctataaaatctgtgacagcag

SEQ ID NO: 21599 - DNA, 22 bp, Homo sapiens
cagcagcagtgttctagaatct

SEQ ID NO: 21600 - DNA, 22 bp, Homo sapiens
ccaaagtgctaggattacaggt

SEQ ID NO: 21601 - DNA, 22 bp, Homo sapiens
gaaactctcgcatcctgggaac

SEQ ID NO: 21602 - DNA, 22 bp, Homo sapiens
tgtgagttattttcaggagttt

SEQ ID NO: 21603 - DNA, 22 bp, Homo sapiens
ctactggccatctgatctacaa

SEQ ID NO: 21604 - DNA, 22 bp, Homo sapiens
cggagcctgcttgttgcagctg

SEQ ID NO: 21605 - DNA, 22 bp, Homo sapiens
cccaggaggcagagatagcagt

SEQ ID NO: 21606 - DNA, 22 bp, Homo sapiens
tgccctttatttctggggcaga

SEQ ID NO: 21607 - DNA, 23 bp, Homo sapiens
gcctgggagttgcgatctgcccg

SEQ ID NO: 21608 - DNA, 22 bp, Homo sapiens
cctcgacctccccaggctcagg

SEQ ID NO: 21609 - DNA, 22 bp, Homo sapiens
agcctattccaggatgagctca

SEQ ID NO: 21610 - DNA, 22 bp, Homo sapiens
gagccaggggtcagctccgagg

SEQ ID NO: 21611 - DNA, 22 bp, Homo sapiens
agggaagaggaccagagtctct

SEQ ID NO: 21612 - DNA, 22 bp, Homo sapiens
caggagatgacagggaagaacc

SEQ ID NO: 21613 - DNA, 22 bp, Homo sapiens
ccagatgtccctctcaggtttg

SEQ ID NO: 21614 - DNA, 21 bp, Homo sapiens
ggagtttttctggaagggact

SEQ ID NO: 21615 - DNA, 21 bp, Homo sapiens
cctcaagtgcctcctgctgct

SEQ ID NO: 21616 - DNA, 18 bp, Homo sapiens
ccatcaccctaactagtg

SEQ ID NO: 21617 - DNA, 22 bp, Homo sapiens
gagcacagtaaagcagtgtcac

SEQ ID NO: 21618 - DNA, 22 bp, Homo sapiens
tttggaaatgaccccgtctaag

SEQ ID NO: 21619 - DNA, 22 bp, Homo sapiens
ggcaggaggtgagtggcgggtg

SEQ ID NO: 21620 - DNA, 22 bp, Homo sapiens
atgaggcaggagtgcagtggca

SEQ ID NO: 21621 - DNA, 22 bp, Homo sapiens
tcttaagcagagaagaagttga

SEQ ID NO: 21622 - DNA, 22 bp, Homo sapiens
tcactgcagcctctgcctcccg

SEQ ID NO: 21623 - DNA, 22 bp, Homo sapiens
gtgtggtcgaagttctcccgga

SEQ ID NO: 21624 - DNA, 22 bp, Homo sapiens
cagtgcttttaaaacaacatca

SEQ ID NO: 21625 - DNA, 22 bp, Homo sapiens
tggaacgtcgtaatgttggtta

SEQ ID NO: 21626 - DNA, 20 bp, Homo sapiens
ataaaataactgccacaaga

SEQ ID NO: 21627 - DNA, 22 bp, Homo sapiens
ttagatttacaagcactgttta

SEQ ID NO: 21628 - DNA, 22 bp, Homo sapiens
gcctccccaagcagcagggatt

SEQ ID NO: 21629 - DNA, 22 bp, Homo sapiens
accctggacatcttgtcatagc

SEQ ID NO: 21630 - DNA, 21 bp, Homo sapiens
cttccccaggctggtctgtat

SEQ ID NO: 21631 - DNA, 22 bp, Homo sapiens
tggaggccagaggtactgggac

SEQ ID NO: 21632 - DNA, 22 bp, Homo sapiens
tccagggagagccgctgctcca

SEQ ID NO: 21633 - DNA, 22 bp, Homo sapiens
ggatgttctggggttctcttgt

SEQ ID NO: 21634 - DNA, 22 bp, Homo sapiens
tgagccatgggactccaaggga

SEQ ID NO: 21635 - DNA, 22 bp, Homo sapiens
tggttaagtccagaaaggaagc

SEQ ID NO: 21636 - DNA, 21 bp, Homo sapiens
gtggttctagagaaacagaat

SEQ ID NO: 21637 - DNA, 22 bp, Homo sapiens
tcaccagacgcgtgggtctgag

SEQ ID NO: 21638 - DNA, 22 bp, Homo sapiens
tcccccaggctggagtgcagtg

SEQ ID NO: 21639 - DNA, 22 bp, Homo sapiens
cagggtttcaccatgttagcag

SEQ ID NO: 21640 - DNA, 22 bp, Homo sapiens
tcatcagggatattggcctgaa

SEQ ID NO: 21641 - DNA, 22 bp, Homo sapiens
tacatagctcctagtgatgcat

SEQ ID NO: 21642 - DNA, 22 bp, Homo sapiens
agccaggatggtctcgatcggc

SEQ ID NO: 21643 - DNA, 22 bp, Homo sapiens
cctagatgggatggcggccggg

SEQ ID NO: 21644 - DNA, 22 bp, Homo sapiens
acatttatataactcactagga

SEQ ID NO: 21645 - DNA, 22 bp, Homo sapiens
gccagggttcgaatccgtatgg

SEQ ID NO: 21646 - DNA, 22 bp, Homo sapiens
gatggtgcaggtgaagtgctgg

SEQ ID NO: 21647 - DNA, 22 bp, Homo sapiens
aagtggactaatacaaggacta

SEQ ID NO: 21648 - DNA, 22 bp, Homo sapiens
ggctcactgcaaactgtgcctc

SEQ ID NO: 21649 - DNA, 22 bp, Homo sapiens
gctcccaggatgaggagccagg

SEQ ID NO: 21650 - DNA, 22 bp, Homo sapiens
ctgctaaacctctctgagagct

SEQ ID NO: 21651 - DNA, 22 bp, Homo sapiens
attaagtgactaaagtaatgct

SEQ ID NO: 21652 - DNA, 22 bp, Homo sapiens
ctgggggtcttgaaagggagag

SEQ ID NO: 21653 - DNA, 22 bp, Homo sapiens
tttaagaagttatgttataaat

SEQ ID NO: 21654 - DNA, 22 bp, Homo sapiens
gatgcacggtcatgtcttttca

SEQ ID NO: 21655 - DNA, 18 bp, Homo sapiens
gatatggaaggccatgcc

SEQ ID NO: 21656 - DNA, 22 bp, Homo sapiens
gctaggttggggaagttctcct

SEQ ID NO: 21657 - DNA, 22 bp, Homo sapiens
ctgtctgcaggatagtaccctc

SEQ ID NO: 21658 - DNA, 22 bp, Homo sapiens
catgttggtgtgctgcacccgt

SEQ ID NO: 21659 - DNA, 19 bp, Homo sapiens
gcagacaggtccagagagg

SEQ ID NO: 21660 - DNA, 22 bp, Homo sapiens
tggctaacaaggtgaaaccccg

SEQ ID NO: 21661 - DNA, 22 bp, Homo sapiens
aaaggcttcggatcagaaggta

SEQ ID NO: 21662 - DNA, 22 bp, Homo sapiens
tagatctgatacaattcatctg

SEQ ID NO: 21663 - DNA, 22 bp, Homo sapiens
tgggagcagcctcagcttcggg

SEQ ID NO: 21664 - DNA, 23 bp, Homo sapiens
aattatctatttcaaatttagca

SEQ ID NO: 21665 - DNA, 22 bp, Homo sapiens
tcaggggcttgaggtgcatgtc

SEQ ID NO: 21666 - DNA, 22 bp, Homo sapiens
gcgagggcacgcggttgaaggc

SEQ ID NO: 21667 - DNA, 22 bp, Homo sapiens
agacagggtgatcgcttgagcc

SEQ ID NO: 21668 - DNA, 22 bp, Homo sapiens
tgtcttcaggagtaaatatcat

SEQ ID NO: 21669 - DNA, 22 bp, Homo sapiens
gggccggagctgggtcccgcgc

SEQ ID NO: 21670 - DNA, 22 bp, Homo sapiens
ctgcacatgtccctaagtgtca

SEQ ID NO: 21671 - DNA, 20 bp, Homo sapiens
ttcgctgggagtggccaggc

SEQ ID NO: 21672 - DNA, 22 bp, Homo sapiens
cacttgttggtggtgaaatcac

SEQ ID NO: 21673 - DNA, 22 bp, Homo sapiens
gccttattacctgcactttgaa

SEQ ID NO: 21674 - DNA, 22 bp, Homo sapiens
tgattttctccattgtaaattc

SEQ ID NO: 21675 - DNA, 20 bp, Homo sapiens
ctgtggaattttaccatgcg

SEQ ID NO: 21676 - DNA, 22 bp, Homo sapiens
agggtgaatctcacaactctta

SEQ ID NO: 21677 - DNA, 22 bp, Homo sapiens
acattacctggcatttgatctt

SEQ ID NO: 21678 - DNA, 22 bp, Homo sapiens
gaggcaggcagattgcttgagg

SEQ ID NO: 21679 - DNA, 22 bp, Homo sapiens
atgctattgaaaagaaataaga

SEQ ID NO: 21680 - DNA, 21 bp, Homo sapiens
ccaccaggtcttctgctcggg

SEQ ID NO: 21681 - DNA, 22 bp, Homo sapiens
ggacaagcctgtgagtgggttt

SEQ ID NO: 21682 - DNA, 22 bp, Homo sapiens
ttggaggcaatgggaaggaggc

SEQ ID NO: 21683 - DNA, 22 bp, Homo sapiens
aacttaggaaaataaggcatga

SEQ ID NO: 21684 - DNA, 19 bp, Homo sapiens
gatttaaacgtggctctat

SEQ ID NO: 21685 - DNA, 22 bp, Homo sapiens
aaaagcaattgcagttcttgcc

SEQ ID NO: 21686 - DNA, 22 bp, Homo sapiens
gcagagatctgagaaggctgcc

SEQ ID NO: 21687 - DNA, 22 bp, Homo sapiens
taagggaacagcttcaaactca

SEQ ID NO: 21688 - DNA, 22 bp, Homo sapiens
ccttgtttctctcccagataag

SEQ ID NO: 21689 - DNA, 22 bp, Homo sapiens
tgttattgtcgctgcactggga

SEQ ID NO: 21690 - DNA, 22 bp, Homo sapiens
attgtactccagcctgggtgac

SEQ ID NO: 21691 - DNA, 22 bp, Homo sapiens
gcaaagaatgcagatttgcctc

SEQ ID NO: 21692 - DNA, 22 bp, Homo sapiens
tatactctgagaaacgtgtcac

SEQ ID NO: 21693 - DNA, 22 bp, Homo sapiens
acacttggagcaacacttatgg

SEQ ID NO: 21694 - DNA, 22 bp, Homo sapiens
tacaggcatgtagcatggtgat

SEQ ID NO: 21695 - DNA, 22 bp, Homo sapiens
ctatgaccccagcatgaataag

SEQ ID NO: 21696 - DNA, 22 bp, Homo sapiens
ttctatttttgtggaactgtag

SEQ ID NO: 21697 - DNA, 22 bp, Homo sapiens
tctgccttttactagctggatg

SEQ ID NO: 21698 - DNA, 22 bp, Homo sapiens
atggccgcctgtccttcccgcc

SEQ ID NO: 21699 - DNA, 22 bp, Homo sapiens
gagggagggactagcattctct

SEQ ID NO: 21700 - DNA, 20 bp, Homo sapiens
ggcagagggcctgggagaag

SEQ ID NO: 21701 - DNA, 22 bp, Homo sapiens
tctcatttacttccacaggctg

SEQ ID NO: 21702 - DNA, 22 bp, Homo sapiens
tcttacccggcaacgtgtgtcg

SEQ ID NO: 21703 - DNA, 22 bp, Homo sapiens
atgaggcaggtggaggctgcca

SEQ ID NO: 21704 - DNA, 22 bp, Homo sapiens
ttcctttctctggactgcagcc

SEQ ID NO: 21705 - DNA, 22 bp, Homo sapiens
cctgtcacctaggtactgagca

SEQ ID NO: 21706 - DNA, 22 bp, Homo sapiens
caggagtgtctccacacagcaa

SEQ ID NO: 21707 - DNA, 20 bp, Homo sapiens
tgcctataaagggccaggta

SEQ ID NO: 21708 - DNA, 22 bp, Homo sapiens
cccacacacatttatgatagga

SEQ ID NO: 21709 - DNA, 22 bp, Homo sapiens
gagccagactgcctgaagctca

SEQ ID NO: 21710 - DNA, 22 bp, Homo sapiens
gcagagctcatgcctgcacctc

SEQ ID NO: 21711 - DNA, 22 bp, Homo sapiens
atccaccctgtggtggctttct

SEQ ID NO: 21712 - DNA, 22 bp, Homo sapiens
ccagctttatagcttcaaagga

SEQ ID NO: 21713 - DNA, 22 bp, Homo sapiens
tcactgcaacctctgcctcccg

SEQ ID NO: 21714 - DNA, 22 bp, Homo sapiens
tctcgctctgtcgcccaggctg

SEQ ID NO: 21715 - DNA, 22 bp, Homo sapiens
atcacaaaggtctcagagcaca

SEQ ID NO: 21716 - DNA, 22 bp, Homo sapiens
tttgtagcagcatgatttataa

SEQ ID NO: 21717 - DNA, 22 bp, Homo sapiens
tgtagtagcattcacgaagtgt

SEQ ID NO: 21718 - DNA, 19 bp, Homo sapiens
agggttacccgctgccacc

SEQ ID NO: 21719 - DNA, 22 bp, Homo sapiens
tctgccttctatcttttgtctg

SEQ ID NO: 21720 - DNA, 22 bp, Homo sapiens
aactatgttaataagtttcatt

SEQ ID NO: 21721 - DNA, 22 bp, Homo sapiens
aaattctgatttaataagtgta

SEQ ID NO: 21722 - DNA, 22 bp, Homo sapiens
ttcctggtctatttagaattgc

SEQ ID NO: 21723 - DNA, 22 bp, Homo sapiens
agagggcattaactctgtcttg

SEQ ID NO: 21724 - DNA, 22 bp, Homo sapiens
tggtcacctatagaggagatgt

SEQ ID NO: 21725 - DNA, 22 bp, Homo sapiens
cccattcatcctcgcttccttc

SEQ ID NO: 21726 - DNA, 22 bp, Homo sapiens
agaggccggccgagcccatggg

SEQ ID NO: 21727 - DNA, 22 bp, Homo sapiens
actggacagaggaaatatggag

SEQ ID NO: 21728 - DNA, 23 bp, Homo sapiens
aaataggagtatctggatcatga

SEQ ID NO: 21729 - DNA, 22 bp, Homo sapiens
ccaaagaaacccaagctcaggg

SEQ ID NO: 21730 - DNA, 19 bp, Homo sapiens
ttttggaaatgtgaacagc

SEQ ID NO: 21731 - DNA, 22 bp, Homo sapiens
atacaaaatatatactggagac

SEQ ID NO: 21732 - DNA, 22 bp, Homo sapiens
cattgctttgtgcatatttaaa

SEQ ID NO: 21733 - DNA, 22 bp, Homo sapiens
agttctgacctaacctttctca

SEQ ID NO: 21734 - DNA, 22 bp, Homo sapiens
tttcagaacataatgtgagcat

SEQ ID NO: 21735 - DNA, 22 bp, Homo sapiens
tcgcccagctcatctcccacaa

SEQ ID NO: 21736 - DNA, 22 bp, Homo sapiens
ggagcagggaattacagcgcag

SEQ ID NO: 21737 - DNA, 22 bp, Homo sapiens
agaccactaaaactttctctat

SEQ ID NO: 21738 - DNA, 22 bp, Homo sapiens
tgtagatattaattattccttt

SEQ ID NO: 21739 - DNA, 22 bp, Homo sapiens
gaatttaagaggatgaatctgt

SEQ ID NO: 21740 - DNA, 22 bp, Homo sapiens
aaaagtaattgtggtttttgct

SEQ ID NO: 21741 - DNA, 22 bp, Homo sapiens
agtgctgtctccttcccccggg

SEQ ID NO: 21742 - DNA, 22 bp, Homo sapiens
tcacaggtacagctaatgctac

SEQ ID NO: 21743 - DNA, 22 bp, Homo sapiens
cccaggaggcctgcctggccgg

SEQ ID NO: 21744 - DNA, 22 bp, Homo sapiens
aagaaatgtgaatattgaatag

SEQ ID NO: 21745 - DNA, 22 bp, Homo sapiens
tattgggtaaagatccagtttt

SEQ ID NO: 21746 - DNA, 22 bp, Homo sapiens
ttggaacatgccggggtccagg

SEQ ID NO: 21747 - DNA, 22 bp, Homo sapiens
acagttaataagtagtaagtca

SEQ ID NO: 21748 - DNA, 22 bp, Homo sapiens
aagcatgaatcgactcggcaac

SEQ ID NO: 21749 - DNA, 20 bp, Homo sapiens
gggcagagccagccagtccc

SEQ ID NO: 21750 - DNA, 22 bp, Homo sapiens
aacccgggaggcggaggttgtg

SEQ ID NO: 21751 - DNA, 22 bp, Homo sapiens
ctcgggtaccatgctaggcact

SEQ ID NO: 21752 - DNA, 18 bp, Homo sapiens
tggttccttgaaggggca

SEQ ID NO: 21753 - DNA, 22 bp, Homo sapiens
ggcctgcctcacagtcagcacc

SEQ ID NO: 21754 - DNA, 22 bp, Homo sapiens
cagcaggaggtgagtagcaggt

SEQ ID NO: 21755 - DNA, 22 bp, Homo sapiens
tccacaggtccggcatgaacag

SEQ ID NO: 21756 - DNA, 22 bp, Homo sapiens
ggaggtcccaggcctggcagca

SEQ ID NO: 21757 - DNA, 22 bp, Homo sapiens
tctgaggctgaatggactccgt

SEQ ID NO: 21758 - DNA, 22 bp, Homo sapiens
cactgcaccctcaaactcctgg

SEQ ID NO: 21759 - DNA, 22 bp, Homo sapiens
tttgaaatgtatcagtataggt

SEQ ID NO: 21760 - DNA, 23 bp, Homo sapiens
ctcaccaagcgccgccgctgtgt

SEQ ID NO: 21761 - DNA, 22 bp, Homo sapiens
tcagcctccgaaagtgctggga

SEQ ID NO: 21762 - DNA, 22 bp, Homo sapiens
gccaggttgctgacgacgatct

SEQ ID NO: 21763 - DNA, 22 bp, Homo sapiens
tcttgaatctaatgcagtttct

SEQ ID NO: 21764 - DNA, 22 bp, Homo sapiens
agatttatgtggtcacactcag

SEQ ID NO: 21765 - DNA, 22 bp, Homo sapiens
acatatgcgatcataggatgca

SEQ ID NO: 21766 - DNA, 22 bp, Homo sapiens
tagtaacccacacaacagtaga

SEQ ID NO: 21767 - DNA, 20 bp, Homo sapiens
gttaggaggttggacatgga

SEQ ID NO: 21768 - DNA, 22 bp, Homo sapiens
ggagttccagaccagactggcc

SEQ ID NO: 21769 - DNA, 22 bp, Homo sapiens
gaagatgttatggagagctcag

SEQ ID NO: 21770 - DNA, 22 bp, Homo sapiens
gaatgtcttcaaaactagactg

SEQ ID NO: 21771 - DNA, 22 bp, Homo sapiens
cccacaggtgtgagcttgctgg

SEQ ID NO: 21772 - DNA, 22 bp, Homo sapiens
cgtcatcacggcaagcatctcc

SEQ ID NO: 21773 - DNA, 19 bp, Homo sapiens
gcctcatttccacctcccc

SEQ ID NO: 21774 - DNA, 22 bp, Homo sapiens
aaggttcctctctccacccagc

SEQ ID NO: 21775 - DNA, 22 bp, Homo sapiens
gcatcccctgcattctgttttc

SEQ ID NO: 21776 - DNA, 22 bp, Homo sapiens
gtagtctgaacagtaattttgt

SEQ ID NO: 21777 - DNA, 22 bp, Homo sapiens
ttgtaagtcacaccagggcagg

SEQ ID NO: 21778 - DNA, 22 bp, Homo sapiens
gctgtatgtgaggccacagtga

SEQ ID NO: 21779 - DNA, 22 bp, Homo sapiens
acttttaaatgagtttcagttg

SEQ ID NO: 21780 - DNA, 22 bp, Homo sapiens
gcactgcaggtgggtggagagg

SEQ ID NO: 21781 - DNA, 22 bp, Homo sapiens
agaaaacataggagacaggaaa

SEQ ID NO: 21782 - DNA, 22 bp, Homo sapiens
agccagggacgctgcaggctac

SEQ ID NO: 21783 - DNA, 22 bp, Homo sapiens
ctgctcttgagggactgcggtc

SEQ ID NO: 21784 - DNA, 22 bp, Homo sapiens
ttctctgcctcacaggtctaag

SEQ ID NO: 21785 - DNA, 22 bp, Homo sapiens
ctgaggcctctcccactccagc

SEQ ID NO: 21786 - DNA, 21 bp, Homo sapiens
gccatttcacacagacatttg

SEQ ID NO: 21787 - DNA, 22 bp, Homo sapiens
gagcagtgtttgtggacctgga

SEQ ID NO: 21788 - DNA, 22 bp, Homo sapiens
aagtcagacagctgagctgcct

SEQ ID NO: 21789 - DNA, 22 bp, Homo sapiens
ggtgcagaggagccagctgggg

SEQ ID NO: 21790 - DNA, 22 bp, Homo sapiens
gggcaggaacaaatcaaatgat

SEQ ID NO: 21791 - DNA, 22 bp, Homo sapiens
ttgggacagctgtggtagtgag

SEQ ID NO: 21792 - DNA, 18 bp, Homo sapiens
tgtccctgcaaataacat

SEQ ID NO: 21793 - DNA, 15 bp, Homo sapiens
tggcccacccgttga

SEQ ID NO: 21794 - DNA, 22 bp, Homo sapiens
tgagataatcatgtgatttcat

SEQ ID NO: 21795 - DNA, 22 bp, Homo sapiens
gcctccagcccacgcaggcctg

SEQ ID NO: 21796 - DNA, 17 bp, Homo sapiens
gaggccaaggcaggcgg

SEQ ID NO: 21797 - DNA, 22 bp, Homo sapiens
agaggcagtatacaatccgagc

SEQ ID NO: 21798 - DNA, 20 bp, Homo sapiens
tcagccttgaatgcttgaaa

SEQ ID NO: 21799 - DNA, 22 bp, Homo sapiens
actgcactcctgcctgggtaac

SEQ ID NO: 21800 - DNA, 22 bp, Homo sapiens
gaatttcctctaaacccctgag

SEQ ID NO: 21801 - DNA, 20 bp, Homo sapiens
cagcagtggatgagagtttt

SEQ ID NO: 21802 - DNA, 22 bp, Homo sapiens
gcccaggctggagtgcagtggt

SEQ ID NO: 21803 - DNA, 22 bp, Homo sapiens
gggaggcagtgctggaggctgg

SEQ ID NO: 21804 - DNA, 22 bp, Homo sapiens
tttgaagactactgggagtgaa

SEQ ID NO: 21805 - DNA, 21 bp, Homo sapiens
agctgcctccacttctgaggc

SEQ ID NO: 21806 - DNA, 22 bp, Homo sapiens
aggtcaccatggcatgctccac

SEQ ID NO: 21807 - DNA, 22 bp, Homo sapiens
ggtgggagccaacacccttctg

SEQ ID NO: 21808 - DNA, 21 bp, Homo sapiens
gggcactgaaagggaatagca

SEQ ID NO: 21809 - DNA, 22 bp, Homo sapiens
tgctgtgaggttgagaaggaag

SEQ ID NO: 21810 - DNA, 22 bp, Homo sapiens
ccaaagtgctgggattacaggt

SEQ ID NO: 21811 - DNA, 22 bp, Homo sapiens
cttgtagaattgaaatggtctc

SEQ ID NO: 21812 - DNA, 20 bp, Homo sapiens
atgaatattttggtctttcc

SEQ ID NO: 21813 - DNA, 22 bp, Homo sapiens
aataaaatggtcagttttctca

SEQ ID NO: 21814 - DNA, 17 bp, Homo sapiens
ggctgcagtccaggagg

SEQ ID NO: 21815 - DNA, 22 bp, Homo sapiens
caggccagggttgagaagagaa

SEQ ID NO: 21816 - DNA, 22 bp, Homo sapiens
aaattagtgcaccaggttgaag

SEQ ID NO: 21817 - DNA, 22 bp, Homo sapiens
atccccctgtatctggaagaat

SEQ ID NO: 21818 - DNA, 22 bp, Homo sapiens
ttgacctatgtttcttcatctg

SEQ ID NO: 21819 - DNA, 22 bp, Homo sapiens
ggagaagcagcttcttgatgaa

SEQ ID NO: 21820 - DNA, 22 bp, Homo sapiens
atacaaaaattagccgggagta

SEQ ID NO: 21821 - DNA, 22 bp, Homo sapiens
aaaggacacacaggaggtgtct

SEQ ID NO: 21822 - DNA, 22 bp, Homo sapiens
tggaggagaccgcattttattt

SEQ ID NO: 21823 - DNA, 22 bp, Homo sapiens
ccaggctggagtgcaatggcat

SEQ ID NO: 21824 - DNA, 22 bp, Homo sapiens
aagatactttgcatgcatgaag

SEQ ID NO: 21825 - DNA, 22 bp, Homo sapiens
gagtccaagctagagccactca

SEQ ID NO: 21826 - DNA, 22 bp, Homo sapiens
tgtgagttcttagaaagtcagt

SEQ ID NO: 21827 - DNA, 22 bp, Homo sapiens
gccctagcgccagctcagcacc

SEQ ID NO: 21828 - DNA, 22 bp, Homo sapiens
tacaccattcccaggtggattt

SEQ ID NO: 21829 - DNA, 22 bp, Homo sapiens
ccaaagtgctaggattacaggc

SEQ ID NO: 21830 - DNA, 19 bp, Homo sapiens
tggttgtgcacgggttggt

SEQ ID NO: 21831 - DNA, 22 bp, Homo sapiens
cccaggatggggctgcagttat

SEQ ID NO: 21832 - DNA, 22 bp, Homo sapiens
aggtattattagcatctctatt

SEQ ID NO: 21833 - DNA, 22 bp, Homo sapiens
cacccaggttggagtgcagtgg

SEQ ID NO: 21834 - DNA, 22 bp, Homo sapiens
ggcagacctctccagccccaca

SEQ ID NO: 21835 - DNA, 22 bp, Homo sapiens
aatttaagagcatagctccaac

SEQ ID NO: 21836 - DNA, 22 bp, Homo sapiens
cagctttgccaagtaaggtctt

SEQ ID NO: 21837 - DNA, 22 bp, Homo sapiens
taacaatacccattctaattac

SEQ ID NO: 21838 - DNA, 22 bp, Homo sapiens
tcttttgtgattctttagttac

SEQ ID NO: 21839 - DNA, 22 bp, Homo sapiens
atgagttgaagctacaagaggc

SEQ ID NO: 21840 - DNA, 21 bp, Homo sapiens
gccagcggccgccctccagga

SEQ ID NO: 21841 - DNA, 22 bp, Homo sapiens
tagaaaagccccagctggaggg

SEQ ID NO: 21842 - DNA, 22 bp, Homo sapiens
tggctcatgcctgtaatcttag

SEQ ID NO: 21843 - DNA, 22 bp, Homo sapiens
cgcgaggtggaggttgcagtga

SEQ ID NO: 21844 - DNA, 17 bp, Homo sapiens
aggaggccctggcgttt

SEQ ID NO: 21845 - DNA, 22 bp, Homo sapiens
gcccagcccagaaaggttcgga

SEQ ID NO: 21846 - DNA, 22 bp, Homo sapiens
aaaatatgtataactcttctgc

SEQ ID NO: 21847 - DNA, 22 bp, Homo sapiens
ggtaccaccaattcagctgcca

SEQ ID NO: 21848 - DNA, 22 bp, Homo sapiens
gccctgttgtcggacgtcaagg

SEQ ID NO: 21849 - DNA, 22 bp, Homo sapiens
aatgctctttaacctattctga

SEQ ID NO: 21850 - DNA, 22 bp, Homo sapiens
tttctttatcatagcatctttg

SEQ ID NO: 21851 - DNA, 22 bp, Homo sapiens
cagccccatggtgtgctccagc

SEQ ID NO: 21852 - DNA, 22 bp, Homo sapiens
aagaataagaggatttagaaca

SEQ ID NO: 21853 - DNA, 22 bp, Homo sapiens
gagatcggtaaagagcatgcac

SEQ ID NO: 21854 - DNA, 22 bp, Homo sapiens
ttcctgcgcccttctcgcccgc

SEQ ID NO: 21855 - DNA, 22 bp, Homo sapiens
aggggaatgggtagactgttga

SEQ ID NO: 21856 - DNA, 22 bp, Homo sapiens
acaaacagagttgaaaaatagg

SEQ ID NO: 21857 - DNA, 22 bp, Homo sapiens
ccaggaggcggaaggtacagtg

SEQ ID NO: 21858 - DNA, 22 bp, Homo sapiens
attgtgtcctcattgaccttca

SEQ ID NO: 21859 - DNA, 22 bp, Homo sapiens
tgttgattagtgtttagactta

SEQ ID NO: 21860 - DNA, 22 bp, Homo sapiens
ggaccggtggcttcctcgggtc

SEQ ID NO: 21861 - DNA, 22 bp, Homo sapiens
tcactgcaacctccacctcccg

SEQ ID NO: 21862 - DNA, 22 bp, Homo sapiens
gttcaagaccagcctggccaac

SEQ ID NO: 21863 - DNA, 22 bp, Homo sapiens
cctgtatttaaaaatattctaa

SEQ ID NO: 21864 - DNA, 22 bp, Homo sapiens
tctcagggctcagagctcaggc

SEQ ID NO: 21865 - DNA, 22 bp, Homo sapiens
gtcccataagtagtgcaacttg

SEQ ID NO: 21866 - DNA, 22 bp, Homo sapiens
ccagagctgattcctgggactt

SEQ ID NO: 21867 - DNA, 22 bp, Homo sapiens
agggagcaaaggtttcagggtt

SEQ ID NO: 21868 - DNA, 22 bp, Homo sapiens
aggaaaacagaccaaggagctc

SEQ ID NO: 21869 - DNA, 22 bp, Homo sapiens
accctggaggtggaggtgcagt

SEQ ID NO: 21870 - DNA, 22 bp, Homo sapiens
taaagattgctcaaaactgtga

SEQ ID NO: 21871 - DNA, 22 bp, Homo sapiens
gtatcacttttgagagtgagaa

SEQ ID NO: 21872 - DNA, 22 bp, Homo sapiens
taaatacttagttttgtgtcta

SEQ ID NO: 21873 - DNA, 22 bp, Homo sapiens
tagagcaatgctctactccttg

SEQ ID NO: 21874 - DNA, 22 bp, Homo sapiens
tttatagtagcatgatttatag

SEQ ID NO: 21875 - DNA, 22 bp, Homo sapiens
aaagattaaatcaaattggtca

SEQ ID NO: 21876 - DNA, 22 bp, Homo sapiens
cgagtgtccctaccatttccta

SEQ ID NO: 21877 - DNA, 22 bp, Homo sapiens
ccaggaggtggagattgcagtg

SEQ ID NO: 21878 - DNA, 22 bp, Homo sapiens
ccaggaggcggaggttgcagcg

SEQ ID NO: 21879 - DNA, 22 bp, Homo sapiens
atgccaggaacaaacagtggtg

SEQ ID NO: 21880 - DNA, 22 bp, Homo sapiens
gaggccaaggtgggcagatcac

SEQ ID NO: 21881 - DNA, 22 bp, Homo sapiens
ccctttagcccctgcagagact

SEQ ID NO: 21882 - DNA, 22 bp, Homo sapiens
tgggaaggggagctggaaagga

SEQ ID NO: 21883 - DNA, 23 bp, Homo sapiens
tgttccagatacgccttttcctc

SEQ ID NO: 21884 - DNA, 22 bp, Homo sapiens
ggccactgctctccagcctggg

SEQ ID NO: 21885 - DNA, 22 bp, Homo sapiens
gcagggcacaaggacgcacagg

SEQ ID NO: 21886 - DNA, 22 bp, Homo sapiens
cacatttttactgccaacttaa

SEQ ID NO: 21887 - DNA, 22 bp, Homo sapiens
atcaaatacaaagggcataagg

SEQ ID NO: 21888 - DNA, 22 bp, Homo sapiens
tttctgagaaattaaacacttt

SEQ ID NO: 21889 - DNA, 22 bp, Homo sapiens
tggctgagttacgaacagagca

SEQ ID NO: 21890 - DNA, 22 bp, Homo sapiens
gggagtgggtttggcctaggcc

SEQ ID NO: 21891 - DNA, 22 bp, Homo sapiens
gaggaggcttccgggaggcacg

SEQ ID NO: 21892 - DNA, 22 bp, Homo sapiens
gagccgaggcgcacagctcggg

SEQ ID NO: 21893 - DNA, 22 bp, Homo sapiens
cccaggaggtcgaagctgcagt

SEQ ID NO: 21894 - DNA, 22 bp, Homo sapiens
gcatacatgggtgcagggacat

SEQ ID NO: 21895 - DNA, 22 bp, Homo sapiens
ttccagctaactcacatccctt

SEQ ID NO: 21896 - DNA, 20 bp, Homo sapiens
cagagccagggttttgtttt

SEQ ID NO: 21897 - DNA, 22 bp, Homo sapiens
gtctttatttgagattgtcatt

SEQ ID NO: 21898 - DNA, 20 bp, Homo sapiens
tgcagcacgggccctttcca

SEQ ID NO: 21899 - DNA, 22 bp, Homo sapiens
tgctggaggccagaagtctgag

SEQ ID NO: 21900 - DNA, 22 bp, Homo sapiens
agacggattacctgaggtcagg

SEQ ID NO: 21901 - DNA, 22 bp, Homo sapiens
cagtcaccttgaggactcagac

SEQ ID NO: 21902 - DNA, 22 bp, Homo sapiens
tggtaaggttccagatctagaa

SEQ ID NO: 21903 - DNA, 22 bp, Homo sapiens
gagatggagtctttttctgtca

SEQ ID NO: 21904 - DNA, 22 bp, Homo sapiens
actgcaacacctcctgggttca

SEQ ID NO: 21905 - DNA, 22 bp, Homo sapiens
agggaagcagcagccgcctgtc

SEQ ID NO: 21906 - DNA, 22 bp, Homo sapiens
tggagccagagcgcagcctggg

SEQ ID NO: 21907 - DNA, 22 bp, Homo sapiens
caattgtcagtgctgtttaaat

SEQ ID NO: 21908 - DNA, 22 bp, Homo sapiens
aagcagagaatctgggagcgag

SEQ ID NO: 21909 - DNA, 22 bp, Homo sapiens
aaagaaatagatggcatttaaa

SEQ ID NO: 21910 - DNA, 22 bp, Homo sapiens
ggcatggacgtctctgaggcca

SEQ ID NO: 21911 - DNA, 22 bp, Homo sapiens
ttttctaacatctagtaatttg

SEQ ID NO: 21912 - DNA, 22 bp, Homo sapiens
cacagctgtgagaagggagcct

SEQ ID NO: 21913 - DNA, 22 bp, Homo sapiens
tcaggaggcggaggttgcagtg

SEQ ID NO: 21914 - DNA, 22 bp, Homo sapiens
actgccctccagcctgggtgac

SEQ ID NO: 21915 - DNA, 22 bp, Homo sapiens
ttgtctaatgagctccacttca

SEQ ID NO: 21916 - DNA, 22 bp, Homo sapiens
atcttcccaggctggggagagg

SEQ ID NO: 21917 - DNA, 22 bp, Homo sapiens
tggtattctttctgtagatcat

SEQ ID NO: 21918 - DNA, 23 bp, Homo sapiens
aacgacagctacaggcatcccac

SEQ ID NO: 21919 - DNA, 22 bp, Homo sapiens
gcgtggcttagagtggggtacc

SEQ ID NO: 21920 - DNA, 22 bp, Homo sapiens
taacatttaaatttttcacata

SEQ ID NO: 21921 - DNA, 22 bp, Homo sapiens
ggcaaaaaccataattactttt

SEQ ID NO: 21922 - DNA, 22 bp, Homo sapiens
gtcttagatttcaccgataatg

SEQ ID NO: 21923 - DNA, 22 bp, Homo sapiens
tacagaagcttttgaaaagatg

SEQ ID NO: 21924 - DNA, 22 bp, Homo sapiens
tgcactactgtgatacacagcc

SEQ ID NO: 21925 - DNA, 22 bp, Homo sapiens
ggagaggggaacttgttgcttg

SEQ ID NO: 21926 - DNA, 22 bp, Homo sapiens
ctgcttctagcaccaagtccct

SEQ ID NO: 21927 - DNA, 21 bp, Homo sapiens
tactgtagccttgcactgtag

SEQ ID NO: 21928 - DNA, 22 bp, Homo sapiens
gcagaggacacaggagggcaag

SEQ ID NO: 21929 - DNA, 22 bp, Homo sapiens
cattgcactccagcctgggcaa

SEQ ID NO: 21930 - DNA, 22 bp, Homo sapiens
ctcacctccaggagctgctggc

SEQ ID NO: 21931 - DNA, 22 bp, Homo sapiens
gaagtattactctgaatgtatt

SEQ ID NO: 21932 - DNA, 22 bp, Homo sapiens
cgcatgagacctgccggccatc

SEQ ID NO: 21933 - DNA, 22 bp, Homo sapiens
agaggaggctctgggatcgtcc

SEQ ID NO: 21934 - DNA, 22 bp, Homo sapiens
cctcttctaggacgtccttgtg

SEQ ID NO: 21935 - DNA, 22 bp, Homo sapiens
aggtatatattctggtccttat

SEQ ID NO: 21936 - DNA, 22 bp, Homo sapiens
agaggcaggaggttgacttgag

SEQ ID NO: 21937 - DNA, 22 bp, Homo sapiens
caggaaggcgcggctgtgcctg

SEQ ID NO: 21938 - DNA, 22 bp, Homo sapiens
atgcttccagattggtaggggt

SEQ ID NO: 21939 - DNA, 22 bp, Homo sapiens
gtcgtggagctcacagtgtgcc

SEQ ID NO: 21940 - DNA, 22 bp, Homo sapiens
gggacttaatgcagagagggac

SEQ ID NO: 21941 - DNA, 22 bp, Homo sapiens
tagctttgtttatcaaggggca

SEQ ID NO: 21942 - DNA, 19 bp, Homo sapiens
atgtacccagtgtcaatcc

SEQ ID NO: 21943 - DNA, 22 bp, Homo sapiens
ccgaggtcctggacttggccct

SEQ ID NO: 21944 - DNA, 22 bp, Homo sapiens
tcctgggaggcggaggttgcag

SEQ ID NO: 21945 - DNA, 22 bp, Homo sapiens
gcccaggctggagttcagtggt

SEQ ID NO: 21946 - DNA, 23 bp, Homo sapiens
aaaacagcttcctccagtggctc

SEQ ID NO: 21947 - DNA, 22 bp, Homo sapiens
cccaggggttctgagcagcagc

SEQ ID NO: 21948 - DNA, 22 bp, Homo sapiens
aagcgcaggactggctcacggc

SEQ ID NO: 21949 - DNA, 22 bp, Homo sapiens
tgggaggccaaggcaggcggat

SEQ ID NO: 21950 - DNA, 23 bp, Homo sapiens
ttctgggctgtggaagcctcggg

SEQ ID NO: 21951 - DNA, 22 bp, Homo sapiens
atgtttttaaatagacttacag

SEQ ID NO: 21952 - DNA, 22 bp, Homo sapiens
gctaatcaatgttaaggctgtg

SEQ ID NO: 21953 - DNA, 22 bp, Homo sapiens
ttaggcctttgattggggtgct

SEQ ID NO: 21954 - DNA, 22 bp, Homo sapiens
taagtcgtggatgattcttcgg

SEQ ID NO: 21955 - DNA, 22 bp, Homo sapiens
aggaatgacaggcctcccgcag

SEQ ID NO: 21956 - DNA, 22 bp, Homo sapiens
cagggggctcaaaggagagtgc

SEQ ID NO: 21957 - DNA, 22 bp, Homo sapiens
aatgttgcagagtgattgtcca

SEQ ID NO: 21958 - DNA, 22 bp, Homo sapiens
gcaggatgagtgagtacattta

SEQ ID NO: 21959 - DNA, 22 bp, Homo sapiens
tctgagccagggtctcctccct

SEQ ID NO: 21960 - DNA, 22 bp, Homo sapiens
tggcaaaatgagcaattacttt

SEQ ID NO: 21961 - DNA, 22 bp, Homo sapiens
agaggacagagtgctggattta

SEQ ID NO: 21962 - DNA, 16 bp, Homo sapiens
gcagaggaaaggggag

SEQ ID NO: 21963 - DNA, 22 bp, Homo sapiens
cactgcactccagcctgggaga

SEQ ID NO: 21964 - DNA, 22 bp, Homo sapiens
tggggagtgatgcctcggataa

SEQ ID NO: 21965 - DNA, 22 bp, Homo sapiens
tcttgggcatgtgtttgatttc

SEQ ID NO: 21966 - DNA, 21 bp, Homo sapiens
gcccacagtgaggaggatccc

SEQ ID NO: 21967 - DNA, 22 bp, Homo sapiens
acgatgatgaaagagaacattc

SEQ ID NO: 21968 - DNA, 22 bp, Homo sapiens
ttcattcttcagagctgcgctt

SEQ ID NO: 21969 - DNA, 22 bp, Homo sapiens
ggagagcagggaggctgctctg

SEQ ID NO: 21970 - DNA, 23 bp, Homo sapiens
cgcccagcctcagtgacctgggc

SEQ ID NO: 21971 - DNA, 22 bp, Homo sapiens
tccttaggcaatttgggagagt

SEQ ID NO: 21972 - DNA, 22 bp, Homo sapiens
gagatgcagaaccctcaggagc

SEQ ID NO: 21973 - DNA, 22 bp, Homo sapiens
aaggcaaaagaggtgtcatcac

SEQ ID NO: 21974 - DNA, 22 bp, Homo sapiens
attgagaagaaaatctaatata

SEQ ID NO: 21975 - DNA, 22 bp, Homo sapiens
aatattatcaaaagctttttca

SEQ ID NO: 21976 - DNA, 22 bp, Homo sapiens
cagcagagaaattacatatttg

SEQ ID NO: 21977 - DNA, 22 bp, Homo sapiens
catgagataatttttctccagt

SEQ ID NO: 21978 - DNA, 17 bp, Homo sapiens
gggcagggactcctggg

SEQ ID NO: 21979 - DNA, 22 bp, Homo sapiens
ccaggcaggcgatggtgcagtg

SEQ ID NO: 21980 - DNA, 22 bp, Homo sapiens
tttgcattgcattaagtattct

SEQ ID NO: 21981 - DNA, 22 bp, Homo sapiens
aaaaaattatcatagttcctga

SEQ ID NO: 21982 - DNA, 20 bp, Homo sapiens
aaaatatgtataactcttct

SEQ ID NO: 21983 - DNA, 19 bp, Homo sapiens
ccctcttgcacaaagcaaa

SEQ ID NO: 21984 - DNA, 22 bp, Homo sapiens
tgccaggcgtggtggtgcgcac

SEQ ID NO: 21985 - DNA, 22 bp, Homo sapiens
gaggcagaggttgttgcagtga

SEQ ID NO: 21986 - DNA, 22 bp, Homo sapiens
gaagcctcaacatctctgcgtc

SEQ ID NO: 21987 - DNA, 22 bp, Homo sapiens
atatattttttgagacagagtc

SEQ ID NO: 21988 - DNA, 22 bp, Homo sapiens
gaactcattagcctgctttcag

SEQ ID NO: 21989 - DNA, 22 bp, Homo sapiens
tccttgtaaaggagctctaaca

SEQ ID NO: 21990 - DNA, 22 bp, Homo sapiens
gagctgagaagcagcgcttgat

SEQ ID NO: 21991 - DNA, 22 bp, Homo sapiens
ccttttgctctcccatccagaa

SEQ ID NO: 21992 - DNA, 23 bp, Homo sapiens
gggggccgtcctggggattatag

SEQ ID NO: 21993 - DNA, 22 bp, Homo sapiens
tgaggcaggagaatcacatgaa

SEQ ID NO: 21994 - DNA, 22 bp, Homo sapiens
gagtggggggtccgtctcagtg

SEQ ID NO: 21995 - DNA, 22 bp, Homo sapiens
gggaacagcttgggctctgcca

SEQ ID NO: 21996 - DNA, 21 bp, Homo sapiens
caaaagagactgattcttgga

SEQ ID NO: 21997 - DNA, 22 bp, Homo sapiens
cagagagaatcttggcagctga

SEQ ID NO: 21998 - DNA, 22 bp, Homo sapiens
gggaggttgaggctgcagtgag

SEQ ID NO: 21999 - DNA, 22 bp, Homo sapiens
tgacatttcctagtgctttgtg

SEQ ID NO: 22000 - DNA, 22 bp, Homo sapiens
aataaacaaatccttccttccc

SEQ ID NO: 22001 - DNA, 22 bp, Homo sapiens
ggccagcctggggctcccagac

SEQ ID NO: 22002 - DNA, 22 bp, Homo sapiens
ttggggtcccacaggctgcctg

SEQ ID NO: 22003 - DNA, 21 bp, Homo sapiens
tttcttaggctctaaaatgac

SEQ ID NO: 22004 - DNA, 22 bp, Homo sapiens
caagccattctcctgcctcagc

SEQ ID NO: 22005 - DNA, 23 bp, Homo sapiens
ggagtgcaatggcgccatctcgg

SEQ ID NO: 22006 - DNA, 22 bp, Homo sapiens
ttagccaggggagcagcttgtc

SEQ ID NO: 22007 - DNA, 22 bp, Homo sapiens
ttctttcagaacacaagtgatt

SEQ ID NO: 22008 - DNA, 18 bp, Homo sapiens
tgagaggctattttttgc

SEQ ID NO: 22009 - DNA, 22 bp, Homo sapiens
aggatttctgtgcctggaaaat

SEQ ID NO: 22010 - DNA, 22 bp, Homo sapiens
gtggcccaggctggagtgcagt

SEQ ID NO: 22011 - DNA, 22 bp, Homo sapiens
ataatacatggttgatcttttc

SEQ ID NO: 22012 - DNA, 22 bp, Homo sapiens
ctgtaatcccagctactcggga

SEQ ID NO: 22013 - DNA, 21 bp, Homo sapiens
gctgctcgagatccagtgctt

SEQ ID NO: 22014 - DNA, 22 bp, Homo sapiens
tggtgccatcatagctcactgc

SEQ ID NO: 22015 - DNA, 22 bp, Homo sapiens
ttgttgtcattgtagaggattt

SEQ ID NO: 22016 - DNA, 22 bp, Homo sapiens
cccagagcatgtgctgcctttg

SEQ ID NO: 22017 - DNA, 22 bp, Homo sapiens
tacaaaaaattgatactgacga

SEQ ID NO: 22018 - DNA, 22 bp, Homo sapiens
tagcaaaggatgactatgtacc

SEQ ID NO: 22019 - DNA, 22 bp, Homo sapiens
cacccaggctggagtgcagtgg

SEQ ID NO: 22020 - DNA, 22 bp, Homo sapiens
ctccccattatgcagtcattat

SEQ ID NO: 22021 - DNA, 22 bp, Homo sapiens
caggaggattgcttgaggccag

SEQ ID NO: 22022 - DNA, 22 bp, Homo sapiens
agcccaggttgaggctgcagtg

SEQ ID NO: 22023 - DNA, 22 bp, Homo sapiens
gggagaggttacccgagcaact

SEQ ID NO: 22024 - DNA, 23 bp, Homo sapiens
acagcaagaggaccagatgtgag

SEQ ID NO: 22025 - DNA, 22 bp, Homo sapiens
agatggagtctcactcttgttg

SEQ ID NO: 22026 - DNA, 22 bp, Homo sapiens
gattgggggtcaggctcaggtc

SEQ ID NO: 22027 - DNA, 22 bp, Homo sapiens
gaggagggagctggaagctctt

SEQ ID NO: 22028 - DNA, 22 bp, Homo sapiens
aggcttttctccagaatgtact

SEQ ID NO: 22029 - DNA, 21 bp, Homo sapiens
ccgccgctgatagctctgggc

SEQ ID NO: 22030 - DNA, 22 bp, Homo sapiens
aagccggctgggccgaggctgc

SEQ ID NO: 22031 - DNA, 22 bp, Homo sapiens
agcgccactgcactccagcctg

SEQ ID NO: 22032 - DNA, 22 bp, Homo sapiens
gtccaaaagagccagccgggcg

SEQ ID NO: 22033 - DNA, 22 bp, Homo sapiens
cccacgttgaaccgcttacaga

SEQ ID NO: 22034 - DNA, 22 bp, Homo sapiens
agcttgtagaaggccacgagca

SEQ ID NO: 22035 - DNA, 22 bp, Homo sapiens
tactgcactccagcctgggtga

SEQ ID NO: 22036 - DNA, 22 bp, Homo sapiens
tgtgacctcatcttaactggaa

SEQ ID NO: 22037 - DNA, 22 bp, Homo sapiens
tcgcaccattgcactccagcca

SEQ ID NO: 22038 - DNA, 22 bp, Homo sapiens
aaaaatcacttttataggcagc

SEQ ID NO: 22039 - DNA, 18 bp, Homo sapiens
acacttcctggtggtgtg

SEQ ID NO: 22040 - DNA, 22 bp, Homo sapiens
gcccagtagttcaaggttgcag

SEQ ID NO: 22041 - DNA, 22 bp, Homo sapiens
tatgttgcaccaacctaataat

SEQ ID NO: 22042 - DNA, 22 bp, Homo sapiens
tttggtattgcacactgtcttc

SEQ ID NO: 22043 - DNA, 22 bp, Homo sapiens
aaggccttgccgaaggatgcca

SEQ ID NO: 22044 - DNA, 22 bp, Homo sapiens
tgataaacttagaaagaatgtt

SEQ ID NO: 22045 - DNA, 22 bp, Homo sapiens
tacttttctataggtttgaaat

SEQ ID NO: 22046 - DNA, 22 bp, Homo sapiens
agggactatttacccatctcac

SEQ ID NO: 22047 - DNA, 22 bp, Homo sapiens
aggggagagttaatgtgaatgt

SEQ ID NO: 22048 - DNA, 22 bp, Homo sapiens
aacccgggaggcagaggttgtg

SEQ ID NO: 22049 - DNA, 22 bp, Homo sapiens
gccctgtgcaggtgtgcagcag

SEQ ID NO: 22050 - DNA, 22 bp, Homo sapiens
ctgattgagaaggaaggggatc

SEQ ID NO: 22051 - DNA, 22 bp, Homo sapiens
ccagggtggcgtagatgctggg

SEQ ID NO: 22052 - DNA, 22 bp, Homo sapiens
actgcactccagcctcggggtc

SEQ ID NO: 22053 - DNA, 22 bp, Homo sapiens
tttgttttcaatgtgtcattca

SEQ ID NO: 22054 - DNA, 23 bp, Homo sapiens
caccactttctccttctccttgg

SEQ ID NO: 22055 - DNA, 22 bp, Homo sapiens
gaggtggctgcttgctgggaaa

SEQ ID NO: 22056 - DNA, 23 bp, Homo sapiens
cagtctgcagcccacttgggcag

SEQ ID NO: 22057 - DNA, 22 bp, Homo sapiens
tgggagcagttgcatctccagt

SEQ ID NO: 22058 - DNA, 22 bp, Homo sapiens
ttacctaaaatagctcaattta

SEQ ID NO: 22059 - DNA, 22 bp, Homo sapiens
acagacaagtagttcagacaag

SEQ ID NO: 22060 - DNA, 22 bp, Homo sapiens
tgccttgtccttcgtcagggct

SEQ ID NO: 22061 - DNA, 22 bp, Homo sapiens
agcaggagtttgatgcttttat

SEQ ID NO: 22062 - DNA, 22 bp, Homo sapiens
atgtttaaagggttgagaaata

SEQ ID NO: 22063 - DNA, 22 bp, Homo sapiens
acggtgctgggtattggggttc

SEQ ID NO: 22064 - DNA, 22 bp, Homo sapiens
gaggcaggaggattgcttgagc

SEQ ID NO: 22065 - DNA, 22 bp, Homo sapiens
gggaagtgatggagccaggatt

SEQ ID NO: 22066 - DNA, 22 bp, Homo sapiens
aaattgcaaaagtacttttagg

SEQ ID NO: 22067 - DNA, 22 bp, Homo sapiens
tttgtcttatccaatctctcag

SEQ ID NO: 22068 - DNA, 22 bp, Homo sapiens
ttaggtattttgttatgtcagc

SEQ ID NO: 22069 - DNA, 22 bp, Homo sapiens
tccctgcaggtgtgcaagctga

SEQ ID NO: 22070 - DNA, 22 bp, Homo sapiens
gaggcacagagtaggtgcacac

SEQ ID NO: 22071 - DNA, 19 bp, Homo sapiens
ttctctgctacattctcag

SEQ ID NO: 22072 - DNA, 22 bp, Homo sapiens
ccactgcacttcagcctgggtg

SEQ ID NO: 22073 - DNA, 22 bp, Homo sapiens
aggacgctctcgctgaacttct

SEQ ID NO: 22074 - DNA, 22 bp, Homo sapiens
tggaaacacccacgcatgcata

SEQ ID NO: 22075 - DNA, 22 bp, Homo sapiens
ctgctctgctgatcagtgtctc

SEQ ID NO: 22076 - DNA, 22 bp, Homo sapiens
gaggcaaagcatgtggctcagg

SEQ ID NO: 22077 - DNA, 20 bp, Homo sapiens
tatttctgggcaaccattta

SEQ ID NO: 22078 - DNA, 22 bp, Homo sapiens
tccaaacgggagccaaatgagc

SEQ ID NO: 22079 - DNA, 22 bp, Homo sapiens
tgatttatgcattatactgttg

SEQ ID NO: 22080 - DNA, 18 bp, Homo sapiens
gtcaggcatgaatctggg

SEQ ID NO: 22081 - DNA, 22 bp, Homo sapiens
gaggtgggtgtatcacaggtca

SEQ ID NO: 22082 - DNA, 22 bp, Homo sapiens
agcctggcctgggcaggcacat

SEQ ID NO: 22083 - DNA, 22 bp, Homo sapiens
gaggccactgtccctgccttcc

SEQ ID NO: 22084 - DNA, 18 bp, Homo sapiens
cccggctaatttttggta

SEQ ID NO: 22085 - DNA, 22 bp, Homo sapiens
agggctggagccacagctggga

SEQ ID NO: 22086 - DNA, 22 bp, Homo sapiens
atgttggagtcgtaaggcatgg

SEQ ID NO: 22087 - DNA, 22 bp, Homo sapiens
tcttagaaattccccagtggct

SEQ ID NO: 22088 - DNA, 22 bp, Homo sapiens
ataaagctattcctctcttttt

SEQ ID NO: 22089 - DNA, 22 bp, Homo sapiens
tttaaaaaactagtctgagtct

SEQ ID NO: 22090 - DNA, 22 bp, Homo sapiens
tgtggactcgcatggctgaggc

SEQ ID NO: 22091 - DNA, 22 bp, Homo sapiens
tgactacaacctccacctcccg

SEQ ID NO: 22092 - DNA, 22 bp, Homo sapiens
cagaggaacgtttggattgatt

SEQ ID NO: 22093 - DNA, 22 bp, Homo sapiens
gtagatgagctcacatgacctt

SEQ ID NO: 22094 - DNA, 22 bp, Homo sapiens
tgagcaggcgcagcaggaggtc

SEQ ID NO: 22095 - DNA, 22 bp, Homo sapiens
gagacacaggcacagaagaggc

SEQ ID NO: 22096 - DNA, 22 bp, Homo sapiens
aaattagtcatgttgtattact

SEQ ID NO: 22097 - DNA, 22 bp, Homo sapiens
cctgccagagcagcttgtcctc

SEQ ID NO: 22098 - DNA, 22 bp, Homo sapiens
tttattctgtgctacatgaaga

SEQ ID NO: 22099 - DNA, 22 bp, Homo sapiens
tgcctcagctgaggccgctcca

SEQ ID NO: 22100 - DNA, 22 bp, Homo sapiens
ccctgctgtcaggtgctgggag

SEQ ID NO: 22101 - DNA, 22 bp, Homo sapiens
agttgctttggatataacttct

SEQ ID NO: 22102 - DNA, 22 bp, Homo sapiens
attcacatttagcctctgacat

SEQ ID NO: 22103 - DNA, 22 bp, Homo sapiens
gcctcaaatgtggagcactatt

SEQ ID NO: 22104 - DNA, 18 bp, Homo sapiens
cagcctctgattggttgc

SEQ ID NO: 22105 - DNA, 22 bp, Homo sapiens
gttattgaggtggagtctcact

SEQ ID NO: 22106 - DNA, 22 bp, Homo sapiens
aaagggaagttgcacatgttcc

SEQ ID NO: 22107 - DNA, 22 bp, Homo sapiens
acacccaggctggcgtgcagtg

SEQ ID NO: 22108 - DNA, 22 bp, Homo sapiens
ctgagcagatgaccagccccag

SEQ ID NO: 22109 - DNA, 22 bp, Homo sapiens
atgaaaacggaccagagctatt

SEQ ID NO: 22110 - DNA, 22 bp, Homo sapiens
tgaatgtgatgctaaacatatg

SEQ ID NO: 22111 - DNA, 22 bp, Homo sapiens
caaatgaatatttccatgggtt

SEQ ID NO: 22112 - DNA, 22 bp, Homo sapiens
gctttgcccctttagtgggtgc

SEQ ID NO: 22113 - DNA, 22 bp, Homo sapiens
cggggccctggggctgaaggtc

SEQ ID NO: 22114 - DNA, 22 bp, Homo sapiens
agctcttacatttaggtctatg

SEQ ID NO: 22115 - DNA, 22 bp, Homo sapiens
aagattttcagtgcctaaaaca

SEQ ID NO: 22116 - DNA, 22 bp, Homo sapiens
aaaagtaattgcggtttttgct

SEQ ID NO: 22117 - DNA, 22 bp, Homo sapiens
cagcctgtcggctccttcattc

SEQ ID NO: 22118 - DNA, 22 bp, Homo sapiens
ttatttttaaaagttcacacag

SEQ ID NO: 22119 - DNA, 22 bp, Homo sapiens
cactgcaacctccacctcctgg

SEQ ID NO: 22120 - DNA, 22 bp, Homo sapiens
ttttccttcatatcccttatgt

SEQ ID NO: 22121 - DNA, 22 bp, Homo sapiens
tcaaatgttccctgtactggcc

SEQ ID NO: 22122 - DNA, 22 bp, Homo sapiens
cgcccaggctggagagcagtgg

SEQ ID NO: 22123 - DNA, 22 bp, Homo sapiens
cctccccacagcccaggagact

SEQ ID NO: 22124 - DNA, 20 bp, Homo sapiens
agagatggggtatcaccgta

SEQ ID NO: 22125 - DNA, 22 bp, Homo sapiens
gctgtcttgctcactcttgcag

SEQ ID NO: 22126 - DNA, 22 bp, Homo sapiens
ctgggctagaaggaccaggatg

SEQ ID NO: 22127 - DNA, 22 bp, Homo sapiens
attataggcttgagccaccgtg

SEQ ID NO: 22128 - DNA, 22 bp, Homo sapiens
agaaggggcccaaggatgtcag

SEQ ID NO: 22129 - DNA, 22 bp, Homo sapiens
ctgcactgacttccccggctgc

SEQ ID NO: 22130 - DNA, 22 bp, Homo sapiens
gggccctgggattcagagcaag

SEQ ID NO: 22131 - DNA, 22 bp, Homo sapiens
tcactgcgcttcagcctgggtg

SEQ ID NO: 22132 - DNA, 22 bp, Homo sapiens
ttctagtgtccttggacttgct

SEQ ID NO: 22133 - DNA, 22 bp, Homo sapiens
gagagcaggaggcagcgggacg

SEQ ID NO: 22134 - DNA, 22 bp, Homo sapiens
atgatactctaggtgatttaca

SEQ ID NO: 22135 - DNA, 22 bp, Homo sapiens
ccagcagagcatggggaggaag

SEQ ID NO: 22136 - DNA, 22 bp, Homo sapiens
gtagttctgcagtgtcacctga

SEQ ID NO: 22137 - DNA, 22 bp, Homo sapiens
aatggcactttataaatgttaa

SEQ ID NO: 22138 - DNA, 22 bp, Homo sapiens
ttgatgtaggtttatctattgt

SEQ ID NO: 22139 - DNA, 22 bp, Homo sapiens
ttattgaaggaactgaaataaa

SEQ ID NO: 22140 - DNA, 22 bp, Homo sapiens
agctgccccgaggcggcgggaa

SEQ ID NO: 22141 - DNA, 22 bp, Homo sapiens
agaaatatgctgattagatgaa

SEQ ID NO: 22142 - DNA, 22 bp, Homo sapiens
ggagagggtaggggtcctgccc

SEQ ID NO: 22143 - DNA, 22 bp, Homo sapiens
gaggctgcagctatcagacatt

SEQ ID NO: 22144 - DNA, 22 bp, Homo sapiens
gtcagaggggcagctgccaggc

SEQ ID NO: 22145 - DNA, 22 bp, Homo sapiens
tggcccagtatgtataatctta

SEQ ID NO: 22146 - DNA, 22 bp, Homo sapiens
gaccaaggaagaggggagccag

SEQ ID NO: 22147 - DNA, 22 bp, Homo sapiens
gctcttgtcaaaaattagttga

SEQ ID NO: 22148 - DNA, 22 bp, Homo sapiens
gccttgtttcattacacgtggt

SEQ ID NO: 22149 - DNA, 22 bp, Homo sapiens
taaagctctgggtttctagatc

SEQ ID NO: 22150 - DNA, 22 bp, Homo sapiens
aggactgggtgcagagggcatc

SEQ ID NO: 22151 - DNA, 22 bp, Homo sapiens
cacagcctcctctggctcacgg

SEQ ID NO: 22152 - DNA, 21 bp, Homo sapiens
cgggaaggaggttctgaccct

SEQ ID NO: 22153 - DNA, 22 bp, Homo sapiens
ttcctaagtcctgccagcagtc

SEQ ID NO: 22154 - DNA, 22 bp, Homo sapiens
aggcactgtgcagtcccaagca

SEQ ID NO: 22155 - DNA, 22 bp, Homo sapiens
aggagcagaccgtagtcctgca

SEQ ID NO: 22156 - DNA, 22 bp, Homo sapiens
gcctcctgtcccaggctgagga

SEQ ID NO: 22157 - DNA, 22 bp, Homo sapiens
ggttccccaggcggcccttgga

SEQ ID NO: 22158 - DNA, 22 bp, Homo sapiens
agaaaatttaaagagacacaca

SEQ ID NO: 22159 - DNA, 22 bp, Homo sapiens
tgatcaaaacattactccacca

SEQ ID NO: 22160 - DNA, 22 bp, Homo sapiens
taagggttcagaatgcagtggt

SEQ ID NO: 22161 - DNA, 22 bp, Homo sapiens
ggcaaggtgctacagacagtga

SEQ ID NO: 22162 - DNA, 22 bp, Homo sapiens
taaatcttctacatcatcataa

SEQ ID NO: 22163 - DNA, 22 bp, Homo sapiens
cagtggctggttagggacagga

SEQ ID NO: 22164 - DNA, 22 bp, Homo sapiens
acagcagcaatagcagtgacat

SEQ ID NO: 22165 - DNA, 22 bp, Homo sapiens
tgggattcaccatgggcttcag

SEQ ID NO: 22166 - DNA, 22 bp, Homo sapiens
cttgcctacttgtcaaccagca

SEQ ID NO: 22167 - DNA, 22 bp, Homo sapiens
gaattttattactagtcaactg

SEQ ID NO: 22168 - DNA, 21 bp, Homo sapiens
ccaggccaggcctacggggat

SEQ ID NO: 22169 - DNA, 22 bp, Homo sapiens
tgaggcaggagttcaggctgcg

SEQ ID NO: 22170 - DNA, 22 bp, Homo sapiens
cactgcactccagcccgggcaa

SEQ ID NO: 22171 - DNA, 22 bp, Homo sapiens
agttggagtgaacatgagattg

SEQ ID NO: 22172 - DNA, 18 bp, Homo sapiens
tctggaacaacttcatgt

SEQ ID NO: 22173 - DNA, 22 bp, Homo sapiens
tgaggcaggagaatcaccggaa

SEQ ID NO: 22174 - DNA, 22 bp, Homo sapiens
ttccaaagaagttcacatttac

SEQ ID NO: 22175 - DNA, 22 bp, Homo sapiens
ccctgatagcccctatcatcag

SEQ ID NO: 22176 - DNA, 22 bp, Homo sapiens
tgcagaaacaagccatcattca

SEQ ID NO: 22177 - DNA, 22 bp, Homo sapiens
aacctgggcttgaacagtgcct

SEQ ID NO: 22178 - DNA, 22 bp, Homo sapiens
cctagagctctgctttatctaa

SEQ ID NO: 22179 - DNA, 22 bp, Homo sapiens
accatgttggccaagctggtct

SEQ ID NO: 22180 - DNA, 22 bp, Homo sapiens
gaagaaagatcaaatagtttcc

SEQ ID NO: 22181 - DNA, 19 bp, Homo sapiens
ggagccgccgcccttcatt

SEQ ID NO: 22182 - DNA, 22 bp, Homo sapiens
atgcagaagactgaaaagctga

SEQ ID NO: 22183 - DNA, 22 bp, Homo sapiens
atatatgcgcaggcacccagct

SEQ ID NO: 22184 - DNA, 23 bp, Homo sapiens
tgaggcaggcggatcacgaggtc

SEQ ID NO: 22185 - DNA, 22 bp, Homo sapiens
tgaggaaacttacaaggcagaa

SEQ ID NO: 22186 - DNA, 22 bp, Homo sapiens
tgagcattacctgaggccactg

SEQ ID NO: 22187 - DNA, 22 bp, Homo sapiens
ggctcactgcaacttccgcctc

SEQ ID NO: 22188 - DNA, 22 bp, Homo sapiens
actgcacttcaccctgggtgac

SEQ ID NO: 22189 - DNA, 22 bp, Homo sapiens
cccagtttcaactttccagtgg

SEQ ID NO: 22190 - DNA, 22 bp, Homo sapiens
ttgcccagagtcacccagctca

SEQ ID NO: 22191 - DNA, 22 bp, Homo sapiens
ttggaagacaatgctgattctc

SEQ ID NO: 22192 - DNA, 14 bp, Homo sapiens
gcaggcggatcact

SEQ ID NO: 22193 - DNA, 22 bp, Homo sapiens
gtgggggcaggcagtgctagga

SEQ ID NO: 22194 - DNA, 22 bp, Homo sapiens
cccatgcaccctctaagaagga

SEQ ID NO: 22195 - DNA, 22 bp, Homo sapiens
ttatttaaaagtggtaagattc

SEQ ID NO: 22196 - DNA, 22 bp, Homo sapiens
ggcaaggggtcaggctgagaca

SEQ ID NO: 22197 - DNA, 22 bp, Homo sapiens
tgctcattggcgatctgaggga

SEQ ID NO: 22198 - DNA, 22 bp, Homo sapiens
tcatctaagagtcttacattta

SEQ ID NO: 22199 - DNA, 22 bp, Homo sapiens
aggacttagaacattatgtact

SEQ ID NO: 22200 - DNA, 22 bp, Homo sapiens
ttaataaagtatgaattggaaa

SEQ ID NO: 22201 - DNA, 22 bp, Homo sapiens
aaacttgagccaagggcttggg

SEQ ID NO: 22202 - DNA, 22 bp, Homo sapiens
ctcagcagtatactctgaagat

SEQ ID NO: 22203 - DNA, 22 bp, Homo sapiens
aaaggctttaaaatgtacatat

SEQ ID NO: 22204 - DNA, 22 bp, Homo sapiens
tccaggattgtcagccagaagg

SEQ ID NO: 22205 - DNA, 22 bp, Homo sapiens
gtgacaatattagctcaggggc

SEQ ID NO: 22206 - DNA, 22 bp, Homo sapiens
atcatcctagaaggaagctagg

SEQ ID NO: 22207 - DNA, 23 bp, Homo sapiens
aaactacaacgccaggcactgag

SEQ ID NO: 22208 - DNA, 22 bp, Homo sapiens
cccagggaggcccaggctctgc

SEQ ID NO: 22209 - DNA, 22 bp, Homo sapiens
gggaaggaaagttattagcaga

SEQ ID NO: 22210 - DNA, 22 bp, Homo sapiens
tttctaatctgattctcctacc

SEQ ID NO: 22211 - DNA, 18 bp, Homo sapiens
gctttctatgcgacagta

SEQ ID NO: 22212 - DNA, 22 bp, Homo sapiens
agcttagtggttgtatgagtta

SEQ ID NO: 22213 - DNA, 22 bp, Homo sapiens
gctgacccctacaggttgtgtt

SEQ ID NO: 22214 - DNA, 22 bp, Homo sapiens
ggtcagccttggatttggtagc

SEQ ID NO: 22215 - DNA, 22 bp, Homo sapiens
gggcggatcacctgaggtcagg

SEQ ID NO: 22216 - DNA, 22 bp, Homo sapiens
tttgaggttagctagcagatca

SEQ ID NO: 22217 - DNA, 22 bp, Homo sapiens
tctgagtggactgtcctgcagg

SEQ ID NO: 22218 - DNA, 22 bp, Homo sapiens
tgacaggaaacatgcagtgatt

SEQ ID NO: 22219 - DNA, 22 bp, Homo sapiens
tcccagtttttctccactaagg

SEQ ID NO: 22220 - DNA, 22 bp, Homo sapiens
accctcttgagggaagcacttt

SEQ ID NO: 22221 - DNA, 22 bp, Homo sapiens
tcaccaggctggagtgcagtgg

SEQ ID NO: 22222 - DNA, 22 bp, Homo sapiens
gtggcccaggttggagtgcagt

SEQ ID NO: 22223 - DNA, 22 bp, Homo sapiens
ggaggcccagaaggaagcccag

SEQ ID NO: 22224 - DNA, 22 bp, Homo sapiens
aagtaaatatctgtagtcttta

SEQ ID NO: 22225 - DNA, 22 bp, Homo sapiens
aggcaggaggatcatggatgca

SEQ ID NO: 22226 - DNA, 22 bp, Homo sapiens
gggcccctgggaattctgtgat

SEQ ID NO: 22227 - DNA, 22 bp, Homo sapiens
actgcactccagcctgggtgat

SEQ ID NO: 22228 - DNA, 22 bp, Homo sapiens
actctgcctgcggtgggcggga

SEQ ID NO: 22229 - DNA, 22 bp, Homo sapiens
agcagcagtatccttccccggc

SEQ ID NO: 22230 - DNA, 22 bp, Homo sapiens
ctgggggcagcaagaagccatg

SEQ ID NO: 22231 - DNA, 22 bp, Homo sapiens
cctttcccgctttgagggcaag

SEQ ID NO: 22232 - DNA, 22 bp, Homo sapiens
tctgtgctaggcagcctggccc

SEQ ID NO: 22233 - DNA, 22 bp, Homo sapiens
tccaggattgcaggtgcacaac

SEQ ID NO: 22234 - DNA, 22 bp, Homo sapiens
aggtggagaagagatgggcagt

SEQ ID NO: 22235 - DNA, 22 bp, Homo sapiens
caaagtggaggctctggggcca

SEQ ID NO: 22236 - DNA, 22 bp, Homo sapiens
ctggcaagaaatatatatctta

SEQ ID NO: 22237 - DNA, 22 bp, Homo sapiens
tattcatagtaaacaaaagtgg

SEQ ID NO: 22238 - DNA, 22 bp, Homo sapiens
tgagcacatttcacatgacagg

SEQ ID NO: 22239 - DNA, 22 bp, Homo sapiens
gggagccccacctcggtgcccg

SEQ ID NO: 22240 - DNA, 22 bp, Homo sapiens
aggtgacaggacaggagctggt

SEQ ID NO: 22241 - DNA, 22 bp, Homo sapiens
agaggccgggtgcctgctcaga

SEQ ID NO: 22242 - DNA, 22 bp, Homo sapiens
acatgtttaagtttgttatatg

SEQ ID NO: 22243 - DNA, 23 bp, Homo sapiens
atgtttgcagtaacccatcctgg

SEQ ID NO: 22244 - DNA, 20 bp, Homo sapiens
aggaaaaatggaaactggag

SEQ ID NO: 22245 - DNA, 22 bp, Homo sapiens
aagaatgagctcaaagatctta

SEQ ID NO: 22246 - DNA, 22 bp, Homo sapiens
agcagcagtgttctggaattct

SEQ ID NO: 22247 - DNA, 22 bp, Homo sapiens
attgtactctagcctctgggca

SEQ ID NO: 22248 - DNA, 22 bp, Homo sapiens
attgcacatctgcactacagcc

SEQ ID NO: 22249 - DNA, 22 bp, Homo sapiens
gcctgctcccagttggcgcctc

SEQ ID NO: 22250 - DNA, 22 bp, Homo sapiens
agcactgtgagcaccagcacgc

SEQ ID NO: 22251 - DNA, 22 bp, Homo sapiens
tatcacatttggagatttatga

SEQ ID NO: 22252 - DNA, 22 bp, Homo sapiens
tagatgaccttgtgttaggcaa

SEQ ID NO: 22253 - DNA, 22 bp, Homo sapiens
gaggccacggaagggagctgtg

SEQ ID NO: 22254 - DNA, 22 bp, Homo sapiens
gggccaccccactgcccacgct

SEQ ID NO: 22255 - DNA, 22 bp, Homo sapiens
ttaaattttagaaacagactct

SEQ ID NO: 22256 - DNA, 18 bp, Homo sapiens
gcagctagccaggggggc

SEQ ID NO: 22257 - DNA, 22 bp, Homo sapiens
acgcccagactcccatactttg

SEQ ID NO: 22258 - DNA, 18 bp, Homo sapiens
tcttccaacactgacacc

SEQ ID NO: 22259 - DNA, 22 bp, Homo sapiens
tctgtcacccagagtgcagtgg

SEQ ID NO: 22260 - DNA, 22 bp, Homo sapiens
gccccagcctcccgagtagctg

SEQ ID NO: 22261 - DNA, 22 bp, Homo sapiens
tgggggtgtcctggtgcacaca

SEQ ID NO: 22262 - DNA, 22 bp, Homo sapiens
cctcccctcagacagagactgg

SEQ ID NO: 22263 - DNA, 22 bp, Homo sapiens
tccctagtcgcatctgtggaga

SEQ ID NO: 22264 - DNA, 22 bp, Homo sapiens
ttcaaatgatggcagtcctggc

SEQ ID NO: 22265 - DNA, 22 bp, Homo sapiens
tgagccaggagtttgaggctgt

SEQ ID NO: 22266 - DNA, 22 bp, Homo sapiens
gcaggaggttgagccaggactg

SEQ ID NO: 22267 - DNA, 22 bp, Homo sapiens
atattgttagtaatatttcgaa

SEQ ID NO: 22268 - DNA, 18 bp, Homo sapiens
cagctgccagctcatgga

SEQ ID NO: 22269 - DNA, 22 bp, Homo sapiens
taagaaatttagttatagaatg

SEQ ID NO: 22270 - DNA, 22 bp, Homo sapiens
ttttcctttgattcccagatgt

SEQ ID NO: 22271 - DNA, 22 bp, Homo sapiens
ggccaggcgatgacccctccac

SEQ ID NO: 22272 - DNA, 22 bp, Homo sapiens
ataaaaactgacccatcctttg

SEQ ID NO: 22273 - DNA, 22 bp, Homo sapiens
gctggaggatggactggaagaa

SEQ ID NO: 22274 - DNA, 22 bp, Homo sapiens
gggagctgagctggaagagaat

SEQ ID NO: 22275 - DNA, 22 bp, Homo sapiens
agcctggcggtcgtcggtcagg

SEQ ID NO: 22276 - DNA, 22 bp, Homo sapiens
aacccacaaaggatttcagctc

SEQ ID NO: 22277 - DNA, 22 bp, Homo sapiens
tttgtggcaggagcggagaccg

SEQ ID NO: 22278 - DNA, 22 bp, Homo sapiens
gctgcactttgactgctggggt

SEQ ID NO: 22279 - DNA, 22 bp, Homo sapiens
ggaggtgggctaaggactctct

SEQ ID NO: 22280 - DNA, 22 bp, Homo sapiens
gagcaggaaggccagaagggtc

SEQ ID NO: 22281 - DNA, 22 bp, Homo sapiens
cacatgaaggctggggtcgtga

SEQ ID NO: 22282 - DNA, 22 bp, Homo sapiens
ggtccccccatggtgagcactg

SEQ ID NO: 22283 - DNA, 22 bp, Homo sapiens
tatttcttttcgtgacttattg

SEQ ID NO: 22284 - DNA, 22 bp, Homo sapiens
tcgcgcccccaagcgtcattgg

SEQ ID NO: 22285 - DNA, 22 bp, Homo sapiens
ccggctactcgggaggctgacg

SEQ ID NO: 22286 - DNA, 22 bp, Homo sapiens
gctccctggtagccatgctctc

SEQ ID NO: 22287 - DNA, 22 bp, Homo sapiens
tccaagatctacagcagtttag

SEQ ID NO: 22288 - DNA, 22 bp, Homo sapiens
ctcctggaggatagtgactggg

SEQ ID NO: 22289 - DNA, 22 bp, Homo sapiens
aggaggcagtctgtcccttagc

SEQ ID NO: 22290 - DNA, 22 bp, Homo sapiens
gtgaataaaacacctgccaaga

SEQ ID NO: 22291 - DNA, 23 bp, Homo sapiens
ggatggacgtgatgccttagcca

SEQ ID NO: 22292 - DNA, 22 bp, Homo sapiens
aacacacctggttaacctcttt

SEQ ID NO: 22293 - DNA, 22 bp, Homo sapiens
ttattttaccttcctctgagct

SEQ ID NO: 22294 - DNA, 22 bp, Homo sapiens
ccaggaggcagaagttgcagtg

SEQ ID NO: 22295 - DNA, 22 bp, Homo sapiens
ttttcatttttgtagatgcaag

SEQ ID NO: 22296 - DNA, 22 bp, Homo sapiens
actgcacttcagcctgggtgac

SEQ ID NO: 22297 - DNA, 22 bp, Homo sapiens
acaggcacctgccaccacatct

SEQ ID NO: 22298 - DNA, 22 bp, Homo sapiens
aggtgggcggattcatgaggtc

SEQ ID NO: 22299 - DNA, 22 bp, Homo sapiens
tcacatctaattccatttctgc

SEQ ID NO: 22300 - DNA, 22 bp, Homo sapiens
aagtggcagttcaggaagcaga

SEQ ID NO: 22301 - DNA, 22 bp, Homo sapiens
atgaccagccgagataaacaga

SEQ ID NO: 22302 - DNA, 22 bp, Homo sapiens
ttgcttgcattgtccctggtga

SEQ ID NO: 22303 - DNA, 23 bp, Homo sapiens
agagtgcagagatatgcttgtgt

SEQ ID NO: 22304 - DNA, 22 bp, Homo sapiens
atggagttctgccagcgctgct

SEQ ID NO: 22305 - DNA, 22 bp, Homo sapiens
cttcctttgctgttcggaggtt

SEQ ID NO: 22306 - DNA, 22 bp, Homo sapiens
tctcccctggtctcgcgcgctg

SEQ ID NO: 22307 - DNA, 22 bp, Homo sapiens
gaaaggagagggttaaggagct

SEQ ID NO: 22308 - DNA, 22 bp, Homo sapiens
tatccgtgatgtttataaacca

SEQ ID NO: 22309 - DNA, 22 bp, Homo sapiens
acccggagtcggaggttgcagt

SEQ ID NO: 22310 - DNA, 22 bp, Homo sapiens
gcaggcagatcacctgtcagga

SEQ ID NO: 22311 - DNA, 22 bp, Homo sapiens
ggctggtgttgagtgcctgtag

SEQ ID NO: 22312 - DNA, 22 bp, Homo sapiens
agctcaatgcaacctccgcctc

SEQ ID NO: 22313 - DNA, 22 bp, Homo sapiens
ctgaacttattgagtgcttgct

SEQ ID NO: 22314 - DNA, 22 bp, Homo sapiens
aagagggctgcaatcttattgc

SEQ ID NO: 22315 - DNA, 22 bp, Homo sapiens
ggggccttggatctgtgccccg

SEQ ID NO: 22316 - DNA, 22 bp, Homo sapiens
attgttcaatgtaataattttg

SEQ ID NO: 22317 - DNA, 22 bp, Homo sapiens
ggtgacgaatccatagcatcga

SEQ ID NO: 22318 - DNA, 22 bp, Homo sapiens
cacttcaacctctgagtcctgg

SEQ ID NO: 22319 - DNA, 22 bp, Homo sapiens
gttatataagacaaatcagagt

SEQ ID NO: 22320 - DNA, 22 bp, Homo sapiens
cacctgccaaatggggatgctg

SEQ ID NO: 22321 - DNA, 22 bp, Homo sapiens
cccacgtcgaacttgctccaga

SEQ ID NO: 22322 - DNA, 22 bp, Homo sapiens
gtggcaagatgactactcactg

SEQ ID NO: 22323 - DNA, 22 bp, Homo sapiens
aaggagtctgggccattcagag

SEQ ID NO: 22324 - DNA, 21 bp, Homo sapiens
ctcccagggtgactgttcaac

SEQ ID NO: 22325 - DNA, 22 bp, Homo sapiens
ggaggtggaggttgcagtgagc

SEQ ID NO: 22326 - DNA, 22 bp, Homo sapiens
tttgcttgattaggatatggaa

SEQ ID NO: 22327 - DNA, 22 bp, Homo sapiens
attgataaattgcaatggggct

SEQ ID NO: 22328 - DNA, 22 bp, Homo sapiens
ttcttctttccaattacatggt

SEQ ID NO: 22329 - DNA, 22 bp, Homo sapiens
ttatgatttgccacagattggt

SEQ ID NO: 22330 - DNA, 22 bp, Homo sapiens
actttaaaactgatcatcagag

SEQ ID NO: 22331 - DNA, 22 bp, Homo sapiens
gtgagactcgcctttgtgtagc

SEQ ID NO: 22332 - DNA, 22 bp, Homo sapiens
gtatccatgggggattggttcc

SEQ ID NO: 22333 - DNA, 22 bp, Homo sapiens
caggcactgtgctgagctctgc

SEQ ID NO: 22334 - DNA, 22 bp, Homo sapiens
gaatgcttggaacctgaagttc

SEQ ID NO: 22335 - DNA, 22 bp, Homo sapiens
aggctggagtgcagtggtgtga

SEQ ID NO: 22336 - DNA, 22 bp, Homo sapiens
agctgcaccggctggaccactg

SEQ ID NO: 22337 - DNA, 22 bp, Homo sapiens
tctctcaggctggagtgcagtg

SEQ ID NO: 22338 - DNA, 22 bp, Homo sapiens
actgcattctttatcccacaac

SEQ ID NO: 22339 - DNA, 22 bp, Homo sapiens
ataaaatttgctactgttaaat

SEQ ID NO: 22340 - DNA, 22 bp, Homo sapiens
aatgccttggagagcctagagg

SEQ ID NO: 22341 - DNA, 22 bp, Homo sapiens
aaagtaattgcagtttctgcca

SEQ ID NO: 22342 - DNA, 22 bp, Homo sapiens
agggagcattgtgacatatcac

SEQ ID NO: 22343 - DNA, 20 bp, Homo sapiens
agcagagtgcccatcccgga

SEQ ID NO: 22344 - DNA, 22 bp, Homo sapiens
ctctgcctgtctcatcctgcaa

SEQ ID NO: 22345 - DNA, 22 bp, Homo sapiens
ttccaactttgtcatatattat

SEQ ID NO: 22346 - DNA, 22 bp, Homo sapiens
tgcctcaagccctccactgcac

SEQ ID NO: 22347 - DNA, 22 bp, Homo sapiens
caatagtgtctgcttgtttcta

SEQ ID NO: 22348 - DNA, 22 bp, Homo sapiens
ttatttgtggcatatgagacga

SEQ ID NO: 22349 - DNA, 22 bp, Homo sapiens
cctgcttaacattgccatgaca

SEQ ID NO: 22350 - DNA, 22 bp, Homo sapiens
atgaaatatcttgaagaaattc

SEQ ID NO: 22351 - DNA, 22 bp, Homo sapiens
tcaggaggtccgcccgggaggg

SEQ ID NO: 22352 - DNA, 18 bp, Homo sapiens
atggtctcatactgggag

SEQ ID NO: 22353 - DNA, 22 bp, Homo sapiens
cagcgtctcgttgtgggcctcg

SEQ ID NO: 22354 - DNA, 22 bp, Homo sapiens
gggacgacaggctctgtggtag

SEQ ID NO: 22355 - DNA, 22 bp, Homo sapiens
gcttttcatgacaactcagcga

SEQ ID NO: 22356 - DNA, 22 bp, Homo sapiens
gatggaggagatggcagggtgc

SEQ ID NO: 22357 - DNA, 22 bp, Homo sapiens
gctctgccagcccaaggcgcag

SEQ ID NO: 22358 - DNA, 22 bp, Homo sapiens
ccttgctcaagctagtgacggg

SEQ ID NO: 22359 - DNA, 22 bp, Homo sapiens
aggagatggagctcagtgggca

SEQ ID NO: 22360 - DNA, 22 bp, Homo sapiens
tgggaaagctgcagaaattctc

SEQ ID NO: 22361 - DNA, 22 bp, Homo sapiens
tgggaagggtcaacagctggaa

SEQ ID NO: 22362 - DNA, 22 bp, Homo sapiens
tttggaaattttcatccagaca

SEQ ID NO: 22363 - DNA, 22 bp, Homo sapiens
tgtgtttctgagaatcccacct

SEQ ID NO: 22364 - DNA, 22 bp, Homo sapiens
actgcgtggggagctgtgacta

SEQ ID NO: 22365 - DNA, 22 bp, Homo sapiens
cactgcactccagcctgggcaa

SEQ ID NO: 22366 - DNA, 22 bp, Homo sapiens
aagcatttcaggtagagatatt

SEQ ID NO: 22367 - DNA, 22 bp, Homo sapiens
ggcctcgcggcttctggtggct

SEQ ID NO: 22368 - DNA, 22 bp, Homo sapiens
tcagagtctgtgcattctgcta

SEQ ID NO: 22369 - DNA, 22 bp, Homo sapiens
ggctccctgcaacctccgcctc

SEQ ID NO: 22370 - DNA, 19 bp, Homo sapiens
tggctctgtcgaaggcaca

SEQ ID NO: 22371 - DNA, 22 bp, Homo sapiens
tacgcctgtaatcccagcactt

SEQ ID NO: 22372 - DNA, 22 bp, Homo sapiens
gcctcctggggtgccatcatct

SEQ ID NO: 22373 - DNA, 22 bp, Homo sapiens
gcccttacagggtggtcagcca

SEQ ID NO: 22374 - DNA, 22 bp, Homo sapiens
gagtcacatactatgtaataga

SEQ ID NO: 22375 - DNA, 22 bp, Homo sapiens
cttgcctttgtcttcaaaggct

SEQ ID NO: 22376 - DNA, 22 bp, Homo sapiens
tcccagagctctggaggttgga

SEQ ID NO: 22377 - DNA, 22 bp, Homo sapiens
tttattggatatttacaagata

SEQ ID NO: 22378 - DNA, 22 bp, Homo sapiens
cctgggcctctcaaagtgctgg

SEQ ID NO: 22379 - DNA, 22 bp, Homo sapiens
tgctgagcgcatccggcggccg

SEQ ID NO: 22380 - DNA, 22 bp, Homo sapiens
ggacacgtggctgaaggcggcc

SEQ ID NO: 22381 - DNA, 22 bp, Homo sapiens
gacctggtccttgtactttgaa

SEQ ID NO: 22382 - DNA, 21 bp, Homo sapiens
atatcaatacagcaggacttc

SEQ ID NO: 22383 - DNA, 22 bp, Homo sapiens
cagtggaggccttgggaccttt

SEQ ID NO: 22384 - DNA, 22 bp, Homo sapiens
ccacactccccgcaggcgtagg

SEQ ID NO: 22385 - DNA, 22 bp, Homo sapiens
ttctcatgaaactcgcttcctc

SEQ ID NO: 22386 - DNA, 22 bp, Homo sapiens
cttggggaagccactgatccct

SEQ ID NO: 22387 - DNA, 22 bp, Homo sapiens
gatctcaaagcagtgtgggttg

SEQ ID NO: 22388 - DNA, 22 bp, Homo sapiens
aacaattactaccaaggcctgt

SEQ ID NO: 22389 - DNA, 22 bp, Homo sapiens
gggaggcacgaggcgcgcagtg

SEQ ID NO: 22390 - DNA, 21 bp, Homo sapiens
atgcattcctcccctttcctc

SEQ ID NO: 22391 - DNA, 19 bp, Homo sapiens
actgcactccagcctgggt

SEQ ID NO: 22392 - DNA, 22 bp, Homo sapiens
gcctgcagggcctgggcctacc

SEQ ID NO: 22393 - DNA, 22 bp, Homo sapiens
ggcgccagcactgcagcgcctc

SEQ ID NO: 22394 - DNA, 22 bp, Homo sapiens
ctacaaaagtaattgtggtttt

SEQ ID NO: 22395 - DNA, 22 bp, Homo sapiens
ccctgctgtgtagcggaggaac

SEQ ID NO: 22396 - DNA, 22 bp, Homo sapiens
atttagtagagaaattaagaaa

SEQ ID NO: 22397 - DNA, 22 bp, Homo sapiens
aagaagagaactggcatcctaa

SEQ ID NO: 22398 - DNA, 22 bp, Homo sapiens
cactgcactccagcctgggtca

SEQ ID NO: 22399 - DNA, 23 bp, Homo sapiens
aggatgtaggatgtatggcagag

SEQ ID NO: 22400 - DNA, 22 bp, Homo sapiens
gcagaagcacaggtgacgggcc

SEQ ID NO: 22401 - DNA, 21 bp, Homo sapiens
ggccccgcagacccagcacgt

SEQ ID NO: 22402 - DNA, 22 bp, Homo sapiens
taggtagctttggcgtttcttg

SEQ ID NO: 22403 - DNA, 22 bp, Homo sapiens
actttatttcctattgcatcca

SEQ ID NO: 22404 - DNA, 18 bp, Homo sapiens
gacatagctcagagctca

SEQ ID NO: 22405 - DNA, 22 bp, Homo sapiens
ctcatcagaaatacctgacaaa

SEQ ID NO: 22406 - DNA, 22 bp, Homo sapiens
acgcctgtaatcccagcacttt

SEQ ID NO: 22407 - DNA, 22 bp, Homo sapiens
tcactgcaagctccacctcccg

SEQ ID NO: 22408 - DNA, 22 bp, Homo sapiens
aatgtcaaaggctatacattca

SEQ ID NO: 22409 - DNA, 22 bp, Homo sapiens
gaacccggggaggttgcagtga

SEQ ID NO: 22410 - DNA, 22 bp, Homo sapiens
tcaccggtgaccctcggctcgc

SEQ ID NO: 22411 - DNA, 22 bp, Homo sapiens
tgttttaagggtcaactgtcac

SEQ ID NO: 22412 - DNA, 23 bp, Homo sapiens
gtgcgccaggacaacctgacgga

SEQ ID NO: 22413 - DNA, 22 bp, Homo sapiens
aagaaggcggaccagaagggag

SEQ ID NO: 22414 - DNA, 22 bp, Homo sapiens
atgcctgtaatcccagcacttt

SEQ ID NO: 22415 - DNA, 22 bp, Homo sapiens
tttatagtagcatgatttataa

SEQ ID NO: 22416 - DNA, 22 bp, Homo sapiens
tccaccatgtaacaagctctgt

SEQ ID NO: 22417 - DNA, 22 bp, Homo sapiens
ctcattgcaacctccgcctccc

SEQ ID NO: 22418 - DNA, 22 bp, Homo sapiens
cttaatctcacctgcaaagtcc

SEQ ID NO: 22419 - DNA, 22 bp, Homo sapiens
aagcctggactatcgcgtgtgc

SEQ ID NO: 22420 - DNA, 22 bp, Homo sapiens
ttgagcccaggaggcctgggtg

SEQ ID NO: 22421 - DNA, 22 bp, Homo sapiens
ctggcctaggaatggttttccg

SEQ ID NO: 22422 - DNA, 22 bp, Homo sapiens
gggaagagggagctggaatgat

SEQ ID NO: 22423 - DNA, 22 bp, Homo sapiens
tcaaaattaaaccaacgtccag

SEQ ID NO: 22424 - DNA, 22 bp, Homo sapiens
ggaatgaatttccagctgggtc

SEQ ID NO: 22425 - DNA, 22 bp, Homo sapiens
aagatgcggttgaccatggtgt

SEQ ID NO: 22426 - DNA, 22 bp, Homo sapiens
tgaggcaggaggttgagaactg

SEQ ID NO: 22427 - DNA, 22 bp, Homo sapiens
gcagtgccgaaggtagtggttg

SEQ ID NO: 22428 - DNA, 22 bp, Homo sapiens
gcaaaagtacagccggatttct

SEQ ID NO: 22429 - DNA, 22 bp, Homo sapiens
acatcctcccgatctactggct

SEQ ID NO: 22430 - DNA, 22 bp, Homo sapiens
tgggcagggagctggaaccaca

SEQ ID NO: 22431 - DNA, 22 bp, Homo sapiens
ctgagctcacgccattctcctt

SEQ ID NO: 22432 - DNA, 22 bp, Homo sapiens
accccaggaagtggaggtcatg

SEQ ID NO: 22433 - DNA, 22 bp, Homo sapiens
aggaaataggaccagacaaagc

SEQ ID NO: 22434 - DNA, 22 bp, Homo sapiens
acaaggcactttatgaagagga

SEQ ID NO: 22435 - DNA, 22 bp, Homo sapiens
ttcaggcccagcacagcgcgtg

SEQ ID NO: 22436 - DNA, 22 bp, Homo sapiens
cattgcaacttcaaactcctgg

SEQ ID NO: 22437 - DNA, 19 bp, Homo sapiens
catctggatgattctcctg

SEQ ID NO: 22438 - DNA, 22 bp, Homo sapiens
acctcctccaaggagccatagg

SEQ ID NO: 22439 - DNA, 22 bp, Homo sapiens
attggtagttttgtatttctct

SEQ ID NO: 22440 - DNA, 22 bp, Homo sapiens
cccagttgttgccggctctgga

SEQ ID NO: 22441 - DNA, 22 bp, Homo sapiens
agagtactgctgctgggtactg

SEQ ID NO: 22442 - DNA, 22 bp, Homo sapiens
attttctatgttgtaattgtta

SEQ ID NO: 22443 - DNA, 22 bp, Homo sapiens
gctgccttgccctcttcccata

SEQ ID NO: 22444 - DNA, 22 bp, Homo sapiens
gtggaggagaggcgccttgcgg

SEQ ID NO: 22445 - DNA, 22 bp, Homo sapiens
tctcgatctcctgaccttgtga

SEQ ID NO: 22446 - DNA, 22 bp, Homo sapiens
ttggccatctaagcccagccac

SEQ ID NO: 22447 - DNA, 22 bp, Homo sapiens
tgactcctggtatggatgacag

SEQ ID NO: 22448 - DNA, 22 bp, Homo sapiens
ctgcatccatgttgctgcaaag

SEQ ID NO: 22449 - DNA, 22 bp, Homo sapiens
ttaaatattatgttgtctgcaa

SEQ ID NO: 22450 - DNA, 22 bp, Homo sapiens
ccaggaggttgaggctgcagtg

SEQ ID NO: 22451 - DNA, 23 bp, Homo sapiens
actcgtggaattctctgcgatcg

SEQ ID NO: 22452 - DNA, 22 bp, Homo sapiens
gccatgcttggtatgctgtgag

SEQ ID NO: 22453 - DNA, 22 bp, Homo sapiens
caggtgcctcaggatgagacaa

SEQ ID NO: 22454 - DNA, 22 bp, Homo sapiens
ctgccttttaaagccagtgtta

SEQ ID NO: 22455 - DNA, 22 bp, Homo sapiens
caggcaggtcagtgaagaagga

SEQ ID NO: 22456 - DNA, 22 bp, Homo sapiens
cgggcgcactccgggcagctgt

SEQ ID NO: 22457 - DNA, 22 bp, Homo sapiens
cactgcactccagcttgggtga

SEQ ID NO: 22458 - DNA, 22 bp, Homo sapiens
tagtatagattgaagcagatca

SEQ ID NO: 22459 - DNA, 22 bp, Homo sapiens
tttcacagaggaggaagctgag

SEQ ID NO: 22460 - DNA, 22 bp, Homo sapiens
accatgtcatttattggccaaa

SEQ ID NO: 22461 - DNA, 22 bp, Homo sapiens
ctctgctgtgccgccagggcct

SEQ ID NO: 22462 - DNA, 22 bp, Homo sapiens
ctacattaaattggcttactta

SEQ ID NO: 22463 - DNA, 22 bp, Homo sapiens
tccagcagtccatgtgagacac

SEQ ID NO: 22464 - DNA, 18 bp, Homo sapiens
ccctcttgcacaaagcaa

SEQ ID NO: 22465 - DNA, 22 bp, Homo sapiens
ctgagcctcctgcttctatttc

SEQ ID NO: 22466 - DNA, 17 bp, Homo sapiens
acctattgatctgtcac

SEQ ID NO: 22467 - DNA, 22 bp, Homo sapiens
aacccgggaggtggaggttatg

SEQ ID NO: 22468 - DNA, 22 bp, Homo sapiens
tgctcatcaacatgatgatcat

SEQ ID NO: 22469 - DNA, 22 bp, Homo sapiens
tccctgatgccttgatccgtgg

SEQ ID NO: 22470 - DNA, 22 bp, Homo sapiens
tccattatacttctgattcaaa

SEQ ID NO: 22471 - DNA, 22 bp, Homo sapiens
agacactgttctcacatgcttg

SEQ ID NO: 22472 - DNA, 21 bp, Homo sapiens
acacaagcactcgtacatacg

SEQ ID NO: 22473 - DNA, 22 bp, Homo sapiens
gccagggttgccaatgggggca

SEQ ID NO: 22474 - DNA, 22 bp, Homo sapiens
caggaaagggatgggctgccac

SEQ ID NO: 22475 - DNA, 22 bp, Homo sapiens
cttctgagatgttgttttacag

SEQ ID NO: 22476 - DNA, 22 bp, Homo sapiens
tggaagaatatgggggtacaga

SEQ ID NO: 22477 - DNA, 22 bp, Homo sapiens
cactgcacttcagcctgggtga

SEQ ID NO: 22478 - DNA, 22 bp, Homo sapiens
tgaagaaacgcagagaggtagg

SEQ ID NO: 22479 - DNA, 22 bp, Homo sapiens
gctgcagggagctggaaggctc

SEQ ID NO: 22480 - DNA, 22 bp, Homo sapiens
agatgctgctccacaggccagg

SEQ ID NO: 22481 - DNA, 22 bp, Homo sapiens
gtggcccatcacgtttcgcctt

SEQ ID NO: 22482 - DNA, 22 bp, Homo sapiens
ctggcaggttatagagctgccc

SEQ ID NO: 22483 - DNA, 22 bp, Homo sapiens
gggagcaagccggaggtactgt

SEQ ID NO: 22484 - DNA, 22 bp, Homo sapiens
tgggcaggggccctgcttccgt

SEQ ID NO: 22485 - DNA, 22 bp, Homo sapiens
ggtgacctcacctggtcccacc

SEQ ID NO: 22486 - DNA, 22 bp, Homo sapiens
cgtgcgcctcagcctcgtgcgc

SEQ ID NO: 22487 - DNA, 22 bp, Homo sapiens
ttctgcagtgttaacaatgtca

SEQ ID NO: 22488 - DNA, 21 bp, Homo sapiens
atgtagggtttgccttctcta

SEQ ID NO: 22489 - DNA, 22 bp, Homo sapiens
gttgaggtgatgccagccctgc

SEQ ID NO: 22490 - DNA, 22 bp, Homo sapiens
tcccacaggtggagcttgcagt

SEQ ID NO: 22491 - DNA, 22 bp, Homo sapiens
tgatcagcatcttcccagctcg

SEQ ID NO: 22492 - DNA, 22 bp, Homo sapiens
ccaaagtgctgggattacaggc

SEQ ID NO: 22493 - DNA, 19 bp, Homo sapiens
cgcctggcaggccctgcgc

SEQ ID NO: 22494 - DNA, 17 bp, Homo sapiens
tgtatttatcatgtcag

SEQ ID NO: 22495 - DNA, 22 bp, Homo sapiens
gtacacaaagtgagacttgata

SEQ ID NO: 22496 - DNA, 22 bp, Homo sapiens
gagcctggagctggaacgaagc

SEQ ID NO: 22497 - DNA, 22 bp, Homo sapiens
ccaggcagcctgctccattctg

SEQ ID NO: 22498 - DNA, 22 bp, Homo sapiens
tgcttttagctagtaactagta

SEQ ID NO: 22499 - DNA, 22 bp, Homo sapiens
acctgcaggcacaggtgtgcgc

SEQ ID NO: 22500 - DNA, 22 bp, Homo sapiens
atggccaggcacctctggctga

SEQ ID NO: 22501 - DNA, 22 bp, Homo sapiens
tgtgggagaaggaagcaagctg

SEQ ID NO: 22502 - DNA, 22 bp, Homo sapiens
ggagaagaggagctggaagcct

SEQ ID NO: 22503 - DNA, 22 bp, Homo sapiens
gcttggaagtaggattgggaga

SEQ ID NO: 22504 - DNA, 22 bp, Homo sapiens
agtcaggggatctagacttgaa

SEQ ID NO: 22505 - DNA, 22 bp, Homo sapiens
ctcctgcttcacgggcaccgcc

SEQ ID NO: 22506 - DNA, 22 bp, Homo sapiens
aagccctggcgggtggagggcc

SEQ ID NO: 22507 - DNA, 22 bp, Homo sapiens
gcccaggagttcaagtctagtg

SEQ ID NO: 22508 - DNA, 22 bp, Homo sapiens
tcttaattctgtgtcttcacta

SEQ ID NO: 22509 - DNA, 22 bp, Homo sapiens
aaggatgattggtaatgacact

SEQ ID NO: 22510 - DNA, 22 bp, Homo sapiens
tccgggaggcagaggttgcagt

SEQ ID NO: 22511 - DNA, 22 bp, Homo sapiens
caggagtgttgattgctcagga

SEQ ID NO: 22512 - DNA, 22 bp, Homo sapiens
cattgcacaccagcctgggcaa

SEQ ID NO: 22513 - DNA, 22 bp, Homo sapiens
cgcccaggctggagtgcagtga

SEQ ID NO: 22514 - DNA, 22 bp, Homo sapiens
tgggaggccgaggcaggtggat

SEQ ID NO: 22515 - DNA, 22 bp, Homo sapiens
gaaaattattgaaaatggctct

SEQ ID NO: 22516 - DNA, 22 bp, Homo sapiens
accgggaagtcctgcactgggc

SEQ ID NO: 22517 - DNA, 22 bp, Homo sapiens
ttgggtgctgtcatggggcacg

SEQ ID NO: 22518 - DNA, 18 bp, Homo sapiens
tcctttctccctcatctt

SEQ ID NO: 22519 - DNA, 22 bp, Homo sapiens
accagggaccgccacactgcaa

SEQ ID NO: 22520 - DNA, 22 bp, Homo sapiens
atgcacctgaactccatcagct

SEQ ID NO: 22521 - DNA, 22 bp, Homo sapiens
gaaagagaacctgggcctagat

SEQ ID NO: 22522 - DNA, 22 bp, Homo sapiens
cctcctgcacctccaggaactc

SEQ ID NO: 22523 - DNA, 22 bp, Homo sapiens
gcaaacaaggacatacatcctg

SEQ ID NO: 22524 - DNA, 22 bp, Homo sapiens
ggcctttgcgtccacgccgctt

SEQ ID NO: 22525 - DNA, 19 bp, Homo sapiens
catggtgaaaccccgtctc

SEQ ID NO: 22526 - DNA, 22 bp, Homo sapiens
ttgcttcagagggagacacttt

SEQ ID NO: 22527 - DNA, 22 bp, Homo sapiens
cctgcctatgagacgttttgcc

SEQ ID NO: 22528 - DNA, 22 bp, Homo sapiens
cctacagttatattcttgattg

SEQ ID NO: 22529 - DNA, 20 bp, Homo sapiens
agtaggtgtccttcaggata

SEQ ID NO: 22530 - DNA, 22 bp, Homo sapiens
ccctcccaggagtggccagaga

SEQ ID NO: 22531 - DNA, 22 bp, Homo sapiens
tgtcttcgctacaatgaaaagg

SEQ ID NO: 22532 - DNA, 16 bp, Homo sapiens
tgcggcaacttgcggc

SEQ ID NO: 22533 - DNA, 21 bp, Homo sapiens
tctgatggtagatgagatgtg

SEQ ID NO: 22534 - DNA, 22 bp, Homo sapiens
aagtgctgggattataggcatg

SEQ ID NO: 22535 - DNA, 22 bp, Homo sapiens
aaaggtcaaaatcgtgacattg

SEQ ID NO: 22536 - DNA, 22 bp, Homo sapiens
aaagcctcccaggttatgagta

SEQ ID NO: 22537 - DNA, 22 bp, Homo sapiens
cacccaggctggagtgcagtga

SEQ ID NO: 22538 - DNA, 22 bp, Homo sapiens
attgtggtgtcagttataggca

SEQ ID NO: 22539 - DNA, 19 bp, Homo sapiens
gccttcccaccacccgtcc

SEQ ID NO: 22540 - DNA, 22 bp, Homo sapiens
tggagaattctatgttgagggg

SEQ ID NO: 22541 - DNA, 22 bp, Homo sapiens
tccacgctgtgtgaccttgggc

SEQ ID NO: 22542 - DNA, 22 bp, Homo sapiens
agagtgcaaccgaaacaagcag

SEQ ID NO: 22543 - DNA, 22 bp, Homo sapiens
cgggttcacgccattctcctgc

SEQ ID NO: 22544 - DNA, 22 bp, Homo sapiens
gcacacggcagcctcctcctga

SEQ ID NO: 22545 - DNA, 22 bp, Homo sapiens
gtgcaggacagcacatctcctg

SEQ ID NO: 22546 - DNA, 20 bp, Homo sapiens
tcacatcctctcccaacatg

SEQ ID NO: 22547 - DNA, 22 bp, Homo sapiens
gacaggaggcagagctcaggtg

SEQ ID NO: 22548 - DNA, 22 bp, Homo sapiens
tcttgaattgtactcccataag

SEQ ID NO: 22549 - DNA, 22 bp, Homo sapiens
tggtattacttctagacacaag

SEQ ID NO: 22550 - DNA, 22 bp, Homo sapiens
cctgcctactgagttttatatt

SEQ ID NO: 22551 - DNA, 22 bp, Homo sapiens
agtgaagctggagaaaggcagt

SEQ ID NO: 22552 - DNA, 22 bp, Homo sapiens
agctggtgtgccagttccagtt

SEQ ID NO: 22553 - DNA, 22 bp, Homo sapiens
ccaggctggagtgcaatggcgt

SEQ ID NO: 22554 - DNA, 22 bp, Homo sapiens
gggatgcagactacagggctta

SEQ ID NO: 22555 - DNA, 22 bp, Homo sapiens
gcagggaggtttgctgacctgg

SEQ ID NO: 22556 - DNA, 21 bp, Homo sapiens
tggcggggacttgtggctgcc

SEQ ID NO: 22557 - DNA, 22 bp, Homo sapiens
taaaatttgtccctgagtgttg

SEQ ID NO: 22558 - DNA, 22 bp, Homo sapiens
caggcagggagctggaaaggat

SEQ ID NO: 22559 - DNA, 22 bp, Homo sapiens
gaccctgtttctacaaataatt

SEQ ID NO: 22560 - DNA, 22 bp, Homo sapiens
acagagcaatgcgtgttctcta

SEQ ID NO: 22561 - DNA, 22 bp, Homo sapiens
gtgggacaaggatgaagatatt

SEQ ID NO: 22562 - DNA, 22 bp, Homo sapiens
cacctagggtttcgcctttctt

SEQ ID NO: 22563 - DNA, 22 bp, Homo sapiens
tctgacattttgagaatgacat

SEQ ID NO: 22564 - DNA, 22 bp, Homo sapiens
tgtcatagtgtggtagcagtgg

SEQ ID NO: 22565 - DNA, 22 bp, Homo sapiens
aaagatgttgctgctccgccct

SEQ ID NO: 22566 - DNA, 17 bp, Homo sapiens
gctactggttacctcta

SEQ ID NO: 22567 - DNA, 22 bp, Homo sapiens
gctgctctccaagcctccttga

SEQ ID NO: 22568 - DNA, 22 bp, Homo sapiens
tgaagaaacgcagagaggtagg

SEQ ID NO: 22569 - DNA, 22 bp, Homo sapiens
ggcatagcggctcagcgtccag

SEQ ID NO: 22570 - DNA, 22 bp, Homo sapiens
gtgcgcttcttcctgagccagg

SEQ ID NO: 22571 - DNA, 22 bp, Homo sapiens
gactttggttcagggctcagag

SEQ ID NO: 22572 - DNA, 22 bp, Homo sapiens
ctcaggagttggaggctacagt

SEQ ID NO: 22573 - DNA, 22 bp, Homo sapiens
tgtaggagtccaatcaggagac

SEQ ID NO: 22574 - DNA, 19 bp, Homo sapiens
ctgtccttggctgcactgt

SEQ ID NO: 22575 - DNA, 22 bp, Homo sapiens
attataggcttgagccaccgtg

SEQ ID NO: 22576 - DNA, 22 bp, Homo sapiens
aactaatacattaatacatgtg

SEQ ID NO: 22577 - DNA, 22 bp, Homo sapiens
caagtggtttatgggagttcca

SEQ ID NO: 22578 - DNA, 22 bp, Homo sapiens
gctgtctcatacaaggccctgc

SEQ ID NO: 22579 - DNA, 22 bp, Homo sapiens
cttgcacgcacatatttgtgca

SEQ ID NO: 22580 - DNA, 19 bp, Homo sapiens
ctgctgccggagactcgtc

SEQ ID NO: 22581 - DNA, 22 bp, Homo sapiens
tctgggtccgggactgtggatg

SEQ ID NO: 22582 - DNA, 22 bp, Homo sapiens
cattgcactccagtctgggcca

SEQ ID NO: 22583 - DNA, 14 bp, Homo sapiens
aagatcaccttcct

SEQ ID NO: 22584 - DNA, 22 bp, Homo sapiens
cctgacaggcggaggctgcagt

SEQ ID NO: 22585 - DNA, 22 bp, Homo sapiens
taactaggattacaagcgtgcg

SEQ ID NO: 22586 - DNA, 22 bp, Homo sapiens
gggagctgaaggagccggcggg

SEQ ID NO: 22587 - DNA, 22 bp, Homo sapiens
ctctgcctcccaggttcaagcg

SEQ ID NO: 22588 - DNA, 22 bp, Homo sapiens
gtttcactgcaaactgactttt

SEQ ID NO: 22589 - DNA, 22 bp, Homo sapiens
agggaagaggaccagagtctct

SEQ ID NO: 22590 - DNA, 22 bp, Homo sapiens
aggattgtgcctccagtcagaa

SEQ ID NO: 22591 - DNA, 22 bp, Homo sapiens
ccttttatagatcagtgtgtta

SEQ ID NO: 22592 - DNA, 22 bp, Homo sapiens
agcgacaccgcctgcaggccat

SEQ ID NO: 22593 - DNA, 22 bp, Homo sapiens
ctgggcaaattgtgccagctat

SEQ ID NO: 22594 - DNA, 22 bp, Homo sapiens
gtctctatcatagctgaaccct

SEQ ID NO: 22595 - DNA, 22 bp, Homo sapiens
tcccggcgctgggaggtgggtc

SEQ ID NO: 22596 - DNA, 22 bp, Homo sapiens
tacgcctgtaatcccagcactt

SEQ ID NO: 22597 - DNA, 22 bp, Homo sapiens
tgcagtttaaacttggcaactt

SEQ ID NO: 22598 - DNA, 22 bp, Homo sapiens
tatcacatttggagatttatga

SEQ ID NO: 22599 - DNA, 22 bp, Homo sapiens
tagggtagtaccatgctgccag

SEQ ID NO: 22600 - DNA, 22 bp, Homo sapiens
tgagtgattaggtttttccttc

SEQ ID NO: 22601 - DNA, 22 bp, Homo sapiens
ctcccataattctcatatgtca

SEQ ID NO: 22602 - DNA, 22 bp, Homo sapiens
tttgtgaataggttggcttcca

SEQ ID NO: 22603 - DNA, 22 bp, Homo sapiens
tgtgattgtagtatacatatta

SEQ ID NO: 22604 - DNA, 22 bp, Homo sapiens
cccaggctggagtgtaatggtg

SEQ ID NO: 22605 - DNA, 20 bp, Homo sapiens
acctcctggcgggcatcctc

SEQ ID NO: 22606 - DNA, 22 bp, Homo sapiens
caggctggagtgcagtggggcg

SEQ ID NO: 22607 - DNA, 22 bp, Homo sapiens
ccagggtggcgtagatgctggg

SEQ ID NO: 22608 - DNA, 22 bp, Homo sapiens
cctggaggcggaggttgcagtg

SEQ ID NO: 22609 - DNA, 22 bp, Homo sapiens
agcagctcctgtttttgggata

SEQ ID NO: 22610 - DNA, 22 bp, Homo sapiens
cattgctttgtgcatatttaaa

SEQ ID NO: 22611 - DNA, 22 bp, Homo sapiens
ggggtctcactatgttacccag

SEQ ID NO: 22612 - DNA, 22 bp, Homo sapiens
ttctgccatctgcagaagggga

SEQ ID NO: 22613 - DNA, 22 bp, Homo sapiens
aagcctggcacattggagtctg

SEQ ID NO: 22614 - DNA, 17 bp, Homo sapiens
gtaaggcttgcagatgc

SEQ ID NO: 22615 - DNA, 22 bp, Homo sapiens
actgaactccagcctgggtggc

SEQ ID NO: 22616 - DNA, 22 bp, Homo sapiens
tttcaggacacctttaaaaacg

SEQ ID NO: 22617 - DNA, 22 bp, Homo sapiens
ccagaggagttgaggctttggg

SEQ ID NO: 22618 - DNA, 22 bp, Homo sapiens
tgaatgtatggtcctgtgaatt

SEQ ID NO: 22619 - DNA, 21 bp, Homo sapiens
agatcctggggtctggggagg

SEQ ID NO: 22620 - DNA, 22 bp, Homo sapiens
gctctgccagcccaaggcgcag

SEQ ID NO: 22621 - DNA, 22 bp, Homo sapiens
agccactttagataccatctta

SEQ ID NO: 22622 - DNA, 22 bp, Homo sapiens
ctggccagatgttacgtccaat

SEQ ID NO: 22623 - DNA, 22 bp, Homo sapiens
aaatcgcttgaacccaggaagt

SEQ ID NO: 22624 - DNA, 22 bp, Homo sapiens
gggcagagactcagaaacagaa

SEQ ID NO: 22625 - DNA, 22 bp, Homo sapiens
catgggtaagactcttttgccc

SEQ ID NO: 22626 - DNA, 22 bp, Homo sapiens
aatggaatacctaggtggccca

SEQ ID NO: 22627 - DNA, 22 bp, Homo sapiens
tctgcatattgttaatggaatg

SEQ ID NO: 22628 - DNA, 22 bp, Homo sapiens
cattgcactccagctctgggcg

SEQ ID NO: 22629 - DNA, 22 bp, Homo sapiens
ccaccagctgcatatgcacgta

SEQ ID NO: 22630 - DNA, 22 bp, Homo sapiens
atacaaagtattaatcctggat

SEQ ID NO: 22631 - DNA, 22 bp, Homo sapiens
gaggctgcagctatcagacatt

SEQ ID NO: 22632 - DNA, 22 bp, Homo sapiens
tgtgtttctgagaatcccacct

SEQ ID NO: 22633 - DNA, 22 bp, Homo sapiens
agatacattgcacgatgcagat

SEQ ID NO: 22634 - DNA, 19 bp, Homo sapiens
aggctaaagagtcttgcgt

SEQ ID NO: 22635 - DNA, 22 bp, Homo sapiens
tctcatggagtcaggagcagaa

SEQ ID NO: 22636 - DNA, 22 bp, Homo sapiens
atggaatgtttatacacagttg

SEQ ID NO: 22637 - DNA, 22 bp, Homo sapiens
tgggatgccggcaggaggcaat

SEQ ID NO: 22638 - DNA, 22 bp, Homo sapiens
cttagagatgggttttacttag

SEQ ID NO: 22639 - DNA, 22 bp, Homo sapiens
cttatttgcccatgtttcttta

SEQ ID NO: 22640 - DNA, 22 bp, Homo sapiens
gcagggaggtttgctgacctgg

SEQ ID NO: 22641 - DNA, 22 bp, Homo sapiens
aatgagatggaattcccgccta

SEQ ID NO: 22642 - DNA, 22 bp, Homo sapiens
atcccaggcggcacaggttgca

SEQ ID NO: 22643 - DNA, 22 bp, Homo sapiens
aagtgtgtgagcctgtcaggct

SEQ ID NO: 22644 - DNA, 22 bp, Homo sapiens
tgaaggggttcagcatgggggt

SEQ ID NO: 22645 - DNA, 22 bp, Homo sapiens
tgttaaatgctcagctcgggga

SEQ ID NO: 22646 - DNA, 22 bp, Homo sapiens
atgcagaagactgaaaagctga

SEQ ID NO: 22647 - DNA, 22 bp, Homo sapiens
ctttttcctcgtagagcctaat

SEQ ID NO: 22648 - DNA, 22 bp, Homo sapiens
cacactgtctttcagaatggtt

SEQ ID NO: 22649 - DNA, 22 bp, Homo sapiens
tgcgcctgtaagtccagagtcc

SEQ ID NO: 22650 - DNA, 22 bp, Homo sapiens
agtattacatggccaatctcct

SEQ ID NO: 22651 - DNA, 22 bp, Homo sapiens
ctgtccatattcaaggggtagg

SEQ ID NO: 22652 - DNA, 22 bp, Homo sapiens
tccagggccatctccatgaggc

SEQ ID NO: 22653 - DNA, 22 bp, Homo sapiens
cgatgaatatttaacgctgtga

SEQ ID NO: 22654 - DNA, 22 bp, Homo sapiens
agcaacacgcagtagtatacga

SEQ ID NO: 22655 - DNA, 22 bp, Homo sapiens
gcccgcagagatctttaacaaa

SEQ ID NO: 22656 - DNA, 22 bp, Homo sapiens
atatgtggcattatttctgagg

SEQ ID NO: 22657 - DNA, 22 bp, Homo sapiens
cactgcaagctccgcctctggg

SEQ ID NO: 22658 - DNA, 22 bp, Homo sapiens
tgctccatgcgctcggccggcg

SEQ ID NO: 22659 - DNA, 22 bp, Homo sapiens
ttctaggcctggcttgggccca

SEQ ID NO: 22660 - DNA, 22 bp, Homo sapiens
gcttacaggtgaggcagcaaga

SEQ ID NO: 22661 - DNA, 22 bp, Homo sapiens
tcgggctcgctctcctagcgga

SEQ ID NO: 22662 - DNA, 22 bp, Homo sapiens
aactgcgattacttttgcacca

SEQ ID NO: 22663 - DNA, 22 bp, Homo sapiens
gacagctgcatcctcagacaca

SEQ ID NO: 22664 - DNA, 22 bp, Homo sapiens
ggtaacttagctcatggctgtg

SEQ ID NO: 22665 - DNA, 22 bp, Homo sapiens
gaggtgctgctgtacttcttgc

SEQ ID NO: 22666 - DNA, 22 bp, Homo sapiens
gccctccagcctgtggaaccgg

SEQ ID NO: 22667 - DNA, 22 bp, Homo sapiens
ttgcaattgctatggagagcgt

SEQ ID NO: 22668 - DNA, 22 bp, Homo sapiens
tatctaataaatctgataagta

SEQ ID NO: 22669 - DNA, 22 bp, Homo sapiens
ggctccctgcaacctccgcctc

SEQ ID NO: 22670 - DNA, 22 bp, Homo sapiens
taaggcaggaactggctgtttt

SEQ ID NO: 22671 - DNA, 22 bp, Homo sapiens
gtggatggccctgcacacaggt

SEQ ID NO: 22672 - DNA, 22 bp, Homo sapiens
gcttggcccattgatcagctgg

SEQ ID NO: 22673 - DNA, 22 bp, Homo sapiens
catgttggtgtgctgcacccgt

SEQ ID NO: 22674 - DNA, 22 bp, Homo sapiens
tacttttcctggaaccactgct

SEQ ID NO: 22675 - DNA, 22 bp, Homo sapiens
gaggttggttccaaccctccca

SEQ ID NO: 22676 - DNA, 22 bp, Homo sapiens
aacactgcctacactttatgaa

SEQ ID NO: 22677 - DNA, 22 bp, Homo sapiens
tagattatccctgatttgtcca

SEQ ID NO: 22678 - DNA, 22 bp, Homo sapiens
tggtacaatcacagctcactgt

SEQ ID NO: 22679 - DNA, 22 bp, Homo sapiens
atgaggcaggagtgcagtggca

SEQ ID NO: 22680 - DNA, 22 bp, Homo sapiens
agcttgtgctggaattacatgt

SEQ ID NO: 22681 - DNA, 22 bp, Homo sapiens
tgcctgtgtcagcaggtggaag

SEQ ID NO: 22682 - DNA, 22 bp, Homo sapiens
ggctcactacaacctccgcctt

SEQ ID NO: 22683 - DNA, 22 bp, Homo sapiens
cagccagtgtgaccgaggagga

SEQ ID NO: 22684 - DNA, 22 bp, Homo sapiens
tcactgcaagctctgccttccg

SEQ ID NO: 22685 - DNA, 22 bp, Homo sapiens
tgcagcactgttcacaatagcc

SEQ ID NO: 22686 - DNA, 18 bp, Homo sapiens
atactagagctctttgcc

SEQ ID NO: 22687 - DNA, 22 bp, Homo sapiens
cagtcctgaatactggacggtg

SEQ ID NO: 22688 - DNA, 22 bp, Homo sapiens
tgggcttaggtcggaggcggcc

SEQ ID NO: 22689 - DNA, 22 bp, Homo sapiens
agctacctgatccttcttctga

SEQ ID NO: 22690 - DNA, 22 bp, Homo sapiens
tcaggcaatctgacagctggag

SEQ ID NO: 22691 - DNA, 22 bp, Homo sapiens
atgagctcatccgagtcacact

SEQ ID NO: 22692 - DNA, 22 bp, Homo sapiens
gagagtgagatcctcctgggga

SEQ ID NO: 22693 - DNA, 22 bp, Homo sapiens
ttcataaacaaattaaggcctg

SEQ ID NO: 22694 - DNA, 22 bp, Homo sapiens
accacctcatcaagctggattg

SEQ ID NO: 22695 - DNA, 22 bp, Homo sapiens
gttcagatttgactggtttctc

SEQ ID NO: 22696 - DNA, 19 bp, Homo sapiens
gggaatgatggaagacttc

SEQ ID NO: 22697 - DNA, 22 bp, Homo sapiens
gcagggttttatagatctcttc

SEQ ID NO: 22698 - DNA, 22 bp, Homo sapiens
tcctgccaggagatggtagcca

SEQ ID NO: 22699 - DNA, 20 bp, Homo sapiens
gataatatttactaggtact

SEQ ID NO: 22700 - DNA, 22 bp, Homo sapiens
agctgcaccggctggaccactg

SEQ ID NO: 22701 - DNA, 22 bp, Homo sapiens
ggaggacaggggctgcagcaca

SEQ ID NO: 22702 - DNA, 22 bp, Homo sapiens
ttagggttacaccagcctcctg

SEQ ID NO: 22703 - DNA, 22 bp, Homo sapiens
cttatagtatgatgttgagaat

SEQ ID NO: 22704 - DNA, 22 bp, Homo sapiens
ccactgtgcccagcctcatggg

SEQ ID NO: 22705 - DNA, 22 bp, Homo sapiens
gtcctaccatgaattcactcca

SEQ ID NO: 22706 - DNA, 22 bp, Homo sapiens
attgggatgccggctgataaga

SEQ ID NO: 22707 - DNA, 22 bp, Homo sapiens
tgctgggctggggcctcagacc

SEQ ID NO: 22708 - DNA, 22 bp, Homo sapiens
acccccaagaggggccttcagc

SEQ ID NO: 22709 - DNA, 22 bp, Homo sapiens
aaggagaggttgtccgtgttgt

SEQ ID NO: 22710 - DNA, 22 bp, Homo sapiens
gccaggacctcagatgcagggc

SEQ ID NO: 22711 - DNA, 22 bp, Homo sapiens
ggtgacggggcccaggtttcct

SEQ ID NO: 22712 - DNA, 22 bp, Homo sapiens
ccaaagtgctggggttacaggc

SEQ ID NO: 22713 - DNA, 22 bp, Homo sapiens
tgagctgacacccaatcatact

SEQ ID NO: 22714 - DNA, 22 bp, Homo sapiens
ctcagccccagcccagatagca

SEQ ID NO: 22715 - DNA, 22 bp, Homo sapiens
tgggatgccctgaccctctgga

SEQ ID NO: 22716 - DNA, 22 bp, Homo sapiens
atgattgaccatctgctgggct

SEQ ID NO: 22717 - DNA, 22 bp, Homo sapiens
atccatttgacataatttcagc

SEQ ID NO: 22718 - DNA, 22 bp, Homo sapiens
tctgagccagggtctcctccct

SEQ ID NO: 22719 - DNA, 22 bp, Homo sapiens
gggccctgcgactcgcggcgga

SEQ ID NO: 22720 - DNA, 20 bp, Homo sapiens
ctgggtggcaagcaaggggg

SEQ ID NO: 22721 - DNA, 22 bp, Homo sapiens
attcacatttagcctctgacat

SEQ ID NO: 22722 - DNA, 22 bp, Homo sapiens
ctgcaagctacccctagcatca

SEQ ID NO: 22723 - DNA, 22 bp, Homo sapiens
cgagagagacatggtgacctgc

SEQ ID NO: 22724 - DNA, 22 bp, Homo sapiens
tgtttcttacgtttttagaggc

SEQ ID NO: 22725 - DNA, 19 bp, Homo sapiens
gactccaactttaagcatg

SEQ ID NO: 22726 - DNA, 22 bp, Homo sapiens
ttctccgctaagttctctgcag

SEQ ID NO: 22727 - DNA, 22 bp, Homo sapiens
gctcactgcctgggcaacaaga

SEQ ID NO: 22728 - DNA, 22 bp, Homo sapiens
cactccagtctgggaacaaagc

SEQ ID NO: 22729 - DNA, 22 bp, Homo sapiens
atttcccagggcctgggatttg

SEQ ID NO: 22730 - DNA, 22 bp, Homo sapiens
gaccagtcattactcatgccct

SEQ ID NO: 22731 - DNA, 22 bp, Homo sapiens
ctcctctttagccccagctgga

SEQ ID NO: 22732 - DNA, 22 bp, Homo sapiens
tcccgttgatgacggtgcatcc

SEQ ID NO: 22733 - DNA, 22 bp, Homo sapiens
aacactgctgctgggttctgtg

SEQ ID NO: 22734 - DNA, 22 bp, Homo sapiens
tcagccagccagctacaggctt

SEQ ID NO: 22735 - DNA, 22 bp, Homo sapiens
actggggtttaggcctgggcaa

SEQ ID NO: 22736 - DNA, 22 bp, Homo sapiens
gtagaggtagacttccttgtct

SEQ ID NO: 22737 - DNA, 22 bp, Homo sapiens
cagcacatgctcatcagggaag

SEQ ID NO: 22738 - DNA, 22 bp, Homo sapiens
gcggcggagacagcaggaagcc

SEQ ID NO: 22739 - DNA, 22 bp, Homo sapiens
atcacaaaggtctcagagcaca

SEQ ID NO: 22740 - DNA, 22 bp, Homo sapiens
gaaaaggcctggggcaaagtgt

SEQ ID NO: 22741 - DNA, 20 bp, Homo sapiens
tgagacccgctgacaagttc

SEQ ID NO: 22742 - DNA, 22 bp, Homo sapiens
tcctgccaccgggggtggcgat

SEQ ID NO: 22743 - DNA, 22 bp, Homo sapiens
actggggctgatgcgttcgtgt

SEQ ID NO: 22744 - DNA, 22 bp, Homo sapiens
ctgctgagccgcacccaggagc

SEQ ID NO: 22745 - DNA, 22 bp, Homo sapiens
agagcgagtctggggctcggat

SEQ ID NO: 22746 - DNA, 22 bp, Homo sapiens
ccacaagtttgttgattgaaac

SEQ ID NO: 22747 - DNA, 22 bp, Homo sapiens
gaccaagatacagcatcataga

SEQ ID NO: 22748 - DNA, 22 bp, Homo sapiens
agaatttcctatgagagattcc

SEQ ID NO: 22749 - DNA, 22 bp, Homo sapiens
agctcctgaaaatccagactgg

SEQ ID NO: 22750 - DNA, 22 bp, Homo sapiens
ggagtgactctcggggccacta

SEQ ID NO: 22751 - DNA, 22 bp, Homo sapiens
atgtcactgttgttattgttat

SEQ ID NO: 22752 - DNA, 22 bp, Homo sapiens
atgtaattattaacacctgtgc

SEQ ID NO: 22753 - DNA, 22 bp, Homo sapiens
ccacaggggcccacgagccgct

SEQ ID NO: 22754 - DNA, 22 bp, Homo sapiens
tataactacttgaagagttcag

SEQ ID NO: 22755 - DNA, 22 bp, Homo sapiens
atgtttaaagggttgagaaata

SEQ ID NO: 22756 - DNA, 16 bp, Homo sapiens
gcaggcagatcacatg

SEQ ID NO: 22757 - DNA, 22 bp, Homo sapiens
taagggttcagaatgcagtggt

SEQ ID NO: 22758 - DNA, 22 bp, Homo sapiens
accgcagtgacgtgggacttcc

SEQ ID NO: 22759 - DNA, 22 bp, Homo sapiens
gcctgcagggcctgggcctacc

SEQ ID NO: 22760 - DNA, 21 bp, Homo sapiens
ggccgccgccttgtgctctgc

SEQ ID NO: 22761 - DNA, 18 bp, Homo sapiens
taatccatatgctttgcc

SEQ ID NO: 22762 - DNA, 22 bp, Homo sapiens
cccctcttggcattgagtgcca

SEQ ID NO: 22763 - DNA, 22 bp, Homo sapiens
tgcatattatgtgtatctgtct

SEQ ID NO: 22764 - DNA, 22 bp, Homo sapiens
ttggccatctaagcccagccac

SEQ ID NO: 22765 - DNA, 22 bp, Homo sapiens
agggcgacaatggagagcgttt

SEQ ID NO: 22766 - DNA, 22 bp, Homo sapiens
atgggttcaagtgattctcctg

SEQ ID NO: 22767 - DNA, 22 bp, Homo sapiens
ttgggcctctcaaagtgctggg

SEQ ID NO: 22768 - DNA, 22 bp, Homo sapiens
ggtatactgcatgacattgggg

SEQ ID NO: 22769 - DNA, 22 bp, Homo sapiens
tcaagagttggtcaaatccaaa

SEQ ID NO: 22770 - DNA, 22 bp, Homo sapiens
ctgaggtgtgaaatggtggcaa

SEQ ID NO: 22771 - DNA, 22 bp, Homo sapiens
tttgttttcaatgtgtcattca

SEQ ID NO: 22772 - DNA, 23 bp, Homo sapiens
ttgggcaaatcactaacgtctcc

SEQ ID NO: 22773 - DNA, 22 bp, Homo sapiens
tttgggttcagacatgattaca

SEQ ID NO: 22774 - DNA, 22 bp, Homo sapiens
gcggggcctgactctgacccgc

SEQ ID NO: 22775 - DNA, 22 bp, Homo sapiens
aaacatggccattcagactgtg

SEQ ID NO: 22776 - DNA, 22 bp, Homo sapiens
ttggagaggcagtcttgctctg

SEQ ID NO: 22777 - DNA, 22 bp, Homo sapiens
tcggtgcgcgaggcgcggtccc

SEQ ID NO: 22778 - DNA, 22 bp, Homo sapiens
gtagtcccagctaccccggagg

SEQ ID NO: 22779 - DNA, 22 bp, Homo sapiens
tagatttgtttccttctctcca

SEQ ID NO: 22780 - DNA, 22 bp, Homo sapiens
gtctctcaaaactagaagagaa

SEQ ID NO: 22781 - DNA, 22 bp, Homo sapiens
attgtcgtcaatggacacatag

SEQ ID NO: 22782 - DNA, 16 bp, Homo sapiens
cttggtgttggcagag

SEQ ID NO: 22783 - DNA, 22 bp, Homo sapiens
tggaatcattgctgtgttgctt

SEQ ID NO: 22784 - DNA, 21 bp, Homo sapiens
accaccctgtttatccagagg

SEQ ID NO: 22785 - DNA, 22 bp, Homo sapiens
aactcactttgtggcttctgaa

SEQ ID NO: 22786 - DNA, 19 bp, Homo sapiens
accttctgggaaacattcc

SEQ ID NO: 22787 - DNA, 22 bp, Homo sapiens
aaaagttattgatgcaggacaa

SEQ ID NO: 22788 - DNA, 22 bp, Homo sapiens
ctggaatctttggagaatgtgg

SEQ ID NO: 22789 - DNA, 22 bp, Homo sapiens
ctgattaaaaacaggttctgag

SEQ ID NO: 22790 - DNA, 22 bp, Homo sapiens
ccaggaggtggagattgcagtg

SEQ ID NO: 22791 - DNA, 22 bp, Homo sapiens
caggctggagtacaattgtgtg

SEQ ID NO: 22792 - DNA, 22 bp, Homo sapiens
ttcctggtctatttagaattgc

SEQ ID NO: 22793 - DNA, 22 bp, Homo sapiens
tgcgatggcgtagacaaatccc

SEQ ID NO: 22794 - DNA, 22 bp, Homo sapiens
tagttagagaagccacagtgga

SEQ ID NO: 22795 - DNA, 22 bp, Homo sapiens
ctcctgagctctgaggaagctt

SEQ ID NO: 22796 - DNA, 22 bp, Homo sapiens
atttcctgcaaggagtgggttt

SEQ ID NO: 22797 - DNA, 22 bp, Homo sapiens
gcttcggggtccaagcgcgtgt

SEQ ID NO: 22798 - DNA, 22 bp, Homo sapiens
gcccagcgagcagaggtggacg

SEQ ID NO: 22799 - DNA, 19 bp, Homo sapiens
ccatggcaatgatctgatg

SEQ ID NO: 22800 - DNA, 22 bp, Homo sapiens
ggaaaagtgttaaggtgttgat

SEQ ID NO: 22801 - DNA, 22 bp, Homo sapiens
cgcccccagggcctcgagcatg

SEQ ID NO: 22802 - DNA, 21 bp, Homo sapiens
tcagtggctcctggtgacgtc

SEQ ID NO: 22803 - DNA, 22 bp, Homo sapiens
tccccagcttgctacttctgct

SEQ ID NO: 22804 - DNA, 22 bp, Homo sapiens
aacgcccgtggttgccaaggta

SEQ ID NO: 22805 - DNA, 22 bp, Homo sapiens
aggaagatgtgcaaagttggaa

SEQ ID NO: 22806 - DNA, 22 bp, Homo sapiens
tgttatcctcagctcacctcta

SEQ ID NO: 22807 - DNA, 22 bp, Homo sapiens
tttgtagcagcatgatttataa

SEQ ID NO: 22808 - DNA, 22 bp, Homo sapiens
tctggctccaggaccgggcaca

SEQ ID NO: 22809 - DNA, 22 bp, Homo sapiens
ttctgtccctctagagaaccat

SEQ ID NO: 22810 - DNA, 22 bp, Homo sapiens
ttttggctctgtctgtatcttt

SEQ ID NO: 22811 - DNA, 22 bp, Homo sapiens
agggcagagctgtctaaatggc

SEQ ID NO: 22812 - DNA, 22 bp, Homo sapiens
ttgggtgctgtcatggggcacg

SEQ ID NO: 22813 - DNA, 22 bp, Homo sapiens
agaagcattggaccaggggccc

SEQ ID NO: 22814 - DNA, 22 bp, Homo sapiens
gggctgtaggagctggaatggg

SEQ ID NO: 22815 - DNA, 22 bp, Homo sapiens
cgggaaggtggaggttgcagtg

SEQ ID NO: 22816 - DNA, 22 bp, Homo sapiens
gagactgtcacttgggacctgt

SEQ ID NO: 22817 - DNA, 22 bp, Homo sapiens
tggtgggctgagtctcatcgga

SEQ ID NO: 22818 - DNA, 22 bp, Homo sapiens
gggcactcctctggtccagccc

SEQ ID NO: 22819 - DNA, 22 bp, Homo sapiens
tgatcaaaacattactccacca

SEQ ID NO: 22820 - DNA, 22 bp, Homo sapiens
gggttgtagagctggaagggga

SEQ ID NO: 22821 - DNA, 22 bp, Homo sapiens
acccaggagacggaggtgcagt

SEQ ID NO: 22822 - DNA, 22 bp, Homo sapiens
gggcggatcatttgaggtcagg

SEQ ID NO: 22823 - DNA, 22 bp, Homo sapiens
ctcagctgcagcctggctggca

SEQ ID NO: 22824 - DNA, 22 bp, Homo sapiens
tgcaaatgtgttttaaaccaaa

SEQ ID NO: 22825 - DNA, 22 bp, Homo sapiens
tgtccaggctggagtgcagtgg

SEQ ID NO: 22826 - DNA, 19 bp, Homo sapiens
ggctgccttctgctcatct

SEQ ID NO: 22827 - DNA, 22 bp, Homo sapiens
cagctggcgactctcctcgatg

SEQ ID NO: 22828 - DNA, 22 bp, Homo sapiens
tcatgctatgagcgagggcctg

SEQ ID NO: 22829 - DNA, 15 bp, Homo sapiens
tggtggtgttgagac

SEQ ID NO: 22830 - DNA, 22 bp, Homo sapiens
caccgcggagtgatggagaaac

SEQ ID NO: 22831 - DNA, 22 bp, Homo sapiens
gagaagtcatttgaccacctag

SEQ ID NO: 22832 - DNA, 22 bp, Homo sapiens
ttggcttttatgcagcttaggt

SEQ ID NO: 22833 - DNA, 22 bp, Homo sapiens
gagcatcgctgagatcccagac

SEQ ID NO: 22834 - DNA, 22 bp, Homo sapiens
tgttttaagggtcaactgtcac

SEQ ID NO: 22835 - DNA, 22 bp, Homo sapiens
agaagtatcaggaagattctca

SEQ ID NO: 22836 - DNA, 22 bp, Homo sapiens
cttcagctcttggtaaatgttt

SEQ ID NO: 22837 - DNA, 22 bp, Homo sapiens
gttcaagaccagcctggccaac

SEQ ID NO: 22838 - DNA, 22 bp, Homo sapiens
ttgcatcagaattacttggagg

SEQ ID NO: 22839 - DNA, 22 bp, Homo sapiens
ttgtgctcctatgagaatctaa

SEQ ID NO: 22840 - DNA, 22 bp, Homo sapiens
ccatcacagtccccatcgtgat

SEQ ID NO: 22841 - DNA, 22 bp, Homo sapiens
gcaccaccaccatcggcacctc

SEQ ID NO: 22842 - DNA, 17 bp, Homo sapiens
ttgaatgcattacttgg

SEQ ID NO: 22843 - DNA, 22 bp, Homo sapiens
ctagttctagatccctgaggaa

SEQ ID NO: 22844 - DNA, 21 bp, Homo sapiens
cagaggcctatcacagactcc

SEQ ID NO: 22845 - DNA, 22 bp, Homo sapiens
gacccaggggcagggagaaagt

SEQ ID NO: 22846 - DNA, 22 bp, Homo sapiens
agaatccctggggagctgcagc

SEQ ID NO: 22847 - DNA, 22 bp, Homo sapiens
ttccacggggctccccgctctt

SEQ ID NO: 22848 - DNA, 22 bp, Homo sapiens
ctggcctaggaatggttttccg

SEQ ID NO: 22849 - DNA, 20 bp, Homo sapiens
tgggatcgaatcaagtctgt

SEQ ID NO: 22850 - DNA, 22 bp, Homo sapiens
cagtgacgtaaactgcatgtgc

SEQ ID NO: 22851 - DNA, 22 bp, Homo sapiens
agccagggtctctcgctctgtt

SEQ ID NO: 22852 - DNA, 22 bp, Homo sapiens
ggggtgtggacggctgtgccag

SEQ ID NO: 22853 - DNA, 22 bp, Homo sapiens
aacttgccaagagctttgctag

SEQ ID NO: 22854 - DNA, 22 bp, Homo sapiens
ttctgatgaggaggtctctaag

SEQ ID NO: 22855 - DNA, 22 bp, Homo sapiens
gcgcaccacctccaggtggccg

SEQ ID NO: 22856 - DNA, 22 bp, Homo sapiens
gtataggtgagggacttgatca

SEQ ID NO: 22857 - DNA, 22 bp, Homo sapiens
taaaatttgtccctgagtgttg

SEQ ID NO: 22858 - DNA, 22 bp, Homo sapiens
aggggtgaaagagggccctcaa

SEQ ID NO: 22859 - DNA, 22 bp, Homo sapiens
gtcagatctttggggatgctgt

SEQ ID NO: 22860 - DNA, 22 bp, Homo sapiens
ttcccacagtgactccagagaa

SEQ ID NO: 22861 - DNA, 22 bp, Homo sapiens
agctcttacatttaggtctatg

SEQ ID NO: 22862 - DNA, 22 bp, Homo sapiens
actgcaacctccacctcctggg

SEQ ID NO: 22863 - DNA, 22 bp, Homo sapiens
attacctatttcattttctgtc

SEQ ID NO: 22864 - DNA, 22 bp, Homo sapiens
cagaagatctcttagtggaggg

SEQ ID NO: 22865 - DNA, 22 bp, Homo sapiens
accagtgttctggaatcctatg

SEQ ID NO: 22866 - DNA, 22 bp, Homo sapiens
cccacaggtgtgagcttgctgg

SEQ ID NO: 22867 - DNA, 22 bp, Homo sapiens
gactggaaagcctgtcctcaga

SEQ ID NO: 22868 - DNA, 22 bp, Homo sapiens
tacttttagcctatttgattct

SEQ ID NO: 22869 - DNA, 22 bp, Homo sapiens
agctcaatgcaacctccgcctc

SEQ ID NO: 22870 - DNA, 23 bp, Homo sapiens
tccctgactctgggagctcccag

SEQ ID NO: 22871 - DNA, 22 bp, Homo sapiens
ttaaattttagaaacagactct

SEQ ID NO: 22872 - DNA, 22 bp, Homo sapiens
gatcccaggtgatcttatttgt

SEQ ID NO: 22873 - DNA, 22 bp, Homo sapiens
gaggcctgggcaagggggtctg

SEQ ID NO: 22874 - DNA, 22 bp, Homo sapiens
agttgggtttgtgtcagttgca

SEQ ID NO: 22875 - DNA, 22 bp, Homo sapiens
agggaagaaaatccatcgctgc

SEQ ID NO: 22876 - DNA, 22 bp, Homo sapiens
aggaaaacagaccaaggagctc

SEQ ID NO: 22877 - DNA, 21 bp, Homo sapiens
ctcccagggtgactgttcaac

SEQ ID NO: 22878 - DNA, 22 bp, Homo sapiens
ggcatgcacccggtgaccatga

SEQ ID NO: 22879 - DNA, 22 bp, Homo sapiens
tgagagttctctcttcaggtgg

SEQ ID NO: 22880 - DNA, 22 bp, Homo sapiens
tcaaaaagttgaagagttgggg

SEQ ID NO: 22881 - DNA, 22 bp, Homo sapiens
agccagatgaagaggtccttaa

SEQ ID NO: 22882 - DNA, 22 bp, Homo sapiens
ctttaaggtgatgagagatgct

SEQ ID NO: 22883 - DNA, 22 bp, Homo sapiens
gctggtagacctcactgcactc

SEQ ID NO: 22884 - DNA, 22 bp, Homo sapiens
tgagctgtatattgttttaata

SEQ ID NO: 22885 - DNA, 22 bp, Homo sapiens
gccaggcgggtctcaaactcct

SEQ ID NO: 22886 - DNA, 22 bp, Homo sapiens
caaatgaatatttccatgggtt

SEQ ID NO: 22887 - DNA, 23 bp, Homo sapiens
actcgtggaattctctgcgatcg

SEQ ID NO: 22888 - DNA, 22 bp, Homo sapiens
gaccttgtgatccagccacctt

SEQ ID NO: 22889 - DNA, 22 bp, Homo sapiens
ctggaggccactgtacagattg

SEQ ID NO: 22890 - DNA, 22 bp, Homo sapiens
aggaaggcttctttggtcttct

SEQ ID NO: 22891 - DNA, 22 bp, Homo sapiens
actgtgaacggactgaagccca

SEQ ID NO: 22892 - DNA, 22 bp, Homo sapiens
tccctgtgtcctgggggcacct

SEQ ID NO: 22893 - DNA, 22 bp, Homo sapiens
ccctggctgcgtgatggatgaa

SEQ ID NO: 22894 - DNA, 22 bp, Homo sapiens
taagtcaaggtggcatttgaga

SEQ ID NO: 22895 - DNA, 22 bp, Homo sapiens
acccaggctggcgtgcagtggc

SEQ ID NO: 22896 - DNA, 22 bp, Homo sapiens
ttcagtttcaagtccctctggg

SEQ ID NO: 22897 - DNA, 22 bp, Homo sapiens
gagccaggggtcagctccgagg

SEQ ID NO: 22898 - DNA, 22 bp, Homo sapiens
tcagtctttccctccctcagtt

SEQ ID NO: 22899 - DNA, 22 bp, Homo sapiens
aggggagccagggctgcgagtt

SEQ ID NO: 22900 - DNA, 22 bp, Homo sapiens
cagtggaggccttgggaccttt

SEQ ID NO: 22901 - DNA, 22 bp, Homo sapiens
gctggccacagatccccaggga

SEQ ID NO: 22902 - DNA, 21 bp, Homo sapiens
gcaattcgctatgatggtggc

SEQ ID NO: 22903 - DNA, 22 bp, Homo sapiens
caatgcattattctcccacttc

SEQ ID NO: 22904 - DNA, 22 bp, Homo sapiens
tcactgcactccagcctgggca

SEQ ID NO: 22905 - DNA, 22 bp, Homo sapiens
tggttcctcaagcgctggcggc

SEQ ID NO: 22906 - DNA, 20 bp, Homo sapiens
tcagccattccttacctttc

SEQ ID NO: 22907 - DNA, 22 bp, Homo sapiens
ttcatatgtgaactcagtgatg

SEQ ID NO: 22908 - DNA, 22 bp, Homo sapiens
agatgctgctccacaggccagg

SEQ ID NO: 22909 - DNA, 22 bp, Homo sapiens
gcccctgcctttgaacctggag

SEQ ID NO: 22910 - DNA, 18 bp, Homo sapiens
atggtctcatactgggag

SEQ ID NO: 22911 - DNA, 22 bp, Homo sapiens
tgctgtgaggttgagaaggaag

SEQ ID NO: 22912 - DNA, 22 bp, Homo sapiens
tatctgatacaacagaataaca

SEQ ID NO: 22913 - DNA, 22 bp, Homo sapiens
aggtctcttgctgtctctgggc

SEQ ID NO: 22914 - DNA, 22 bp, Homo sapiens
tgacaggaaacatgcagtgatt

SEQ ID NO: 22915 - DNA, 22 bp, Homo sapiens
gccagcagcttcttctcatcct

SEQ ID NO: 22916 - DNA, 22 bp, Homo sapiens
ctgtcaggtttcccggctcacg

SEQ ID NO: 22917 - DNA, 22 bp, Homo sapiens
actgaataaggtgaatgctctg

SEQ ID NO: 22918 - DNA, 22 bp, Homo sapiens
atgcattgtcaggcaatttcat

SEQ ID NO: 22919 - DNA, 22 bp, Homo sapiens
aaattgcaaaagtacttttagg

SEQ ID NO: 22920 - DNA, 22 bp, Homo sapiens
gcagatggatgtggacggcgcc

SEQ ID NO: 22921 - DNA, 22 bp, Homo sapiens
tacagtgcttggtatctagtaa

SEQ ID NO: 22922 - DNA, 22 bp, Homo sapiens
actctgctctgtatttcactgt

SEQ ID NO: 22923 - DNA, 20 bp, Homo sapiens
agacaccccctgacagggaa

SEQ ID NO: 22924 - DNA, 22 bp, Homo sapiens
ttcagcactgactgagtggtta

SEQ ID NO: 22925 - DNA, 22 bp, Homo sapiens
tcgcttgaacccaggaagtgga

SEQ ID NO: 22926 - DNA, 22 bp, Homo sapiens
atggccgcctgtccttcccgcc

SEQ ID NO: 22927 - DNA, 22 bp, Homo sapiens
aggctctcaccctctgaccaga

SEQ ID NO: 22928 - DNA, 22 bp, Homo sapiens
caggaaggcgcggctgtgcctg

SEQ ID NO: 22929 - DNA, 22 bp, Homo sapiens
agggagatcgaccgtgttatat

SEQ ID NO: 22930 - DNA, 22 bp, Homo sapiens
tctgaggaactggcaaagatgg

SEQ ID NO: 22931 - DNA, 19 bp, Homo sapiens
agccccttggtactgtcct

SEQ ID NO: 22932 - DNA, 22 bp, Homo sapiens
atgagctagaaaaccatgtgga

SEQ ID NO: 22933 - DNA, 22 bp, Homo sapiens
ttgtgaatagtgccacaataaa

SEQ ID NO: 22934 - DNA, 22 bp, Homo sapiens
ttgtgagtagtgccgcaataaa

SEQ ID NO: 22935 - DNA, 22 bp, Homo sapiens
tatgccactgctctccatccta

SEQ ID NO: 22936 - DNA, 22 bp, Homo sapiens
agctacagtcggaaggacagac

SEQ ID NO: 22937 - DNA, 22 bp, Homo sapiens
aaactcttggtcaacatgagga

SEQ ID NO: 22938 - DNA, 22 bp, Homo sapiens
agtctgcaggaccgcgtcacat

SEQ ID NO: 22939 - DNA, 22 bp, Homo sapiens
gaggggcacagtaaagggtccc

SEQ ID NO: 22940 - DNA, 22 bp, Homo sapiens
gcctccggagtcacagtgtctt

SEQ ID NO: 22941 - DNA, 22 bp, Homo sapiens
gctcggtggccagcctgaggcc

SEQ ID NO: 22942 - DNA, 22 bp, Homo sapiens
ccctgcatccaaaggcctcctc

SEQ ID NO: 22943 - DNA, 22 bp, Homo sapiens
gaaactctcgcatcctgggaac

SEQ ID NO: 22944 - DNA, 22 bp, Homo sapiens
ggtgggagagcttgctttgatg

SEQ ID NO: 22945 - DNA, 22 bp, Homo sapiens
cccttggggtggaggttgcagt

SEQ ID NO: 22946 - DNA, 22 bp, Homo sapiens
ggaggctgaggcaggcggatca

SEQ ID NO: 22947 - DNA, 22 bp, Homo sapiens
gccctcctggcaggcagtgatg

SEQ ID NO: 22948 - DNA, 22 bp, Homo sapiens
ttgtgtgtactggttatgggca

SEQ ID NO: 22949 - DNA, 19 bp, Homo sapiens
actggcacacaggggctgc

SEQ ID NO: 22950 - DNA, 22 bp, Homo sapiens
gggccggagctgggtcccgcgc

SEQ ID NO: 22951 - DNA, 22 bp, Homo sapiens
atgcaactacccccaggatttt

SEQ ID NO: 22952 - DNA, 22 bp, Homo sapiens
tgctttgtgacagattagtttt

SEQ ID NO: 22953 - DNA, 21 bp, Homo sapiens
tgctccaggagggggcagtcc

SEQ ID NO: 22954 - DNA, 19 bp, Homo sapiens
ttcacattggaagaagtag

SEQ ID NO: 22955 - DNA, 22 bp, Homo sapiens
cagtctctaaatcaatctgaat

SEQ ID NO: 22956 - DNA, 22 bp, Homo sapiens
agcttgtgtttttctaagtatc

SEQ ID NO: 22957 - DNA, 22 bp, Homo sapiens
accctccccaagaggtcgtgcc

SEQ ID NO: 22958 - DNA, 22 bp, Homo sapiens
gaccttgtgatctgcctgcctt

SEQ ID NO: 22959 - DNA, 22 bp, Homo sapiens
ctgaggcaggatggcctggctg

SEQ ID NO: 22960 - DNA, 22 bp, Homo sapiens
ggagctgaggacactacatttt

SEQ ID NO: 22961 - DNA, 22 bp, Homo sapiens
caatgctaaaaattctgtacat

SEQ ID NO: 22962 - DNA, 22 bp, Homo sapiens
acagcgccgattctccggggct

SEQ ID NO: 22963 - DNA, 22 bp, Homo sapiens
tgtgacagcaataactacttaa

SEQ ID NO: 22964 - DNA, 22 bp, Homo sapiens
gggacttaatgcagagagggac

SEQ ID NO: 22965 - DNA, 22 bp, Homo sapiens
tgtgcgtcctgtgcgcacactg

SEQ ID NO: 22966 - DNA, 22 bp, Homo sapiens
tgcctactagtactattttgtg

SEQ ID NO: 22967 - DNA, 22 bp, Homo sapiens
tgtgttaaggtgcatctagtgc

SEQ ID NO: 22968 - DNA, 22 bp, Homo sapiens
tgtagctctccagccagcaagg

SEQ ID NO: 22969 - DNA, 22 bp, Homo sapiens
gctcccaccgccgctatgggta

SEQ ID NO: 22970 - DNA, 22 bp, Homo sapiens
aacggctgtggctggcggcagc

SEQ ID NO: 22971 - DNA, 22 bp, Homo sapiens
ccaggaggtggaggttgcggtg

SEQ ID NO: 22972 - DNA, 22 bp, Homo sapiens
ccgggaggtggaggttgcagtg

SEQ ID NO: 22973 - DNA, 22 bp, Homo sapiens
tgggaaggggagctggaaagga

SEQ ID NO: 22974 - DNA, 22 bp, Homo sapiens
tgaggcaggagaatcacatgaa

SEQ ID NO: 22975 - DNA, 22 bp, Homo sapiens
actttatttcctattgcatcca

SEQ ID NO: 22976 - DNA, 22 bp, Homo sapiens
tcccagattcctgctcttatat

SEQ ID NO: 22977 - DNA, 22 bp, Homo sapiens
tctctcaggctggagtgcagtg

SEQ ID NO: 22978 - DNA, 22 bp, Homo sapiens
cccattgtggttgttgaggata

SEQ ID NO: 22979 - DNA, 22 bp, Homo sapiens
cacagctgtgagaagggagcct

SEQ ID NO: 22980 - DNA, 22 bp, Homo sapiens
ggaacagttgcgtcatgggcct

SEQ ID NO: 22981 - DNA, 23 bp, Homo sapiens
gctcatcaggcttagagtcaagg

SEQ ID NO: 22982 - DNA, 22 bp, Homo sapiens
agaacgtggaatgtggctcctt

SEQ ID NO: 22983 - DNA, 22 bp, Homo sapiens
ctctccattccctacagttttc

SEQ ID NO: 22984 - DNA, 22 bp, Homo sapiens
agcttactgccccatggaagga

SEQ ID NO: 22985 - DNA, 22 bp, Homo sapiens
catggcactgagcaggtatgca

SEQ ID NO: 22986 - DNA, 22 bp, Homo sapiens
ggtggttcacgcctataatccc

SEQ ID NO: 22987 - DNA, 22 bp, Homo sapiens
gcatacatgggtgcagggacat

SEQ ID NO: 22988 - DNA, 17 bp, Homo sapiens
gcccgcggcccggggtg

SEQ ID NO: 22989 - DNA, 22 bp, Homo sapiens
tgttgcacggccttcacagagc

SEQ ID NO: 22990 - DNA, 22 bp, Homo sapiens
ccagcagccaccttctcgaaat

SEQ ID NO: 22991 - DNA, 22 bp, Homo sapiens
tctcctggtacccttcctagca

SEQ ID NO: 22992 - DNA, 22 bp, Homo sapiens
ttttccttcatatcccttatgt

SEQ ID NO: 22993 - DNA, 22 bp, Homo sapiens
aaggtttcgggagcgggtctgg

SEQ ID NO: 22994 - DNA, 22 bp, Homo sapiens
aagaaatgctgatgttggatgg

SEQ ID NO: 22995 - DNA, 22 bp, Homo sapiens
aaagtgctgggattacaggcct

SEQ ID NO: 22996 - DNA, 22 bp, Homo sapiens
tccgggttttacactcacatca

SEQ ID NO: 22997 - DNA, 22 bp, Homo sapiens
tcactgcaacctctgcctcttg

SEQ ID NO: 22998 - DNA, 22 bp, Homo sapiens
ctggacacactggagtctggca

SEQ ID NO: 22999 - DNA, 22 bp, Homo sapiens
cgcggtggcggcctccagcgcc

SEQ ID NO: 23000 - DNA, 22 bp, Homo sapiens
gatattcctgaaggacagggtt

SEQ ID NO: 23001 - DNA, 22 bp, Homo sapiens
tcggagctgtagatgaaaccct

SEQ ID NO: 23002 - DNA, 22 bp, Homo sapiens
actcccagaacatgctcttctt

SEQ ID NO: 23003 - DNA, 22 bp, Homo sapiens
gttaagtgagggcttttgagtc

SEQ ID NO: 23004 - DNA, 22 bp, Homo sapiens
ttccccttgggctgtggaggag

SEQ ID NO: 23005 - DNA, 22 bp, Homo sapiens
gcttttacaagagccagagagg

SEQ ID NO: 23006 - DNA, 22 bp, Homo sapiens
tgaagcaaattgtttagcctga

SEQ ID NO: 23007 - DNA, 22 bp, Homo sapiens
tctagggtgtataaggaagcct

SEQ ID NO: 23008 - DNA, 22 bp, Homo sapiens
aagccaatgctagcccacatgc

SEQ ID NO: 23009 - DNA, 22 bp, Homo sapiens
cctcggaggcggaggctgcagt

SEQ ID NO: 23010 - DNA, 22 bp, Homo sapiens
agagtggagagaaacaactctg

SEQ ID NO: 23011 - DNA, 22 bp, Homo sapiens
gtcatggtgctagcgggaatgt

SEQ ID NO: 23012 - DNA, 22 bp, Homo sapiens
agccaggatggtctcgatcggc

SEQ ID NO: 23013 - DNA, 22 bp, Homo sapiens
gtgaccaatattatgctaatta

SEQ ID NO: 23014 - DNA, 22 bp, Homo sapiens
ttagctcagaaaatttaaactt

SEQ ID NO: 23015 - DNA, 19 bp, Homo sapiens
gttttgcaggcagagggga

SEQ ID NO: 23016 - DNA, 22 bp, Homo sapiens
gagtgcaatggcatgatctggg

SEQ ID NO: 23017 - DNA, 22 bp, Homo sapiens
ctgaggctggagtgcagtggtg

SEQ ID NO: 23018 - DNA, 22 bp, Homo sapiens
ggcctctgccccgcggggctcg

SEQ ID NO: 23019 - DNA, 22 bp, Homo sapiens
ctgtccatggtccttattacca

SEQ ID NO: 23020 - DNA, 22 bp, Homo sapiens
tgtgcacaatgtgcaggtttgt

SEQ ID NO: 23021 - DNA, 22 bp, Homo sapiens
ggcagagcttgcagtgagccga

SEQ ID NO: 23022 - DNA, 22 bp, Homo sapiens
tgctgctccccagcacacagca

SEQ ID NO: 23023 - DNA, 22 bp, Homo sapiens
ctggcaggagcattcacagagg

SEQ ID NO: 23024 - DNA, 22 bp, Homo sapiens
gggatcgtcatggaaagtgcta

SEQ ID NO: 23025 - DNA, 22 bp, Homo sapiens
tctgctcagccgatctgctccg

SEQ ID NO: 23026 - DNA, 23 bp, Homo sapiens
cagggccctgctcaatttctcca

SEQ ID NO: 23027 - DNA, 22 bp, Homo sapiens
tgaaatcttcactaagtctctt

SEQ ID NO: 23028 - DNA, 22 bp, Homo sapiens
cgctccttgagcgtgtcggcct

SEQ ID NO: 23029 - DNA, 22 bp, Homo sapiens
gctcactgcaacctccacctcc

SEQ ID NO: 23030 - DNA, 22 bp, Homo sapiens
ggcgctcagtgttgccccagag

SEQ ID NO: 23031 - DNA, 20 bp, Homo sapiens
caggtccagcacgtgcacgg

SEQ ID NO: 23032 - DNA, 22 bp, Homo sapiens
gcaacaatggaggtttggaggg

SEQ ID NO: 23033 - DNA, 20 bp, Homo sapiens
cctgtcatcccagcattttg

SEQ ID NO: 23034 - DNA, 22 bp, Homo sapiens
tgggtgtccagaccctgcacat

SEQ ID NO: 23035 - DNA, 22 bp, Homo sapiens
cacccaggctggagagcagtgg

SEQ ID NO: 23036 - DNA, 22 bp, Homo sapiens
cgtcagggttgagcaggtagat

SEQ ID NO: 23037 - DNA, 22 bp, Homo sapiens
agtgaaaacctaatcatgcagt

SEQ ID NO: 23038 - DNA, 22 bp, Homo sapiens
ggccctctttagacagagtagg

SEQ ID NO: 23039 - DNA, 22 bp, Homo sapiens
ctgagtttccagataagacctt

SEQ ID NO: 23040 - DNA, 22 bp, Homo sapiens
caagtctgacctctgggtgaag

SEQ ID NO: 23041 - DNA, 22 bp, Homo sapiens
gacaatatagttgaatgagcaa

SEQ ID NO: 23042 - DNA, 22 bp, Homo sapiens
acaggtgcatgctaccatgtct

SEQ ID NO: 23043 - DNA, 22 bp, Homo sapiens
ctggtctggctacccagcgaat

SEQ ID NO: 23044 - DNA, 22 bp, Homo sapiens
tgttccgaccgtggggtttgat

SEQ ID NO: 23045 - DNA, 22 bp, Homo sapiens
ggaggtgactggatcatgggca

SEQ ID NO: 23046 - DNA, 22 bp, Homo sapiens
gggaaactttcacaatgtccag

SEQ ID NO: 23047 - DNA, 22 bp, Homo sapiens
cgcagggccgcgagcgggacca

SEQ ID NO: 23048 - DNA, 22 bp, Homo sapiens
cccaggaggtggagttcacagt

SEQ ID NO: 23049 - DNA, 22 bp, Homo sapiens
gggccagtgaacaatgagggaa

SEQ ID NO: 23050 - DNA, 22 bp, Homo sapiens
atgccaggaacaaacagtggtg

SEQ ID NO: 23051 - DNA, 22 bp, Homo sapiens
cccatgaggtggaggttgcagt

SEQ ID NO: 23052 - DNA, 22 bp, Homo sapiens
tggcacttttcccagttttggt

SEQ ID NO: 23053 - DNA, 22 bp, Homo sapiens
catctcccacttccttgggggt

SEQ ID NO: 23054 - DNA, 22 bp, Homo sapiens
ggggtggatttcaggcggtgtc

SEQ ID NO: 23055 - DNA, 22 bp, Homo sapiens
cactgcactccagcctgggcaa

SEQ ID NO: 23056 - DNA, 22 bp, Homo sapiens
ttgctttgtttaaaagtggtat

SEQ ID NO: 23057 - DNA, 22 bp, Homo sapiens
tctcatgaagatagaatagtat

SEQ ID NO: 23058 - DNA, 22 bp, Homo sapiens
agggcgctgaaatactaacatg

SEQ ID NO: 23059 - DNA, 22 bp, Homo sapiens
gattgctaatgtggggatttgg

SEQ ID NO: 23060 - DNA, 22 bp, Homo sapiens
ctgctttaaaactgatacatga

SEQ ID NO: 23061 - DNA, 22 bp, Homo sapiens
gggcatttcttgtcaatgtagg

SEQ ID NO: 23062 - DNA, 21 bp, Homo sapiens
agcgtcaatatcgtcaacagg

SEQ ID NO: 23063 - DNA, 22 bp, Homo sapiens
ctggagggctgcagcgaggctg

SEQ ID NO: 23064 - DNA, 23 bp, Homo sapiens
ggagtgcaatggcgccatctcgg

SEQ ID NO: 23065 - DNA, 22 bp, Homo sapiens
catgtgaattccaaagctaggt

SEQ ID NO: 23066 - DNA, 23 bp, Homo sapiens
ggggcctgcaccggtctgcgcgg

SEQ ID NO: 23067 - DNA, 22 bp, Homo sapiens
ggagtgaatcactagatgcaga

SEQ ID NO: 23068 - DNA, 22 bp, Homo sapiens
ttctttcagaacacaagtgatt

SEQ ID NO: 23069 - DNA, 22 bp, Homo sapiens
ggtgggaggactgtttgaggca

SEQ ID NO: 23070 - DNA, 22 bp, Homo sapiens
tgtgttcagaatttgctgcttt

SEQ ID NO: 23071 - DNA, 22 bp, Homo sapiens
cggggaagcggttctggcggta

SEQ ID NO: 23072 - DNA, 22 bp, Homo sapiens
atctccgccatcgcgaacgcct

SEQ ID NO: 23073 - DNA, 22 bp, Homo sapiens
tgccgtggggctgaggctggag

SEQ ID NO: 23074 - DNA, 22 bp, Homo sapiens
gaggccaaggtgggcagatcac

SEQ ID NO: 23075 - DNA, 18 bp, Homo sapiens
tcactgtgtgtcttgggt

SEQ ID NO: 23076 - DNA, 22 bp, Homo sapiens
ggaggcggaagttgcagtgagc

SEQ ID NO: 23077 - DNA, 22 bp, Homo sapiens
tggaaagaaagtaaaggcgtat

SEQ ID NO: 23078 - DNA, 18 bp, Homo sapiens
tgtagagccaggtttgcc

SEQ ID NO: 23079 - DNA, 20 bp, Homo sapiens
tcaggtgacacacgtggcac

SEQ ID NO: 23080 - DNA, 22 bp, Homo sapiens
gctatgtataaccaaagtacaa

SEQ ID NO: 23081 - DNA, 19 bp, Homo sapiens
ccacagcctgctgtcttcc

SEQ ID NO: 23082 - DNA, 22 bp, Homo sapiens
gttgaaatcctaaccccctagt

SEQ ID NO: 23083 - DNA, 22 bp, Homo sapiens
tggagacacaggaccagactgc

SEQ ID NO: 23084 - DNA, 22 bp, Homo sapiens
ggagtgctttgaagccttcatt

SEQ ID NO: 23085 - DNA, 22 bp, Homo sapiens
ggctcatatcccggccatcatt

SEQ ID NO: 23086 - DNA, 22 bp, Homo sapiens
ggaggtggagctggaagttcca

SEQ ID NO: 23087 - DNA, 22 bp, Homo sapiens
aggccagcctcaggcagggacc

SEQ ID NO: 23088 - DNA, 22 bp, Homo sapiens
atacatgcgccatgttggtgtg

SEQ ID NO: 23089 - DNA, 22 bp, Homo sapiens
ctcgcatgccctgcctcatcca

SEQ ID NO: 23090 - DNA, 22 bp, Homo sapiens
gggctgagacgatggggtcttc

SEQ ID NO: 23091 - DNA, 22 bp, Homo sapiens
gcacggctaatttttgtatttt

SEQ ID NO: 23092 - DNA, 22 bp, Homo sapiens
gggtggtggccagcagtgggca

SEQ ID NO: 23093 - DNA, 22 bp, Homo sapiens
tgttattgtcgctgcactggga

SEQ ID NO: 23094 - DNA, 22 bp, Homo sapiens
tgtctggtgggttgacaggcag

SEQ ID NO: 23095 - DNA, 18 bp, Homo sapiens
ccgggctttggtgacaca

SEQ ID NO: 23096 - DNA, 22 bp, Homo sapiens
gcagagatctgagaaggctgcc

SEQ ID NO: 23097 - DNA, 21 bp, Homo sapiens
ggccccgcagacccagcacgt

SEQ ID NO: 23098 - DNA, 20 bp, Homo sapiens
tgtcttccagcaggtgttta

SEQ ID NO: 23099 - DNA, 22 bp, Homo sapiens
cttctggcgttggaggtctgag

SEQ ID NO: 23100 - DNA, 22 bp, Homo sapiens
tggctaggctggtgtcaagctc

SEQ ID NO: 23101 - DNA, 22 bp, Homo sapiens
cggctgggttcggctgcaggcc

SEQ ID NO: 23102 - DNA, 22 bp, Homo sapiens
cagtcactggaatagctgagga

SEQ ID NO: 23103 - DNA, 22 bp, Homo sapiens
ttgcccaggctggagtgcagta

SEQ ID NO: 23104 - DNA, 22 bp, Homo sapiens
ctactggccatctgatctacaa

SEQ ID NO: 23105 - DNA, 22 bp, Homo sapiens
ttcgcccagctccaggctggcc

SEQ ID NO: 23106 - DNA, 22 bp, Homo sapiens
gcttccacctactaaatgccac

SEQ ID NO: 23107 - DNA, 22 bp, Homo sapiens
tctgctttcttactaaaaatga

SEQ ID NO: 23108 - DNA, 22 bp, Homo sapiens
gaggaggcagcctatcccttag

SEQ ID NO: 23109 - DNA, 22 bp, Homo sapiens
cccaggccctggcagagcttgt

SEQ ID NO: 23110 - DNA, 22 bp, Homo sapiens
caggtgtgccgggagcagtttg

SEQ ID NO: 23111 - DNA, 22 bp, Homo sapiens
atacacgtgccatgttggtgtg

SEQ ID NO: 23112 - DNA, 18 bp, Homo sapiens
ctgcactcccgcctgggc

SEQ ID NO: 23113 - DNA, 22 bp, Homo sapiens
tggtcttagctggaaggaggga

SEQ ID NO: 23114 - DNA, 22 bp, Homo sapiens
agggaaattaatgtgagcaatg

SEQ ID NO: 23115 - DNA, 22 bp, Homo sapiens
tgtccccacctaaatcttatct

SEQ ID NO: 23116 - DNA, 22 bp, Homo sapiens
caggagctcagatgacatctca

SEQ ID NO: 23117 - DNA, 22 bp, Homo sapiens
aacaattactaccaaggcctgt

SEQ ID NO: 23118 - DNA, 22 bp, Homo sapiens
agcccagaggctgggcgtgcat

SEQ ID NO: 23119 - DNA, 22 bp, Homo sapiens
tgggccgtggagcactctgaga

SEQ ID NO: 23120 - DNA, 22 bp, Homo sapiens
agtcccaacagcttacaaggaa

SEQ ID NO: 23121 - DNA, 22 bp, Homo sapiens
tacccaaggccctttcaatttc

SEQ ID NO: 23122 - DNA, 22 bp, Homo sapiens
atcttctcatgtgtaatgaggt

SEQ ID NO: 23123 - DNA, 22 bp, Homo sapiens
ctgtctgtagacatttttggtt

SEQ ID NO: 23124 - DNA, 22 bp, Homo sapiens
atacagttatagtcagggctaa

SEQ ID NO: 23125 - DNA, 22 bp, Homo sapiens
cctcttcaggcactcgaaggcc

SEQ ID NO: 23126 - DNA, 22 bp, Homo sapiens
gtcttagatttcaccgataatg

SEQ ID NO: 23127 - DNA, 22 bp, Homo sapiens
aaagaaatagatggcatttaaa

SEQ ID NO: 23128 - DNA, 22 bp, Homo sapiens
tgatctttggtaatctggcaca

SEQ ID NO: 23129 - DNA, 22 bp, Homo sapiens
aggggtgacacatatcagtgca

SEQ ID NO: 23130 - DNA, 22 bp, Homo sapiens
acgggctgggacggggaagctc

SEQ ID NO: 23131 - DNA, 22 bp, Homo sapiens
cagtggccaacttcctgcctct

SEQ ID NO: 23132 - DNA, 22 bp, Homo sapiens
aggaatgtgaaacaggtggctg

SEQ ID NO: 23133 - DNA, 22 bp, Homo sapiens
gctaggagtggtgggtcaagga

SEQ ID NO: 23134 - DNA, 22 bp, Homo sapiens
tcacatgtgtacagtcctccca

SEQ ID NO: 23135 - DNA, 22 bp, Homo sapiens
gtttacttgtgccttggcttaa

SEQ ID NO: 23136 - DNA, 22 bp, Homo sapiens
tgccgcagtgcggggagggccc

SEQ ID NO: 23137 - DNA, 22 bp, Homo sapiens
gaaagtgctctctctatacaca

SEQ ID NO: 23138 - DNA, 22 bp, Homo sapiens
ttgtgctgactgcgcccagctc

SEQ ID NO: 23139 - DNA, 22 bp, Homo sapiens
tgtgctggagatcagcttattt

SEQ ID NO: 23140 - DNA, 22 bp, Homo sapiens
gggaagtgagctggaatcaagg

SEQ ID NO: 23141 - DNA, 22 bp, Homo sapiens
cttgtattaggaagaatgcttt

SEQ ID NO: 23142 - DNA, 22 bp, Homo sapiens
aagactgagtggcttaagaaaa

SEQ ID NO: 23143 - DNA, 22 bp, Homo sapiens
agctgccccgaggcggcgggaa

SEQ ID NO: 23144 - DNA, 17 bp, Homo sapiens
aatctgtttacagtcag

SEQ ID NO: 23145 - DNA, 22 bp, Homo sapiens
tcctcagaatcacctggcagct

SEQ ID NO: 23146 - DNA, 22 bp, Homo sapiens
ttcctggtcactgctgttccct

SEQ ID NO: 23147 - DNA, 22 bp, Homo sapiens
gtgggggcaggcagtgctagga

SEQ ID NO: 23148 - DNA, 22 bp, Homo sapiens
cacatgaaggctggggtcgtga

SEQ ID NO: 23149 - DNA, 22 bp, Homo sapiens
aggcgcattgaggccctgttgc

SEQ ID NO: 23150 - DNA, 22 bp, Homo sapiens
tcaggtccaagatggccatcca

SEQ ID NO: 23151 - DNA, 22 bp, Homo sapiens
aaattagtgcaccaggttgaag

SEQ ID NO: 23152 - DNA, 22 bp, Homo sapiens
gaccttgtgatccacccgcttt

SEQ ID NO: 23153 - DNA, 22 bp, Homo sapiens
gtgctccctccttcctcaagga

SEQ ID NO: 23154 - DNA, 22 bp, Homo sapiens
cgagcatgatgacggctgtggc

SEQ ID NO: 23155 - DNA, 22 bp, Homo sapiens
attcactgtgggtcctttggat

SEQ ID NO: 23156 - DNA, 20 bp, Homo sapiens
gccactgggcaccagcaggg

SEQ ID NO: 23157 - DNA, 21 bp, Homo sapiens
ctgtggtacagctgggacgga

SEQ ID NO: 23158 - DNA, 22 bp, Homo sapiens
cagtgcagccaaggacaggcac

SEQ ID NO: 23159 - DNA, 22 bp, Homo sapiens
agaggctgcacttgctcatgat

SEQ ID NO: 23160 - DNA, 22 bp, Homo sapiens
cttctcggggttcccgcgccct

SEQ ID NO: 23161 - DNA, 22 bp, Homo sapiens
cttcatagtgagtttaatgatg

SEQ ID NO: 23162 - DNA, 22 bp, Homo sapiens
atatgcagtctcttgcccttct

SEQ ID NO: 23163 - DNA, 22 bp, Homo sapiens
tccctcaatgtgggtcaagacc

SEQ ID NO: 23164 - DNA, 21 bp, Homo sapiens
caatggcgagatcttggctca

SEQ ID NO: 23165 - DNA, 22 bp, Homo sapiens
gattcagcctctgcttccctga

SEQ ID NO: 23166 - DNA, 22 bp, Homo sapiens
agaagcagaaactgggcttgtg

SEQ ID NO: 23167 - DNA, 22 bp, Homo sapiens
agtggcacaattttgactcccc

SEQ ID NO: 23168 - DNA, 22 bp, Homo sapiens
cacagtcctgccagagggcctt

SEQ ID NO: 23169 - DNA, 23 bp, Homo sapiens
ctcaccaagcgccgccgctgtgt

SEQ ID NO: 23170 - DNA, 22 bp, Homo sapiens
cttctacacgtggctgtgccaa

SEQ ID NO: 23171 - DNA, 22 bp, Homo sapiens
tctgtgcctgcttccccaccca

SEQ ID NO: 23172 - DNA, 22 bp, Homo sapiens
ggcggtctcagcaccctcttgg

SEQ ID NO: 23173 - DNA, 22 bp, Homo sapiens
catagcggtattccacgtggtt

SEQ ID NO: 23174 - DNA, 22 bp, Homo sapiens
ctgagcagatgaccagccccag

SEQ ID NO: 23175 - DNA, 22 bp, Homo sapiens
tgcctaggctggagtgcagtga

SEQ ID NO: 23176 - DNA, 22 bp, Homo sapiens
ccagcagagcatggggaggaag

SEQ ID NO: 23177 - DNA, 22 bp, Homo sapiens
gaatatcccgctatgcaaagta

SEQ ID NO: 23178 - DNA, 22 bp, Homo sapiens
ttccactctacacactgctggc

SEQ ID NO: 23179 - DNA, 22 bp, Homo sapiens
gcatgcaatctatccttaggaa

SEQ ID NO: 23180 - DNA, 22 bp, Homo sapiens
cactctgcagctgaagggctgg

SEQ ID NO: 23181 - DNA, 22 bp, Homo sapiens
ggggggcgccatggtctcttgg

SEQ ID NO: 23182 - DNA, 22 bp, Homo sapiens
gtacagtgggtgtagggaccag

SEQ ID NO: 23183 - DNA, 22 bp, Homo sapiens
aggaatgacagatgtccgcacc

SEQ ID NO: 23184 - DNA, 22 bp, Homo sapiens
gtggctcacacctgtaatccca

SEQ ID NO: 23185 - DNA, 22 bp, Homo sapiens
aattatggtcactgttcctggg

SEQ ID NO: 23186 - DNA, 22 bp, Homo sapiens
cactgcagcctcgctctcctga

SEQ ID NO: 23187 - DNA, 18 bp, Homo sapiens
gtgactgccccaaaaggc

SEQ ID NO: 23188 - DNA, 22 bp, Homo sapiens
ccaggcagcctgctccattctg

SEQ ID NO: 23189 - DNA, 20 bp, Homo sapiens
tggcctctgagatgccacgg

SEQ ID NO: 23190 - DNA, 21 bp, Homo sapiens
agtagtttagcacagggtttg

SEQ ID NO: 23191 - DNA, 22 bp, Homo sapiens
agacccaggattggggctgccg

SEQ ID NO: 23192 - DNA, 22 bp, Homo sapiens
tcgcccaggctggaagtgcagt

SEQ ID NO: 23193 - DNA, 22 bp, Homo sapiens
ccctcccaggagtggccagaga

SEQ ID NO: 23194 - DNA, 20 bp, Homo sapiens
cagtgcattgcttctgattt

SEQ ID NO: 23195 - DNA, 22 bp, Homo sapiens
actgcgctccagcctgggtgac

SEQ ID NO: 23196 - DNA, 14 bp, Homo sapiens
gcaggcagatcacc

SEQ ID NO: 23197 - DNA, 22 bp, Homo sapiens
cacctagggtttcgcctttctt

SEQ ID NO: 23198 - DNA, 22 bp, Homo sapiens
gggaatgtagcaaatctgcaat

SEQ ID NO: 23199 - DNA, 22 bp, Homo sapiens
caccaggctggagtgcagtggc

SEQ ID NO: 23200 - DNA, 22 bp, Homo sapiens
cctccccacagcccaggagact

SEQ ID NO: 23201 - DNA, 22 bp, Homo sapiens
aagtgctgggattacaggtgtg

SEQ ID NO: 23202 - DNA, 22 bp, Homo sapiens
tgtgctcagtctttggctggga

SEQ ID NO: 23203 - DNA, 22 bp, Homo sapiens
tgtcttcagcagtcatctgggg

SEQ ID NO: 23204 - DNA, 22 bp, Homo sapiens
ccaggctggagtgcagtggcac

SEQ ID NO: 23205 - DNA, 22 bp, Homo sapiens
cgggcaaggcgagactaggccc

SEQ ID NO: 23206 - DNA, 17 bp, Homo sapiens
tggtagaatgacaggcc

SEQ ID NO: 23207 - DNA, 22 bp, Homo sapiens
gtccagtgttggaggttttacc

SEQ ID NO: 23208 - DNA, 22 bp, Homo sapiens
tggaagggagctggaatttgga

SEQ ID NO: 23209 - DNA, 22 bp, Homo sapiens
gtggaggagaggcgccttgcgg

SEQ ID NO: 23210 - DNA, 22 bp, Homo sapiens
ggaccaggactggtggtatctc

SEQ ID NO: 23211 - DNA, 22 bp, Homo sapiens
gctccctggtagccatgctctc

SEQ ID NO: 23212 - DNA, 22 bp, Homo sapiens
aacccgggaggcggaggttgtg

SEQ ID NO: 23213 - DNA, 22 bp, Homo sapiens
gcgctgcgcctcctcttccgca

SEQ ID NO: 23214 - DNA, 22 bp, Homo sapiens
gccttgagaaatgtttggtttt

SEQ ID NO: 23215 - DNA, 22 bp, Homo sapiens
tttggaaattttcatccagaca

SEQ ID NO: 23216 - DNA, 22 bp, Homo sapiens
aattcacatccgaccaggtcaa

SEQ ID NO: 23217 - DNA, 22 bp, Homo sapiens
gctgacccctacaggttgtgtt

SEQ ID NO: 23218 - DNA, 22 bp, Homo sapiens
ggaaaatgggaacctgaagcca

SEQ ID NO: 23219 - DNA, 22 bp, Homo sapiens
cggagcctgcttgttgcagctg

SEQ ID NO: 23220 - DNA, 22 bp, Homo sapiens
aacacacctggttaacctcttt

SEQ ID NO: 23221 - DNA, 22 bp, Homo sapiens
aggtgaacccaggtgcttcacg

SEQ ID NO: 23222 - DNA, 22 bp, Homo sapiens
cctcggggcaccgcggcctgct

SEQ ID NO: 23223 - DNA, 22 bp, Homo sapiens
ggcatggacgtctctgaggcca

SEQ ID NO: 23224 - DNA, 22 bp, Homo sapiens
tcccagaaacgcatatgttcat

SEQ ID NO: 23225 - DNA, 22 bp, Homo sapiens
aacccaggaggcggaggttgtg

SEQ ID NO: 23226 - DNA, 22 bp, Homo sapiens
gtgtggctgaaatcaaggcagg

SEQ ID NO: 23227 - DNA, 22 bp, Homo sapiens
ggggtcggggcatagccactta

SEQ ID NO: 23228 - DNA, 22 bp, Homo sapiens
ctgcagtatgagctacccaggt

SEQ ID NO: 23229 - DNA, 22 bp, Homo sapiens
cgctgataaacgtcacgttccc

SEQ ID NO: 23230 - DNA, 22 bp, Homo sapiens
tgctggaggccagaagtctgag

SEQ ID NO: 23231 - DNA, 22 bp, Homo sapiens
atgtccttcctgagatccctgt

SEQ ID NO: 23232 - DNA, 22 bp, Homo sapiens
gtagaggggtgattctgtgaga

SEQ ID NO: 23233 - DNA, 22 bp, Homo sapiens
gctgtgtatcagatgccacggg

SEQ ID NO: 23234 - DNA, 22 bp, Homo sapiens
gccgtgcgtgcgcaggtgctgt

SEQ ID NO: 23235 - DNA, 22 bp, Homo sapiens
taatactgtatactgcaaattt

SEQ ID NO: 23236 - DNA, 22 bp, Homo sapiens
cactgcactccagcttgggtga

SEQ ID NO: 23237 - DNA, 22 bp, Homo sapiens
atcgcaagtttaaaaatctttg

SEQ ID NO: 23238 - DNA, 22 bp, Homo sapiens
cctcaaagctcaaatgaggctt

SEQ ID NO: 23239 - DNA, 22 bp, Homo sapiens
gttacagtcaggagatattttg

SEQ ID NO: 23240 - DNA, 22 bp, Homo sapiens
tgagaaacacaggcatgaatag

SEQ ID NO: 23241 - DNA, 22 bp, Homo sapiens
ttaagggccattatggatgggt

SEQ ID NO: 23242 - DNA, 22 bp, Homo sapiens
ggggacctgggcttcaagggtt

SEQ ID NO: 23243 - DNA, 22 bp, Homo sapiens
caggaggttgagggtgcagtga

SEQ ID NO: 23244 - DNA, 22 bp, Homo sapiens
aaactgtcctcccgaggtttcc

SEQ ID NO: 23245 - DNA, 22 bp, Homo sapiens
aagcatttcaggtagagatatt

SEQ ID NO: 23246 - DNA, 22 bp, Homo sapiens
gcagagtgctgtcgtacgcccc

SEQ ID NO: 23247 - DNA, 22 bp, Homo sapiens
tgcccagagcctgagaggatta

SEQ ID NO: 23248 - DNA, 22 bp, Homo sapiens
ggacattgaagctggaaaggga

SEQ ID NO: 23249 - DNA, 22 bp, Homo sapiens
gtgagagattgattgtagcggc

SEQ ID NO: 23250 - DNA, 22 bp, Homo sapiens
ctcccagccttcgccagtctga

SEQ ID NO: 23251 - DNA, 22 bp, Homo sapiens
agaaggggcccaaggatgtcag

SEQ ID NO: 23252 - DNA, 22 bp, Homo sapiens
agccctcgtttctgcatcctgt

SEQ ID NO: 23253 - DNA, 22 bp, Homo sapiens
ctccagtcttctcatgtatccc

SEQ ID NO: 23254 - DNA, 22 bp, Homo sapiens
aaattacagccttgggtagctt

SEQ ID NO: 23255 - DNA, 22 bp, Homo sapiens
ccaaagtgctgagattacaggt

SEQ ID NO: 23256 - DNA, 23 bp, Homo sapiens
tctctgcatgtcctgagcacatc

SEQ ID NO: 23257 - DNA, 22 bp, Homo sapiens
ttgtgaatggtgccgcaataaa

SEQ ID NO: 23258 - DNA, 23 bp, Homo sapiens
ggctgggagctccgggtgcacgt

SEQ ID NO: 23259 - DNA, 22 bp, Homo sapiens
agtaatcaatttttcggtggat

SEQ ID NO: 23260 - DNA, 22 bp, Homo sapiens
atgtggcaccgatctttagcca

SEQ ID NO: 23261 - DNA, 16 bp, Homo sapiens
gaggagcccctctgcc

SEQ ID NO: 23262 - DNA, 22 bp, Homo sapiens
gaatcccaatctgttattgaca

SEQ ID NO: 23263 - DNA, 22 bp, Homo sapiens
ccaaagtgctgggattacaggt

SEQ ID NO: 23264 - DNA, 22 bp, Homo sapiens
tcactcaggctggagtgcagtg

SEQ ID NO: 23265 - DNA, 22 bp, Homo sapiens
atggagttctgccagcgctgct

SEQ ID NO: 23266 - DNA, 22 bp, Homo sapiens
tctgcaggaagctggcggctga

SEQ ID NO: 23267 - DNA, 22 bp, Homo sapiens
tgaagtcagggattccatgaag

SEQ ID NO: 23268 - DNA, 22 bp, Homo sapiens
atggagcaacagacctatcaca

SEQ ID NO: 23269 - DNA, 22 bp, Homo sapiens
tcaaatgctgtattgtagtaat

SEQ ID NO: 23270 - DNA, 22 bp, Homo sapiens
agtccgtcctgtcaagcagctg

SEQ ID NO: 23271 - DNA, 22 bp, Homo sapiens
aatattatcaaaagctttttca

SEQ ID NO: 23272 - DNA, 22 bp, Homo sapiens
caccagagtgggtgagggtgat

SEQ ID NO: 23273 - DNA, 22 bp, Homo sapiens
taaatgttgtaagtacatctaa

SEQ ID NO: 23274 - DNA, 22 bp, Homo sapiens
ggcatggtggtacacatctgta

SEQ ID NO: 23275 - DNA, 19 bp, Homo sapiens
acacagggatcagagggtt

SEQ ID NO: 23276 - DNA, 23 bp, Homo sapiens
ggaagctcacgtagtcctgcact

SEQ ID NO: 23277 - DNA, 22 bp, Homo sapiens
aagaggtaaccatagcaaccac

SEQ ID NO: 23278 - DNA, 22 bp, Homo sapiens
ctaaaatgtttggggcagaacc

SEQ ID NO: 23279 - DNA, 22 bp, Homo sapiens
gcggcgcctgggacccgccagc

SEQ ID NO: 23280 - DNA, 22 bp, Homo sapiens
agtttgaattttaatctcggtg

SEQ ID NO: 23281 - DNA, 22 bp, Homo sapiens
agatgctgggatgcttggatgg

SEQ ID NO: 23282 - DNA, 22 bp, Homo sapiens
aacctcaaactcttgggcttaa

SEQ ID NO: 23283 - DNA, 22 bp, Homo sapiens
gcggggacagaaggcggttctc

SEQ ID NO: 23284 - DNA, 22 bp, Homo sapiens
agcccaggttgaggctgcagtg

SEQ ID NO: 23285 - DNA, 22 bp, Homo sapiens
ttggagttctgggcacagctgc

SEQ ID NO: 23286 - DNA, 22 bp, Homo sapiens
caggctgctgacaggcttggag

SEQ ID NO: 23287 - DNA, 22 bp, Homo sapiens
ggctccaccctgcttccagaag

SEQ ID NO: 23288 - DNA, 18 bp, Homo sapiens
ccaaggatgctgccggcc

SEQ ID NO: 23289 - DNA, 22 bp, Homo sapiens
ccaggagtgcagggatggtatc

SEQ ID NO: 23290 - DNA, 22 bp, Homo sapiens
gcggggttccgtgccccagagt

SEQ ID NO: 23291 - DNA, 22 bp, Homo sapiens
aaggtagggatgtattcagctt

SEQ ID NO: 23292 - DNA, 20 bp, Homo sapiens
tgttgattggtgtcatctca

SEQ ID NO: 23293 - DNA, 18 bp, Homo sapiens
tcttccaacactgacacc

SEQ ID NO: 23294 - DNA, 23 bp, Homo sapiens
ctatttctcatagttcaggtctt

SEQ ID NO: 23295 - DNA, 22 bp, Homo sapiens
agtgctgtcagttttatagata

SEQ ID NO: 23296 - DNA, 22 bp, Homo sapiens
attcatcaactgatagccatag

SEQ ID NO: 23297 - DNA, 22 bp, Homo sapiens
ggcctgggctccgggagttact

SEQ ID NO: 23298 - DNA, 23 bp, Homo sapiens
agagcaaggaaatgaggtgtgat

SEQ ID NO: 23299 - DNA, 22 bp, Homo sapiens
gctgaggctcctcgggaggaca

SEQ ID NO: 23300 - DNA, 22 bp, Homo sapiens
agcatagagtcctgagggcagg

SEQ ID NO: 23301 - DNA, 22 bp, Homo sapiens
atgagttgaagctacaagaggc

SEQ ID NO: 23302 - DNA, 22 bp, Homo sapiens
ctacattaaattggcttactta

SEQ ID NO: 23303 - DNA, 22 bp, Homo sapiens
cctccctgccggctggactagt

SEQ ID NO: 23304 - DNA, 22 bp, Homo sapiens
gccaccctggacgcactgttcg

SEQ ID NO: 23305 - DNA, 22 bp, Homo sapiens
ggagaagcagcttcttgatgaa

SEQ ID NO: 23306 - DNA, 22 bp, Homo sapiens
tagagagtcgggaacttacctg

SEQ ID NO: 23307 - DNA, 22 bp, Homo sapiens
atacaatgacccgggtccaagg

SEQ ID NO: 23308 - DNA, 22 bp, Homo sapiens
aggctggagtgcagttgcatga

SEQ ID NO: 23309 - DNA, 22 bp, Homo sapiens
tgtgtgagtaaggctgagagag

SEQ ID NO: 23310 - DNA, 22 bp, Homo sapiens
cttgctttcagtctcggcctca

SEQ ID NO: 23311 - DNA, 22 bp, Homo sapiens
cttgcagtttaggtcctctgtg

SEQ ID NO: 23312 - DNA, 22 bp, Homo sapiens
caggagatgacagggaagaacc

SEQ ID NO: 23313 - DNA, 22 bp, Homo sapiens
caggctgatcagggctgggatg

SEQ ID NO: 23314 - DNA, 22 bp, Homo sapiens
tcagttatagatacttttacca

SEQ ID NO: 23315 - DNA, 22 bp, Homo sapiens
caagaatcaacattatttagtg

SEQ ID NO: 23316 - DNA, 22 bp, Homo sapiens
agtggccagcagcctagcctag

SEQ ID NO: 23317 - DNA, 22 bp, Homo sapiens
tcacagctcactgtagcctcga

SEQ ID NO: 23318 - DNA, 22 bp, Homo sapiens
agtgcaggccccaggccaggcc

SEQ ID NO: 23319 - DNA, 20 bp, Homo sapiens
ccagagctgatggctgcccg

SEQ ID NO: 23320 - DNA, 22 bp, Homo sapiens
tcccaagtactaccaatctaat

SEQ ID NO: 23321 - DNA, 22 bp, Homo sapiens
ctgaacttattgagtgcttgct

SEQ ID NO: 23322 - DNA, 19 bp, Homo sapiens
agggaatccggctgaggga

SEQ ID NO: 23323 - DNA, 22 bp, Homo sapiens
tttcagatggaggtttaggaca

SEQ ID NO: 23324 - DNA, 22 bp, Homo sapiens
ccttcctaacattgccatgaca

SEQ ID NO: 23325 - DNA, 22 bp, Homo sapiens
tagctaaaccagtatgtgaagg

SEQ ID NO: 23326 - DNA, 22 bp, Homo sapiens
catcttgtctttttgggcctga

SEQ ID NO: 23327 - DNA, 22 bp, Homo sapiens
catccatagcttgatctgttcc

SEQ ID NO: 23328 - DNA, 22 bp, Homo sapiens
gcacatgcatgcatattcctgg

SEQ ID NO: 23329 - DNA, 22 bp, Homo sapiens
tccttgtaacgttgggctgggg

SEQ ID NO: 23330 - DNA, 22 bp, Homo sapiens
ttatgggagcaattggggaggt

SEQ ID NO: 23331 - DNA, 22 bp, Homo sapiens
tttctaatctgattctcctacc

SEQ ID NO: 23332 - DNA, 22 bp, Homo sapiens
ggtgccaggctgtagtcagggt

SEQ ID NO: 23333 - DNA, 22 bp, Homo sapiens
tacagggattgttttaatcacc

SEQ ID NO: 23334 - DNA, 22 bp, Homo sapiens
tggttaagtccagaaaggaagc

SEQ ID NO: 23335 - DNA, 22 bp, Homo sapiens
ttcagcagtgcagacacccagt

SEQ ID NO: 23336 - DNA, 22 bp, Homo sapiens
agtgaggggcagctgagtgggc

SEQ ID NO: 23337 - DNA, 17 bp, Homo sapiens
aagtgattcagccctca

SEQ ID NO: 23338 - DNA, 22 bp, Homo sapiens
caagagtgaaactctgtctcaa

SEQ ID NO: 23339 - DNA, 22 bp, Homo sapiens
gggctaaatgcagaaatgcaga

SEQ ID NO: 23340 - DNA, 22 bp, Homo sapiens
tcaccaggctggagtgcagtgg

SEQ ID NO: 23341 - DNA, 22 bp, Homo sapiens
aaggccttgccgaaggatgcca

SEQ ID NO: 23342 - DNA, 22 bp, Homo sapiens
cctgacgaaaggcgtgctggag

SEQ ID NO: 23343 - DNA, 22 bp, Homo sapiens
agccttcggccagagggtggcc

SEQ ID NO: 23344 - DNA, 22 bp, Homo sapiens
agctagtatttcattgaggatt

SEQ ID NO: 23345 - DNA, 22 bp, Homo sapiens
aaggctgtggttctatacagaa

SEQ ID NO: 23346 - DNA, 22 bp, Homo sapiens
tccccattcctctcggtggtgg

SEQ ID NO: 23347 - DNA, 22 bp, Homo sapiens
ctagtgcaatgatgaatacaag

SEQ ID NO: 23348 - DNA, 22 bp, Homo sapiens
ggggaaggaaagttattagcag

SEQ ID NO: 23349 - DNA, 22 bp, Homo sapiens
aggtcaagagtaaatttgggta

SEQ ID NO: 23350 - DNA, 22 bp, Homo sapiens
taggaatggtgctcagcagaaa

SEQ ID NO: 23351 - DNA, 16 bp, Homo sapiens
aggtggagaagttcac

SEQ ID NO: 23352 - DNA, 22 bp, Homo sapiens
ctggcccaggtggtcgttgagg

SEQ ID NO: 23353 - DNA, 22 bp, Homo sapiens
taattataacagttacatctta

SEQ ID NO: 23354 - DNA, 22 bp, Homo sapiens
ccgggccccacggtgacctcag

SEQ ID NO: 23355 - DNA, 22 bp, Homo sapiens
tggtatgaccgtggtgcaagca

SEQ ID NO: 23356 - DNA, 22 bp, Homo sapiens
tcttgggggactttggcatgga

SEQ ID NO: 23357 - DNA, 22 bp, Homo sapiens
ctggaaggagcccgggcggatc

SEQ ID NO: 23358 - DNA, 22 bp, Homo sapiens
caatcaatgctgctagttcctt

SEQ ID NO: 23359 - DNA, 22 bp, Homo sapiens
atggtactggggtcccggagtt

SEQ ID NO: 23360 - DNA, 22 bp, Homo sapiens
agtcaaggtggaccagaaaaat

SEQ ID NO: 23361 - DNA, 22 bp, Homo sapiens
cctgagtagctggaattaaagg

SEQ ID NO: 23362 - DNA, 22 bp, Homo sapiens
tgccgctccaggtctcgcggtg

SEQ ID NO: 23363 - DNA, 22 bp, Homo sapiens
tcctttgcttctgtcattctcc

SEQ ID NO: 23364 - DNA, 22 bp, Homo sapiens
ggtgaagtaatgaaacagggag

SEQ ID NO: 23365 - DNA, 22 bp, Homo sapiens
ctcgggcaccctggttctggtg

SEQ ID NO: 23366 - DNA, 22 bp, Homo sapiens
tctaattttggcattttaacct

SEQ ID NO: 23367 - DNA, 22 bp, Homo sapiens
tgggattcaccatgggcttcag

SEQ ID NO: 23368 - DNA, 22 bp, Homo sapiens
caagcgtggctgctctgatgga

SEQ ID NO: 23369 - DNA, 22 bp, Homo sapiens
aggagctgtcagagtgccagag

SEQ ID NO: 23370 - DNA, 22 bp, Homo sapiens
aggtggagaagagatgggcagt

SEQ ID NO: 23371 - DNA, 22 bp, Homo sapiens
acttatagaataatgtttttag

SEQ ID NO: 23372 - DNA, 22 bp, Homo sapiens
aatataacacagatggcctgtt

SEQ ID NO: 23373 - DNA, 22 bp, Homo sapiens
ccaggaggcggaggttgcagcg

SEQ ID NO: 23374 - DNA, 22 bp, Homo sapiens
ctgcgtgagcgtgcccgtcttg

SEQ ID NO: 23375 - DNA, 22 bp, Homo sapiens
ccgaggctggagtgcagtggcg

SEQ ID NO: 23376 - DNA, 19 bp, Homo sapiens
atcccaaggagctgggact

SEQ ID NO: 23377 - DNA, 22 bp, Homo sapiens
ctcactgcaacctctgcctccc

SEQ ID NO: 23378 - DNA, 22 bp, Homo sapiens
caagcaccatgtgctccatgtt

SEQ ID NO: 23379 - DNA, 18 bp, Homo sapiens
ttcacaagggcttggttt

SEQ ID NO: 23380 - DNA, 22 bp, Homo sapiens
gactactcaaactttctctata

SEQ ID NO: 23381 - DNA, 21 bp, Homo sapiens
tctgagactgggttagaatgt

SEQ ID NO: 23382 - DNA, 19 bp, Homo sapiens
ctctgggcaagtcacttaa

SEQ ID NO: 23383 - DNA, 22 bp, Homo sapiens
gtagtctgaacagtaattttgt

SEQ ID NO: 23384 - DNA, 22 bp, Homo sapiens
ttgagcatctgaggattttcct

SEQ ID NO: 23385 - DNA, 22 bp, Homo sapiens
ctgtaacctcctctttccattc

SEQ ID NO: 23386 - DNA, 22 bp, Homo sapiens
ttggcagattctgaacaaagcc

SEQ ID NO: 23387 - DNA, 22 bp, Homo sapiens
tctgccttctatcttttgtctg

SEQ ID NO: 23388 - DNA, 22 bp, Homo sapiens
tgtgcatgtgtctttatagtag

SEQ ID NO: 23389 - DNA, 22 bp, Homo sapiens
cagaagactgcagggaagggac

SEQ ID NO: 23390 - DNA, 21 bp, Homo sapiens
gttcaaatcctgacactacac

SEQ ID NO: 23391 - DNA, 22 bp, Homo sapiens
cactgcactccagcctgggaga

SEQ ID NO: 23392 - DNA, 22 bp, Homo sapiens
caactccctgtggggtactggg

SEQ ID NO: 23393 - DNA, 22 bp, Homo sapiens
gccgggaccaaggccacggagc

SEQ ID NO: 23394 - DNA, 22 bp, Homo sapiens
cagccccacacggtctagctct

SEQ ID NO: 23395 - DNA, 21 bp, Homo sapiens
gggcctggctgcgcaggacgg

SEQ ID NO: 23396 - DNA, 22 bp, Homo sapiens
cttccctctgctccttggtcca

SEQ ID NO: 23397 - DNA, 22 bp, Homo sapiens
tccttgactgtgaggaactagc

SEQ ID NO: 23398 - DNA, 22 bp, Homo sapiens
ctcgttgctgaagccaaagtca

SEQ ID NO: 23399 - DNA, 22 bp, Homo sapiens
ggtgccagatgaggcccgcgat

SEQ ID NO: 23400 - DNA, 21 bp, Homo sapiens
aggcaccacatctccctcccc

SEQ ID NO: 23401 - DNA, 22 bp, Homo sapiens
ctgggggtcttgaaagggagag

SEQ ID NO: 23402 - DNA, 23 bp, Homo sapiens
aggcgagctcttctccagcacgt

SEQ ID NO: 23403 - DNA, 22 bp, Homo sapiens
tattgacagtgactattggtag

SEQ ID NO: 23404 - DNA, 22 bp, Homo sapiens
ggctcactgcaagctccgcctc

SEQ ID NO: 23405 - DNA, 22 bp, Homo sapiens
ccagcccgaatccctggccagg

SEQ ID NO: 23406 - DNA, 22 bp, Homo sapiens
cggagcgctgggggactctgca

SEQ ID NO: 23407 - DNA, 22 bp, Homo sapiens
accactgcccatggtgaaaact

SEQ ID NO: 23408 - DNA, 22 bp, Homo sapiens
aaagtgctgaaattacaggggt

SEQ ID NO: 23409 - DNA, 22 bp, Homo sapiens
aagtagcagggattacaggtgt

SEQ ID NO: 23410 - DNA, 21 bp, Homo sapiens
ccgtgctcggctatggaccac

SEQ ID NO: 23411 - DNA, 22 bp, Homo sapiens
ccctgatagcccctatcatcag

SEQ ID NO: 23412 - DNA, 22 bp, Homo sapiens
ggaccggtggcttcctcgggtc

SEQ ID NO: 23413 - DNA, 22 bp, Homo sapiens
tctctcttttttgaacccgctc

SEQ ID NO: 23414 - DNA, 22 bp, Homo sapiens
ctgcgtgcatgtctgcgtgcat

SEQ ID NO: 23415 - DNA, 22 bp, Homo sapiens
cgctgcagaagcgtgttcagga

SEQ ID NO: 23416 - DNA, 22 bp, Homo sapiens
attggccatttgcatgtattat

SEQ ID NO: 23417 - DNA, 22 bp, Homo sapiens
ctggatgtccaggtagaagttt

SEQ ID NO: 23418 - DNA, 22 bp, Homo sapiens
gggctcgaagcgctggtggttg

SEQ ID NO: 23419 - DNA, 21 bp, Homo sapiens
gacactgcttactctgaccta

SEQ ID NO: 23420 - DNA, 22 bp, Homo sapiens
tcactgcatcctccgcctcctg

SEQ ID NO: 23421 - DNA, 22 bp, Homo sapiens
ttcctgggattattgtcaagca

SEQ ID NO: 23422 - DNA, 22 bp, Homo sapiens
tgatgaccgccaacgtttaggt

SEQ ID NO: 23423 - DNA, 22 bp, Homo sapiens
ttacatgtggtgtgaagaagag

SEQ ID NO: 23424 - DNA, 22 bp, Homo sapiens
aatgcaccttggcagggattca

SEQ ID NO: 23425 - DNA, 22 bp, Homo sapiens
actgcaacacctcctgggttca

SEQ ID NO: 23426 - DNA, 22 bp, Homo sapiens
gctgggtgattcatttccataa

SEQ ID NO: 23427 - DNA, 22 bp, Homo sapiens
gtcaggactctgacccgtcccg

SEQ ID NO: 23428 - DNA, 22 bp, Homo sapiens
tggtgccatcatagctcactgc

SEQ ID NO: 23429 - DNA, 22 bp, Homo sapiens
catagagtgatgtaaggtatgt

SEQ ID NO: 23430 - DNA, 22 bp, Homo sapiens
atgcacacgtaccctacaaggc

SEQ ID NO: 23431 - DNA, 22 bp, Homo sapiens
ccctcccagatgggcttgaggt

SEQ ID NO: 23432 - DNA, 22 bp, Homo sapiens
cccagcagtagagctcatatgg

SEQ ID NO: 23433 - DNA, 22 bp, Homo sapiens
gacccggctccaggcccagcag

SEQ ID NO: 23434 - DNA, 22 bp, Homo sapiens
ttcaccatgttggccaggctgg

SEQ ID NO: 23435 - DNA, 22 bp, Homo sapiens
atcacccaggctggagtgcagt

SEQ ID NO: 23436 - DNA, 22 bp, Homo sapiens
ctcactgcaagctcagcctccc

SEQ ID NO: 23437 - DNA, 22 bp, Homo sapiens
attcacagggggagaagggtat

SEQ ID NO: 23438 - DNA, 22 bp, Homo sapiens
aacccagggtggaggttgcagt

SEQ ID NO: 23439 - DNA, 22 bp, Homo sapiens
agccagtgcagctggaaattca

SEQ ID NO: 23440 - DNA, 22 bp, Homo sapiens
gaggaggcttccgggaggcacg

SEQ ID NO: 23441 - DNA, 22 bp, Homo sapiens
gcccatgcactttctgtgatgg

SEQ ID NO: 23442 - DNA, 22 bp, Homo sapiens
gtcttgatctcctgaccttgtg

SEQ ID NO: 23443 - DNA, 22 bp, Homo sapiens
tctcccaagcctggcaggggca

SEQ ID NO: 23444 - DNA, 22 bp, Homo sapiens
tagcccctgcctttgaacctgg

SEQ ID NO: 23445 - DNA, 22 bp, Homo sapiens
aagtataatcaaagcagggcta

SEQ ID NO: 23446 - DNA, 22 bp, Homo sapiens
gcttctcaattctcaccctcca

SEQ ID NO: 23447 - DNA, 22 bp, Homo sapiens
ccagttccagtgctcacatcca

SEQ ID NO: 23448 - DNA, 22 bp, Homo sapiens
tggcacaggatctcagcggcca

SEQ ID NO: 23449 - DNA, 22 bp, Homo sapiens
gtcacctcgctgtcttcctgag

SEQ ID NO: 23450 - DNA, 22 bp, Homo sapiens
gctcccagtctgatggaggaga

SEQ ID NO: 23451 - DNA, 22 bp, Homo sapiens
ttgaggtcatctgaagtactag

SEQ ID NO: 23452 - DNA, 22 bp, Homo sapiens
tttggtaagtacccacctgggt

SEQ ID NO: 23453 - DNA, 22 bp, Homo sapiens
taaatgttttgtgggttgagtt

SEQ ID NO: 23454 - DNA, 22 bp, Homo sapiens
tatggctaattctttactgacc

SEQ ID NO: 23455 - DNA, 18 bp, Homo sapiens
ggtgagggagctggaagc

SEQ ID NO: 23456 - DNA, 23 bp, Homo sapiens
tcaagcaattctcctgcctcggc

SEQ ID NO: 23457 - DNA, 22 bp, Homo sapiens
aggagaagccaagttgtgagca

SEQ ID NO: 23458 - DNA, 22 bp, Homo sapiens
ttcctagggcagagccgctggg

SEQ ID NO: 23459 - DNA, 22 bp, Homo sapiens
gttctgagtcctcctttgaagg

SEQ ID NO: 23460 - DNA, 22 bp, Homo sapiens
tacagcctggcactaccctggg

SEQ ID NO: 23461 - DNA, 22 bp, Homo sapiens
gaggcccggcgcaggcggactt

SEQ ID NO: 23462 - DNA, 22 bp, Homo sapiens
aaagtaattgcagtttctgcca

SEQ ID NO: 23463 - DNA, 22 bp, Homo sapiens
ctgtgttctccaggggcagctg

SEQ ID NO: 23464 - DNA, 22 bp, Homo sapiens
atcactgtgtatgtatatgcag

SEQ ID NO: 23465 - DNA, 22 bp, Homo sapiens
cacagctgaagtagccatgtgg

SEQ ID NO: 23466 - DNA, 22 bp, Homo sapiens
ctcactgcaagctccgcctccc

SEQ ID NO: 23467 - DNA, 22 bp, Homo sapiens
cccaggcttttctcttgcccca

SEQ ID NO: 23468 - DNA, 22 bp, Homo sapiens
ggggtactggctggagccccac

SEQ ID NO: 23469 - DNA, 22 bp, Homo sapiens
gtgagactcgcctttgtgtagc

SEQ ID NO: 23470 - DNA, 22 bp, Homo sapiens
atgatggctaggctggttttga

SEQ ID NO: 23471 - DNA, 22 bp, Homo sapiens
cccaggaggcggaggttgcagt

SEQ ID NO: 23472 - DNA, 21 bp, Homo sapiens
agaacccagcagcactgttct

SEQ ID NO: 23473 - DNA, 22 bp, Homo sapiens
tgtgacaagcattgtatattgg

SEQ ID NO: 23474 - DNA, 22 bp, Homo sapiens
cgggttcacgccattctcctgc

SEQ ID NO: 23475 - DNA, 22 bp, Homo sapiens
tatgttaacatgttaggaactg

SEQ ID NO: 23476 - DNA, 22 bp, Homo sapiens
ggaatcgttaggtaagcaggga

SEQ ID NO: 23477 - DNA, 22 bp, Homo sapiens
ttacctaaaatagctcaattta

SEQ ID NO: 23478 - DNA, 21 bp, Homo sapiens
ggtgacacgtggccccgctct

SEQ ID NO: 23479 - DNA, 22 bp, Homo sapiens
cccaggaattggaggctgcagt

SEQ ID NO: 23480 - DNA, 22 bp, Homo sapiens
tttattctgtgctacatgaaga

SEQ ID NO: 23481 - DNA, 22 bp, Homo sapiens
gaggctggacgtgcatttctac

SEQ ID NO: 23482 - DNA, 23 bp, Homo sapiens
catgatgttaactttgttatgct

SEQ ID NO: 23483 - DNA, 20 bp, Homo sapiens
ttcatgggagcaaagaggcc

SEQ ID NO: 23484 - DNA, 22 bp, Homo sapiens
atccaccctgtggtggctttct

SEQ ID NO: 23485 - DNA, 22 bp, Homo sapiens
gagtgccttccccatgctttgg

SEQ ID NO: 23486 - DNA, 22 bp, Homo sapiens
gatgggcgtggcgcgtttggtg

SEQ ID NO: 23487 - DNA, 22 bp, Homo sapiens
ttccatcattaacaccacaagg

SEQ ID NO: 23488 - DNA, 22 bp, Homo sapiens
cttgccttcagtccatcagtca

SEQ ID NO: 23489 - DNA, 22 bp, Homo sapiens
tggaggcagccgtgaaccacct

SEQ ID NO: 23490 - DNA, 22 bp, Homo sapiens
gaattcttttctttctgaaagt

SEQ ID NO: 23491 - DNA, 22 bp, Homo sapiens
gatggcacacagacatccccgc

SEQ ID NO: 23492 - DNA, 22 bp, Homo sapiens
cagggcctcctaaggcatctaa

SEQ ID NO: 23493 - DNA, 22 bp, Homo sapiens
gatggtgcaggtgaagtgctgg

SEQ ID NO: 23494 - DNA, 20 bp, Homo sapiens
attagctcaggtgaggtcat

SEQ ID NO: 23495 - DNA, 22 bp, Homo sapiens
atcaaatacaaagggcataagg

SEQ ID NO: 23496 - DNA, 22 bp, Homo sapiens
tgaggcgtctccctgagctcac

SEQ ID NO: 23497 - DNA, 22 bp, Homo sapiens
gaccctctagatggaagcactg

SEQ ID NO: 23498 - DNA, 22 bp, Homo sapiens
tcaccttgtgatctccctgcct

SEQ ID NO: 23499 - DNA, 22 bp, Homo sapiens
tagaaaagccccagctggaggg

SEQ ID NO: 23500 - DNA, 22 bp, Homo sapiens
tctccgatcacaggttttcaat

SEQ ID NO: 23501 - DNA, 22 bp, Homo sapiens
gaatgtgtactgagtgcccctt

SEQ ID NO: 23502 - DNA, 23 bp, Homo sapiens
agaaagtcatggccaggtttgat

SEQ ID NO: 23503 - DNA, 22 bp, Homo sapiens
tgagaaacttgccaagcatctc

SEQ ID NO: 23504 - DNA, 19 bp, Homo sapiens
gatgctcattcaggtggaa

SEQ ID NO: 23505 - DNA, 22 bp, Homo sapiens
atacaaaatatatactggagac

SEQ ID NO: 23506 - DNA, 22 bp, Homo sapiens
tgaggatgtctgtattttgcct

SEQ ID NO: 23507 - DNA, 22 bp, Homo sapiens
tagactggtgaattagggggaa

SEQ ID NO: 23508 - DNA, 22 bp, Homo sapiens
taggggcaggatcctttgagcc

SEQ ID NO: 23509 - DNA, 22 bp, Homo sapiens
ggaatgaatttccagctgggtc

SEQ ID NO: 23510 - DNA, 22 bp, Homo sapiens
gggatcgggcttgaggggccct

SEQ ID NO: 23511 - DNA, 19 bp, Homo sapiens
tccacagtggttgaactag

SEQ ID NO: 23512 - DNA, 22 bp, Homo sapiens
ttccaaaggctgcaccttgccc

SEQ ID NO: 23513 - DNA, 22 bp, Homo sapiens
ccgaggtcctggacttggccct

SEQ ID NO: 23514 - DNA, 18 bp, Homo sapiens
ggctgtggacaagattag

SEQ ID NO: 23515 - DNA, 23 bp, Homo sapiens
ctcctggtgctgctatcaggggt

SEQ ID NO: 23516 - DNA, 22 bp, Homo sapiens
caggggcgggtaaaaggcctcc

SEQ ID NO: 23517 - DNA, 22 bp, Homo sapiens
ctacttgttcactgtaggtcgc

SEQ ID NO: 23518 - DNA, 22 bp, Homo sapiens
atgtatacgtgcaggtcacagg

SEQ ID NO: 23519 - DNA, 22 bp, Homo sapiens
caggaattcatagcattgttct

SEQ ID NO: 23520 - DNA, 22 bp, Homo sapiens
gagtagaactggttatctaata

SEQ ID NO: 23521 - DNA, 22 bp, Homo sapiens
cccgagtgtctactcactccca

SEQ ID NO: 23522 - DNA, 22 bp, Homo sapiens
aggggaatgggtagactgttga

SEQ ID NO: 23523 - DNA, 21 bp, Homo sapiens
ttgttcctatctgcctcctgc

SEQ ID NO: 23524 - DNA, 22 bp, Homo sapiens
agggctctgagtgggaaagagg

SEQ ID NO: 23525 - DNA, 19 bp, Homo sapiens
tgtccgtggccttctggat

SEQ ID NO: 23526 - DNA, 22 bp, Homo sapiens
gggaaatctcgtcctctattta

SEQ ID NO: 23527 - DNA, 22 bp, Homo sapiens
ctgctgagagccccagctgaga

SEQ ID NO: 23528 - DNA, 22 bp, Homo sapiens
tcatcagcaccctatgtccttt

SEQ ID NO: 23529 - DNA, 22 bp, Homo sapiens
tgatttcaagccagggggcgtt

SEQ ID NO: 23530 - DNA, 22 bp, Homo sapiens
gaggttggggctgcagtgagct

SEQ ID NO: 23531 - DNA, 22 bp, Homo sapiens
ttggaaacgtcaccttttcctt

SEQ ID NO: 23532 - DNA, 22 bp, Homo sapiens
ttgtgctgtgagaatgctcatt

SEQ ID NO: 23533 - DNA, 22 bp, Homo sapiens
tctggagataagcagcaatgaa

SEQ ID NO: 23534 - DNA, 22 bp, Homo sapiens
attggccagacttatccttcag

SEQ ID NO: 23535 - DNA, 22 bp, Homo sapiens
gtgcgggcctgggggtttctct

SEQ ID NO: 23536 - DNA, 22 bp, Homo sapiens
aagagggaaattgttggctgct

SEQ ID NO: 23537 - DNA, 22 bp, Homo sapiens
acggggctagagaaggtttctt

SEQ ID NO: 23538 - DNA, 22 bp, Homo sapiens
tctcctggagcccagatgctgg

SEQ ID NO: 23539 - DNA, 22 bp, Homo sapiens
atcacccaagctggagtgcagt

SEQ ID NO: 23540 - DNA, 22 bp, Homo sapiens
gggtaattggggccttgcagtg

SEQ ID NO: 23541 - DNA, 21 bp, Homo sapiens
cctggttcaagtgatgcccct

SEQ ID NO: 23542 - DNA, 21 bp, Homo sapiens
ggagtttttctggaagggact

SEQ ID NO: 23543 - DNA, 22 bp, Homo sapiens
tcactgcgcttcagcctgggtg

SEQ ID NO: 23544 - DNA, 22 bp, Homo sapiens
tgtcttcgctacaatgaaaagg

SEQ ID NO: 23545 - DNA, 22 bp, Homo sapiens
catgctgggtaaaggtggtgaa

SEQ ID NO: 23546 - DNA, 22 bp, Homo sapiens
gagcaggtgcctgtagctctct

SEQ ID NO: 23547 - DNA, 22 bp, Homo sapiens
gcaggtctgttgattacagtca

SEQ ID NO: 23548 - DNA, 22 bp, Homo sapiens
agctgaacgtgcttctgcagca

SEQ ID NO: 23549 - DNA, 22 bp, Homo sapiens
actgagcaggagaatcacttta

SEQ ID NO: 23550 - DNA, 22 bp, Homo sapiens
cgtgctgggtctgcggggccgt

SEQ ID NO: 23551 - DNA, 22 bp, Homo sapiens
tctgaatcgttcccatgcagga

SEQ ID NO: 23552 - DNA, 22 bp, Homo sapiens
atgtgcacggtgtcaaacgggg

SEQ ID NO: 23553 - DNA, 19 bp, Homo sapiens
tggctctgtcgaaggcaca

SEQ ID NO: 23554 - DNA, 22 bp, Homo sapiens
aggacaaaggaccagatctgga

SEQ ID NO: 23555 - DNA, 22 bp, Homo sapiens
tcgtgatctgtccacctcggcc

SEQ ID NO: 23556 - DNA, 22 bp, Homo sapiens
gacaggtgctaagggacctggc

SEQ ID NO: 23557 - DNA, 22 bp, Homo sapiens
ccctggctggctctgcccggac

SEQ ID NO: 23558 - DNA, 22 bp, Homo sapiens
tgctatgtcgaaagggccatta

SEQ ID NO: 23559 - DNA, 22 bp, Homo sapiens
ttctatttttgtggaactgtag

SEQ ID NO: 23560 - DNA, 22 bp, Homo sapiens
cgcccaggctggagtgcagtga

SEQ ID NO: 23561 - DNA, 22 bp, Homo sapiens
aaatgtaagtctttgtttctta

SEQ ID NO: 23562 - DNA, 18 bp, Homo sapiens
agagtatacagacaacaa

SEQ ID NO: 23563 - DNA, 23 bp, Homo sapiens
tcctcgcaggagggagatgatgc

SEQ ID NO: 23564 - DNA, 22 bp, Homo sapiens
acagatgttgcttgtcattctc

SEQ ID NO: 23565 - DNA, 20 bp, Homo sapiens
tttctccggtcttgagatcc

SEQ ID NO: 23566 - DNA, 22 bp, Homo sapiens
cagggccctgctcaatttctcc

SEQ ID NO: 23567 - DNA, 22 bp, Homo sapiens
accctcttgagggaagcacttt

SEQ ID NO: 23568 - DNA, 22 bp, Homo sapiens
agatttccagaccaatttctca

SEQ ID NO: 23569 - DNA, 22 bp, Homo sapiens
gctttatccgcttgacccttac

SEQ ID NO: 23570 - DNA, 22 bp, Homo sapiens
caaagctggaaaaggaggctgg

SEQ ID NO: 23571 - DNA, 21 bp, Homo sapiens
aggagcattgttgtggtggag

SEQ ID NO: 23572 - DNA, 22 bp, Homo sapiens
aggtgcccatgagctccatggc

SEQ ID NO: 23573 - DNA, 21 bp, Homo sapiens
tccttcagtctagatgattgt

SEQ ID NO: 23574 - DNA, 22 bp, Homo sapiens
gaatgcttggaacctgaagttc

SEQ ID NO: 23575 - DNA, 22 bp, Homo sapiens
gccctgagaagaagtcggaggg

SEQ ID NO: 23576 - DNA, 22 bp, Homo sapiens
atggaccagagcctcattctgt

SEQ ID NO: 23577 - DNA, 22 bp, Homo sapiens
gggagctgagctggaagagaat

SEQ ID NO: 23578 - DNA, 22 bp, Homo sapiens
aagtcgtggcaggcttgcacga

SEQ ID NO: 23579 - DNA, 22 bp, Homo sapiens
ttaggctgttcttgtgttgtta

SEQ ID NO: 23580 - DNA, 22 bp, Homo sapiens
agcaccgttcaaacccaggtta

SEQ ID NO: 23581 - DNA, 22 bp, Homo sapiens
acaagaagtaaaggtcggatgc

SEQ ID NO: 23582 - DNA, 22 bp, Homo sapiens
aagatactttgcatgcatgaag

SEQ ID NO: 23583 - DNA, 22 bp, Homo sapiens
ctccaggccatggctgcggagg

SEQ ID NO: 23584 - DNA, 22 bp, Homo sapiens
tggatatccttgttaactttct

SEQ ID NO: 23585 - DNA, 22 bp, Homo sapiens
gggggctccaggcgagaatgtg

SEQ ID NO: 23586 - DNA, 22 bp, Homo sapiens
gaggcaaagcatgtggctcagg

SEQ ID NO: 23587 - DNA, 22 bp, Homo sapiens
aggaggaagggaagacaagtaa

SEQ ID NO: 23588 - DNA, 22 bp, Homo sapiens
gtgaattacatgtatttttaag

SEQ ID NO: 23589 - DNA, 22 bp, Homo sapiens
atttggcagtataaattctggc

SEQ ID NO: 23590 - DNA, 22 bp, Homo sapiens
tataaactcctcttgcattcct

SEQ ID NO: 23591 - DNA, 22 bp, Homo sapiens
ctacccttaagtttctgtgggg

SEQ ID NO: 23592 - DNA, 22 bp, Homo sapiens
tgggctttgagctcggtcacct

SEQ ID NO: 23593 - DNA, 22 bp, Homo sapiens
atcttgttaaaaagcagattct

SEQ ID NO: 23594 - DNA, 22 bp, Homo sapiens
tgatctaggttggcttcaactg

SEQ ID NO: 23595 - DNA, 22 bp, Homo sapiens
gagctgaaggagaaagcagggg

SEQ ID NO: 23596 - DNA, 22 bp, Homo sapiens
ttaagtctctttgaagtgctct

SEQ ID NO: 23597 - DNA, 22 bp, Homo sapiens
tctttgggccgacactcgtcaa

SEQ ID NO: 23598 - DNA, 22 bp, Homo sapiens
gtccaagagtcaagaagggggc

SEQ ID NO: 23599 - DNA, 22 bp, Homo sapiens
tcttcctgtcaatgagaattaa

SEQ ID NO: 23600 - DNA, 22 bp, Homo sapiens
tgcagtcttccagctgcacaaa

SEQ ID NO: 23601 - DNA, 22 bp, Homo sapiens
gtcgtggagctcacagtgtgcc

SEQ ID NO: 23602 - DNA, 22 bp, Homo sapiens
aagcagagaatctgggagcgag

SEQ ID NO: 23603 - DNA, 22 bp, Homo sapiens
gaggcggaggttgcagtgagct

SEQ ID NO: 23604 - DNA, 22 bp, Homo sapiens
agaaagagatgaatgctttaag

SEQ ID NO: 23605 - DNA, 22 bp, Homo sapiens
agacgcggtggtgcatgcctgt

SEQ ID NO: 23606 - DNA, 22 bp, Homo sapiens
taacaaagtattgtttgtgtat

SEQ ID NO: 23607 - DNA, 22 bp, Homo sapiens
gaatgtcttcaaaactagactg

SEQ ID NO: 23608 - DNA, 22 bp, Homo sapiens
cccaggggttcaaggctgcagt

SEQ ID NO: 23609 - DNA, 22 bp, Homo sapiens
tgacagtattgatggcaggatt

SEQ ID NO: 23610 - DNA, 21 bp, Homo sapiens
gggcagaggggcctcctgggt

SEQ ID NO: 23611 - DNA, 22 bp, Homo sapiens
gtacaaatgcaggtttgttaca

SEQ ID NO: 23612 - DNA, 19 bp, Homo sapiens
ccttgtctggtgaaggact

SEQ ID NO: 23613 - DNA, 22 bp, Homo sapiens
ctctgcaagtccagcccctggc

SEQ ID NO: 23614 - DNA, 22 bp, Homo sapiens
cacaaaccttctgcagcctgta

SEQ ID NO: 23615 - DNA, 22 bp, Homo sapiens
tactttaatatatgtgaagttc

SEQ ID NO: 23616 - DNA, 22 bp, Homo sapiens
ttctgcagtgttaacaatgtca

SEQ ID NO: 23617 - DNA, 22 bp, Homo sapiens
cacgttaacagctaacagatga

SEQ ID NO: 23618 - DNA, 22 bp, Homo sapiens
cgcatgagacctgccggccatc

SEQ ID NO: 23619 - DNA, 21 bp, Homo sapiens
tgcttgttctctgtccttgca

SEQ ID NO: 23620 - DNA, 22 bp, Homo sapiens
aggctaggaacagcccggccct

SEQ ID NO: 23621 - DNA, 16 bp, Homo sapiens
cttgtctgttgctcat

SEQ ID NO: 23622 - DNA, 18 bp, Homo sapiens
tcctttctccctcatctt

SEQ ID NO: 23623 - DNA, 22 bp, Homo sapiens
tttacagcagcatgatttataa

SEQ ID NO: 23624 - DNA, 22 bp, Homo sapiens
gaagaggttcaacgtggtcatc

SEQ ID NO: 23625 - DNA, 21 bp, Homo sapiens
acatggactgtgaatggggac

SEQ ID NO: 23626 - DNA, 22 bp, Homo sapiens
tgcaaagttgaggaaggcatgg

SEQ ID NO: 23627 - DNA, 22 bp, Homo sapiens
agagcccctgggtcacacagcc

SEQ ID NO: 23628 - DNA, 22 bp, Homo sapiens
ctcagagtcccttccctcgtgg

SEQ ID NO: 23629 - DNA, 22 bp, Homo sapiens
tctgccgtgcgaggtcccacca

SEQ ID NO: 23630 - DNA, 22 bp, Homo sapiens
gtggcatctcagaggccaagaa

SEQ ID NO: 23631 - DNA, 22 bp, Homo sapiens
aatcacacaaaggcaacttttg

SEQ ID NO: 23632 - DNA, 22 bp, Homo sapiens
agagttgctccattagaactta

SEQ ID NO: 23633 - DNA, 22 bp, Homo sapiens
gatggcggtcgtcgacggtcct

SEQ ID NO: 23634 - DNA, 22 bp, Homo sapiens
ggagcagggaattacagcgcag

SEQ ID NO: 23635 - DNA, 22 bp, Homo sapiens
agaagccaccagctgaggaaga

SEQ ID NO: 23636 - DNA, 22 bp, Homo sapiens
gtgccgcgacgcagtcggtgcc

SEQ ID NO: 23637 - DNA, 22 bp, Homo sapiens
ggccgtgctccaaagtcatcgt

SEQ ID NO: 23638 - DNA, 22 bp, Homo sapiens
agatacattgttctaagcattg

SEQ ID NO: 23639 - DNA, 22 bp, Homo sapiens
aggtatatattctggtccttat

SEQ ID NO: 23640 - DNA, 22 bp, Homo sapiens
cccgtgggagagacacgcaccc

SEQ ID NO: 23641 - DNA, 22 bp, Homo sapiens
ggtcgctgtgtaggttcagcta

SEQ ID NO: 23642 - DNA, 17 bp, Homo sapiens
aggaggccctggcgttt

SEQ ID NO: 23643 - DNA, 22 bp, Homo sapiens
ggcctgcctcacagtcagcacc

SEQ ID NO: 23644 - DNA, 22 bp, Homo sapiens
aggtagaaggaccagaatttat

SEQ ID NO: 23645 - DNA, 22 bp, Homo sapiens
gtgggacaaggatgaagatatt

SEQ ID NO: 23646 - DNA, 22 bp, Homo sapiens
gaaccacaatgtgaagaaggag

SEQ ID NO: 23647 - DNA, 22 bp, Homo sapiens
gaagtttttgtagagacagggt

SEQ ID NO: 23648 - DNA, 22 bp, Homo sapiens
gggaggaggaatgttttgtgta

SEQ ID NO: 23649 - DNA, 22 bp, Homo sapiens
ggtttattgttaataagtttga

SEQ ID NO: 23650 - DNA, 22 bp, Homo sapiens
ggcagacctctccagccccaca

SEQ ID NO: 23651 - DNA, 22 bp, Homo sapiens
agctcaagctacacacagagtc

SEQ ID NO: 23652 - DNA, 22 bp, Homo sapiens
cactgcactccagctgggtgac

SEQ ID NO: 23653 - DNA, 21 bp, Homo sapiens
tcagataccagactcaagggg

SEQ ID NO: 23654 - DNA, 15 bp, Homo sapiens
gcaggcaggtcacct

SEQ ID NO: 23655 - DNA, 23 bp, Homo sapiens
aacgacagctacaggcatcccac

SEQ ID NO: 23656 - DNA, 22 bp, Homo sapiens
ttcgggaggcggagcttgcagt

SEQ ID NO: 23657 - DNA, 22 bp, Homo sapiens
accctgctttatgccgtcctct

SEQ ID NO: 23658 - DNA, 22 bp, Homo sapiens
tcctccccaaagcccagcctgg

SEQ ID NO: 23659 - DNA, 22 bp, Homo sapiens
taggccacagagaggagatttc

SEQ ID NO: 23660 - DNA, 22 bp, Homo sapiens
ttgtctaatgagctccacttca

SEQ ID NO: 23661 - DNA, 22 bp, Homo sapiens
catgatctggtcctactgtggg

SEQ ID NO: 23662 - DNA, 22 bp, Homo sapiens
ctgctcttgagggactgcggtc

SEQ ID NO: 23663 - DNA, 22 bp, Homo sapiens
agcttagtggttgtatgagtta

SEQ ID NO: 23664 - DNA, 22 bp, Homo sapiens
atggggagctcaccacctgttt

SEQ ID NO: 23665 - DNA, 22 bp, Homo sapiens
tcataaattctggtgctgtgag

SEQ ID NO: 23666 - DNA, 22 bp, Homo sapiens
cctgagagcattccacactgaa

SEQ ID NO: 23667 - DNA, 18 bp, Homo sapiens
acttcccagatgagggga

SEQ ID NO: 23668 - DNA, 22 bp, Homo sapiens
tcttagaaattccccagtggct

SEQ ID NO: 23669 - DNA, 22 bp, Homo sapiens
ttaccacagtgcctgtctaatg

SEQ ID NO: 23670 - DNA, 22 bp, Homo sapiens
attgggagtgtcctgatatccc

SEQ ID NO: 23671 - DNA, 21 bp, Homo sapiens
ttagaagctaatgcagctggt

SEQ ID NO: 23672 - DNA, 22 bp, Homo sapiens
acatggcgggagtttcagatac

SEQ ID NO: 23673 - DNA, 22 bp, Homo sapiens
tcactgcactccagcctgggtg

SEQ ID NO: 23674 - DNA, 22 bp, Homo sapiens
aggactgggtgcagagggcatc

SEQ ID NO: 23675 - DNA, 22 bp, Homo sapiens
gcagactgtatcaatgtcagta

SEQ ID NO: 23676 - DNA, 22 bp, Homo sapiens
ctcattgcaacctccgcctccc

SEQ ID NO: 23677 - DNA, 22 bp, Homo sapiens
caaagtggaggctctggggcca

SEQ ID NO: 23678 - DNA, 22 bp, Homo sapiens
ggagttcacgatgttggccagg

SEQ ID NO: 23679 - DNA, 22 bp, Homo sapiens
ctctgcctgtctcatcctgcaa

SEQ ID NO: 23680 - DNA, 22 bp, Homo sapiens
ctgatagacaatcaccatggga

SEQ ID NO: 23681 - DNA, 22 bp, Homo sapiens
ccgggagcaggcgccaccgcca

SEQ ID NO: 23682 - DNA, 22 bp, Homo sapiens
tgcgttgcgctcctgcagcagg

SEQ ID NO: 23683 - DNA, 22 bp, Homo sapiens
aattttctggtgtgtaatgaag

SEQ ID NO: 23684 - DNA, 21 bp, Homo sapiens
agtatcgtacctttaaggcag

SEQ ID NO: 23685 - DNA, 22 bp, Homo sapiens
taacaactgctgaggtatttga

SEQ ID NO: 23686 - DNA, 22 bp, Homo sapiens
ttgctctgactggagtgcagtg

SEQ ID NO: 23687 - DNA, 22 bp, Homo sapiens
cggagccagaggctggagaggc

SEQ ID NO: 23688 - DNA, 22 bp, Homo sapiens
agacactgttctcacatgcttg

SEQ ID NO: 23689 - DNA, 22 bp, Homo sapiens
aggactcatccctgcttgtcag

SEQ ID NO: 23690 - DNA, 22 bp, Homo sapiens
tattggccgggcgcggtggctc

SEQ ID NO: 23691 - DNA, 22 bp, Homo sapiens
ctgaggcaggcagatcacttga

SEQ ID NO: 23692 - DNA, 22 bp, Homo sapiens
ttgaaaagttttgaaacactct

SEQ ID NO: 23693 - DNA, 22 bp, Homo sapiens
tagctgggactactggccctgc

SEQ ID NO: 23694 - DNA, 22 bp, Homo sapiens
gagccaggaggcagagactgca

SEQ ID NO: 23695 - DNA, 22 bp, Homo sapiens
tgtctttgttattgtggacagg

SEQ ID NO: 23696 - DNA, 22 bp, Homo sapiens
ttcattttctttcacgctgctg

SEQ ID NO: 23697 - DNA, 22 bp, Homo sapiens
aacctgggcttgaacagtgcct

SEQ ID NO: 23698 - DNA, 22 bp, Homo sapiens
ctgtcctgccagtcctggactc

SEQ ID NO: 23699 - DNA, 19 bp, Homo sapiens
ggcttcgaggctggggaag

SEQ ID NO: 23700 - DNA, 22 bp, Homo sapiens
tctgatctgtcagtcatgaagg

SEQ ID NO: 23701 - DNA, 22 bp, Homo sapiens
ctcgggtaccatgctaggcact

SEQ ID NO: 23702 - DNA, 22 bp, Homo sapiens
tccggtccgggtactcctctct

SEQ ID NO: 23703 - DNA, 22 bp, Homo sapiens
gggaggctctgctcagcccccg

SEQ ID NO: 23704 - DNA, 22 bp, Homo sapiens
ggaaaggcctgggtgtcctggg

SEQ ID NO: 23705 - DNA, 22 bp, Homo sapiens
gagtgctttgtcttgtaattct

SEQ ID NO: 23706 - DNA, 22 bp, Homo sapiens
gatcctgggcccttctgggtca

SEQ ID NO: 23707 - DNA, 23 bp, Homo sapiens
tcagaacagttcttggtgcatag

SEQ ID NO: 23708 - DNA, 22 bp, Homo sapiens
aggctgtgtggataatattggg

SEQ ID NO: 23709 - DNA, 22 bp, Homo sapiens
ggctcaggcctgtaatcctagc

SEQ ID NO: 23710 - DNA, 22 bp, Homo sapiens
tcgcaccattgcactccagcca

SEQ ID NO: 23711 - DNA, 22 bp, Homo sapiens
ggagaagaggagctggaagcct

SEQ ID NO: 23712 - DNA, 22 bp, Homo sapiens
ctctcctattgtgtggtaagga

SEQ ID NO: 23713 - DNA, 22 bp, Homo sapiens
ggtgggccacggcataacgggc

SEQ ID NO: 23714 - DNA, 22 bp, Homo sapiens
gtgtccccacccaaatctcatc

SEQ ID NO: 23715 - DNA, 22 bp, Homo sapiens
tcagcagtgagaattaatgttg

SEQ ID NO: 23716 - DNA, 22 bp, Homo sapiens
agaggacagagtgctggattta

SEQ ID NO: 23717 - DNA, 22 bp, Homo sapiens
ctgggaggcggaggttgtagtg

SEQ ID NO: 23718 - DNA, 22 bp, Homo sapiens
ccccgaggctggagtgcagtgg

SEQ ID NO: 23719 - DNA, 20 bp, Homo sapiens
tgtttgtgtggggccttggc

SEQ ID NO: 23720 - DNA, 22 bp, Homo sapiens
tgtgccatgaggctctgatatg

SEQ ID NO: 23721 - DNA, 22 bp, Homo sapiens
taggggactgacaagcggggac

SEQ ID NO: 23722 - DNA, 22 bp, Homo sapiens
aggcggaagatggccccataga

SEQ ID NO: 23723 - DNA, 22 bp, Homo sapiens
actgtactccaacctgggcaac

SEQ ID NO: 23724 - DNA, 22 bp, Homo sapiens
ccctggaggcggagcttgcagt

SEQ ID NO: 23725 - DNA, 22 bp, Homo sapiens
gtgagatggagttggtgtcttt

SEQ ID NO: 23726 - DNA, 22 bp, Homo sapiens
agctggggctgtggttgtgatt

SEQ ID NO: 23727 - DNA, 22 bp, Homo sapiens
tccctctacagggaagcgcttt

SEQ ID NO: 23728 - DNA, 19 bp, Homo sapiens
tctcaattctccccactgc

SEQ ID NO: 23729 - DNA, 22 bp, Homo sapiens
cattctgcgatcctcaagcaca

SEQ ID NO: 23730 - DNA, 22 bp, Homo sapiens
acgtagcactgagagatgcagg

SEQ ID NO: 23731 - DNA, 22 bp, Homo sapiens
tcagtgatttctggggtgaggg

SEQ ID NO: 23732 - DNA, 22 bp, Homo sapiens
ataaagtggaggtagtattcat

SEQ ID NO: 23733 - DNA, 22 bp, Homo sapiens
tctgtggcccaagtgatggctg

SEQ ID NO: 23734 - DNA, 22 bp, Homo sapiens
tgtggtgccgagagtctggacg

SEQ ID NO: 23735 - DNA, 22 bp, Homo sapiens
atttagtagagaaattaagaaa

SEQ ID NO: 23736 - DNA, 22 bp, Homo sapiens
gctgcctacgcttgagccctgg

SEQ ID NO: 23737 - DNA, 18 bp, Homo sapiens
gaggtagataagattttc

SEQ ID NO: 23738 - DNA, 22 bp, Homo sapiens
caggtgagaggcggtcctgcat

SEQ ID NO: 23739 - DNA, 22 bp, Homo sapiens
ttacatgtttatgtggtacatg

SEQ ID NO: 23740 - DNA, 22 bp, Homo sapiens
tgtaagtagtaatggaaggaca

SEQ ID NO: 23741 - DNA, 22 bp, Homo sapiens
tggactaaagaaacattccgtg

SEQ ID NO: 23742 - DNA, 22 bp, Homo sapiens
tctacctggagtccgttgttaa

SEQ ID NO: 23743 - DNA, 22 bp, Homo sapiens
ttgcttgcattgtccctggtga

SEQ ID NO: 23744 - DNA, 22 bp, Homo sapiens
ggtcacacaccaggacctgcag

SEQ ID NO: 23745 - DNA, 22 bp, Homo sapiens
cccaggaggcctgcctggccgg

SEQ ID NO: 23746 - DNA, 22 bp, Homo sapiens
ttgtacatttgttcagttctga

SEQ ID NO: 23747 - DNA, 22 bp, Homo sapiens
ttctagtgtccttggacttgct

SEQ ID NO: 23748 - DNA, 22 bp, Homo sapiens
ggagctcctggcagtgacagag

SEQ ID NO: 23749 - DNA, 22 bp, Homo sapiens
tccagaaggccacccggggatg

SEQ ID NO: 23750 - DNA, 22 bp, Homo sapiens
cattccttaacgtggggagtct

SEQ ID NO: 23751 - DNA, 22 bp, Homo sapiens
cagcctttgggtcagaagattc

SEQ ID NO: 23752 - DNA, 22 bp, Homo sapiens
ggtagggctgcaatggtagtga

SEQ ID NO: 23753 - DNA, 22 bp, Homo sapiens
catttctgggagacatgctaga

SEQ ID NO: 23754 - DNA, 22 bp, Homo sapiens
aacttaggaaaataaggcatga

SEQ ID NO: 23755 - DNA, 22 bp, Homo sapiens
taagagaatgttgtggctaggt

SEQ ID NO: 23756 - DNA, 22 bp, Homo sapiens
cgtgtggtcccggcaaggcaag

SEQ ID NO: 23757 - DNA, 22 bp, Homo sapiens
aagctctttccactaaaccact

SEQ ID NO: 23758 - DNA, 22 bp, Homo sapiens
ttccaaagaagttcacatttac

SEQ ID NO: 23759 - DNA, 22 bp, Homo sapiens
aaagtgctgggattacaggctt

SEQ ID NO: 23760 - DNA, 22 bp, Homo sapiens
tcgctgaggctgcacggctgcc

SEQ ID NO: 23761 - DNA, 22 bp, Homo sapiens
attgtaaatagtgccacaataa

SEQ ID NO: 23762 - DNA, 22 bp, Homo sapiens
agataaagtccaaactgtgtag

SEQ ID NO: 23763 - DNA, 22 bp, Homo sapiens
agttgagggtgggagagaaatg

SEQ ID NO: 23764 - DNA, 22 bp, Homo sapiens
agacaaagaaaccgtagaagca

SEQ ID NO: 23765 - DNA, 22 bp, Homo sapiens
tttctcatggaacatcgtttag

SEQ ID NO: 23766 - DNA, 22 bp, Homo sapiens
gtggaatttttacctatgaatg

SEQ ID NO: 23767 - DNA, 22 bp, Homo sapiens
tggaacaagggcgtggcggtcg

SEQ ID NO: 23768 - DNA, 21 bp, Homo sapiens
gttctacagttttagaattcc

SEQ ID NO: 23769 - DNA, 22 bp, Homo sapiens
atacaatgattggttctcaccc

SEQ ID NO: 23770 - DNA, 22 bp, Homo sapiens
ctgcattgatcaggcagaatct

SEQ ID NO: 23771 - DNA, 22 bp, Homo sapiens
gtgcaaccatcaccactgactc

SEQ ID NO: 23772 - DNA, 22 bp, Homo sapiens
tattgctatgagcattgttctt

SEQ ID NO: 23773 - DNA, 22 bp, Homo sapiens
agctgattccactttttcccca

SEQ ID NO: 23774 - DNA, 22 bp, Homo sapiens
gatcgggtgggttctgccatca

SEQ ID NO: 23775 - DNA, 22 bp, Homo sapiens
gtcagtaggaacctagggtcaa

SEQ ID NO: 23776 - DNA, 22 bp, Homo sapiens
cttaatctcacctgcaaagtcc

SEQ ID NO: 23777 - DNA, 22 bp, Homo sapiens
gaggttcattcagctctgtcac

SEQ ID NO: 23778 - DNA, 22 bp, Homo sapiens
aggtgcttggctcgtgcacaca

SEQ ID NO: 23779 - DNA, 22 bp, Homo sapiens
tttcccagcctcagctcagcag

SEQ ID NO: 23780 - DNA, 22 bp, Homo sapiens
acggcaggctcagagctggaat

SEQ ID NO: 23781 - DNA, 22 bp, Homo sapiens
ggagagcttggagtgcgatttt

SEQ ID NO: 23782 - DNA, 22 bp, Homo sapiens
tgagcctgggtggtcgaggctg

SEQ ID NO: 23783 - DNA, 22 bp, Homo sapiens
cttgcctttgtcttcaaaggct

SEQ ID NO: 23784 - DNA, 22 bp, Homo sapiens
aaggctgaggcagtgaggcaga

SEQ ID NO: 23785 - DNA, 22 bp, Homo sapiens
tgatgcctaatatacttcaatt

SEQ ID NO: 23786 - DNA, 22 bp, Homo sapiens
tcttctatcctcagcccctgcc

SEQ ID NO: 23787 - DNA, 22 bp, Homo sapiens
cattaaacaaccttgaatcaat

SEQ ID NO: 23788 - DNA, 16 bp, Homo sapiens
aggctcagaggctgga

SEQ ID NO: 23789 - DNA, 22 bp, Homo sapiens
attcacctttccccaaaatgag

SEQ ID NO: 23790 - DNA, 22 bp, Homo sapiens
ctggctttgatcagagtgacct

SEQ ID NO: 23791 - DNA, 17 bp, Homo sapiens
catccgtgagctcggca

SEQ ID NO: 23792 - DNA, 22 bp, Homo sapiens
tcgaaggcctcttgctcctcga

SEQ ID NO: 23793 - DNA, 22 bp, Homo sapiens
caggctgaagtgcagtggtgtg

SEQ ID NO: 23794 - DNA, 22 bp, Homo sapiens
gggttggcatcagggttctgtg

SEQ ID NO: 23795 - DNA, 22 bp, Homo sapiens
tgtgggtggcatcgtcctggcc

SEQ ID NO: 23796 - DNA, 21 bp, Homo sapiens
tggcggggacttgtggctgcc

SEQ ID NO: 23797 - DNA, 16 bp, Homo sapiens
atgctgctattagagg

SEQ ID NO: 23798 - DNA, 22 bp, Homo sapiens
gcctggactgttctaccatttt

SEQ ID NO: 23799 - DNA, 22 bp, Homo sapiens
atagttttaaaacctcaggaag

SEQ ID NO: 23800 - DNA, 22 bp, Homo sapiens
tggggacttgccttgttgctca

SEQ ID NO: 23801 - DNA, 22 bp, Homo sapiens
ttggaatgttttaatataaatt

SEQ ID NO: 23802 - DNA, 22 bp, Homo sapiens
ccacctgagataagagagctca

SEQ ID NO: 23803 - DNA, 22 bp, Homo sapiens
accccaggaagtggaggtcatg

SEQ ID NO: 23804 - DNA, 17 bp, Homo sapiens
tgtagcttctccttctc

SEQ ID NO: 23805 - DNA, 21 bp, Homo sapiens
ggtgctcgctgatgaggagtg

SEQ ID NO: 23806 - DNA, 22 bp, Homo sapiens
acaggggcaagggctcacggcc

SEQ ID NO: 23807 - DNA, 22 bp, Homo sapiens
aaagtgctgggattacaggcat

SEQ ID NO: 23808 - DNA, 22 bp, Homo sapiens
cctgattcagtggtgcccagag

SEQ ID NO: 23809 - DNA, 22 bp, Homo sapiens
cgtgagcaaaatggacactccc

SEQ ID NO: 23810 - DNA, 22 bp, Homo sapiens
cagtgcatgcacacacatggta

SEQ ID NO: 23811 - DNA, 22 bp, Homo sapiens
aatgtgagccaatgcccgtggg

SEQ ID NO: 23812 - DNA, 22 bp, Homo sapiens
gggaaggccttgtcagcggatt

SEQ ID NO: 23813 - DNA, 22 bp, Homo sapiens
actgagggtcaaccatttgctc

SEQ ID NO: 23814 - DNA, 22 bp, Homo sapiens
aggaatggtgctcagcagaaat

SEQ ID NO: 23815 - DNA, 22 bp, Homo sapiens
ttggatgggcattaggaaagtc

SEQ ID NO: 23816 - DNA, 22 bp, Homo sapiens
tggcatgcatctgttgtcctag

SEQ ID NO: 23817 - DNA, 22 bp, Homo sapiens
ggagtttgcctattgcttttgg

SEQ ID NO: 23818 - DNA, 22 bp, Homo sapiens
gtgcaggacagcacatctcctg

SEQ ID NO: 23819 - DNA, 22 bp, Homo sapiens
tgtgtggattcatctcaaagag

SEQ ID NO: 23820 - DNA, 22 bp, Homo sapiens
aagtggcagttcaggaagcaga

SEQ ID NO: 23821 - DNA, 22 bp, Homo sapiens
agggtgaatctcacaactctta

SEQ ID NO: 23822 - DNA, 22 bp, Homo sapiens
tctaatcctatggtggggaggg

SEQ ID NO: 23823 - DNA, 22 bp, Homo sapiens
acctggacacctgctgtcatct

SEQ ID NO: 23824 - DNA, 22 bp, Homo sapiens
attgcactccatcctgggcaat

SEQ ID NO: 23825 - DNA, 22 bp, Homo sapiens
atcctcagacttcacgttccat

SEQ ID NO: 23826 - DNA, 22 bp, Homo sapiens
acaggggaatttactgtcatta

SEQ ID NO: 23827 - DNA, 22 bp, Homo sapiens
agtgggtgtagtcttcctcctg

SEQ ID NO: 23828 - DNA, 22 bp, Homo sapiens
tcaggtatttcttttagctgtg

SEQ ID NO: 23829 - DNA, 16 bp, Homo sapiens
aaactgacggcatctg

SEQ ID NO: 23830 - DNA, 22 bp, Homo sapiens
gccttgccgctcagcagtgggg

SEQ ID NO: 23831 - DNA, 22 bp, Homo sapiens
atcccaagctctacaagtgatt

SEQ ID NO: 23832 - DNA, 22 bp, Homo sapiens
ccgggcgggggctctcgtcacc

SEQ ID NO: 23833 - DNA, 22 bp, Homo sapiens
tgagatggagtctcgctctgtt

SEQ ID NO: 23834 - DNA, 22 bp, Homo sapiens
ggaggcggaggctgcagtgagc

SEQ ID NO: 23835 - DNA, 22 bp, Homo sapiens
tgctagtgtgtgagatgttcaa

SEQ ID NO: 23836 - DNA, 18 bp, Homo sapiens
tcactgggtgtatgtggc

SEQ ID NO: 23837 - DNA, 22 bp, Homo sapiens
cgtgcgcctcagcctcgtgcgc

SEQ ID NO: 23838 - DNA, 21 bp, Homo sapiens
tgcaatccagcctgggcgaca

SEQ ID NO: 23839 - DNA, 22 bp, Homo sapiens
ttcattcttttacatgtgaata

SEQ ID NO: 23840 - DNA, 23 bp, Homo sapiens
ggatggacgtgatgccttagcca

SEQ ID NO: 23841 - DNA, 22 bp, Homo sapiens
cttcctcctccatctcgaaggc

SEQ ID NO: 23842 - DNA, 22 bp, Homo sapiens
cagggccagcgtctcgggctat

SEQ ID NO: 23843 - DNA, 20 bp, Homo sapiens
ggggaagtcactgcagtcag

SEQ ID NO: 23844 - DNA, 22 bp, Homo sapiens
cagtggcaggatttcagctcag

SEQ ID NO: 23845 - DNA, 22 bp, Homo sapiens
cccccaaagtttgcacggataa

SEQ ID NO: 23846 - DNA, 22 bp, Homo sapiens
gtggagggtgattgccggctgt

SEQ ID NO: 23847 - DNA, 23 bp, Homo sapiens
ccagtgattgcctggaaggaggt

SEQ ID NO: 23848 - DNA, 22 bp, Homo sapiens
tctccaatgcttaggaaagttt

SEQ ID NO: 23849 - DNA, 22 bp, Homo sapiens
atattagtttggagactacaat

SEQ ID NO: 23850 - DNA, 22 bp, Homo sapiens
ttgccgccgtctgctcgccccg

SEQ ID NO: 23851 - DNA, 22 bp, Homo sapiens
agctggtgtgccagttccagtt

SEQ ID NO: 23852 - DNA, 22 bp, Homo sapiens
ttccccttgataagcagggttg

SEQ ID NO: 23853 - DNA, 22 bp, Homo sapiens
tgtccaggctaaagtgcagtgg

SEQ ID NO: 23854 - DNA, 22 bp, Homo sapiens
tttggactgcatgatgatctgg

SEQ ID NO: 23855 - DNA, 22 bp, Homo sapiens
gctcgttgaacctgtccccgag

SEQ ID NO: 23856 - DNA, 22 bp, Homo sapiens
gaaaaggcagagttccggggaa

SEQ ID NO: 23857 - DNA, 22 bp, Homo sapiens
ttcctcaggctgctttcacata

SEQ ID NO: 23858 - DNA, 22 bp, Homo sapiens
acagcccagctctttctctgca

SEQ ID NO: 23859 - DNA, 22 bp, Homo sapiens
cctggtgctgctatcaggggta

SEQ ID NO: 23860 - DNA, 22 bp, Homo sapiens
tttgaagactactgggagtgaa

SEQ ID NO: 23861 - DNA, 22 bp, Homo sapiens
tcccacacagcccgctcaccgg

SEQ ID NO: 23862 - DNA, 22 bp, Homo sapiens
taagtcatagattaatggccac

SEQ ID NO: 23863 - DNA, 22 bp, Homo sapiens
gcaggtccagtcaccagagaga

SEQ ID NO: 23864 - DNA, 22 bp, Homo sapiens
cactgcaccctcaaactcctgg

SEQ ID NO: 23865 - DNA, 22 bp, Homo sapiens
gaatttcctctaaacccctgag

SEQ ID NO: 23866 - DNA, 23 bp, Homo sapiens
tgacctcatgatccgcccacctc

SEQ ID NO: 23867 - DNA, 20 bp, Homo sapiens
gggcagtggcgctatctcag

SEQ ID NO: 23868 - DNA, 22 bp, Homo sapiens
caagaggattattaataaataa

SEQ ID NO: 23869 - DNA, 22 bp, Homo sapiens
cactgcactccagcctgggtca

SEQ ID NO: 23870 - DNA, 22 bp, Homo sapiens
aagccaggttccatggaggagc

SEQ ID NO: 23871 - DNA, 22 bp, Homo sapiens
attgtcagtttaatatagtcaa

SEQ ID NO: 23872 - DNA, 22 bp, Homo sapiens
ctcctaggtaacagggtggttt

SEQ ID NO: 23873 - DNA, 19 bp, Homo sapiens
cggcccctcctctcgcgcc

SEQ ID NO: 23874 - DNA, 20 bp, Homo sapiens
ataaaataactgccacaaga

SEQ ID NO: 23875 - DNA, 22 bp, Homo sapiens
agggaaatctcagctctaaaat

SEQ ID NO: 23876 - DNA, 22 bp, Homo sapiens
agtccccctctgagcccaggga

SEQ ID NO: 23877 - DNA, 22 bp, Homo sapiens
aatgctctttaacctattctga

SEQ ID NO: 23878 - DNA, 22 bp, Homo sapiens
cctcacctcagtctgggcctca

SEQ ID NO: 23879 - DNA, 22 bp, Homo sapiens
acagattagctggggccattga

SEQ ID NO: 23880 - DNA, 22 bp, Homo sapiens
accctggaggtggaggtgcagt

SEQ ID NO: 23881 - DNA, 22 bp, Homo sapiens
catttacatttaaggttaatat

SEQ ID NO: 23882 - DNA, 23 bp, Homo sapiens
gggtccagccaattccaaggaaa

SEQ ID NO: 23883 - DNA, 22 bp, Homo sapiens
cactgcactccagcttgggcaa

SEQ ID NO: 23884 - DNA, 22 bp, Homo sapiens
atcatgttttaattagcaaact

SEQ ID NO: 23885 - DNA, 22 bp, Homo sapiens
ggcgtgggcgaggtgctctatc

SEQ ID NO: 23886 - DNA, 22 bp, Homo sapiens
gcagggtctgaggccacagagg

SEQ ID NO: 23887 - DNA, 22 bp, Homo sapiens
ggttggacactaggtaggagcg

SEQ ID NO: 23888 - DNA, 21 bp, Homo sapiens
gaccccagaccagcagacaca

SEQ ID NO: 23889 - DNA, 22 bp, Homo sapiens
ttagcttttgagaatgatttct

SEQ ID NO: 23890 - DNA, 22 bp, Homo sapiens
cccaggaggcagagcttgcagt

SEQ ID NO: 23891 - DNA, 22 bp, Homo sapiens
actgtacctcaaactctggaac

SEQ ID NO: 23892 - DNA, 22 bp, Homo sapiens
tacaaaggaggtgcatagaaca

SEQ ID NO: 23893 - DNA, 22 bp, Homo sapiens
tttttgggtccaggctgtatct

SEQ ID NO: 23894 - DNA, 22 bp, Homo sapiens
gctgctttggaaagcatggaaa

SEQ ID NO: 23895 - DNA, 22 bp, Homo sapiens
cttagctgcgggccctcctcgc

SEQ ID NO: 23896 - DNA, 22 bp, Homo sapiens
ttgaggcctgctggaaggtgtt

SEQ ID NO: 23897 - DNA, 22 bp, Homo sapiens
gggcaccttgggtctcaggcaa

SEQ ID NO: 23898 - DNA, 22 bp, Homo sapiens
gacctgaccgcgtccctgccga

SEQ ID NO: 23899 - DNA, 20 bp, Homo sapiens
attagagctacatggctaca

SEQ ID NO: 23900 - DNA, 22 bp, Homo sapiens
gggagcaagccggaggtactgt

SEQ ID NO: 23901 - DNA, 16 bp, Homo sapiens
tggggatggggaagag

SEQ ID NO: 23902 - DNA, 22 bp, Homo sapiens
acagttaataagtagtaagtca

SEQ ID NO: 23903 - DNA, 22 bp, Homo sapiens
ttgtcgggcttacgcagggcca

SEQ ID NO: 23904 - DNA, 22 bp, Homo sapiens
atctgtcttttaatgttaatgc

SEQ ID NO: 23905 - DNA, 21 bp, Homo sapiens
tctgatggtagatgagatgtg

SEQ ID NO: 23906 - DNA, 22 bp, Homo sapiens
gtgagaaatgacaaatgtgtcg

SEQ ID NO: 23907 - DNA, 22 bp, Homo sapiens
gagctactgaaatattgatttt

SEQ ID NO: 23908 - DNA, 22 bp, Homo sapiens
tgccacagacaggacagaacag

SEQ ID NO: 23909 - DNA, 22 bp, Homo sapiens
gcaccgccttggaccgcccgct

SEQ ID NO: 23910 - DNA, 22 bp, Homo sapiens
cattctcagtatcagccagccc

SEQ ID NO: 23911 - DNA, 22 bp, Homo sapiens
tttggggatgtctgagttgttg

SEQ ID NO: 23912 - DNA, 22 bp, Homo sapiens
tggggagaaatgtctttgttcc

SEQ ID NO: 23913 - DNA, 22 bp, Homo sapiens
aaggatacttttagagcctgag

SEQ ID NO: 23914 - DNA, 22 bp, Homo sapiens
ccaggagctggagggtgcagtg

SEQ ID NO: 23915 - DNA, 18 bp, Homo sapiens
gcctgagggtcaagtgtg

SEQ ID NO: 23916 - DNA, 22 bp, Homo sapiens
tttatagcagcatgatttataa

SEQ ID NO: 23917 - DNA, 22 bp, Homo sapiens
tcagggattaaggtcaaaggtg

SEQ ID NO: 23918 - DNA, 22 bp, Homo sapiens
aggagagctggtgtctggaatc

SEQ ID NO: 23919 - DNA, 22 bp, Homo sapiens
agctgccgatgcccagctgcat

SEQ ID NO: 23920 - DNA, 22 bp, Homo sapiens
ttttaatactgctattgtagga

SEQ ID NO: 23921 - DNA, 22 bp, Homo sapiens
ctgctcagtaatagtcctatct

SEQ ID NO: 23922 - DNA, 22 bp, Homo sapiens
tgggcccgcgcaaaggactcca

SEQ ID NO: 23923 - DNA, 22 bp, Homo sapiens
aacccgggaggcagaggttgtg

SEQ ID NO: 23924 - DNA, 22 bp, Homo sapiens
gcagaccctgaactgggcatgg

SEQ ID NO: 23925 - DNA, 22 bp, Homo sapiens
tggatctcggcaatgcgggact

SEQ ID NO: 23926 - DNA, 22 bp, Homo sapiens
gctcccaggatgaggagccagg

SEQ ID NO: 23927 - DNA, 22 bp, Homo sapiens
ttatacagggagtttccctgca

SEQ ID NO: 23928 - DNA, 22 bp, Homo sapiens
acctggaggcagaggttgcagt

SEQ ID NO: 23929 - DNA, 22 bp, Homo sapiens
agaagtataactatttgctttc

SEQ ID NO: 23930 - DNA, 22 bp, Homo sapiens
ataaaatttgctactgttaaat

SEQ ID NO: 23931 - DNA, 19 bp, Homo sapiens
ggcttgtctcggcagccgc

SEQ ID NO: 23932 - DNA, 22 bp, Homo sapiens
gcccttacagggtggtcagcca

SEQ ID NO: 23933 - DNA, 22 bp, Homo sapiens
cgtctaggccgtgccctgaggt

SEQ ID NO: 23934 - DNA, 22 bp, Homo sapiens
tggtctgctgaacagccgtatc

SEQ ID NO: 23935 - DNA, 22 bp, Homo sapiens
tcaaagatcagatggttgtagg

SEQ ID NO: 23936 - DNA, 21 bp, Homo sapiens
ttggccgtgcagatgaacagc

SEQ ID NO: 23937 - DNA, 22 bp, Homo sapiens
gagccaggtcgggccgcggcga

SEQ ID NO: 23938 - DNA, 23 bp, Homo sapiens
tgttccagatacgccttttcctc

SEQ ID NO: 23939 - DNA, 22 bp, Homo sapiens
ctcctggaggatagtgactggg

SEQ ID NO: 23940 - DNA, 22 bp, Homo sapiens
agggatggagtgcggcccggac

SEQ ID NO: 23941 - DNA, 22 bp, Homo sapiens
tctcgctctgtcgcccaggctg

SEQ ID NO: 23942 - DNA, 22 bp, Homo sapiens
ggcctggcagagcgcgcggctg

SEQ ID NO: 23943 - DNA, 22 bp, Homo sapiens
tccgtgcccctggcactaggtc

SEQ ID NO: 23944 - DNA, 22 bp, Homo sapiens
actgggcctgattgggtcggag

SEQ ID NO: 23945 - DNA, 22 bp, Homo sapiens
cccaggaggttgaggctgcagt

SEQ ID NO: 23946 - DNA, 22 bp, Homo sapiens
acggtgctgggtattggggttc

SEQ ID NO: 23947 - DNA, 23 bp, Homo sapiens
tcatttggacaaggcacagcaga

SEQ ID NO: 23948 - DNA, 22 bp, Homo sapiens
gccgtgtcatctgcgggtggca

SEQ ID NO: 23949 - DNA, 22 bp, Homo sapiens
atgaatgccacgatttcatcct

SEQ ID NO: 23950 - DNA, 22 bp, Homo sapiens
tcctggcaaagatgttggtgtt

SEQ ID NO: 23951 - DNA, 22 bp, Homo sapiens
gcacatgaggctgtctttgtct

SEQ ID NO: 23952 - DNA, 22 bp, Homo sapiens
gactttgtgccaaacgccagaa

SEQ ID NO: 23953 - DNA, 22 bp, Homo sapiens
cccagttttctgattgaagagc

SEQ ID NO: 23954 - DNA, 22 bp, Homo sapiens
cagtgcttttaaaacaacatca

SEQ ID NO: 23955 - DNA, 22 bp, Homo sapiens
aagaggtttaactgactcacag

SEQ ID NO: 23956 - DNA, 22 bp, Homo sapiens
ggtgcccaaggaaggttgccgt

SEQ ID NO: 23957 - DNA, 22 bp, Homo sapiens
acccagggctcaagcgtaggca

SEQ ID NO: 23958 - DNA, 22 bp, Homo sapiens
tgagtgtggggaatgtcatgag

SEQ ID NO: 23959 - DNA, 22 bp, Homo sapiens
ggttcccggatctccgagtccc

SEQ ID NO: 23960 - DNA, 22 bp, Homo sapiens
cccagggagagcgcggaggcgg

SEQ ID NO: 23961 - DNA, 22 bp, Homo sapiens
gctagtgcagggaaatctttgg

SEQ ID NO: 23962 - DNA, 22 bp, Homo sapiens
aaggtcagagtgagctgtggcc

SEQ ID NO: 23963 - DNA, 22 bp, Homo sapiens
ggcaggaggtgagtggcgggtg

SEQ ID NO: 23964 - DNA, 22 bp, Homo sapiens
atttcagtattatacaactgct

SEQ ID NO: 23965 - DNA, 22 bp, Homo sapiens
gcaggaggttgagccaggactg

SEQ ID NO: 23966 - DNA, 22 bp, Homo sapiens
tggtattacttctagacacaag

SEQ ID NO: 23967 - DNA, 22 bp, Homo sapiens
aatttgttataacttgggctga

SEQ ID NO: 23968 - DNA, 22 bp, Homo sapiens
atttagacatgtatctgatagc

SEQ ID NO: 23969 - DNA, 22 bp, Homo sapiens
tcccgtcttgctgttgtctgcg

SEQ ID NO: 23970 - DNA, 22 bp, Homo sapiens
tagtgaatgggggttatgagac

SEQ ID NO: 23971 - DNA, 22 bp, Homo sapiens
tttggcttctcctaccacctct

SEQ ID NO: 23972 - DNA, 22 bp, Homo sapiens
tttgctttgtttaaaagtggta

SEQ ID NO: 23973 - DNA, 22 bp, Homo sapiens
cctcgacctccccaggctcagg

SEQ ID NO: 23974 - DNA, 22 bp, Homo sapiens
gacctcatgatccacctgcctt

SEQ ID NO: 23975 - DNA, 22 bp, Homo sapiens
cacaaccatgcacagctaattt

SEQ ID NO: 23976 - DNA, 23 bp, Homo sapiens
ttgcttagagacctcctcatcag

SEQ ID NO: 23977 - DNA, 22 bp, Homo sapiens
tccttgtaaaggagctctaaca

SEQ ID NO: 23978 - DNA, 22 bp, Homo sapiens
ttatagcagcatgatttataat

SEQ ID NO: 23979 - DNA, 22 bp, Homo sapiens
gcttctggtgaggcctcaggaa

SEQ ID NO: 23980 - DNA, 22 bp, Homo sapiens
accacccagccagcttctccct

SEQ ID NO: 23981 - DNA, 21 bp, Homo sapiens
tactgtagccttgcactgtag

SEQ ID NO: 23982 - DNA, 18 bp, Homo sapiens
tgctgatggtccattagt

SEQ ID NO: 23983 - DNA, 22 bp, Homo sapiens
ccaagggcgcctccgttccccc

SEQ ID NO: 23984 - DNA, 22 bp, Homo sapiens
ggagtgaagtggcgcgatctcg

SEQ ID NO: 23985 - DNA, 22 bp, Homo sapiens
gtggccccagggccctgtctgg

SEQ ID NO: 23986 - DNA, 22 bp, Homo sapiens
aatatttccaaggcctgtcagg

SEQ ID NO: 23987 - DNA, 22 bp, Homo sapiens
tcaggggcttgaggtgcatgtc

SEQ ID NO: 23988 - DNA, 22 bp, Homo sapiens
cagtggttgaacccaaatactt

SEQ ID NO: 23989 - DNA, 21 bp, Homo sapiens
tctcttcctccgcgccgccgc

SEQ ID NO: 23990 - DNA, 22 bp, Homo sapiens
gtggagaggaacccagctctgt

SEQ ID NO: 23991 - DNA, 22 bp, Homo sapiens
cacccaggctggagtgcagtgg

SEQ ID NO: 23992 - DNA, 22 bp, Homo sapiens
accctctagagggaagcacttt

SEQ ID NO: 23993 - DNA, 22 bp, Homo sapiens
caacaacatgggattcatttct

SEQ ID NO: 23994 - DNA, 22 bp, Homo sapiens
tttgaggttagctagcagatca

SEQ ID NO: 23995 - DNA, 22 bp, Homo sapiens
tgtatattctgcctaaaagctt

SEQ ID NO: 23996 - DNA, 21 bp, Homo sapiens
agggttttatagatctcttcc

SEQ ID NO: 23997 - DNA, 22 bp, Homo sapiens
tttaatgtagcgtgaaatgatt

SEQ ID NO: 23998 - DNA, 22 bp, Homo sapiens
acagagcaataacagggagagg

SEQ ID NO: 23999 - DNA, 22 bp, Homo sapiens
gcccaggaggagaggctgcagt

SEQ ID NO: 24000 - DNA, 22 bp, Homo sapiens
cgtgtagcatgcgccaccacca

SEQ ID NO: 24001 - DNA, 22 bp, Homo sapiens
tgtccagctcgagacactatct

SEQ ID NO: 24002 - DNA, 22 bp, Homo sapiens
acaattctgatggtttcccagt

SEQ ID NO: 24003 - DNA, 22 bp, Homo sapiens
gcactggccgcacgcgtagggc

SEQ ID NO: 24004 - DNA, 22 bp, Homo sapiens
tgcttgtgacagaactgtgtcc

SEQ ID NO: 24005 - DNA, 22 bp, Homo sapiens
ctgggtggcagagcctgcagtg

SEQ ID NO: 24006 - DNA, 22 bp, Homo sapiens
ggggcattgtgtctgggttcct

SEQ ID NO: 24007 - DNA, 22 bp, Homo sapiens
gtgtggtcgaagttctcccgga

SEQ ID NO: 24008 - DNA, 22 bp, Homo sapiens
tctgagaaatttctttgtgatg

SEQ ID NO: 24009 - DNA, 22 bp, Homo sapiens
catcgccctggggtcctgcctt

SEQ ID NO: 24010 - DNA, 22 bp, Homo sapiens
gctccaaagtacagtgacttac

SEQ ID NO: 24011 - DNA, 22 bp, Homo sapiens
cactgcactccagcctgcgcaa

SEQ ID NO: 24012 - DNA, 22 bp, Homo sapiens
tcagtgttaatcagtggtacct

SEQ ID NO: 24013 - DNA, 22 bp, Homo sapiens
acccgccgcacgtccaggctga

SEQ ID NO: 24014 - DNA, 22 bp, Homo sapiens
gggagaggttacccgagcaact

SEQ ID NO: 24015 - DNA, 18 bp, Homo sapiens
gaaagatgaacttttttc

SEQ ID NO: 24016 - DNA, 22 bp, Homo sapiens
ttttcctttgattcccagatgt

SEQ ID NO: 24017 - DNA, 22 bp, Homo sapiens
ttagccaggggagcagcttgtc

SEQ ID NO: 24018 - DNA, 22 bp, Homo sapiens
gggcgcatcacctgaggtcagg

SEQ ID NO: 24019 - DNA, 22 bp, Homo sapiens
gccagtgcctcgccgcgctcct

SEQ ID NO: 24020 - DNA, 22 bp, Homo sapiens
ggaactgaatgtctcggtataa

SEQ ID NO: 24021 - DNA, 20 bp, Homo sapiens
tgtttactctagagggtaga

SEQ ID NO: 24022 - DNA, 22 bp, Homo sapiens
cccgcagtcggaatttctcagt

SEQ ID NO: 24023 - DNA, 22 bp, Homo sapiens
aagcacaatgaacatcttagat

SEQ ID NO: 24024 - DNA, 22 bp, Homo sapiens
tggtttgtctaaatgagtaata

SEQ ID NO: 24025 - DNA, 22 bp, Homo sapiens
tggtgctgccaggctcctgcca

SEQ ID NO: 24026 - DNA, 22 bp, Homo sapiens
agttgcagacgcagagatgttg

SEQ ID NO: 24027 - DNA, 22 bp, Homo sapiens
tgagcaggcgcagcaggaggtc

SEQ ID NO: 24028 - DNA, 22 bp, Homo sapiens
cctgccagagcagcttgtcctc

SEQ ID NO: 24029 - DNA, 22 bp, Homo sapiens
actctggccatcttggaccttg

SEQ ID NO: 24030 - DNA, 22 bp, Homo sapiens
tctgtgaagctctgaacagcag

SEQ ID NO: 24031 - DNA, 22 bp, Homo sapiens
cattgcacaccagcctgggcaa

SEQ ID NO: 24032 - DNA, 22 bp, Homo sapiens
tcaaaccagccttgcatcccag

SEQ ID NO: 24033 - DNA, 22 bp, Homo sapiens
aacccaggagccggaggttgtg

SEQ ID NO: 24034 - DNA, 22 bp, Homo sapiens
cttgcctacttgtcaaccagca

SEQ ID NO: 24035 - DNA, 22 bp, Homo sapiens
gcctccccaagcagcagggatt

SEQ ID NO: 24036 - DNA, 22 bp, Homo sapiens
atcaacatgtcataaagtgaaa

SEQ ID NO: 24037 - DNA, 22 bp, Homo sapiens
cttgtcttgcacacggttgcca

SEQ ID NO: 24038 - DNA, 22 bp, Homo sapiens
ggacaaatttttgtgatgtgct

SEQ ID NO: 24039 - DNA, 22 bp, Homo sapiens
gtgcacttgatctagacagatt

SEQ ID NO: 24040 - DNA, 22 bp, Homo sapiens
tgaaatgttaaacaagtggctc

SEQ ID NO: 24041 - DNA, 22 bp, Homo sapiens
caaatcctcacctcatcatgaa

SEQ ID NO: 24042 - DNA, 22 bp, Homo sapiens
actgattgcattcatagggttt

SEQ ID NO: 24043 - DNA, 22 bp, Homo sapiens
gagagcaggaggcagcgggacg

SEQ ID NO: 24044 - DNA, 22 bp, Homo sapiens
gttccaggtggtcacagagctc

SEQ ID NO: 24045 - DNA, 22 bp, Homo sapiens
agcttgggcaacacagcaagac

SEQ ID NO: 24046 - DNA, 22 bp, Homo sapiens
cctctgtgtctccaagaggcct

SEQ ID NO: 24047 - DNA, 22 bp, Homo sapiens
gtaggccatggtggttgtctct

SEQ ID NO: 24048 - DNA, 22 bp, Homo sapiens
gatcctggagctccatcactat

SEQ ID NO: 24049 - DNA, 22 bp, Homo sapiens
aagaactgtttacaattttcac

SEQ ID NO: 24050 - DNA, 22 bp, Homo sapiens
gcccttctgctgttaggtagcc

SEQ ID NO: 24051 - DNA, 22 bp, Homo sapiens
ttcttttaattgtgggggagtg

SEQ ID NO: 24052 - DNA, 22 bp, Homo sapiens
agtgtattctgcatgggagact

SEQ ID NO: 24053 - DNA, 22 bp, Homo sapiens
aggtcacccgtttgactatcca

SEQ ID NO: 24054 - DNA, 22 bp, Homo sapiens
tgaacgcaggtccacatggctc

SEQ ID NO: 24055 - DNA, 22 bp, Homo sapiens
cacattggcaaacggggttgca

SEQ ID NO: 24056 - DNA, 22 bp, Homo sapiens
ttctccacccactcttttgttg

SEQ ID NO: 24057 - DNA, 22 bp, Homo sapiens
acaggcacctgccaccacatct

SEQ ID NO: 24058 - DNA, 22 bp, Homo sapiens
gagcccaggcagaggttgcagt

SEQ ID NO: 24059 - DNA, 22 bp, Homo sapiens
acttgccccagaattgctgctg

SEQ ID NO: 24060 - DNA, 22 bp, Homo sapiens
cctggcctttgaacgctagact

SEQ ID NO: 24061 - DNA, 22 bp, Homo sapiens
aacccgagggccccaggctcgg

SEQ ID NO: 24062 - DNA, 22 bp, Homo sapiens
ctggggtccttgccatgtgtca

SEQ ID NO: 24063 - DNA, 22 bp, Homo sapiens
tgtgtcccttggaacctcagct

SEQ ID NO: 24064 - DNA, 22 bp, Homo sapiens
gggtcgcttggagaggcttcct

SEQ ID NO: 24065 - DNA, 22 bp, Homo sapiens
ttggcctggcgcggtggctcac

SEQ ID NO: 24066 - DNA, 22 bp, Homo sapiens
cattgcactccagcctgggtga

SEQ ID NO: 24067 - DNA, 22 bp, Homo sapiens
ttccctccatttcattttataa

SEQ ID NO: 24068 - DNA, 22 bp, Homo sapiens
ctttggagaaaagttcttgggc

SEQ ID NO: 24069 - DNA, 22 bp, Homo sapiens
gcggcaggagtaaaggaggaag

SEQ ID NO: 24070 - DNA, 19 bp, Homo sapiens
gttctttcatagtaagagc

SEQ ID NO: 24071 - DNA, 20 bp, Homo sapiens
gggaagtcccgcctgtcttc

SEQ ID NO: 24072 - DNA, 22 bp, Homo sapiens
accgggaagtcctgcactgggc

SEQ ID NO: 24073 - DNA, 22 bp, Homo sapiens
cgcgctgcagacagcggaggcc

SEQ ID NO: 24074 - DNA, 22 bp, Homo sapiens
ttggtttccttaacagcctaaa

SEQ ID NO: 24075 - DNA, 22 bp, Homo sapiens
tcatctccatacggtctcgcag

SEQ ID NO: 24076 - DNA, 22 bp, Homo sapiens
catctgtaaagtaggaatattg

SEQ ID NO: 24077 - DNA, 22 bp, Homo sapiens
ctttgcttgacactgtgattgt

SEQ ID NO: 24078 - DNA, 22 bp, Homo sapiens
gttggccaggctggtctcaatc

SEQ ID NO: 24079 - DNA, 20 bp, Homo sapiens
agcggctggcggaggacacg

SEQ ID NO: 24080 - DNA, 22 bp, Homo sapiens
ctggagcaaaagtgactcctct

SEQ ID NO: 24081 - DNA, 22 bp, Homo sapiens
tctgcaggtaagcgttcttgga

SEQ ID NO: 24082 - DNA, 22 bp, Homo sapiens
cactgcaacctctgcctcctgg

SEQ ID NO: 24083 - DNA, 22 bp, Homo sapiens
gcccagcacctctctcagggtt

SEQ ID NO: 24084 - DNA, 22 bp, Homo sapiens
ccccacaactcatgttgaaact

SEQ ID NO: 24085 - DNA, 22 bp, Homo sapiens
gtaatagtctcaaactcctgga

SEQ ID NO: 24086 - DNA, 22 bp, Homo sapiens
tcaccagatctctctgtaatgg

SEQ ID NO: 24087 - DNA, 22 bp, Homo sapiens
ctggctgggagcgagctgctca

SEQ ID NO: 24088 - DNA, 22 bp, Homo sapiens
tgagtgaccagaagtccccctc

SEQ ID NO: 24089 - DNA, 22 bp, Homo sapiens
gactggtaaggaaattcactaa

SEQ ID NO: 24090 - DNA, 22 bp, Homo sapiens
tctgccttgtttgagctttgac

SEQ ID NO: 24091 - DNA, 22 bp, Homo sapiens
atgcagttccacaggcgcatgg

SEQ ID NO: 24092 - DNA, 22 bp, Homo sapiens
cacagcgtgatgaatgtagcgt

SEQ ID NO: 24093 - DNA, 22 bp, Homo sapiens
ttcctttctctggactgcagcc

SEQ ID NO: 24094 - DNA, 22 bp, Homo sapiens
agcccgcatctcgctaaagata

SEQ ID NO: 24095 - DNA, 22 bp, Homo sapiens
agtcttcctgcccagcaggagg

SEQ ID NO: 24096 - DNA, 22 bp, Homo sapiens
gggaacagcttgggctctgcca

SEQ ID NO: 24097 - DNA, 22 bp, Homo sapiens
aagagaattctggttttcctat

SEQ ID NO: 24098 - DNA, 22 bp, Homo sapiens
ccgcggggcgtgggctcttacc

SEQ ID NO: 24099 - DNA, 22 bp, Homo sapiens
gcagatgtgtcctggagggagg

SEQ ID NO: 24100 - DNA, 22 bp, Homo sapiens
ttgttgtcattgtagaggattt

SEQ ID NO: 24101 - DNA, 22 bp, Homo sapiens
atggcagaatatctgcatcgca

SEQ ID NO: 24102 - DNA, 22 bp, Homo sapiens
tagtgtctcttcctgtttgaaa

SEQ ID NO: 24103 - DNA, 22 bp, Homo sapiens
gcctggagaaaggaaggtggga

SEQ ID NO: 24104 - DNA, 22 bp, Homo sapiens
tcactgcaagctcagcctcccg

SEQ ID NO: 24105 - DNA, 22 bp, Homo sapiens
gtgtatgttctacttaatatta

SEQ ID NO: 24106 - DNA, 22 bp, Homo sapiens
ctgggatccacgggctcccaag

SEQ ID NO: 24107 - DNA, 20 bp, Homo sapiens
gtgcaatggcaccatctcag

SEQ ID NO: 24108 - DNA, 22 bp, Homo sapiens
atggtttattagctgcacaggc

SEQ ID NO: 24109 - DNA, 22 bp, Homo sapiens
agctgtcaccaggagccggacc

SEQ ID NO: 24110 - DNA, 22 bp, Homo sapiens
aaaagtcttggggaaggccagg

SEQ ID NO: 24111 - DNA, 22 bp, Homo sapiens
atgactagaggagggatggcca

SEQ ID NO: 24112 - DNA, 22 bp, Homo sapiens
aacccacaaaggatttcagctc

SEQ ID NO: 24113 - DNA, 22 bp, Homo sapiens
cttggaggtggaagttgcagtg

SEQ ID NO: 24114 - DNA, 22 bp, Homo sapiens
gctgctgggatcctgggtctca

SEQ ID NO: 24115 - DNA, 22 bp, Homo sapiens
gagatgcagaaccctcaggagc

SEQ ID NO: 24116 - DNA, 19 bp, Homo sapiens
atctgccttagtgctgctg

SEQ ID NO: 24117 - DNA, 20 bp, Homo sapiens
tccaaagaagttcacattta

SEQ ID NO: 24118 - DNA, 22 bp, Homo sapiens
attgcacatctgcactacagcc

SEQ ID NO: 24119 - DNA, 22 bp, Homo sapiens
ggaaatctcagatctcccagat

SEQ ID NO: 24120 - DNA, 22 bp, Homo sapiens
tgctccagcaccaagagctcca

SEQ ID NO: 24121 - DNA, 21 bp, Homo sapiens
attctttgatgtgcaataagt

SEQ ID NO: 24122 - DNA, 22 bp, Homo sapiens
actgggaagtcagagagaggct

SEQ ID NO: 24123 - DNA, 22 bp, Homo sapiens
gaccggttctgccgtggactgg

SEQ ID NO: 24124 - DNA, 22 bp, Homo sapiens
tgtcttcaggagtaaatatcat

SEQ ID NO: 24125 - DNA, 17 bp, Homo sapiens
gcccgtgggctacggta

SEQ ID NO: 24126 - DNA, 22 bp, Homo sapiens
cgagtgtccctaccatttccta

SEQ ID NO: 24127 - DNA, 22 bp, Homo sapiens
aggtcacgtcctgtgatgtcat

SEQ ID NO: 24128 - DNA, 22 bp, Homo sapiens
catgcggctctttccaaaccgg

SEQ ID NO: 24129 - DNA, 22 bp, Homo sapiens
gcgagggcacgcggttgaaggc

SEQ ID NO: 24130 - DNA, 20 bp, Homo sapiens
ctgtggaattttaccatgcg

SEQ ID NO: 24131 - DNA, 22 bp, Homo sapiens
gagaggaagccttctgtacttg

SEQ ID NO: 24132 - DNA, 22 bp, Homo sapiens
gcagtggggcaatcatagctca

SEQ ID NO: 24133 - DNA, 22 bp, Homo sapiens
gtccagttgtatgtccagtgtc

SEQ ID NO: 24134 - DNA, 22 bp, Homo sapiens
tcactgcaagctcctcctcctg

SEQ ID NO: 24135 - DNA, 22 bp, Homo sapiens
caaccccactacacgttggaga

SEQ ID NO: 24136 - DNA, 22 bp, Homo sapiens
tccgggagctgaacgtcttgcg

SEQ ID NO: 24137 - DNA, 22 bp, Homo sapiens
gcggtagctcaagcttgtaatc

SEQ ID NO: 24138 - DNA, 18 bp, Homo sapiens
cagcctctgattggttgc

SEQ ID NO: 24139 - DNA, 22 bp, Homo sapiens
tttgatccgttgctggtgagga

SEQ ID NO: 24140 - DNA, 22 bp, Homo sapiens
ttctgtgaatcttttttcccac

SEQ ID NO: 24141 - DNA, 22 bp, Homo sapiens
cttcatgctgatatcctcgatg

SEQ ID NO: 24142 - DNA, 22 bp, Homo sapiens
ctgtggccagagcgccgttgac

SEQ ID NO: 24143 - DNA, 22 bp, Homo sapiens
caggccagggttgagaagagaa

SEQ ID NO: 24144 - DNA, 22 bp, Homo sapiens
gcaagacatgtctaaggtttaa

SEQ ID NO: 24145 - DNA, 22 bp, Homo sapiens
aggcttttctccagaatgtact

SEQ ID NO: 24146 - DNA, 20 bp, Homo sapiens
aaattactgccacacatttc

SEQ ID NO: 24147 - DNA, 22 bp, Homo sapiens
tcaatgtgaattaagaatactt

SEQ ID NO: 24148 - DNA, 21 bp, Homo sapiens
aggattccagcacactgcttc

SEQ ID NO: 24149 - DNA, 22 bp, Homo sapiens
atgattgaaaatgacattgcca

SEQ ID NO: 24150 - DNA, 22 bp, Homo sapiens
tctctttgcctgctgccatcca

SEQ ID NO: 24151 - DNA, 22 bp, Homo sapiens
tcatggggccacagctgccagc

SEQ ID NO: 24152 - DNA, 22 bp, Homo sapiens
aagagagtcagtctgagcacca

SEQ ID NO: 24153 - DNA, 22 bp, Homo sapiens
gccaggttgctgacgacgatct

SEQ ID NO: 24154 - DNA, 22 bp, Homo sapiens
tgggggacaccagtctctctct

SEQ ID NO: 24155 - DNA, 22 bp, Homo sapiens
tgggaagaggggtataaagaag

SEQ ID NO: 24156 - DNA, 22 bp, Homo sapiens
tagcacagcttcttgatgtcac

SEQ ID NO: 24157 - DNA, 22 bp, Homo sapiens
gtcccataagtagtgcaacttg

SEQ ID NO: 24158 - DNA, 18 bp, Homo sapiens
gaccccgggatctgtcga

SEQ ID NO: 24159 - DNA, 23 bp, Homo sapiens
gacagagtgagaccttgtcttac

SEQ ID NO: 24160 - DNA, 22 bp, Homo sapiens
aagcgccatggttcctgcgcag

SEQ ID NO: 24161 - DNA, 21 bp, Homo sapiens
ggcctcccggaccgcagcgcc

SEQ ID NO: 24162 - DNA, 22 bp, Homo sapiens
atagagtgatgtaaggtatgtg

SEQ ID NO: 24163 - DNA, 22 bp, Homo sapiens
ctgaagcagggagtgatgaagt

SEQ ID NO: 24164 - DNA, 22 bp, Homo sapiens
gctggcagacttcctctggaac

SEQ ID NO: 24165 - DNA, 22 bp, Homo sapiens
tccccaagcaggcaatctcccg

SEQ ID NO: 24166 - DNA, 22 bp, Homo sapiens
ataggtccaaggagaggtcttt

SEQ ID NO: 24167 - DNA, 22 bp, Homo sapiens
ttgcatttggttctgcctggta

SEQ ID NO: 24168 - DNA, 22 bp, Homo sapiens
tcattccctcattgttcactgg

SEQ ID NO: 24169 - DNA, 22 bp, Homo sapiens
cgtgtacagtctatcttttttc

SEQ ID NO: 24170 - DNA, 22 bp, Homo sapiens
tcactgcaagctccgcctcccg

SEQ ID NO: 24171 - DNA, 22 bp, Homo sapiens
aatgttacgatcaacaacacat

SEQ ID NO: 24172 - DNA, 22 bp, Homo sapiens
ctgccgtgtttttcatgttaaa

SEQ ID NO: 24173 - DNA, 23 bp, Homo sapiens
tctgtgtctccacccaaatctca

SEQ ID NO: 24174 - DNA, 22 bp, Homo sapiens
acatttttcacatttgtagggt

SEQ ID NO: 24175 - DNA, 22 bp, Homo sapiens
aggaattgtgttgtagtggaga

SEQ ID NO: 24176 - DNA, 22 bp, Homo sapiens
ttatagcagcatgatttatagt

SEQ ID NO: 24177 - DNA, 22 bp, Homo sapiens
ttaagtgcaaaaatgaaagtat

SEQ ID NO: 24178 - DNA, 22 bp, Homo sapiens
tgtaatattgtagtgacagtac

SEQ ID NO: 24179 - DNA, 22 bp, Homo sapiens
gggagccccacctcggtgcccg

SEQ ID NO: 24180 - DNA, 22 bp, Homo sapiens
gagcaacagtggcagtggtggg

SEQ ID NO: 24181 - DNA, 23 bp, Homo sapiens
aatggtcttcctccacccctctg

SEQ ID NO: 24182 - DNA, 22 bp, Homo sapiens
gaggagggagctggaagctctt

SEQ ID NO: 24183 - DNA, 22 bp, Homo sapiens
tcgaaataatttagaatataga

SEQ ID NO: 24184 - DNA, 22 bp, Homo sapiens
gggtaggcaaagcaatgacgtt

SEQ ID NO: 24185 - DNA, 22 bp, Homo sapiens
ggtagactgtcaaacactagcc

SEQ ID NO: 24186 - DNA, 22 bp, Homo sapiens
aagttgttgttgaggtgggtaa

SEQ ID NO: 24187 - DNA, 22 bp, Homo sapiens
gcagctcaaaggccacggacgg

SEQ ID NO: 24188 - DNA, 22 bp, Homo sapiens
cgcggaggaggtcaggaggtga

SEQ ID NO: 24189 - DNA, 22 bp, Homo sapiens
aggggaggtgtccccaaatctc

SEQ ID NO: 24190 - DNA, 22 bp, Homo sapiens
ttgcttcagagggagacacttt

SEQ ID NO: 24191 - DNA, 21 bp, Homo sapiens
tggtacaccttgcctgtcaga

SEQ ID NO: 24192 - DNA, 22 bp, Homo sapiens
gtgctttgttaagtctgaaatt

SEQ ID NO: 24193 - DNA, 22 bp, Homo sapiens
acaggggattgattggaagtct

SEQ ID NO: 24194 - DNA, 22 bp, Homo sapiens
tcacagtgttaaacctttcttt

SEQ ID NO: 24195 - DNA, 22 bp, Homo sapiens
ctgtcctggggaaagccagccc

SEQ ID NO: 24196 - DNA, 22 bp, Homo sapiens
cggaggcctcagctcatggttt

SEQ ID NO: 24197 - DNA, 22 bp, Homo sapiens
actattagcatatcatgaatgg

SEQ ID NO: 24198 - DNA, 22 bp, Homo sapiens
ggggtgggcgtgcagggacacc

SEQ ID NO: 24199 - DNA, 22 bp, Homo sapiens
ttgtccttcttcattcagtccc

SEQ ID NO: 24200 - DNA, 22 bp, Homo sapiens
gaggactgaaacttacaggaaa

SEQ ID NO: 24201 - DNA, 19 bp, Homo sapiens
gctggatggatcctggagt

SEQ ID NO: 24202 - DNA, 22 bp, Homo sapiens
ttgaaattttaggccttgcaat

SEQ ID NO: 24203 - DNA, 22 bp, Homo sapiens
tttgggcaggcttttccctaga

SEQ ID NO: 24204 - DNA, 22 bp, Homo sapiens
gctctctgcagcctccttggag

SEQ ID NO: 24205 - DNA, 22 bp, Homo sapiens
ttttcctggagatggagttgtt

SEQ ID NO: 24206 - DNA, 22 bp, Homo sapiens
tcagggctgcagaagaggcagg

SEQ ID NO: 24207 - DNA, 22 bp, Homo sapiens
agaaggacccggtgggagatga

SEQ ID NO: 24208 - DNA, 22 bp, Homo sapiens
agatcacagtggcaactccctt

SEQ ID NO: 24209 - DNA, 23 bp, Homo sapiens
ggggtcttggaacaggtggccct

SEQ ID NO: 24210 - DNA, 22 bp, Homo sapiens
gaggccactgtccctgccttcc

SEQ ID NO: 24211 - DNA, 22 bp, Homo sapiens
gagaaatatggctcagttccac

SEQ ID NO: 24212 - DNA, 22 bp, Homo sapiens
cccagccaaaagcaagtttacc

SEQ ID NO: 24213 - DNA, 20 bp, Homo sapiens
tgacatagctcttggggtgc

SEQ ID NO: 24214 - DNA, 22 bp, Homo sapiens
tcctccagttccttggtttcag

SEQ ID NO: 24215 - DNA, 22 bp, Homo sapiens
ttccgagggctcggcggccgcc

SEQ ID NO: 24216 - DNA, 22 bp, Homo sapiens
tgagcacatttcacatgacagg

SEQ ID NO: 24217 - DNA, 22 bp, Homo sapiens
tcagtgcacccaattctctcca

SEQ ID NO: 24218 - DNA, 18 bp, Homo sapiens
acgtgctgtgccttttgc

SEQ ID NO: 24219 - DNA, 22 bp, Homo sapiens
cattctctctacttgttttcaa

SEQ ID NO: 24220 - DNA, 22 bp, Homo sapiens
gacccttagaatgtgatcttat

SEQ ID NO: 24221 - DNA, 22 bp, Homo sapiens
aaaacctcagttctgctcttaa

SEQ ID NO: 24222 - DNA, 22 bp, Homo sapiens
gcccggcagtcacacacccagg

SEQ ID NO: 24223 - DNA, 22 bp, Homo sapiens
acatcatttgtctgtagctgaa

SEQ ID NO: 24224 - DNA, 22 bp, Homo sapiens
aagggcctgccagctcttcatg

SEQ ID NO: 24225 - DNA, 22 bp, Homo sapiens
tgcctagttctgtatttacagt

SEQ ID NO: 24226 - DNA, 22 bp, Homo sapiens
tcaaatgttccctgtactggcc

SEQ ID NO: 24227 - DNA, 22 bp, Homo sapiens
ctggtttgtcttgggaggatgt

SEQ ID NO: 24228 - DNA, 22 bp, Homo sapiens
gtagcagagggcccaggtaact

SEQ ID NO: 24229 - DNA, 22 bp, Homo sapiens
agtgctatcgagttctaatgct

SEQ ID NO: 24230 - DNA, 22 bp, Homo sapiens
atgcgagtgatgcagagtggct

SEQ ID NO: 24231 - DNA, 22 bp, Homo sapiens
gatgctgctcgggtgcctggga

SEQ ID NO: 24232 - DNA, 22 bp, Homo sapiens
cctgcgggctgtgctgaagcct

SEQ ID NO: 24233 - DNA, 22 bp, Homo sapiens
cagctggttgaagaggagctgg

SEQ ID NO: 24234 - DNA, 23 bp, Homo sapiens
tctacaaagctgtgtcaggaccc

SEQ ID NO: 24235 - DNA, 22 bp, Homo sapiens
ctgagcctcctgcttctatttc

SEQ ID NO: 24236 - DNA, 19 bp, Homo sapiens
tcattgtgctgagcaaggt

SEQ ID NO: 24237 - DNA, 22 bp, Homo sapiens
aatgtgaggccttggtagttat

SEQ ID NO: 24238 - DNA, 22 bp, Homo sapiens
ttatttgtggcatatgagacga

SEQ ID NO: 24239 - DNA, 22 bp, Homo sapiens
tggttgtggtcctccacatcgc

SEQ ID NO: 24240 - DNA, 22 bp, Homo sapiens
ggtgacagtggttaaaatttgt

SEQ ID NO: 24241 - DNA, 22 bp, Homo sapiens
tctagttctagatccctgagga

SEQ ID NO: 24242 - DNA, 23 bp, Homo sapiens
actctcaggttctttccagcagg

SEQ ID NO: 24243 - DNA, 22 bp, Homo sapiens
ggggaccctcaggactgcgtct

SEQ ID NO: 24244 - DNA, 22 bp, Homo sapiens
ccaggaggttgaggctgcagtg

SEQ ID NO: 24245 - DNA, 22 bp, Homo sapiens
aagactgtgtctatggctactc

SEQ ID NO: 24246 - DNA, 22 bp, Homo sapiens
ctgaattatttaaggtgaaggg

SEQ ID NO: 24247 - DNA, 22 bp, Homo sapiens
ctacaaaagtaattgtggtttt

SEQ ID NO: 24248 - DNA, 22 bp, Homo sapiens
tcagtttttctatactttgtag

SEQ ID NO: 24249 - DNA, 22 bp, Homo sapiens
agacgcgcagaaggaagcggcc

SEQ ID NO: 24250 - DNA, 22 bp, Homo sapiens
gacaattgcttttgccgaataa

SEQ ID NO: 24251 - DNA, 22 bp, Homo sapiens
tgagaacggatactaagggctg

SEQ ID NO: 24252 - DNA, 22 bp, Homo sapiens
agccctcttccagccagcacag

SEQ ID NO: 24253 - DNA, 22 bp, Homo sapiens
tgggtgagcggctgcacacccg

SEQ ID NO: 24254 - DNA, 22 bp, Homo sapiens
aaaactacatttgacattttgt

SEQ ID NO: 24255 - DNA, 22 bp, Homo sapiens
gaggccacggaagggagctgtg

SEQ ID NO: 24256 - DNA, 22 bp, Homo sapiens
agagtccctcttcccaggaggc

SEQ ID NO: 24257 - DNA, 22 bp, Homo sapiens
taggatttaataaaagaataga

SEQ ID NO: 24258 - DNA, 22 bp, Homo sapiens
ccaagctacttaggagtctgag

SEQ ID NO: 24259 - DNA, 22 bp, Homo sapiens
gtctcccaaactctgatggtcc

SEQ ID NO: 24260 - DNA, 22 bp, Homo sapiens
tgattcatcagaataggagttt

SEQ ID NO: 24261 - DNA, 22 bp, Homo sapiens
ctcgagagatcctcttgccacc

SEQ ID NO: 24262 - DNA, 22 bp, Homo sapiens
cagtgatcgcactcaacagttt

SEQ ID NO: 24263 - DNA, 22 bp, Homo sapiens
tgcgcggctcagtcatctccag

SEQ ID NO: 24264 - DNA, 22 bp, Homo sapiens
ttataagctctgaaatctccta

SEQ ID NO: 24265 - DNA, 22 bp, Homo sapiens
ctcatgatccaccgatgtcagc

SEQ ID NO: 24266 - DNA, 22 bp, Homo sapiens
gttaggtagaagtttactttga

SEQ ID NO: 24267 - DNA, 22 bp, Homo sapiens
aggagatggagctcagtgggca

SEQ ID NO: 24268 - DNA, 22 bp, Homo sapiens
caggctggagttcagtggtgtg

SEQ ID NO: 24269 - DNA, 22 bp, Homo sapiens
tgcaatttttccatgacctaga

SEQ ID NO: 24270 - DNA, 18 bp, Homo sapiens
ggaaaaggagtgtctagc

SEQ ID NO: 24271 - DNA, 22 bp, Homo sapiens
attagggtaaggcttttcttag

SEQ ID NO: 24272 - DNA, 19 bp, Homo sapiens
aggtggctgaaactacaga

SEQ ID NO: 24273 - DNA, 22 bp, Homo sapiens
ccctgccttgtctgggctaggt

SEQ ID NO: 24274 - DNA, 22 bp, Homo sapiens
atcggcaagccccacaccgtcc

SEQ ID NO: 24275 - DNA, 22 bp, Homo sapiens
aagctgtagcttttcaaaacgt

SEQ ID NO: 24276 - DNA, 22 bp, Homo sapiens
tgatatgcatgtaagggagaca

SEQ ID NO: 24277 - DNA, 22 bp, Homo sapiens
cagctgcccctccagggctggg

SEQ ID NO: 24278 - DNA, 22 bp, Homo sapiens
gcctgggtccaccgctcgcgct

SEQ ID NO: 24279 - DNA, 22 bp, Homo sapiens
ctctaccaggagtctccaccgt

SEQ ID NO: 24280 - DNA, 22 bp, Homo sapiens
cagggaaagtcccaccccacac

SEQ ID NO: 24281 - DNA, 21 bp, Homo sapiens
aggcttggatctagacaggcc

SEQ ID NO: 24282 - DNA, 22 bp, Homo sapiens
tggactaaagaggaagcaaata

SEQ ID NO: 24283 - DNA, 22 bp, Homo sapiens
atgaattgtccgatgttgtgca

SEQ ID NO: 24284 - DNA, 22 bp, Homo sapiens
taggctgggaagaaagattctc

SEQ ID NO: 24285 - DNA, 22 bp, Homo sapiens
aatggtttctgaagttaggcag

SEQ ID NO: 24286 - DNA, 22 bp, Homo sapiens
ccccatcatctttgaggtcatt

SEQ ID NO: 24287 - DNA, 22 bp, Homo sapiens
gagaaatgcatgcatgtcatca

SEQ ID NO: 24288 - DNA, 22 bp, Homo sapiens
gccagccagaaacgtcacactg

SEQ ID NO: 24289 - DNA, 23 bp, Homo sapiens
tgtgggcgcattgtaagggtagc

SEQ ID NO: 24290 - DNA, 22 bp, Homo sapiens
tgcctccctggcaagtctctcc

SEQ ID NO: 24291 - DNA, 22 bp, Homo sapiens
agggagcaaaggtttcagggtt

SEQ ID NO: 24292 - DNA, 21 bp, Homo sapiens
gggcactgaaagggaatagca

SEQ ID NO: 24293 - DNA, 22 bp, Homo sapiens
tgtgaaagatactaggcagagg

SEQ ID NO: 24294 - DNA, 22 bp, Homo sapiens
ttattgaaggaactgaaataaa

SEQ ID NO: 24295 - DNA, 22 bp, Homo sapiens
gtggctcacgtctgtcatctca

SEQ ID NO: 24296 - DNA, 22 bp, Homo sapiens
tcaccagacgcgtgggtctgag

SEQ ID NO: 24297 - DNA, 22 bp, Homo sapiens
tgttcagaacaaaggtaaatga

SEQ ID NO: 24298 - DNA, 20 bp, Homo sapiens
ccaccctgtccggggcggag

SEQ ID NO: 24299 - DNA, 22 bp, Homo sapiens
tgtcagggatttccaactcccc

SEQ ID NO: 24300 - DNA, 22 bp, Homo sapiens
tgggagaaagaaccctgagtga

SEQ ID NO: 24301 - DNA, 22 bp, Homo sapiens
ctgagatctttatacgaggcac

SEQ ID NO: 24302 - DNA, 22 bp, Homo sapiens
attgtgtcctcattgaccttca

SEQ ID NO: 24303 - DNA, 22 bp, Homo sapiens
aaggagcacacaatctagaacc

SEQ ID NO: 24304 - DNA, 22 bp, Homo sapiens
ctcatcagaaatacctgacaaa

SEQ ID NO: 24305 - DNA, 22 bp, Homo sapiens
tgtgacagcacggttcaactgc

SEQ ID NO: 24306 - DNA, 22 bp, Homo sapiens
actgcacttcagcctgggtgac

SEQ ID NO: 24307 - DNA, 22 bp, Homo sapiens
gccaatgacagtctcagttctg

SEQ ID NO: 24308 - DNA, 22 bp, Homo sapiens
tagcttatcccacagtgcccag

SEQ ID NO: 24309 - DNA, 22 bp, Homo sapiens
ttcacagcttaataaggctcag

SEQ ID NO: 24310 - DNA, 17 bp, Homo sapiens
cttcccaccatctcctg

SEQ ID NO: 24311 - DNA, 22 bp, Homo sapiens
gtggggacgggatggctcactg

SEQ ID NO: 24312 - DNA, 22 bp, Homo sapiens
gtccaggagctcagggcttatt

SEQ ID NO: 24313 - DNA, 22 bp, Homo sapiens
ttggagatatcacaccttcaca

SEQ ID NO: 24314 - DNA, 22 bp, Homo sapiens
ccttagggactaatagactgtc

SEQ ID NO: 24315 - DNA, 22 bp, Homo sapiens
tccaggttcaagcgattgtcct

SEQ ID NO: 24316 - DNA, 22 bp, Homo sapiens
gtggcatgtgcctgtaatctca

SEQ ID NO: 24317 - DNA, 22 bp, Homo sapiens
tcatcagaggcatctggcaagg

SEQ ID NO: 24318 - DNA, 22 bp, Homo sapiens
gaagaaggtggcccaggggtag

SEQ ID NO: 24319 - DNA, 22 bp, Homo sapiens
tctgcggtccccttctcgccct

SEQ ID NO: 24320 - DNA, 22 bp, Homo sapiens
gctgatagactgaatgttggga

SEQ ID NO: 24321 - DNA, 22 bp, Homo sapiens
ctctgagctgccttttgagctt

SEQ ID NO: 24322 - DNA, 22 bp, Homo sapiens
cctcggctgggccttggccact

SEQ ID NO: 24323 - DNA, 22 bp, Homo sapiens
gccagaattttgagactacttg

SEQ ID NO: 24324 - DNA, 22 bp, Homo sapiens
ggggcaggagcccttcttcagc

SEQ ID NO: 24325 - DNA, 22 bp, Homo sapiens
tgccaggcgtggtggtgcgcac

SEQ ID NO: 24326 - DNA, 22 bp, Homo sapiens
gaccaaggaagaggggagccag

SEQ ID NO: 24327 - DNA, 22 bp, Homo sapiens
gctctgagtcacactgccctgt

SEQ ID NO: 24328 - DNA, 22 bp, Homo sapiens
atatattttttgagacagagtc

SEQ ID NO: 24329 - DNA, 22 bp, Homo sapiens
gctgatggaaggacaggcgccg

SEQ ID NO: 24330 - DNA, 22 bp, Homo sapiens
aagtgctgggattacaggtgtc

SEQ ID NO: 24331 - DNA, 22 bp, Homo sapiens
atacctgtgtatccacaagcgt

SEQ ID NO: 24332 - DNA, 22 bp, Homo sapiens
ttcctaagtcctgccagcagtc

SEQ ID NO: 24333 - DNA, 22 bp, Homo sapiens
ggagactgatctgagtgataac

SEQ ID NO: 24334 - DNA, 22 bp, Homo sapiens
ctggtagctcctgaatatccct

SEQ ID NO: 24335 - DNA, 22 bp, Homo sapiens
ttaaactgcttgaattgggttt

SEQ ID NO: 24336 - DNA, 22 bp, Homo sapiens
tgggggagctcagtccagccca

SEQ ID NO: 24337 - DNA, 22 bp, Homo sapiens
atcgatcccgcgtaaggccccg

SEQ ID NO: 24338 - DNA, 22 bp, Homo sapiens
tatcagcgtgcaaatctttgga

SEQ ID NO: 24339 - DNA, 22 bp, Homo sapiens
gagctcattcattcattgcctg

SEQ ID NO: 24340 - DNA, 22 bp, Homo sapiens
tgtaatactccattgtatggat

SEQ ID NO: 24341 - DNA, 22 bp, Homo sapiens
ggctcacgcaattatcccggcc

SEQ ID NO: 24342 - DNA, 22 bp, Homo sapiens
tgtatgttgggtcaaagtacat

SEQ ID NO: 24343 - DNA, 22 bp, Homo sapiens
taggtagctttggcgtttcttg

SEQ ID NO: 24344 - DNA, 22 bp, Homo sapiens
tctaggcctggcttgggcccag

SEQ ID NO: 24345 - DNA, 22 bp, Homo sapiens
agaaatgggccttgggacacaa

SEQ ID NO: 24346 - DNA, 22 bp, Homo sapiens
cattctaggcctggcttgggcc

SEQ ID NO: 24347 - DNA, 22 bp, Homo sapiens
tgtcctcgtccgcctcgaactc

SEQ ID NO: 24348 - DNA, 22 bp, Homo sapiens
gcagctgacatctggctgggcc

SEQ ID NO: 24349 - DNA, 22 bp, Homo sapiens
gtgatctgccagcctcagcctc

SEQ ID NO: 24350 - DNA, 22 bp, Homo sapiens
gagagaagggggatatgagcct

SEQ ID NO: 24351 - DNA, 22 bp, Homo sapiens
atggccctaatgagttggtgtt

SEQ ID NO: 24352 - DNA, 21 bp, Homo sapiens
tctgccagctgaagaggtgga

SEQ ID NO: 24353 - DNA, 22 bp, Homo sapiens
tgtgatgaagagtccaagaaca

SEQ ID NO: 24354 - DNA, 22 bp, Homo sapiens
tcactgtatcatgttgcactta

SEQ ID NO: 24355 - DNA, 22 bp, Homo sapiens
ccggctcggcgaccaggctgaa

SEQ ID NO: 24356 - DNA, 22 bp, Homo sapiens
caggctggagtgcaatgacgcc

SEQ ID NO: 24357 - DNA, 18 bp, Homo sapiens
atgagaggtgtcagaaga

SEQ ID NO: 24358 - DNA, 22 bp, Homo sapiens
gagaactttctgtgtttttatc

SEQ ID NO: 24359 - DNA, 22 bp, Homo sapiens
ctattattagataatctacttg

SEQ ID NO: 24360 - DNA, 22 bp, Homo sapiens
actaggggctcaggcccaggga

SEQ ID NO: 24361 - DNA, 22 bp, Homo sapiens
cctggaagttggaggttgcagt

SEQ ID NO: 24362 - DNA, 18 bp, Homo sapiens
acacttcctggtggtgtg

SEQ ID NO: 24363 - DNA, 22 bp, Homo sapiens
actgcactccagcctgggcgac

SEQ ID NO: 24364 - DNA, 20 bp, Homo sapiens
tttgagaccagtctgcccaa

SEQ ID NO: 24365 - DNA, 22 bp, Homo sapiens
gggtccagtagttggtggccgt

SEQ ID NO: 24366 - DNA, 23 bp, Homo sapiens
aagttagtttcaataaagcaatt

SEQ ID NO: 24367 - DNA, 23 bp, Homo sapiens
cctgcctccccatcagttataca

SEQ ID NO: 24368 - DNA, 22 bp, Homo sapiens
actcagtacatctggagttggc

SEQ ID NO: 24369 - DNA, 19 bp, Homo sapiens
gtgtccatggagcatggag

SEQ ID NO: 24370 - DNA, 22 bp, Homo sapiens
caaatctctgctactagctatg

SEQ ID NO: 24371 - DNA, 22 bp, Homo sapiens
agttacagaatgtacagaggtt

SEQ ID NO: 24372 - DNA, 22 bp, Homo sapiens
gcagttaaaaataaaccttcat

SEQ ID NO: 24373 - DNA, 22 bp, Homo sapiens
agacacttcatgtaagtggaat

SEQ ID NO: 24374 - DNA, 22 bp, Homo sapiens
taggtttcagaggtgccgggaa

SEQ ID NO: 24375 - DNA, 22 bp, Homo sapiens
caggccggggcggcgccatctt

SEQ ID NO: 24376 - DNA, 21 bp, Homo sapiens
gctgctcgagatccagtgctt

SEQ ID NO: 24377 - DNA, 22 bp, Homo sapiens
cacgcacgctgggtggaggcgc

SEQ ID NO: 24378 - DNA, 19 bp, Homo sapiens
gggcttggggctgaagcct

SEQ ID NO: 24379 - DNA, 22 bp, Homo sapiens
tgggaagaggagcactggaatg

SEQ ID NO: 24380 - DNA, 22 bp, Homo sapiens
ctcagctcattgtggatccggt

SEQ ID NO: 24381 - DNA, 22 bp, Homo sapiens
aagccctggcgggtggagggcc

SEQ ID NO: 24382 - DNA, 22 bp, Homo sapiens
tatgccgcagccggatttcccc

SEQ ID NO: 24383 - DNA, 22 bp, Homo sapiens
ttcagcccaggagttggaggct

SEQ ID NO: 24384 - DNA, 22 bp, Homo sapiens
gccttattacctgcactttgaa

SEQ ID NO: 24385 - DNA, 22 bp, Homo sapiens
cactccagatcacaccccttgg

SEQ ID NO: 24386 - DNA, 22 bp, Homo sapiens
ggcgccagcactgcagcgcctc

SEQ ID NO: 24387 - DNA, 22 bp, Homo sapiens
tgccaccccggaccccgaagtg

SEQ ID NO: 24388 - DNA, 22 bp, Homo sapiens
atgctattgaaaagaaataaga

SEQ ID NO: 24389 - DNA, 22 bp, Homo sapiens
ttttctcttccctctggacctg

SEQ ID NO: 24390 - DNA, 22 bp, Homo sapiens
cacagacagtgtccctttgttg

SEQ ID NO: 24391 - DNA, 22 bp, Homo sapiens
ccagaaaaatcctcccttgtcc

SEQ ID NO: 24392 - DNA, 22 bp, Homo sapiens
ctcctgaattgtccctcacagc

SEQ ID NO: 24393 - DNA, 23 bp, Homo sapiens
atgacactcctgtgcgcaccctg

SEQ ID NO: 24394 - DNA, 22 bp, Homo sapiens
gtgctcatagatgatgctcttt

SEQ ID NO: 24395 - DNA, 22 bp, Homo sapiens
ctggggtaggaggcagctgtgc

SEQ ID NO: 24396 - DNA, 22 bp, Homo sapiens
gtcagaggggcagctgccaggc

SEQ ID NO: 24397 - DNA, 22 bp, Homo sapiens
tattgtgaatagtgccgcaata

SEQ ID NO: 24398 - DNA, 22 bp, Homo sapiens
attcactgaatttcatgattat

SEQ ID NO: 24399 - DNA, 22 bp, Homo sapiens
gaactttataactgtaaatgtc

SEQ ID NO: 24400 - DNA, 22 bp, Homo sapiens
ttaggttggtgcaaaagtaatt

SEQ ID NO: 24401 - DNA, 22 bp, Homo sapiens
gacctccgtgtacacctcccag

SEQ ID NO: 24402 - DNA, 22 bp, Homo sapiens
cgcaggtgaaagaggctgggca

SEQ ID NO: 24403 - DNA, 22 bp, Homo sapiens
ctgcttgcaaagtgttggtgat

SEQ ID NO: 24404 - DNA, 22 bp, Homo sapiens
actttaattaatgaactgtggc

SEQ ID NO: 24405 - DNA, 22 bp, Homo sapiens
gcccaggaggcagaggttgtgg

SEQ ID NO: 24406 - DNA, 22 bp, Homo sapiens
gcctgtattcccagcactttgg

SEQ ID NO: 24407 - DNA, 22 bp, Homo sapiens
ttgaataatatgcttcgttctc

SEQ ID NO: 24408 - DNA, 22 bp, Homo sapiens
ctccagtgcttctagaaaatac

SEQ ID NO: 24409 - DNA, 22 bp, Homo sapiens
gggtacagttcttccagtgtca

SEQ ID NO: 24410 - DNA, 22 bp, Homo sapiens
gggtggagagaaagaaacgtga

SEQ ID NO: 24411 - DNA, 19 bp, Homo sapiens
tctgccgagctagaccact

SEQ ID NO: 24412 - DNA, 22 bp, Homo sapiens
gggttcagtccctcttgctact

SEQ ID NO: 24413 - DNA, 22 bp, Homo sapiens
gggagtgggtttggcctaggcc

SEQ ID NO: 24414 - DNA, 22 bp, Homo sapiens
cagacgttggaggaaatatacc

SEQ ID NO: 24415 - DNA, 22 bp, Homo sapiens
taaagttggacctgattttatt

SEQ ID NO: 24416 - DNA, 22 bp, Homo sapiens
aggaatgacatagaaaggggag

SEQ ID NO: 24417 - DNA, 18 bp, Homo sapiens
ctgtacttcagcctgggt

SEQ ID NO: 24418 - DNA, 22 bp, Homo sapiens
aagcagcacagcaatgactcta

SEQ ID NO: 24419 - DNA, 22 bp, Homo sapiens
gatataggttcatagtgttaca

SEQ ID NO: 24420 - DNA, 20 bp, Homo sapiens
gctgaggggtctatggcata

SEQ ID NO: 24421 - DNA, 22 bp, Homo sapiens
ggccgccctttccacggtttct

SEQ ID NO: 24422 - DNA, 22 bp, Homo sapiens
tggaatgtcagctacaagaggg

SEQ ID NO: 24423 - DNA, 22 bp, Homo sapiens
ctgaagaggctccgcccacaag

SEQ ID NO: 24424 - DNA, 23 bp, Homo sapiens
agctctgctcgggcatgccctgc

SEQ ID NO: 24425 - DNA, 22 bp, Homo sapiens
tcttaagcagagaagaagttga

SEQ ID NO: 24426 - DNA, 22 bp, Homo sapiens
agctggaagtgcatttctcact

SEQ ID NO: 24427 - DNA, 22 bp, Homo sapiens
gctgatcacatttccaaaaccc

SEQ ID NO: 24428 - DNA, 22 bp, Homo sapiens
ggtgagcagctgtctgtatgga

SEQ ID NO: 24429 - DNA, 22 bp, Homo sapiens
tttgccagtattttattgatga

SEQ ID NO: 24430 - DNA, 22 bp, Homo sapiens
tgagtgaggctgggcagtccct

SEQ ID NO: 24431 - DNA, 22 bp, Homo sapiens
ttcaatttgtgctaaggcaccg

SEQ ID NO: 24432 - DNA, 22 bp, Homo sapiens
aaagtgctggtattacaggtgt

SEQ ID NO: 24433 - DNA, 22 bp, Homo sapiens
cagtaatagaggctttgagtct

SEQ ID NO: 24434 - DNA, 22 bp, Homo sapiens
gggaaagaccttcctggggtgt

SEQ ID NO: 24435 - DNA, 22 bp, Homo sapiens
ctcttcctagtgtgcagcgtgg

SEQ ID NO: 24436 - DNA, 22 bp, Homo sapiens
ctctgcctcagtgatttcttta

SEQ ID NO: 24437 - DNA, 22 bp, Homo sapiens
tgaggaaacttacaaggcagaa

SEQ ID NO: 24438 - DNA, 22 bp, Homo sapiens
aaagtgctgagattacaagcgt

SEQ ID NO: 24439 - DNA, 22 bp, Homo sapiens
aaagtgctgggattacaggcgt

SEQ ID NO: 24440 - DNA, 22 bp, Homo sapiens
cacagcggcctccgatgctgat

SEQ ID NO: 24441 - DNA, 22 bp, Homo sapiens
agactttaacaatgggtatgaa

SEQ ID NO: 24442 - DNA, 22 bp, Homo sapiens
ctttatgaaaacctgaattatg

SEQ ID NO: 24443 - DNA, 22 bp, Homo sapiens
tctggctctggagtccacctgc

SEQ ID NO: 24444 - DNA, 22 bp, Homo sapiens
cctcagacccctgctgagcttc

SEQ ID NO: 24445 - DNA, 22 bp, Homo sapiens
gtcctgtgagattcatgctcaa

SEQ ID NO: 24446 - DNA, 22 bp, Homo sapiens
ctctcagtcctgcgcgcctctg

SEQ ID NO: 24447 - DNA, 22 bp, Homo sapiens
ctgaggggtcgtgggagcccag

SEQ ID NO: 24448 - DNA, 22 bp, Homo sapiens
ggaaagtcttgtgtagatgtct

SEQ ID NO: 24449 - DNA, 22 bp, Homo sapiens
tgagtttgtctgagtggtaaca

SEQ ID NO: 24450 - DNA, 22 bp, Homo sapiens
ccacactccccgcaggcgtagg

SEQ ID NO: 24451 - DNA, 22 bp, Homo sapiens
gtgaggtggtacaatattaact

SEQ ID NO: 24452 - DNA, 22 bp, Homo sapiens
gcccatagtctctttctttctt

SEQ ID NO: 24453 - DNA, 22 bp, Homo sapiens
tgcaagctgacatccagagaga

SEQ ID NO: 24454 - DNA, 22 bp, Homo sapiens
ggaagggcaaaagagatgaact

SEQ ID NO: 24455 - DNA, 22 bp, Homo sapiens
atggactgggaggtcatcttct

SEQ ID NO: 24456 - DNA, 22 bp, Homo sapiens
ggacgcttaccagtaacgactt

SEQ ID NO: 24457 - DNA, 22 bp, Homo sapiens
gtggtgagagtaggtgtcctct

SEQ ID NO: 24458 - DNA, 22 bp, Homo sapiens
aggtaaatgtcagagcctttaa

SEQ ID NO: 24459 - DNA, 22 bp, Homo sapiens
aacccaggagttggaggctgtg

SEQ ID NO: 24460 - DNA, 22 bp, Homo sapiens
tttaagtaataaagtagcagct

SEQ ID NO: 24461 - DNA, 22 bp, Homo sapiens
taggttttcctaaaattctggt

SEQ ID NO: 24462 - DNA, 22 bp, Homo sapiens
atttacaggtagaattttaagt

SEQ ID NO: 24463 - DNA, 22 bp, Homo sapiens
cttatcttacttccccttcatg

SEQ ID NO: 24464 - DNA, 22 bp, Homo sapiens
tggccaccaccaatacttgcct

SEQ ID NO: 24465 - DNA, 22 bp, Homo sapiens
tgcgcctgcgcaaaggtttctg

SEQ ID NO: 24466 - DNA, 22 bp, Homo sapiens
aacagcttgctgcaccttaata

SEQ ID NO: 24467 - DNA, 22 bp, Homo sapiens
cccagagcatgtgctgcctttg

SEQ ID NO: 24468 - DNA, 22 bp, Homo sapiens
agccacacagcttaatgacaga

SEQ ID NO: 24469 - DNA, 22 bp, Homo sapiens
tgcaccctcatcagtcaaatgg

SEQ ID NO: 24470 - DNA, 22 bp, Homo sapiens
tccaaacgggagccaaatgagc

SEQ ID NO: 24471 - DNA, 22 bp, Homo sapiens
aagccaaagtgggcatgcctca

SEQ ID NO: 24472 - DNA, 22 bp, Homo sapiens
ctgtccgccgacttggccaggc

SEQ ID NO: 24473 - DNA, 22 bp, Homo sapiens
taattgtaaagtagtagtacag

SEQ ID NO: 24474 - DNA, 22 bp, Homo sapiens
tgactggattgtcattacgacg

SEQ ID NO: 24475 - DNA, 22 bp, Homo sapiens
tttctttatcatagcatctttg

SEQ ID NO: 24476 - DNA, 22 bp, Homo sapiens
catgtgtgtctccaccagctgc

SEQ ID NO: 24477 - DNA, 22 bp, Homo sapiens
tggctcctcacgtcctcagagc

SEQ ID NO: 24478 - DNA, 22 bp, Homo sapiens
ggtgggagagctctgtctccag

SEQ ID NO: 24479 - DNA, 22 bp, Homo sapiens
agccacatggacctgatgctag

SEQ ID NO: 24480 - DNA, 22 bp, Homo sapiens
tccaccctgcttttgtctttga

SEQ ID NO: 24481 - DNA, 22 bp, Homo sapiens
ttccaactttgtcatatattat

SEQ ID NO: 24482 - DNA, 22 bp, Homo sapiens
tggggtacttgtatcaaagcac

SEQ ID NO: 24483 - DNA, 20 bp, Homo sapiens
ggcagagggcctgggagaag

SEQ ID NO: 24484 - DNA, 22 bp, Homo sapiens
tctctatttgcctaggcttgtg

SEQ ID NO: 24485 - DNA, 19 bp, Homo sapiens
tgttgtctaccatgaagtc

SEQ ID NO: 24486 - DNA, 22 bp, Homo sapiens
acctggccaatttttgtatttt

SEQ ID NO: 24487 - DNA, 22 bp, Homo sapiens
gatttagtggcccttggtacac

SEQ ID NO: 24488 - DNA, 21 bp, Homo sapiens
taaacataaccttgtatggct

SEQ ID NO: 24489 - DNA, 20 bp, Homo sapiens
gaaatgtacacattaccaca

SEQ ID NO: 24490 - DNA, 22 bp, Homo sapiens
tcactgaaacctccacctctcg

SEQ ID NO: 24491 - DNA, 22 bp, Homo sapiens
tttggcatgggctatttgcttt

SEQ ID NO: 24492 - DNA, 22 bp, Homo sapiens
ggagtgactcacagctgggaca

SEQ ID NO: 24493 - DNA, 22 bp, Homo sapiens
cgaggcggcggaagtgcccgta

SEQ ID NO: 24494 - DNA, 22 bp, Homo sapiens
tcaccaggctagagtgcagtgg

SEQ ID NO: 24495 - DNA, 21 bp, Homo sapiens
ccaggccaggcctacggggat

SEQ ID NO: 24496 - DNA, 22 bp, Homo sapiens
agcacctccagagcttgaagct

SEQ ID NO: 24497 - DNA, 22 bp, Homo sapiens
aacactctctgttggtaaggct

SEQ ID NO: 24498 - DNA, 22 bp, Homo sapiens
gcctgatgagcttccagctgag

SEQ ID NO: 24499 - DNA, 22 bp, Homo sapiens
caaagtgctgggattataggca

SEQ ID NO: 24500 - DNA, 14 bp, Homo sapiens
gcaggcggatcact

SEQ ID NO: 24501 - DNA, 23 bp, Homo sapiens
ggttctgccgcttactgctgtgc

SEQ ID NO: 24502 - DNA, 22 bp, Homo sapiens
gggacacgggctgagcagagcc

SEQ ID NO: 24503 - DNA, 22 bp, Homo sapiens
taagggaacagcttcaaactca

SEQ ID NO: 24504 - DNA, 19 bp, Homo sapiens
tcctgcctggggccgcctg

SEQ ID NO: 24505 - DNA, 22 bp, Homo sapiens
acacggcactttaggaaggggc

SEQ ID NO: 24506 - DNA, 22 bp, Homo sapiens
gtgttggacagcttctactgtg

SEQ ID NO: 24507 - DNA, 22 bp, Homo sapiens
aaggccctggcaggaagcagga

SEQ ID NO: 24508 - DNA, 22 bp, Homo sapiens
gccgggttcaagccattctcct

SEQ ID NO: 24509 - DNA, 22 bp, Homo sapiens
tgtgggacctcagagggtcccc

SEQ ID NO: 24510 - DNA, 23 bp, Homo sapiens
aaataggagtatctggatcatga

SEQ ID NO: 24511 - DNA, 22 bp, Homo sapiens
ggacagaaaccatatgagtgta

SEQ ID NO: 24512 - DNA, 22 bp, Homo sapiens
agatgcagtggttaacaataca

SEQ ID NO: 24513 - DNA, 22 bp, Homo sapiens
acttttaaatgagtttcagttg

SEQ ID NO: 24514 - DNA, 19 bp, Homo sapiens
tcctggggaggggcatggc

SEQ ID NO: 24515 - DNA, 22 bp, Homo sapiens
ggccagcctggggctcccagac

SEQ ID NO: 24516 - DNA, 22 bp, Homo sapiens
agcgtgaattagttggtacaca

SEQ ID NO: 24517 - DNA, 22 bp, Homo sapiens
atgttggccaggctggtcttga

SEQ ID NO: 24518 - DNA, 21 bp, Homo sapiens
tcttttctcagctttgtggtt

SEQ ID NO: 24519 - DNA, 22 bp, Homo sapiens
tggtgcaaaactaattgcggtt

SEQ ID NO: 24520 - DNA, 22 bp, Homo sapiens
caatttctaacattccatggat

SEQ ID NO: 24521 - DNA, 22 bp, Homo sapiens
ctgatccctccatagggcacag

SEQ ID NO: 24522 - DNA, 22 bp, Homo sapiens
ttgctcagtggcagggctggta

SEQ ID NO: 24523 - DNA, 22 bp, Homo sapiens
ccacagaattctgtctccagga

SEQ ID NO: 24524 - DNA, 22 bp, Homo sapiens
ggcagcactgcagcttgttggg

SEQ ID NO: 24525 - DNA, 22 bp, Homo sapiens
ttgtgctcctgtgagaatctag

SEQ ID NO: 24526 - DNA, 22 bp, Homo sapiens
gctcccaccttaaccttcacat

SEQ ID NO: 24527 - DNA, 22 bp, Homo sapiens
attccagaggggattcccggcc

SEQ ID NO: 24528 - DNA, 22 bp, Homo sapiens
ctggggtcagggatcagagagc

SEQ ID NO: 24529 - DNA, 22 bp, Homo sapiens
tgctgagcgcatccggcggccg

SEQ ID NO: 24530 - DNA, 22 bp, Homo sapiens
aactagaaaaagactttctgag

SEQ ID NO: 24531 - DNA, 22 bp, Homo sapiens
tgtgactgaggctccaagctag

SEQ ID NO: 24532 - DNA, 22 bp, Homo sapiens
cctgtgcttggccagagaggtt

SEQ ID NO: 24533 - DNA, 22 bp, Homo sapiens
agaaagtgcttccctttggact

SEQ ID NO: 24534 - DNA, 22 bp, Homo sapiens
gtagggttggagagcacaacca

SEQ ID NO: 24535 - DNA, 22 bp, Homo sapiens
tgcgccatgtgctctcggccct

SEQ ID NO: 24536 - DNA, 22 bp, Homo sapiens
taaggctatcttttgagtgtgt

SEQ ID NO: 24537 - DNA, 22 bp, Homo sapiens
taaatacttagttttgtgtcta

SEQ ID NO: 24538 - DNA, 22 bp, Homo sapiens
actttaaaactgatcatcagag

SEQ ID NO: 24539 - DNA, 22 bp, Homo sapiens
tccgtggggcctgtggcttccg

SEQ ID NO: 24540 - DNA, 22 bp, Homo sapiens
tttaaaaaactagtctgagtct

SEQ ID NO: 24541 - DNA, 22 bp, Homo sapiens
tgcagattcaaatgaaatgcaa

SEQ ID NO: 24542 - DNA, 22 bp, Homo sapiens
aacccaggctggagtgcagtgg

SEQ ID NO: 24543 - DNA, 18 bp, Homo sapiens
tggcgatggtcatttttc

SEQ ID NO: 24544 - DNA, 22 bp, Homo sapiens
gaccttgtgatctgcccacctt

SEQ ID NO: 24545 - DNA, 22 bp, Homo sapiens
gcagcctgggcaacagagtgag

SEQ ID NO: 24546 - DNA, 22 bp, Homo sapiens
gagcctcgtggcggccactgcg

SEQ ID NO: 24547 - DNA, 22 bp, Homo sapiens
ggaggcggaggttgcagtgagc

SEQ ID NO: 24548 - DNA, 17 bp, Homo sapiens
ttaaggtggatcagcac

SEQ ID NO: 24549 - DNA, 20 bp, Homo sapiens
gctgaggtggaggaaggaga

SEQ ID NO: 24550 - DNA, 22 bp, Homo sapiens
agatgtgagaatcaagtgacca

SEQ ID NO: 24551 - DNA, 22 bp, Homo sapiens
ccgcccacactaaatatgagcg

SEQ ID NO: 24552 - DNA, 23 bp, Homo sapiens
aaacttgctatggctgaaatcat

SEQ ID NO: 24553 - DNA, 22 bp, Homo sapiens
ggctttgacatgctgaattaaa

SEQ ID NO: 24554 - DNA, 22 bp, Homo sapiens
cctgtaactccttggctcaagt

SEQ ID NO: 24555 - DNA, 22 bp, Homo sapiens
ccaggaggcggaaggtacagtg

SEQ ID NO: 24556 - DNA, 22 bp, Homo sapiens
tcttgggcaatttctctagagg

SEQ ID NO: 24557 - DNA, 22 bp, Homo sapiens
tccgggcaactgaagggaggtt

SEQ ID NO: 24558 - DNA, 22 bp, Homo sapiens
agagcacagccaccatttacaa

SEQ ID NO: 24559 - DNA, 22 bp, Homo sapiens
gcacagccacgtaatgtggtca

SEQ ID NO: 24560 - DNA, 22 bp, Homo sapiens
caggaggattgcttgaggccag

SEQ ID NO: 24561 - DNA, 21 bp, Homo sapiens
ccgccgctgatagctctgggc

SEQ ID NO: 24562 - DNA, 22 bp, Homo sapiens
ggaggaggggtgactgaatgct

SEQ ID NO: 24563 - DNA, 22 bp, Homo sapiens
gccctgccctctcggcactcgc

SEQ ID NO: 24564 - DNA, 22 bp, Homo sapiens
gtcccgcattgggcattcctgg

SEQ ID NO: 24565 - DNA, 22 bp, Homo sapiens
tgatatgggaaaagggctcgga

SEQ ID NO: 24566 - DNA, 22 bp, Homo sapiens
gcaaatgctaaagtgtagagac

SEQ ID NO: 24567 - DNA, 22 bp, Homo sapiens
tggacaggcaagcaagacatac

SEQ ID NO: 24568 - DNA, 22 bp, Homo sapiens
tcccagagctctggaggttgga

SEQ ID NO: 24569 - DNA, 22 bp, Homo sapiens
tggtggctcacacctgtaatcc

SEQ ID NO: 24570 - DNA, 22 bp, Homo sapiens
gcgaggaggggtgctgggcccc

SEQ ID NO: 24571 - DNA, 23 bp, Homo sapiens
tgaatgtttattctcggtgcaga

SEQ ID NO: 24572 - DNA, 22 bp, Homo sapiens
agtggtgataaccgctatcata

SEQ ID NO: 24573 - DNA, 22 bp, Homo sapiens
caaagtgctgggattacaggtg

SEQ ID NO: 24574 - DNA, 22 bp, Homo sapiens
ggctgagtctgtgacccatgcg

SEQ ID NO: 24575 - DNA, 22 bp, Homo sapiens
tacatttataaggcttctctgt

SEQ ID NO: 24576 - DNA, 22 bp, Homo sapiens
gcaccactacactccagcctgg

SEQ ID NO: 24577 - DNA, 22 bp, Homo sapiens
aggtgcatctcgtagctcttct

SEQ ID NO: 24578 - DNA, 22 bp, Homo sapiens
ccaggagttggaggctgcagtg

SEQ ID NO: 24579 - DNA, 22 bp, Homo sapiens
tggggccatctcacccactgtt

SEQ ID NO: 24580 - DNA, 22 bp, Homo sapiens
atatccagcagcaggtgagtat

SEQ ID NO: 24581 - DNA, 22 bp, Homo sapiens
atggcctcagcatggagcttcg

SEQ ID NO: 24582 - DNA, 22 bp, Homo sapiens
cggccgcgtccagggccgccag

SEQ ID NO: 24583 - DNA, 22 bp, Homo sapiens
gtccaggcctgcctctgaggag

SEQ ID NO: 24584 - DNA, 22 bp, Homo sapiens
aggcaacttttggggatgatgg

SEQ ID NO: 24585 - DNA, 22 bp, Homo sapiens
aggggatgcctagtggagtctc

SEQ ID NO: 24586 - DNA, 22 bp, Homo sapiens
aggagccagtggagttcctgcc

SEQ ID NO: 24587 - DNA, 22 bp, Homo sapiens
cccaggaggcgcaggttgcggt

SEQ ID NO: 24588 - DNA, 22 bp, Homo sapiens
agattctaccagagctagtttg

SEQ ID NO: 24589 - DNA, 22 bp, Homo sapiens
tgacctattagatttccttgcc

SEQ ID NO: 24590 - DNA, 22 bp, Homo sapiens
tctacatgcagcgaggggactt

SEQ ID NO: 24591 - DNA, 22 bp, Homo sapiens
cacccaggctggagtgcagtga

SEQ ID NO: 24592 - DNA, 22 bp, Homo sapiens
cacccaggctggaatgcagtgg

SEQ ID NO: 24593 - DNA, 22 bp, Homo sapiens
gcacacggcagcctcctcctga

SEQ ID NO: 24594 - DNA, 22 bp, Homo sapiens
gctgcagctcgccttccggcct

SEQ ID NO: 24595 - DNA, 22 bp, Homo sapiens
aaccagctaacatgtggaatga

SEQ ID NO: 24596 - DNA, 22 bp, Homo sapiens
gttaaggatcttgagatgagga

SEQ ID NO: 24597 - DNA, 18 bp, Homo sapiens
taggagagaatttattta

SEQ ID NO: 24598 - DNA, 22 bp, Homo sapiens
caagacttcaccgctctgtgct

SEQ ID NO: 24599 - DNA, 22 bp, Homo sapiens
cagggccagggacacgctgtca

SEQ ID NO: 24600 - DNA, 22 bp, Homo sapiens
cactccagcctcagtgacagag

SEQ ID NO: 24601 - DNA, 22 bp, Homo sapiens
cagggcgaacttggcggtgggc

SEQ ID NO: 24602 - DNA, 22 bp, Homo sapiens
gaccttgtgatccccctgcctt

SEQ ID NO: 24603 - DNA, 22 bp, Homo sapiens
ttagatttgtagtgagttcaga

SEQ ID NO: 24604 - DNA, 22 bp, Homo sapiens
atgatgtaaaataagttgtgag

SEQ ID NO: 24605 - DNA, 22 bp, Homo sapiens
gggcggatcacctgaggtcagg

SEQ ID NO: 24606 - DNA, 22 bp, Homo sapiens
aactgctgacaagtgaccagtg

SEQ ID NO: 24607 - DNA, 21 bp, Homo sapiens
ctgtttgcaagcctatgtgtc

SEQ ID NO: 24608 - DNA, 22 bp, Homo sapiens
accttgatggggctgttggagt

SEQ ID NO: 24609 - DNA, 22 bp, Homo sapiens
tcttcccagaggaggtgccagc

SEQ ID NO: 24610 - DNA, 22 bp, Homo sapiens
ggtgccagaaaacttgaagagt

SEQ ID NO: 24611 - DNA, 22 bp, Homo sapiens
gcaaacaaggacatacatcctg

SEQ ID NO: 24612 - DNA, 22 bp, Homo sapiens
actgcacttcagcctgggtgtc

SEQ ID NO: 24613 - DNA, 22 bp, Homo sapiens
ttgagtttcctgacagcgaagg

SEQ ID NO: 24614 - DNA, 22 bp, Homo sapiens
caggggcggtggctcacgcctg

SEQ ID NO: 24615 - DNA, 22 bp, Homo sapiens
atttgtgggactataatgcagg

SEQ ID NO: 24616 - DNA, 22 bp, Homo sapiens
gagacgtggcctttgcctgagc

SEQ ID NO: 24617 - DNA, 22 bp, Homo sapiens
ttacatgtttatgggggtacat

SEQ ID NO: 24618 - DNA, 22 bp, Homo sapiens
cggggttcatccatgctgtggc

SEQ ID NO: 24619 - DNA, 22 bp, Homo sapiens
acccgatgttggtgctctagta

SEQ ID NO: 24620 - DNA, 22 bp, Homo sapiens
ttctccctgtcctatcaagact

SEQ ID NO: 24621 - DNA, 22 bp, Homo sapiens
acaggtcctcaagtcagctggg

SEQ ID NO: 24622 - DNA, 22 bp, Homo sapiens
gccaccccataggtgttaggtg

SEQ ID NO: 24623 - DNA, 22 bp, Homo sapiens
tctttctacatcatttgcttct

SEQ ID NO: 24624 - DNA, 22 bp, Homo sapiens
ctcagcagtatactctgaagat

SEQ ID NO: 24625 - DNA, 22 bp, Homo sapiens
acacccaggctggcgtgcagtg

SEQ ID NO: 24626 - DNA, 22 bp, Homo sapiens
gaagattgaaggctgggaatta

SEQ ID NO: 24627 - DNA, 22 bp, Homo sapiens
atctggttcttcttaggcatca

SEQ ID NO: 24628 - DNA, 22 bp, Homo sapiens
cgggagcctctgggtcacactg

SEQ ID NO: 24629 - DNA, 22 bp, Homo sapiens
tcattacaagatttccaatttg

SEQ ID NO: 24630 - DNA, 22 bp, Homo sapiens
catcccctgatgctcttgagta

SEQ ID NO: 24631 - DNA, 22 bp, Homo sapiens
cagatgtacatgaagggcaatg

SEQ ID NO: 24632 - DNA, 22 bp, Homo sapiens
tgtgcctgttcccactttgcct

SEQ ID NO: 24633 - DNA, 22 bp, Homo sapiens
aggtgggtgcctatgtatgtat

SEQ ID NO: 24634 - DNA, 22 bp, Homo sapiens
aaatactcatcccaggaactgg

SEQ ID NO: 24635 - DNA, 22 bp, Homo sapiens
tgggcaggggccctgcttccgt

SEQ ID NO: 24636 - DNA, 20 bp, Homo sapiens
agagtgagactccatctcag

SEQ ID NO: 24637 - DNA, 22 bp, Homo sapiens
cttatcagattatctgggctgt

SEQ ID NO: 24638 - DNA, 22 bp, Homo sapiens
caggccctgtgctgggtgatgt

SEQ ID NO: 24639 - DNA, 22 bp, Homo sapiens
gatgctgagagattggagacta

SEQ ID NO: 24640 - DNA, 22 bp, Homo sapiens
tggcacagcctccatgtcgtcc

SEQ ID NO: 24641 - DNA, 22 bp, Homo sapiens
ggttgtagttggaggttgtata

SEQ ID NO: 24642 - DNA, 22 bp, Homo sapiens
ggctccccaggtccaggagctg

SEQ ID NO: 24643 - DNA, 22 bp, Homo sapiens
gcaggtggatcaccacgtcagg

SEQ ID NO: 24644 - DNA, 22 bp, Homo sapiens
aatgaattgcagtactgacttg

SEQ ID NO: 24645 - DNA, 22 bp, Homo sapiens
ccctggctgataccggaaaggc

SEQ ID NO: 24646 - DNA, 22 bp, Homo sapiens
gtgtcctttccgggcctggagg

SEQ ID NO: 24647 - DNA, 22 bp, Homo sapiens
attgttcaatgtaataattttg

SEQ ID NO: 24648 - DNA, 22 bp, Homo sapiens
acccatccagtgtccctgctag

SEQ ID NO: 24649 - DNA, 19 bp, Homo sapiens
gccttcccaccacccgtcc

SEQ ID NO: 24650 - DNA, 22 bp, Homo sapiens
ttccagtgggctgggagtaagg

SEQ ID NO: 24651 - DNA, 22 bp, Homo sapiens
gaggtggccaagcgaggaaggg

SEQ ID NO: 24652 - DNA, 22 bp, Homo sapiens
aagaggttgtctgtgatgagtt

SEQ ID NO: 24653 - DNA, 22 bp, Homo sapiens
caggagtgttgattgctcagga

SEQ ID NO: 24654 - DNA, 22 bp, Homo sapiens
gggttggatcctggtggctgcc

SEQ ID NO: 24655 - DNA, 19 bp, Homo sapiens
taaaacgtgcatggcagca

SEQ ID NO: 24656 - DNA, 20 bp, Homo sapiens
ttgagcagcagtgctgtgtc

SEQ ID NO: 24657 - DNA, 22 bp, Homo sapiens
ctgcagtctacctggattttta

SEQ ID NO: 24658 - DNA, 22 bp, Homo sapiens
gctaggttggggaagttctcct

SEQ ID NO: 24659 - DNA, 22 bp, Homo sapiens
gtgcagttgtggacatgacaac

SEQ ID NO: 24660 - DNA, 22 bp, Homo sapiens
aggccttaccatagctgtagca

SEQ ID NO: 24661 - DNA, 22 bp, Homo sapiens
acagagacacggaagctaaaga

SEQ ID NO: 24662 - DNA, 19 bp, Homo sapiens
cataatacagtggatctga

SEQ ID NO: 24663 - DNA, 22 bp, Homo sapiens
gttattgaggtggagtctcact

SEQ ID NO: 24664 - DNA, 22 bp, Homo sapiens
tttcttcctgctttgtcccatg

SEQ ID NO: 24665 - DNA, 22 bp, Homo sapiens
ggcatagatttctttaggttta

SEQ ID NO: 24666 - DNA, 22 bp, Homo sapiens
cccaggaggcagatgttgcagt

SEQ ID NO: 24667 - DNA, 22 bp, Homo sapiens
gagtggggggtccgtctcagtg

SEQ ID NO: 24668 - DNA, 22 bp, Homo sapiens
actcatgtaagcggaatgtagt

SEQ ID NO: 24669 - DNA, 22 bp, Homo sapiens
tactgcactccagcctgggtga

SEQ ID NO: 24670 - DNA, 22 bp, Homo sapiens
tggcaccatcaaggctgagaac

SEQ ID NO: 24671 - DNA, 22 bp, Homo sapiens
ttgttcttgtctttgccttcac

SEQ ID NO: 24672 - DNA, 22 bp, Homo sapiens
attctaatggcagagactcctg

SEQ ID NO: 24673 - DNA, 22 bp, Homo sapiens
ttcctggaaattatgctcacct

SEQ ID NO: 24674 - DNA, 22 bp, Homo sapiens
cagggatggcgctggctgcccg

SEQ ID NO: 24675 - DNA, 22 bp, Homo sapiens
atggtggacgggagacaggact

SEQ ID NO: 24676 - DNA, 22 bp, Homo sapiens
gggaggttctgttcgcacttga

SEQ ID NO: 24677 - DNA, 22 bp, Homo sapiens
aaatgcacaaagattttgcact

SEQ ID NO: 24678 - DNA, 22 bp, Homo sapiens
ggccaggcgatgacccctccac

SEQ ID NO: 24679 - DNA, 23 bp, Homo sapiens
cagagctggcttcatgggtgtgc

SEQ ID NO: 24680 - DNA, 22 bp, Homo sapiens
tccctgaggatggttgtattta

SEQ ID NO: 24681 - DNA, 22 bp, Homo sapiens
tctggacaggggcgctttgggg

SEQ ID NO: 24682 - DNA, 22 bp, Homo sapiens
ggcttggaaactagagtgtgca

SEQ ID NO: 24683 - DNA, 22 bp, Homo sapiens
tgctcttcacagtttcagcatc

SEQ ID NO: 24684 - DNA, 22 bp, Homo sapiens
cagcgtctcgttgtgggcctcg

SEQ ID NO: 24685 - DNA, 22 bp, Homo sapiens
caggctggagtgcagtggtgcc

SEQ ID NO: 24686 - DNA, 22 bp, Homo sapiens
ctgcttctagcaccaagtccct

SEQ ID NO: 24687 - DNA, 22 bp, Homo sapiens
tatgtgtttgacaccctgcaag

SEQ ID NO: 24688 - DNA, 22 bp, Homo sapiens
ttcacagtggtagtgcatttag

SEQ ID NO: 24689 - DNA, 22 bp, Homo sapiens
ctgattctcctcaagactttcg

SEQ ID NO: 24690 - DNA, 22 bp, Homo sapiens
ggagtgcggtggcaccatctca

SEQ ID NO: 24691 - DNA, 18 bp, Homo sapiens
taggttacagccagccag

SEQ ID NO: 24692 - DNA, 22 bp, Homo sapiens
tgggtgctctgcgaccgtaggg

SEQ ID NO: 24693 - DNA, 22 bp, Homo sapiens
ttcctgcgcccttctcgcccgc

SEQ ID NO: 24694 - DNA, 22 bp, Homo sapiens
cagctcgggcctccctctcccg

SEQ ID NO: 24695 - DNA, 22 bp, Homo sapiens
cccaccagacctgcaccggcac

SEQ ID NO: 24696 - DNA, 22 bp, Homo sapiens
aatttcggttcaaggcccagtt

SEQ ID NO: 24697 - DNA, 23 bp, Homo sapiens
aaactacaacgccaggcactgag

SEQ ID NO: 24698 - DNA, 22 bp, Homo sapiens
gcaggtctatcaggctgcaggt

SEQ ID NO: 24699 - DNA, 22 bp, Homo sapiens
ggaggagcatgagagggtagtg

SEQ ID NO: 24700 - DNA, 22 bp, Homo sapiens
atgtcatgaggctagcccccaa

SEQ ID NO: 24701 - DNA, 22 bp, Homo sapiens
cagtggcctctggctttgctgt

SEQ ID NO: 24702 - DNA, 22 bp, Homo sapiens
ggctctgcgcctgcggggactt

SEQ ID NO: 24703 - DNA, 22 bp, Homo sapiens
atacaaaaattagccgggagta

SEQ ID NO: 24704 - DNA, 22 bp, Homo sapiens
tgaattccatcctgttgcaacc

SEQ ID NO: 24705 - DNA, 22 bp, Homo sapiens
agggttcagtgaggtgtactcc

SEQ ID NO: 24706 - DNA, 22 bp, Homo sapiens
tccctgatgccttgatccgtgg

SEQ ID NO: 24707 - DNA, 22 bp, Homo sapiens
gaaaagagacagggtgggtgat

SEQ ID NO: 24708 - DNA, 22 bp, Homo sapiens
cgggttttccacaggagtcttt

SEQ ID NO: 24709 - DNA, 22 bp, Homo sapiens
acaaagccagattctggagcac

SEQ ID NO: 24710 - DNA, 22 bp, Homo sapiens
tcttgaagtgggagacatcgtg

SEQ ID NO: 24711 - DNA, 22 bp, Homo sapiens
gaggggctgccctggtgtcagg

SEQ ID NO: 24712 - DNA, 22 bp, Homo sapiens
ccctggcagtgctcctttagac

SEQ ID NO: 24713 - DNA, 22 bp, Homo sapiens
cgcgaggtggaggttgcagtga

SEQ ID NO: 24714 - DNA, 22 bp, Homo sapiens
cactgcaacctccatcttctgg

SEQ ID NO: 24715 - DNA, 22 bp, Homo sapiens
cagcagcagtgttctagaatct

SEQ ID NO: 24716 - DNA, 22 bp, Homo sapiens
tcccagctactctagaggctga

SEQ ID NO: 24717 - DNA, 22 bp, Homo sapiens
ctgccgttgtgaagctcttaga

SEQ ID NO: 24718 - DNA, 22 bp, Homo sapiens
gctgacctcgtccaggcgcttc

SEQ ID NO: 24719 - DNA, 22 bp, Homo sapiens
gcctgtgacccagggcccagga

SEQ ID NO: 24720 - DNA, 22 bp, Homo sapiens
cccatttcttgagttcagctct

SEQ ID NO: 24721 - DNA, 21 bp, Homo sapiens
cccgcacagcggtaggccgcc

SEQ ID NO: 24722 - DNA, 22 bp, Homo sapiens
cttgggaggcagaggttgcagt

SEQ ID NO: 24723 - DNA, 22 bp, Homo sapiens
agttattactctttaacatatt

SEQ ID NO: 24724 - DNA, 22 bp, Homo sapiens
cacggcctgtaaggacccagga

SEQ ID NO: 24725 - DNA, 22 bp, Homo sapiens
gtggcagaccttcccttctcct

SEQ ID NO: 24726 - DNA, 22 bp, Homo sapiens
aaatgcaacgggctttccttat

SEQ ID NO: 24727 - DNA, 22 bp, Homo sapiens
aatgctgagtcctgtgagtctt

SEQ ID NO: 24728 - DNA, 22 bp, Homo sapiens
tgcagcctggcttcgcgcctcc

SEQ ID NO: 24729 - DNA, 22 bp, Homo sapiens
atgatccaaagccacaggggca

SEQ ID NO: 24730 - DNA, 22 bp, Homo sapiens
aaccattcactgaacagttcaa

SEQ ID NO: 24731 - DNA, 22 bp, Homo sapiens
tgtcagtgtctatgaagaattt

SEQ ID NO: 24732 - DNA, 22 bp, Homo sapiens
aacagctttgtatacagtaact

SEQ ID NO: 24733 - DNA, 22 bp, Homo sapiens
aggcaaggtgctacagacagtg

SEQ ID NO: 24734 - DNA, 22 bp, Homo sapiens
cactgcaagctccgcctcctgg

SEQ ID NO: 24735 - DNA, 22 bp, Homo sapiens
ctgctgaggtggagattgcagt

SEQ ID NO: 24736 - DNA, 22 bp, Homo sapiens
taattcttcaggccttttgtct

SEQ ID NO: 24737 - DNA, 22 bp, Homo sapiens
aaggccctgtctccaaatacag

SEQ ID NO: 24738 - DNA, 22 bp, Homo sapiens
tgtcctcatcctccagtctgtc

SEQ ID NO: 24739 - DNA, 22 bp, Homo sapiens
gctgcagtgagccaagatcgtg

SEQ ID NO: 24740 - DNA, 22 bp, Homo sapiens
aggacctactgatatcttagca

SEQ ID NO: 24741 - DNA, 22 bp, Homo sapiens
ccagcctggttcagaattggct

SEQ ID NO: 24742 - DNA, 22 bp, Homo sapiens
tgaactcctgacctcatgatcc

SEQ ID NO: 24743 - DNA, 22 bp, Homo sapiens
cacagggcttctcatggggtgc

SEQ ID NO: 24744 - DNA, 22 bp, Homo sapiens
ccagtgtgcattatcatgtgtc

SEQ ID NO: 24745 - DNA, 22 bp, Homo sapiens
tgaggcaggagaatcaccggaa

SEQ ID NO: 24746 - DNA, 22 bp, Homo sapiens
tgcagcacttgccaaactaact

SEQ ID NO: 24747 - DNA, 22 bp, Homo sapiens
aggaaagcttggcaaactaaat

SEQ ID NO: 24748 - DNA, 22 bp, Homo sapiens
ttaggcaattttgtcattgtgt

SEQ ID NO: 24749 - DNA, 22 bp, Homo sapiens
aggtggcagatgggggtgctcg

SEQ ID NO: 24750 - DNA, 22 bp, Homo sapiens
cataaaaggtagcagtttgaaa

SEQ ID NO: 24751 - DNA, 22 bp, Homo sapiens
gtgtcaataaatagcggtgtgg

SEQ ID NO: 24752 - DNA, 22 bp, Homo sapiens
ctcaggacccggtccaggtggg

SEQ ID NO: 24753 - DNA, 22 bp, Homo sapiens
ctgccttttaaagccagtgtta

SEQ ID NO: 24754 - DNA, 22 bp, Homo sapiens
catggcggtcaggatgtaggtg

SEQ ID NO: 24755 - DNA, 22 bp, Homo sapiens
cctcgcggcactcgggccggat

SEQ ID NO: 24756 - DNA, 22 bp, Homo sapiens
aggaaggactccatggtccgtc

SEQ ID NO: 24757 - DNA, 22 bp, Homo sapiens
agggctggagccacagctggga

SEQ ID NO: 24758 - DNA, 22 bp, Homo sapiens
tggcactgagcagccgcggcag

SEQ ID NO: 24759 - DNA, 22 bp, Homo sapiens
ctgcagggagaggggacagcct

SEQ ID NO: 24760 - DNA, 22 bp, Homo sapiens
ggaggggatttagtagatgcta

SEQ ID NO: 24761 - DNA, 22 bp, Homo sapiens
aggtaaacaggagaaaatgaga

SEQ ID NO: 24762 - DNA, 18 bp, Homo sapiens
actctgcggaggccccag

SEQ ID NO: 24763 - DNA, 22 bp, Homo sapiens
ggtcagaggtcccagaagaagc

SEQ ID NO: 24764 - DNA, 22 bp, Homo sapiens
actctttgtctgttgccgctta

SEQ ID NO: 24765 - DNA, 22 bp, Homo sapiens
atcagtgtgtcaaaagcacaaa

SEQ ID NO: 24766 - DNA, 22 bp, Homo sapiens
gcgtctcaaggcccccaggcca

SEQ ID NO: 24767 - DNA, 22 bp, Homo sapiens
tgctgctcagaacccctgggct

SEQ ID NO: 24768 - DNA, 22 bp, Homo sapiens
tgattaatatcaccaccattgg

SEQ ID NO: 24769 - DNA, 18 bp, Homo sapiens
tgagaggctattttttgc

SEQ ID NO: 24770 - DNA, 22 bp, Homo sapiens
aagtgattctccctacgcggga

SEQ ID NO: 24771 - DNA, 22 bp, Homo sapiens
atcctcagagaacgaacacaat

SEQ ID NO: 24772 - DNA, 22 bp, Homo sapiens
aggctatttccactcttctcat

SEQ ID NO: 24773 - DNA, 22 bp, Homo sapiens
gtcaccttgaacaggctactca

SEQ ID NO: 24774 - DNA, 22 bp, Homo sapiens
tgttgatttgtgggctgcaaaa

SEQ ID NO: 24775 - DNA, 22 bp, Homo sapiens
acggcttcttgactgtgggttg

SEQ ID NO: 24776 - DNA, 22 bp, Homo sapiens
gcatacttcttgctgctttcag

SEQ ID NO: 24777 - DNA, 22 bp, Homo sapiens
ttattagagtgctttgagaaag

SEQ ID NO: 24778 - DNA, 22 bp, Homo sapiens
ggcctctcttgggacagctgtc

SEQ ID NO: 24779 - DNA, 22 bp, Homo sapiens
ggcctgttttatcagtttttaa

SEQ ID NO: 24780 - DNA, 22 bp, Homo sapiens
gaagcctcaacatctctgcgtc

SEQ ID NO: 24781 - DNA, 22 bp, Homo sapiens
cttgagtcatataaagacagag

SEQ ID NO: 24782 - DNA, 22 bp, Homo sapiens
tcaccgaggctggagtgcagtg

SEQ ID NO: 24783 - DNA, 22 bp, Homo sapiens
atttaagggatttggagaccaa

SEQ ID NO: 24784 - DNA, 22 bp, Homo sapiens
tttaggttttttcacgtggcta

SEQ ID NO: 24785 - DNA, 22 bp, Homo sapiens
acagttaattgttgttgggtgt

SEQ ID NO: 24786 - DNA, 22 bp, Homo sapiens
tccagtttccaatcactgcacg

SEQ ID NO: 24787 - DNA, 22 bp, Homo sapiens
tgaatgtttatattggccaaaa

SEQ ID NO: 24788 - DNA, 22 bp, Homo sapiens
caggagtgtctccacacagcaa

SEQ ID NO: 24789 - DNA, 22 bp, Homo sapiens
ttccacaatggttaagctcgtt

SEQ ID NO: 24790 - DNA, 22 bp, Homo sapiens
atccatcctgccatctgagtag

SEQ ID NO: 24791 - DNA, 18 bp, Homo sapiens
tccaccgcgtgcacctct

SEQ ID NO: 24792 - DNA, 22 bp, Homo sapiens
tcgcgcccccaagcgtcattgg

SEQ ID NO: 24793 - DNA, 23 bp, Homo sapiens
ggactgcaatggcgccgtctcag

SEQ ID NO: 24794 - DNA, 22 bp, Homo sapiens
gtgccactgataaatcagaatg

SEQ ID NO: 24795 - DNA, 22 bp, Homo sapiens
aaattcttttgtgcggtgaagt

SEQ ID NO: 24796 - DNA, 22 bp, Homo sapiens
cctggggccccgagccagaagc

SEQ ID NO: 24797 - DNA, 22 bp, Homo sapiens
ggccctggcagccacgaaagcc

SEQ ID NO: 24798 - DNA, 22 bp, Homo sapiens
tccaggtgggctgcacccaggc

SEQ ID NO: 24799 - DNA, 22 bp, Homo sapiens
taaaggtagtgtgacatattgt

SEQ ID NO: 24800 - DNA, 22 bp, Homo sapiens
cagggtgacaagtggcaaggag

SEQ ID NO: 24801 - DNA, 22 bp, Homo sapiens
agtcaataaaagctttagattc

SEQ ID NO: 24802 - DNA, 22 bp, Homo sapiens
tatgcacaacatgcaggtttgt

SEQ ID NO: 24803 - DNA, 19 bp, Homo sapiens
tgaacgatgtctcagggca

SEQ ID NO: 24804 - DNA, 22 bp, Homo sapiens
actgcactccagcccgagcaac

SEQ ID NO: 24805 - DNA, 22 bp, Homo sapiens
tctctggactcgagcttactca

SEQ ID NO: 24806 - DNA, 22 bp, Homo sapiens
ttgtttccataattaagtgtga

SEQ ID NO: 24807 - DNA, 22 bp, Homo sapiens
ttcctgttcaggaaagttgtgt

SEQ ID NO: 24808 - DNA, 22 bp, Homo sapiens
cactgctacctctgcctcccgg

SEQ ID NO: 24809 - DNA, 22 bp, Homo sapiens
tacaacctctgcctcccaagtt

SEQ ID NO: 24810 - DNA, 22 bp, Homo sapiens
aagtcattggtagcttgatagg

SEQ ID NO: 24811 - DNA, 22 bp, Homo sapiens
agcgagtgggtcagcgttgcag

SEQ ID NO: 24812 - DNA, 22 bp, Homo sapiens
gctcatgactgtaatcccagca

SEQ ID NO: 24813 - DNA, 22 bp, Homo sapiens
tttccctgtgaatatttaaaga

SEQ ID NO: 24814 - DNA, 22 bp, Homo sapiens
caggaagctgtgaaggagacgg

SEQ ID NO: 24815 - DNA, 22 bp, Homo sapiens
ttggagagtgatattcagatgc

SEQ ID NO: 24816 - DNA, 22 bp, Homo sapiens
ttggcataccttagtggtggag

SEQ ID NO: 24817 - DNA, 22 bp, Homo sapiens
aagcgcaggactggctcacggc

SEQ ID NO: 24818 - DNA, 22 bp, Homo sapiens
tcactgcaacctccacctcccg

SEQ ID NO: 24819 - DNA, 22 bp, Homo sapiens
tttgtcctaacagtggtaaagg

SEQ ID NO: 24820 - DNA, 22 bp, Homo sapiens
gagtcacatactatgtaataga

SEQ ID NO: 24821 - DNA, 22 bp, Homo sapiens
taagtcttcatagtctaatgtc

SEQ ID NO: 24822 - DNA, 21 bp, Homo sapiens
tgaaggggtggcagtgtgctt

SEQ ID NO: 24823 - DNA, 19 bp, Homo sapiens
agccagccagcaggtatgc

SEQ ID NO: 24824 - DNA, 22 bp, Homo sapiens
tattgggtaaagatccagtttt

SEQ ID NO: 24825 - DNA, 22 bp, Homo sapiens
tttctgagaaattaaacacttt

SEQ ID NO: 24826 - DNA, 22 bp, Homo sapiens
actctccttttgatcttcagaa

SEQ ID NO: 24827 - DNA, 22 bp, Homo sapiens
tcctgagataaatctcatgtga

SEQ ID NO: 24828 - DNA, 22 bp, Homo sapiens
caccatttagtagcaagagctc

SEQ ID NO: 24829 - DNA, 22 bp, Homo sapiens
atcagagtgtaagttctttcct

SEQ ID NO: 24830 - DNA, 22 bp, Homo sapiens
aaagtgctgggattacaggtgt

SEQ ID NO: 24831 - DNA, 17 bp, Homo sapiens
catcaaagaaatttcca

SEQ ID NO: 24832 - DNA, 22 bp, Homo sapiens
ttacttaaacagaaatgcagaa

SEQ ID NO: 24833 - DNA, 22 bp, Homo sapiens
tgtctgcctgcgggccggcaca

SEQ ID NO: 24834 - DNA, 22 bp, Homo sapiens
caacatggcgaaaccccatctc

SEQ ID NO: 24835 - DNA, 22 bp, Homo sapiens
cccagttgttgccggctctgga

SEQ ID NO: 24836 - DNA, 23 bp, Homo sapiens
ggttccaggaacacagcctgatg

SEQ ID NO: 24837 - DNA, 22 bp, Homo sapiens
ctgctctgctgatcagtgtctc

SEQ ID NO: 24838 - DNA, 22 bp, Homo sapiens
ccactgcactccagccttggca

SEQ ID NO: 24839 - DNA, 22 bp, Homo sapiens
tgccagctgcttgtcccccaca

SEQ ID NO: 24840 - DNA, 21 bp, Homo sapiens
tacaatgcacaggagagcctc

SEQ ID NO: 24841 - DNA, 22 bp, Homo sapiens
cagccccatggtgtgctccagc

SEQ ID NO: 24842 - DNA, 22 bp, Homo sapiens
ctaggctcaggtgactccaagc

SEQ ID NO: 24843 - DNA, 22 bp, Homo sapiens
tggattcacaccattctcctgc

SEQ ID NO: 24844 - DNA, 22 bp, Homo sapiens
accctactaaatgtggtatgtc

SEQ ID NO: 24845 - DNA, 22 bp, Homo sapiens
cccagcaggtcggtgctgcctg

SEQ ID NO: 24846 - DNA, 22 bp, Homo sapiens
tggaggctggagtgcagtggcg

SEQ ID NO: 24847 - DNA, 22 bp, Homo sapiens
tactgtgtgcccagccgagctg

SEQ ID NO: 24848 - DNA, 22 bp, Homo sapiens
gggggagagacgagcggctctg

SEQ ID NO: 24849 - DNA, 22 bp, Homo sapiens
ttatagcagcatgatttacaat

SEQ ID NO: 24850 - DNA, 22 bp, Homo sapiens
ctgattgctaacctgttagaat

SEQ ID NO: 24851 - DNA, 23 bp, Homo sapiens
tgagtgtgaaaatcctggagatg

SEQ ID NO: 24852 - DNA, 22 bp, Homo sapiens
ggggccgccagagagagccttg

SEQ ID NO: 24853 - DNA, 22 bp, Homo sapiens
tccagctgaggtggcctctgtg

SEQ ID NO: 24854 - DNA, 22 bp, Homo sapiens
gatgcgggcccgctccactgcc

SEQ ID NO: 24855 - DNA, 22 bp, Homo sapiens
caagggaattgtgtgtgagagg

SEQ ID NO: 24856 - DNA, 22 bp, Homo sapiens
tggtggaattgtaaaatagtgt

SEQ ID NO: 24857 - DNA, 22 bp, Homo sapiens
cggcatccccacttcctcctgc

SEQ ID NO: 24858 - DNA, 22 bp, Homo sapiens
attaagactgcccatgttttta

SEQ ID NO: 24859 - DNA, 22 bp, Homo sapiens
cctagatgggatggcggccggg

SEQ ID NO: 24860 - DNA, 22 bp, Homo sapiens
gcccagtggtaaaagcaggcct

SEQ ID NO: 24861 - DNA, 22 bp, Homo sapiens
ctgctcttcacactacacccgt

SEQ ID NO: 24862 - DNA, 22 bp, Homo sapiens
cctggcactgctgaagtcctgg

SEQ ID NO: 24863 - DNA, 22 bp, Homo sapiens
ctgcatccatgttgctgcaaag

SEQ ID NO: 24864 - DNA, 22 bp, Homo sapiens
tccagaatcaatagcagttatc

SEQ ID NO: 24865 - DNA, 22 bp, Homo sapiens
catctgtctgcatgctctgggt

SEQ ID NO: 24866 - DNA, 22 bp, Homo sapiens
gtcagtgtcttaacagagatta

SEQ ID NO: 24867 - DNA, 22 bp, Homo sapiens
catccaggctgaagtgcagtgg

SEQ ID NO: 24868 - DNA, 22 bp, Homo sapiens
gaaaattattgaaaatggctct

SEQ ID NO: 24869 - DNA, 22 bp, Homo sapiens
tgatcagcatcttcccagctcg

SEQ ID NO: 24870 - DNA, 22 bp, Homo sapiens
aaattgtaatgacttcacttga

SEQ ID NO: 24871 - DNA, 22 bp, Homo sapiens
aggacagagggaccagagccca

SEQ ID NO: 24872 - DNA, 18 bp, Homo sapiens
actctttctgcccacagg

SEQ ID NO: 24873 - DNA, 19 bp, Homo sapiens
ctatctcaaatcttttccc

SEQ ID NO: 24874 - DNA, 22 bp, Homo sapiens
ccaggctggagtgcaatggcgt

SEQ ID NO: 24875 - DNA, 22 bp, Homo sapiens
ttgagcccaggaggcctgggtg

SEQ ID NO: 24876 - DNA, 22 bp, Homo sapiens
ccctgggattcaatttcactct

SEQ ID NO: 24877 - DNA, 23 bp, Homo sapiens
tcggtgggcgtggaggccgaggc

SEQ ID NO: 24878 - DNA, 22 bp, Homo sapiens
tctccccagtatggattctctg

SEQ ID NO: 24879 - DNA, 22 bp, Homo sapiens
tcacatctaattccatttctgc

SEQ ID NO: 24880 - DNA, 22 bp, Homo sapiens
aagggcatgagaagcttgaaag

SEQ ID NO: 24881 - DNA, 22 bp, Homo sapiens
aagtgctgggattataggcatg

SEQ ID NO: 24882 - DNA, 22 bp, Homo sapiens
ccagtgacttgccaggtggatc

SEQ ID NO: 24883 - DNA, 22 bp, Homo sapiens
ccttacactgcctggggccacg

SEQ ID NO: 24884 - DNA, 22 bp, Homo sapiens
aatcagaaattgagggtctggt

SEQ ID NO: 24885 - DNA, 22 bp, Homo sapiens
tgatgtggccccacttagctgt

SEQ ID NO: 24886 - DNA, 22 bp, Homo sapiens
caacatggtaaaaccccgtctc

SEQ ID NO: 24887 - DNA, 18 bp, Homo sapiens
ggctcaagtgatcctcct

SEQ ID NO: 24888 - DNA, 23 bp, Homo sapiens
ctgtggtgaggccctagaatctg

SEQ ID NO: 24889 - DNA, 22 bp, Homo sapiens
atgttctacagatggaaagggg

SEQ ID NO: 24890 - DNA, 22 bp, Homo sapiens
tttttagtagaggtgggtttca

SEQ ID NO: 24891 - DNA, 22 bp, Homo sapiens
tcttggattttaatggatcaaa

SEQ ID NO: 24892 - DNA, 22 bp, Homo sapiens
tccagctgttccatcagctctt

SEQ ID NO: 24893 - DNA, 22 bp, Homo sapiens
tagcagtgtctaggtaggccat

SEQ ID NO: 24894 - DNA, 22 bp, Homo sapiens
ttccggaaggttctctagaatt

SEQ ID NO: 24895 - DNA, 22 bp, Homo sapiens
tgcctgttgcccacctgataaa

SEQ ID NO: 24896 - DNA, 17 bp, Homo sapiens
agtttttggacctgtgt

SEQ ID NO: 24897 - DNA, 22 bp, Homo sapiens
gggatctgggacaacaggtggt

SEQ ID NO: 24898 - DNA, 22 bp, Homo sapiens
aggcttcaggtttgctttgcag

SEQ ID NO: 24899 - DNA, 22 bp, Homo sapiens
tattccagccgcttgagctcgc

SEQ ID NO: 24900 - DNA, 22 bp, Homo sapiens
taactgattcctttttgaaaat

SEQ ID NO: 24901 - DNA, 22 bp, Homo sapiens
atggtcaccttgggagcctgct

SEQ ID NO: 24902 - DNA, 22 bp, Homo sapiens
aatactgcctgtgaggtaactc

SEQ ID NO: 24903 - DNA, 22 bp, Homo sapiens
attgattttcagactatgcgag

SEQ ID NO: 24904 - DNA, 22 bp, Homo sapiens
tgacagtgaacaggttaccact

SEQ ID NO: 24905 - DNA, 22 bp, Homo sapiens
agaccaaagaaaacacatctgg

SEQ ID NO: 24906 - DNA, 22 bp, Homo sapiens
agaaaatgtgaacttgtgaatt

SEQ ID NO: 24907 - DNA, 19 bp, Homo sapiens
caggcctcttaccctctct

SEQ ID NO: 24908 - DNA, 22 bp, Homo sapiens
tttgcatattaatatctgcgct

SEQ ID NO: 24909 - DNA, 22 bp, Homo sapiens
gtgccgctggagctggaattga

SEQ ID NO: 24910 - DNA, 22 bp, Homo sapiens
aaggggtgagcagaggcttcgc

SEQ ID NO: 24911 - DNA, 22 bp, Homo sapiens
tggctgtgtccctgtccagagt

SEQ ID NO: 24912 - DNA, 22 bp, Homo sapiens
aacatacgagcagtttatagag

SEQ ID NO: 24913 - DNA, 22 bp, Homo sapiens
ggctcactgcaacctctgcctc

SEQ ID NO: 24914 - DNA, 22 bp, Homo sapiens
tggaatgcagtgggagcttacc

SEQ ID NO: 24915 - DNA, 22 bp, Homo sapiens
atgctttctcttagttcattga

SEQ ID NO: 24916 - DNA, 22 bp, Homo sapiens
ttctttgaatagatgttcccag

SEQ ID NO: 24917 - DNA, 22 bp, Homo sapiens
acggtgcagcctgtcccttctc

SEQ ID NO: 24918 - DNA, 22 bp, Homo sapiens
caaagcccagaggcctcacttt

SEQ ID NO: 24919 - DNA, 23 bp, Homo sapiens
tactatggttattatccctctcc

SEQ ID NO: 24920 - DNA, 22 bp, Homo sapiens
ccagagctgcaggtaaaatgct

SEQ ID NO: 24921 - DNA, 22 bp, Homo sapiens
ctggcaagaaatatatatctta

SEQ ID NO: 24922 - DNA, 22 bp, Homo sapiens
gtggttttattcgttcctctgt

SEQ ID NO: 24923 - DNA, 23 bp, Homo sapiens
tgctaattggacttgattctgca

SEQ ID NO: 24924 - DNA, 22 bp, Homo sapiens
aaagtgctcggattacaggtat

SEQ ID NO: 24925 - DNA, 22 bp, Homo sapiens
ctctggagtgtctggccagggt

SEQ ID NO: 24926 - DNA, 18 bp, Homo sapiens
tggtcactgtggatagtg

SEQ ID NO: 24927 - DNA, 22 bp, Homo sapiens
ggaggcagaatagagtgtgggt

SEQ ID NO: 24928 - DNA, 22 bp, Homo sapiens
gcggtcggcagaggggctctgc

SEQ ID NO: 24929 - DNA, 23 bp, Homo sapiens
tgcaatggcatgatttcagctca

SEQ ID NO: 24930 - DNA, 22 bp, Homo sapiens
ctatggtctggaccgaggtcct

SEQ ID NO: 24931 - DNA, 21 bp, Homo sapiens
agtggctctcagcttgctaag

SEQ ID NO: 24932 - DNA, 23 bp, Homo sapiens
cagtacaatgtggaaaaggagtg

SEQ ID NO: 24933 - DNA, 22 bp, Homo sapiens
aacccaggagatggaggttgtg

SEQ ID NO: 24934 - DNA, 22 bp, Homo sapiens
gggtgtagaaagaaccctctgg

SEQ ID NO: 24935 - DNA, 20 bp, Homo sapiens
ttggatgtgcatggccgtgc

SEQ ID NO: 24936 - DNA, 22 bp, Homo sapiens
gtgggccagcttttctcctggg

SEQ ID NO: 24937 - DNA, 22 bp, Homo sapiens
ttggaacatgccggggtccagg

SEQ ID NO: 24938 - DNA, 22 bp, Homo sapiens
tcatcttcctcatttctccagg

SEQ ID NO: 24939 - DNA, 22 bp, Homo sapiens
aatatttcttctaaagcccttt

SEQ ID NO: 24940 - DNA, 22 bp, Homo sapiens
tgggcagggagctggaaccaca

SEQ ID NO: 24941 - DNA, 22 bp, Homo sapiens
cacctcaggcagcaaagtctca

SEQ ID NO: 24942 - DNA, 22 bp, Homo sapiens
atagcagggatgtcagcaagta

SEQ ID NO: 24943 - DNA, 22 bp, Homo sapiens
agcttgtagaaggccacgagca

SEQ ID NO: 24944 - DNA, 22 bp, Homo sapiens
cactgaacaacaaatagtgaat

SEQ ID NO: 24945 - DNA, 21 bp, Homo sapiens
ctacttaagtaggggattagg

SEQ ID NO: 24946 - DNA, 22 bp, Homo sapiens
cctgtcacctaggtactgagca

SEQ ID NO: 24947 - DNA, 22 bp, Homo sapiens
actgcactccatcctgggcaac

SEQ ID NO: 24948 - DNA, 19 bp, Homo sapiens
ggagccgccgcccttcatt

SEQ ID NO: 24949 - DNA, 20 bp, Homo sapiens
tttgcgaggccaaggcgggc

SEQ ID NO: 24950 - DNA, 22 bp, Homo sapiens
aacatatcatttaaccctcacc

SEQ ID NO: 24951 - DNA, 22 bp, Homo sapiens
ctccgggtagctgaggccctgg

SEQ ID NO: 24952 - DNA, 17 bp, Homo sapiens
ccctcactcctgccggg

SEQ ID NO: 24953 - DNA, 22 bp, Homo sapiens
ctgctttagacggctttcgctg

SEQ ID NO: 24954 - DNA, 22 bp, Homo sapiens
gagtgtgtcggtcagcgtggcg

SEQ ID NO: 24955 - DNA, 22 bp, Homo sapiens
tctaatccttgctacctgggtg

SEQ ID NO: 24956 - DNA, 22 bp, Homo sapiens
ggtgtccgcgctgtagaaggtc

SEQ ID NO: 24957 - DNA, 22 bp, Homo sapiens
ctgtaatcccagctactcggga

SEQ ID NO: 24958 - DNA, 22 bp, Homo sapiens
cgtgattggcttctgcattgga

SEQ ID NO: 24959 - DNA, 22 bp, Homo sapiens
gcttaattctggctcagtttcc

SEQ ID NO: 24960 - DNA, 22 bp, Homo sapiens
ttctcaagaacatatgtagggt

SEQ ID NO: 24961 - DNA, 20 bp, Homo sapiens
ctgccgaccacagccatgga

SEQ ID NO: 24962 - DNA, 22 bp, Homo sapiens
gttgccatctgagaagagcagc

SEQ ID NO: 24963 - DNA, 22 bp, Homo sapiens
ccctggaggttgaggctgcagt

SEQ ID NO: 24964 - DNA, 21 bp, Homo sapiens
cctgtggtgccagatcgccag

SEQ ID NO: 24965 - DNA, 22 bp, Homo sapiens
ggccctggtcctaggggtggaa

SEQ ID NO: 24966 - DNA, 22 bp, Homo sapiens
cagggggctcaaaggagagtgc

SEQ ID NO: 24967 - DNA, 22 bp, Homo sapiens
agaatacttgggaatgggttaa

SEQ ID NO: 24968 - DNA, 22 bp, Homo sapiens
agtggagacaggacagtcgata

SEQ ID NO: 24969 - DNA, 21 bp, Homo sapiens
gctcctggtgctgcgtggcgc

SEQ ID NO: 24970 - DNA, 22 bp, Homo sapiens
cagtagatttggtaaactagga

SEQ ID NO: 24971 - DNA, 22 bp, Homo sapiens
cgagagatgggttggcaggggc

SEQ ID NO: 24972 - DNA, 18 bp, Homo sapiens
catgggtgacaggtggat

SEQ ID NO: 24973 - DNA, 22 bp, Homo sapiens
agcccggcttccccggttgcta

SEQ ID NO: 24974 - DNA, 22 bp, Homo sapiens
atgccccagtgtgtgcttcctt

SEQ ID NO: 24975 - DNA, 22 bp, Homo sapiens
cactgcactccagcactccagc

SEQ ID NO: 24976 - DNA, 22 bp, Homo sapiens
aagtcagacagctgagctgcct

SEQ ID NO: 24977 - DNA, 22 bp, Homo sapiens
tgtccagatcaatgcccacatg

SEQ ID NO: 24978 - DNA, 18 bp, Homo sapiens
ccctgccagctcccagca

SEQ ID NO: 24979 - DNA, 22 bp, Homo sapiens
tgggggctgggatgtcactttc

SEQ ID NO: 24980 - DNA, 22 bp, Homo sapiens
tgacacccatctgtgccagtcc

SEQ ID NO: 24981 - DNA, 23 bp, Homo sapiens
catctagcatccagtgagtagtg

SEQ ID NO: 24982 - DNA, 22 bp, Homo sapiens
gtacagaggttgctggaggctc

SEQ ID NO: 24983 - DNA, 22 bp, Homo sapiens
tttcttaggctctaaaatgact

SEQ ID NO: 24984 - DNA, 22 bp, Homo sapiens
ctggcctggcgcagtggctcac

SEQ ID NO: 24985 - DNA, 22 bp, Homo sapiens
tctttcttgtgggtgccctttt

SEQ ID NO: 24986 - DNA, 22 bp, Homo sapiens
ggagtgtcccgattttccaggt

SEQ ID NO: 24987 - DNA, 22 bp, Homo sapiens
caacccaaggttagttggtctt

SEQ ID NO: 24988 - DNA, 22 bp, Homo sapiens
gggagagtagctggaaggttct

SEQ ID NO: 24989 - DNA, 22 bp, Homo sapiens
cggccaggcacagtggcccacg

SEQ ID NO: 24990 - DNA, 23 bp, Homo sapiens
cgtcttgtcctcgggcgcctggg

SEQ ID NO: 24991 - DNA, 22 bp, Homo sapiens
gtgtaagtatctttgtatcttt

SEQ ID NO: 24992 - DNA, 22 bp, Homo sapiens
caggcgggcaggtgcggcccct

SEQ ID NO: 24993 - DNA, 22 bp, Homo sapiens
atggggaagcaattggatttcc

SEQ ID NO: 24994 - DNA, 22 bp, Homo sapiens
gctggagaggatcccaaagcca

SEQ ID NO: 24995 - DNA, 22 bp, Homo sapiens
gccagatttacagatttgccct

SEQ ID NO: 24996 - DNA, 22 bp, Homo sapiens
cctggggtcacttgcagccgca

SEQ ID NO: 24997 - DNA, 20 bp, Homo sapiens
aggggcacctgcgacggggc

SEQ ID NO: 24998 - DNA, 19 bp, Homo sapiens
agcggttctcaaagtcagg

SEQ ID NO: 24999 - DNA, 22 bp, Homo sapiens
attcttcctcatcaatctgtag

SEQ ID NO: 25000 - DNA, 22 bp, Homo sapiens
gaattttattactagtcaactg

SEQ ID NO: 25001 - DNA, 22 bp, Homo sapiens
aggagggtgggaagcagtttta

SEQ ID NO: 25002 - DNA, 22 bp, Homo sapiens
gagaaagctaaataagttgatt

SEQ ID NO: 25003 - DNA, 22 bp, Homo sapiens
ttgcactccagcccgagcaaca

SEQ ID NO: 25004 - DNA, 22 bp, Homo sapiens
tggaagaatatgggggtacaga

SEQ ID NO: 25005 - DNA, 22 bp, Homo sapiens
tcccaccttccgtggaacccgt

SEQ ID NO: 25006 - DNA, 22 bp, Homo sapiens
tggtatgtaaattgtaactcaa

SEQ ID NO: 25007 - DNA, 22 bp, Homo sapiens
tagatgaccttgtgttaggcaa

SEQ ID NO: 25008 - DNA, 22 bp, Homo sapiens
caaagtaattacggttttggcc

SEQ ID NO: 25009 - DNA, 22 bp, Homo sapiens
gcagacgtcaccgagtcgatgg

SEQ ID NO: 25010 - DNA, 22 bp, Homo sapiens
gtggggcctgtggcttccgtgg

SEQ ID NO: 25011 - DNA, 22 bp, Homo sapiens
tgagatggagccactgcactct

SEQ ID NO: 25012 - DNA, 22 bp, Homo sapiens
tggaaacacccacgcatgcata

SEQ ID NO: 25013 - DNA, 22 bp, Homo sapiens
aggctcccaagcactgacccca

SEQ ID NO: 25014 - DNA, 22 bp, Homo sapiens
gagtgcagtggcgtgatctctg

SEQ ID NO: 25015 - DNA, 22 bp, Homo sapiens
ggtcactttaccccttggagcc

SEQ ID NO: 25016 - DNA, 22 bp, Homo sapiens
ttaatgaaaggcagtttggaac

SEQ ID NO: 25017 - DNA, 17 bp, Homo sapiens
tactgaggggtctggag

SEQ ID NO: 25018 - DNA, 22 bp, Homo sapiens
cccaggatggggctgcagttat

SEQ ID NO: 25019 - DNA, 23 bp, Homo sapiens
catcatgcaatcttgggatttct

SEQ ID NO: 25020 - DNA, 22 bp, Homo sapiens
tggggatcataaattgatggag

SEQ ID NO: 25021 - DNA, 22 bp, Homo sapiens
gcccagcccagaaaggttcgga

SEQ ID NO: 25022 - DNA, 22 bp, Homo sapiens
tgtgcggggaagggctcactca

SEQ ID NO: 25023 - DNA, 22 bp, Homo sapiens
tcctgggtccatggcagccgaa

SEQ ID NO: 25024 - DNA, 22 bp, Homo sapiens
agtgagtttagggtgcaggtgt

SEQ ID NO: 25025 - DNA, 22 bp, Homo sapiens
tggcatttgagctggaaggatg

SEQ ID NO: 25026 - DNA, 22 bp, Homo sapiens
agctttacctgccttggggcac

SEQ ID NO: 25027 - DNA, 22 bp, Homo sapiens
ggcaagaaccacaattactttt

SEQ ID NO: 25028 - DNA, 22 bp, Homo sapiens
tgtgttccagagcatccaggtc

SEQ ID NO: 25029 - DNA, 23 bp, Homo sapiens
ccactagcacctgttcaacttct

SEQ ID NO: 25030 - DNA, 22 bp, Homo sapiens
agccagggacgctgcaggctac

SEQ ID NO: 25031 - DNA, 22 bp, Homo sapiens
tatgaggtaggtattatactta

SEQ ID NO: 25032 - DNA, 22 bp, Homo sapiens
tgatatgtaactactccttata

SEQ ID NO: 25033 - DNA, 18 bp, Homo sapiens
cccggctaatttttggta

SEQ ID NO: 25034 - DNA, 22 bp, Homo sapiens
ggtcacgtgaccgcacctgcct

SEQ ID NO: 25035 - DNA, 20 bp, Homo sapiens
tgtccccaccaaaatttcat

SEQ ID NO: 25036 - DNA, 22 bp, Homo sapiens
ttccagttcactccatttctgg

SEQ ID NO: 25037 - DNA, 22 bp, Homo sapiens
tcttggccactaccacctggag

SEQ ID NO: 25038 - DNA, 22 bp, Homo sapiens
agtgactggtgtgaagttaaat

SEQ ID NO: 25039 - DNA, 22 bp, Homo sapiens
cctcccctcagacagagactgg

SEQ ID NO: 25040 - DNA, 22 bp, Homo sapiens
gttgcagatgtggaactcgtgc

SEQ ID NO: 25041 - DNA, 22 bp, Homo sapiens
tgtttctgtatgatcaatattg

SEQ ID NO: 25042 - DNA, 22 bp, Homo sapiens
aaggaggcctggcagatgaaga

SEQ ID NO: 25043 - DNA, 22 bp, Homo sapiens
tacctcaagttccaggaaagcg

SEQ ID NO: 25044 - DNA, 22 bp, Homo sapiens
tgttgctgtatgaataggaagg

SEQ ID NO: 25045 - DNA, 22 bp, Homo sapiens
cagctgctgttcagttttgttt

SEQ ID NO: 25046 - DNA, 22 bp, Homo sapiens
cccaaaggttgaggctgcagtg

SEQ ID NO: 25047 - DNA, 22 bp, Homo sapiens
cagatgtcatttcccatgcagc

SEQ ID NO: 25048 - DNA, 22 bp, Homo sapiens
atttcctgtaggggcttgcgaa

SEQ ID NO: 25049 - DNA, 22 bp, Homo sapiens
acccggagtcggaggttgcagt

SEQ ID NO: 25050 - DNA, 17 bp, Homo sapiens
gagattttcgtcctgaa

SEQ ID NO: 25051 - DNA, 16 bp, Homo sapiens
gcagaggaaaggggag

SEQ ID NO: 25052 - DNA, 22 bp, Homo sapiens
ttctcttacattttctcagcct

SEQ ID NO: 25053 - DNA, 22 bp, Homo sapiens
ttctgtggttgaaaggagagat

SEQ ID NO: 25054 - DNA, 22 bp, Homo sapiens
atacttctttagcatattgaac

SEQ ID NO: 25055 - DNA, 22 bp, Homo sapiens
agtcttagaactacagtgccta

SEQ ID NO: 25056 - DNA, 22 bp, Homo sapiens
ccaaagtgctaggattacaggt

SEQ ID NO: 25057 - DNA, 22 bp, Homo sapiens
attaagtgactaaagtaatgct

SEQ ID NO: 25058 - DNA, 22 bp, Homo sapiens
tcttccagatggttctttagct

SEQ ID NO: 25059 - DNA, 22 bp, Homo sapiens
tatccaattcaccattgatggg

SEQ ID NO: 25060 - DNA, 22 bp, Homo sapiens
gtcccctgtccagggccagcca

SEQ ID NO: 25061 - DNA, 22 bp, Homo sapiens
caggtgcctcaggatgagacaa

SEQ ID NO: 25062 - DNA, 22 bp, Homo sapiens
acactgcagatgaaagcataag

SEQ ID NO: 25063 - DNA, 22 bp, Homo sapiens
cttccgtgtcagttccaggtgg

SEQ ID NO: 25064 - DNA, 19 bp, Homo sapiens
gatttaaacgtggctctat

SEQ ID NO: 25065 - DNA, 22 bp, Homo sapiens
ttgcatagtgctgaggttcggg

SEQ ID NO: 25066 - DNA, 22 bp, Homo sapiens
gttcacagtttctaatcccagc

SEQ ID NO: 25067 - DNA, 22 bp, Homo sapiens
gaagagtggttatccctgctgt

SEQ ID NO: 25068 - DNA, 22 bp, Homo sapiens
gagccagactgcctgaagctca

SEQ ID NO: 25069 - DNA, 22 bp, Homo sapiens
caccctccagctcccgggggct

SEQ ID NO: 25070 - DNA, 22 bp, Homo sapiens
ctgatattctattttgcttgct

SEQ ID NO: 25071 - DNA, 22 bp, Homo sapiens
gcagcctcaaactccccagctc

SEQ ID NO: 25072 - DNA, 23 bp, Homo sapiens
agcaatctgtgtttcagcaagcc

SEQ ID NO: 25073 - DNA, 22 bp, Homo sapiens
cttctttcaagaatggattagg

SEQ ID NO: 25074 - DNA, 22 bp, Homo sapiens
tctagcaagctcgtgctcaagg

SEQ ID NO: 25075 - DNA, 21 bp, Homo sapiens
tagcccttctccacctcgccc

SEQ ID NO: 25076 - DNA, 22 bp, Homo sapiens
tgggtggcagcttcagcatgtt

SEQ ID NO: 25077 - DNA, 22 bp, Homo sapiens
cggagtcttgctatgttgccca

SEQ ID NO: 25078 - DNA, 22 bp, Homo sapiens
gggctctcccacaacgtgccag

SEQ ID NO: 25079 - DNA, 22 bp, Homo sapiens
ctagggtgtgcagattttgcct

SEQ ID NO: 25080 - DNA, 22 bp, Homo sapiens
ttgaagactaatttagataatg

SEQ ID NO: 25081 - DNA, 22 bp, Homo sapiens
cttggggaagccactgatccct

SEQ ID NO: 25082 - DNA, 22 bp, Homo sapiens
gttgcctaggctggagtgcagt

SEQ ID NO: 25083 - DNA, 19 bp, Homo sapiens
gccatcccaagcattttgg

SEQ ID NO: 25084 - DNA, 22 bp, Homo sapiens
gagatggagtctcactctgtca

SEQ ID NO: 25085 - DNA, 22 bp, Homo sapiens
agcaggagtttgatgcttttat

SEQ ID NO: 25086 - DNA, 22 bp, Homo sapiens
tctaccctgcggtcttggggca

SEQ ID NO: 25087 - DNA, 22 bp, Homo sapiens
ctgcgggctgtcaggcgtgcca

SEQ ID NO: 25088 - DNA, 22 bp, Homo sapiens
ggtgctggacacgtggcactcc

SEQ ID NO: 25089 - DNA, 22 bp, Homo sapiens
tggcactgaagctggaaagcct

SEQ ID NO: 25090 - DNA, 22 bp, Homo sapiens
gggtccctggaattacttgaca

SEQ ID NO: 25091 - DNA, 22 bp, Homo sapiens
gctgcagctgtaggacacaatt

SEQ ID NO: 25092 - DNA, 22 bp, Homo sapiens
ctccagttggccccagttggtt

SEQ ID NO: 25093 - DNA, 22 bp, Homo sapiens
catggcattgcataacggggct

SEQ ID NO: 25094 - DNA, 22 bp, Homo sapiens
gagcaggaaggccagaagggtc

SEQ ID NO: 25095 - DNA, 22 bp, Homo sapiens
tctgttgcaatgtgcatggtga

SEQ ID NO: 25096 - DNA, 20 bp, Homo sapiens
gtgcaatggctcagtctcag

SEQ ID NO: 25097 - DNA, 22 bp, Homo sapiens
aacccaggagacaggttgcagt

SEQ ID NO: 25098 - DNA, 22 bp, Homo sapiens
tgtctattcccccacctccgtt

SEQ ID NO: 25099 - DNA, 22 bp, Homo sapiens
ttgtatagcccagagagtgaga

SEQ ID NO: 25100 - DNA, 22 bp, Homo sapiens
acactccagggagggagggaat

SEQ ID NO: 25101 - DNA, 22 bp, Homo sapiens
cattgcaacttcaaactcctgg

SEQ ID NO: 25102 - DNA, 22 bp, Homo sapiens
aaagaggcaatcaatgtagcaa

SEQ ID NO: 25103 - DNA, 22 bp, Homo sapiens
gagatggagtctttttctgtca

SEQ ID NO: 25104 - DNA, 22 bp, Homo sapiens
tggctcatgcctgtaatcttag

SEQ ID NO: 25105 - DNA, 22 bp, Homo sapiens
tcagagtctgtgcattctgcta

SEQ ID NO: 25106 - DNA, 22 bp, Homo sapiens
aaatatcttaggagtatatgag

SEQ ID NO: 25107 - DNA, 22 bp, Homo sapiens
gctcgaccgccagaaacttcct

SEQ ID NO: 25108 - DNA, 22 bp, Homo sapiens
gctactgattgaccttggagag

SEQ ID NO: 25109 - DNA, 22 bp, Homo sapiens
cccaggagttggaggctgcagt

SEQ ID NO: 25110 - DNA, 22 bp, Homo sapiens
ttggacgctcctaagaccaagc

SEQ ID NO: 25111 - DNA, 20 bp, Homo sapiens
ttcaggaataagatagcagc

SEQ ID NO: 25112 - DNA, 22 bp, Homo sapiens
acaaacagagttgaaaaatagg

SEQ ID NO: 25113 - DNA, 22 bp, Homo sapiens
agagtgtaccaaatatcctaca

SEQ ID NO: 25114 - DNA, 22 bp, Homo sapiens
ctagttgaagaggctgtcatca

SEQ ID NO: 25115 - DNA, 22 bp, Homo sapiens
acatttatataactcactagga

SEQ ID NO: 25116 - DNA, 23 bp, Homo sapiens
caccccaccctgaggaggaggga

SEQ ID NO: 25117 - DNA, 22 bp, Homo sapiens
gacagtgaacaggttcccactg

SEQ ID NO: 25118 - DNA, 22 bp, Homo sapiens
agcgggctcacccggttgttgt

SEQ ID NO: 25119 - DNA, 22 bp, Homo sapiens
tcagcctgctccaagtgctgcc

SEQ ID NO: 25120 - DNA, 19 bp, Homo sapiens
gcccacggccctgctctgc

SEQ ID NO: 25121 - DNA, 22 bp, Homo sapiens
ccgggaggctaaggttgcagtg

SEQ ID NO: 25122 - DNA, 22 bp, Homo sapiens
tggcagttcaggttggactctt

SEQ ID NO: 25123 - DNA, 22 bp, Homo sapiens
tgttatctgagcaacgtcgacg

SEQ ID NO: 25124 - DNA, 22 bp, Homo sapiens
ggcatcgtcctgggcataggga

SEQ ID NO: 25125 - DNA, 22 bp, Homo sapiens
gagccaggttggaggctgcagt

SEQ ID NO: 25126 - DNA, 22 bp, Homo sapiens
tcacaatatttatcttccaatt

SEQ ID NO: 25127 - DNA, 22 bp, Homo sapiens
ccacagtctatgcaacaaggtc

SEQ ID NO: 25128 - DNA, 22 bp, Homo sapiens
tcctgccttgcctgggacatca

SEQ ID NO: 25129 - DNA, 22 bp, Homo sapiens
ctctttggatagaattacaaag

SEQ ID NO: 25130 - DNA, 22 bp, Homo sapiens
tagtggatgggtaaagtatttt

SEQ ID NO: 25131 - DNA, 22 bp, Homo sapiens
gggcttcagttctgaccatctt

SEQ ID NO: 25132 - DNA, 22 bp, Homo sapiens
atttcagcagcccatgtttgga

SEQ ID NO: 25133 - DNA, 22 bp, Homo sapiens
ggcatctggatctgcttctccc

SEQ ID NO: 25134 - DNA, 22 bp, Homo sapiens
tcgcccagctcatctcccacaa

SEQ ID NO: 25135 - DNA, 22 bp, Homo sapiens
cgtgaggggggtaaggcgtccg

SEQ ID NO: 25136 - DNA, 23 bp, Homo sapiens
ggcctcagtgatgatgggttaaa

SEQ ID NO: 25137 - DNA, 22 bp, Homo sapiens
aggtcctcgtcgtgctgggcca

SEQ ID NO: 25138 - DNA, 22 bp, Homo sapiens
tttattggatatttacaagata

SEQ ID NO: 25139 - DNA, 22 bp, Homo sapiens
ttcagacaggcagctgggctgg

SEQ ID NO: 25140 - DNA, 22 bp, Homo sapiens
tcccacaggtggagcttgcagt

SEQ ID NO: 25141 - DNA, 18 bp, Homo sapiens
ccatcaccctaactagtg

SEQ ID NO: 25142 - DNA, 17 bp, Homo sapiens
tccttcagtgcctctgc

SEQ ID NO: 25143 - DNA, 22 bp, Homo sapiens
gggtaggccgtgggtcaccagg

SEQ ID NO: 25144 - DNA, 22 bp, Homo sapiens
cttccccaggacctctgctaaa

SEQ ID NO: 25145 - DNA, 22 bp, Homo sapiens
tcagaacatgtttgagtaagac

SEQ ID NO: 25146 - DNA, 22 bp, Homo sapiens
gcctcctgtcccaggctgagga

SEQ ID NO: 25147 - DNA, 22 bp, Homo sapiens
gaccttgtgatccacctgcctt

SEQ ID NO: 25148 - DNA, 22 bp, Homo sapiens
gatttttatataaagtgagaaa

SEQ ID NO: 25149 - DNA, 22 bp, Homo sapiens
agtgccctttacaacttcttga

SEQ ID NO: 25150 - DNA, 22 bp, Homo sapiens
attgcactccagcctgggtgac

SEQ ID NO: 25151 - DNA, 22 bp, Homo sapiens
gcagaagcacaggtgacgggcc

SEQ ID NO: 25152 - DNA, 22 bp, Homo sapiens
tgtagtagcattcacgaagtgt

SEQ ID NO: 25153 - DNA, 22 bp, Homo sapiens
ctgggctagaaggaccaggatg

SEQ ID NO: 25154 - DNA, 22 bp, Homo sapiens
gtatagaaacccagaaagatag

SEQ ID NO: 25155 - DNA, 21 bp, Homo sapiens
gtgcggatgccgtcattgtca

SEQ ID NO: 25156 - DNA, 22 bp, Homo sapiens
ttcaaagcagagggtcaataca

SEQ ID NO: 25157 - DNA, 22 bp, Homo sapiens
gtgcaaacatcatagagtgtac

SEQ ID NO: 25158 - DNA, 22 bp, Homo sapiens
aagcatgaatcgactcggcaac

SEQ ID NO: 25159 - DNA, 22 bp, Homo sapiens
gggaggcagtgctggaggctgg

SEQ ID NO: 25160 - DNA, 22 bp, Homo sapiens
tatcactacacctggctaatta

SEQ ID NO: 25161 - DNA, 22 bp, Homo sapiens
ggggccttggatctgtgccccg

SEQ ID NO: 25162 - DNA, 22 bp, Homo sapiens
catccagtgggacagagaaacc

SEQ ID NO: 25163 - DNA, 22 bp, Homo sapiens
actgggccaggtgtgggtgagt

SEQ ID NO: 25164 - DNA, 22 bp, Homo sapiens
ggctgggcctctccctcagctg

SEQ ID NO: 25165 - DNA, 22 bp, Homo sapiens
gaccatcctggccaacgtggta

SEQ ID NO: 25166 - DNA, 19 bp, Homo sapiens
tcttgggtcgagacataga

SEQ ID NO: 25167 - DNA, 22 bp, Homo sapiens
acatggcaaaaccccgtttcta

SEQ ID NO: 25168 - DNA, 22 bp, Homo sapiens
ggggcagagaataaaaacctaa

SEQ ID NO: 25169 - DNA, 22 bp, Homo sapiens
tgagtgactccactggggcaga

SEQ ID NO: 25170 - DNA, 22 bp, Homo sapiens
aggaaataggaccagacaaagc

SEQ ID NO: 25171 - DNA, 22 bp, Homo sapiens
ctcactgcaagctccacctctt

SEQ ID NO: 25172 - DNA, 22 bp, Homo sapiens
attgctaggaacaggttgcacc

SEQ ID NO: 25173 - DNA, 22 bp, Homo sapiens
ggggttaacagtattgctcatg

SEQ ID NO: 25174 - DNA, 22 bp, Homo sapiens
ttaagtaacttgtccaaatgag

SEQ ID NO: 25175 - DNA, 22 bp, Homo sapiens
actttcttggtcccatgtttga

SEQ ID NO: 25176 - DNA, 22 bp, Homo sapiens
agttggcactgagctgtgattg

SEQ ID NO: 25177 - DNA, 22 bp, Homo sapiens
agttgttcgtggtggattcgct

SEQ ID NO: 25178 - DNA, 22 bp, Homo sapiens
gtgcagagaggaccttggggag

SEQ ID NO: 25179 - DNA, 22 bp, Homo sapiens
tttacaacccaagtccagagag

SEQ ID NO: 25180 - DNA, 22 bp, Homo sapiens
gccagggttcgaatccgtatgg

SEQ ID NO: 25181 - DNA, 22 bp, Homo sapiens
ctgcactgacttccccggctgc

SEQ ID NO: 25182 - DNA, 22 bp, Homo sapiens
ttcaggaagtgctgcctggtgt

SEQ ID NO: 25183 - DNA, 22 bp, Homo sapiens
tgtggcacatacacaggagggc

SEQ ID NO: 25184 - DNA, 22 bp, Homo sapiens
aagggaatgttgtggctggttt

SEQ ID NO: 25185 - DNA, 22 bp, Homo sapiens
actgcactccagcctgggtgat

SEQ ID NO: 25186 - DNA, 17 bp, Homo sapiens
ctggagcagacaaaagg

SEQ ID NO: 25187 - DNA, 22 bp, Homo sapiens
gtctgctcgctgctcagccctg

SEQ ID NO: 25188 - DNA, 22 bp, Homo sapiens
tagggtacatgtgcacaacatg

SEQ ID NO: 25189 - DNA, 22 bp, Homo sapiens
ttggccttagcttcttcttaaa

SEQ ID NO: 25190 - DNA, 22 bp, Homo sapiens
ggggaaagccagccctgcttcc

SEQ ID NO: 25191 - DNA, 22 bp, Homo sapiens
gggacaatggaggcctctctcc

SEQ ID NO: 25192 - DNA, 20 bp, Homo sapiens
gggtgtgtgcagggcctggt

SEQ ID NO: 25193 - DNA, 22 bp, Homo sapiens
tctcgatctcctgaccttgtga

SEQ ID NO: 25194 - DNA, 22 bp, Homo sapiens
aaacttttttaggttcataggc

SEQ ID NO: 25195 - DNA, 22 bp, Homo sapiens
ctgtggttggagtgcagtgaga

SEQ ID NO: 25196 - DNA, 22 bp, Homo sapiens
gaatttaagaggatgaatctgt

SEQ ID NO: 25197 - DNA, 21 bp, Homo sapiens
tggtaggtactggcttcaggc

SEQ ID NO: 25198 - DNA, 22 bp, Homo sapiens
tctttgctccacactctagaga

SEQ ID NO: 25199 - DNA, 22 bp, Homo sapiens
ttgtgaaacattcatggatttg

SEQ ID NO: 25200 - DNA, 20 bp, Homo sapiens
agcagagtgcccatcccgga

SEQ ID NO: 25201 - DNA, 22 bp, Homo sapiens
cacctgccaaatggggatgctg

SEQ ID NO: 25202 - DNA, 22 bp, Homo sapiens
caattgacaatgacagtgtcaa

SEQ ID NO: 25203 - DNA, 22 bp, Homo sapiens
aagaagcaggtcacagacaggg

SEQ ID NO: 25204 - DNA, 21 bp, Homo sapiens
aaactgaccttgcctgagaca

SEQ ID NO: 25205 - DNA, 22 bp, Homo sapiens
gaatgctacttgactcagctca

SEQ ID NO: 25206 - DNA, 22 bp, Homo sapiens
tcgggggcttgaggatcaaatg

SEQ ID NO: 25207 - DNA, 22 bp, Homo sapiens
gaggacaagctgtgagtggggt

SEQ ID NO: 25208 - DNA, 22 bp, Homo sapiens
caggctgtccaggctcctttgg

SEQ ID NO: 25209 - DNA, 22 bp, Homo sapiens
ggacaattcagtgatttgggga

SEQ ID NO: 25210 - DNA, 22 bp, Homo sapiens
ccagaagcagagcctgaggcag

SEQ ID NO: 25211 - DNA, 21 bp, Homo sapiens
ggtgtgggatggactgaacca

SEQ ID NO: 25212 - DNA, 22 bp, Homo sapiens
tgtctattaattccacataaaa

SEQ ID NO: 25213 - DNA, 22 bp, Homo sapiens
atgaagcgttcgagataggtag

SEQ ID NO: 25214 - DNA, 22 bp, Homo sapiens
agcatttatcttttgtttgagt

SEQ ID NO: 25215 - DNA, 22 bp, Homo sapiens
ttcagcttgctgactgcggcag

SEQ ID NO: 25216 - DNA, 22 bp, Homo sapiens
ctctgtggtggagtgggtcacc

SEQ ID NO: 25217 - DNA, 22 bp, Homo sapiens
caggaacagggtgtcctggcag

SEQ ID NO: 25218 - DNA, 22 bp, Homo sapiens
gatgcacggtcatgtcttttca

SEQ ID NO: 25219 - DNA, 22 bp, Homo sapiens
ctgcaccgtgtctcgggctgcc

SEQ ID NO: 25220 - DNA, 22 bp, Homo sapiens
ttgtgcttgccctggaggtgcg

SEQ ID NO: 25221 - DNA, 22 bp, Homo sapiens
ttagatttacaagcactgttta

SEQ ID NO: 25222 - DNA, 22 bp, Homo sapiens
tgcacgtgggctctctgctctt

SEQ ID NO: 25223 - DNA, 22 bp, Homo sapiens
tggacaacatagtgagacctca

SEQ ID NO: 25224 - DNA, 22 bp, Homo sapiens
gaacccggggaggttgcagtga

SEQ ID NO: 25225 - DNA, 22 bp, Homo sapiens
cagcagcagtggctgcagaaca

SEQ ID NO: 25226 - DNA, 22 bp, Homo sapiens
agcagcagtatccttccccggc

SEQ ID NO: 25227 - DNA, 22 bp, Homo sapiens
ggcaggactgatcagtgggatg

SEQ ID NO: 25228 - DNA, 22 bp, Homo sapiens
gaggtgatggttgcacaatgct

SEQ ID NO: 25229 - DNA, 22 bp, Homo sapiens
actgcactccagcctgggcaac

SEQ ID NO: 25230 - DNA, 22 bp, Homo sapiens
ctgatcctcctttaagtagctg

SEQ ID NO: 25231 - DNA, 23 bp, Homo sapiens
gcagaggagcaagctggacacca

SEQ ID NO: 25232 - DNA, 22 bp, Homo sapiens
gccttgagctgcacggccaggt

SEQ ID NO: 25233 - DNA, 23 bp, Homo sapiens
agtgggctcagtcctccaacccc

SEQ ID NO: 25234 - DNA, 22 bp, Homo sapiens
ctgctttgcatagctgccagag

SEQ ID NO: 25235 - DNA, 22 bp, Homo sapiens
aaagtgctgcgacatttgagcg

SEQ ID NO: 25236 - DNA, 22 bp, Homo sapiens
gcttccggagccaaaaggcccc

SEQ ID NO: 25237 - DNA, 22 bp, Homo sapiens
ggtgacgaatccatagcatcga

SEQ ID NO: 25238 - DNA, 22 bp, Homo sapiens
gtagctctgtttaaagttcttt

SEQ ID NO: 25239 - DNA, 22 bp, Homo sapiens
ctggctggagtgcaggtgagtg

SEQ ID NO: 25240 - DNA, 22 bp, Homo sapiens
cagccacttgtgatgctgggga

SEQ ID NO: 25241 - DNA, 22 bp, Homo sapiens
attgtgaatagtgccgcagtaa

SEQ ID NO: 25242 - DNA, 22 bp, Homo sapiens
aggccagcctgcccaaagctgc

SEQ ID NO: 25243 - DNA, 22 bp, Homo sapiens
ttgcttctcagggcctgatgca

SEQ ID NO: 25244 - DNA, 22 bp, Homo sapiens
caggcttgtgactattccaaag

SEQ ID NO: 25245 - DNA, 22 bp, Homo sapiens
ggcttcagtggccagagatgat

SEQ ID NO: 25246 - DNA, 22 bp, Homo sapiens
ggctcctgggggtgctcctgcc

SEQ ID NO: 25247 - DNA, 22 bp, Homo sapiens
cctgctggctctgttgctcggc

SEQ ID NO: 25248 - DNA, 22 bp, Homo sapiens
gtctcctccctttcattcacct

SEQ ID NO: 25249 - DNA, 22 bp, Homo sapiens
atgcaggcagacactgtgggca

SEQ ID NO: 25250 - DNA, 22 bp, Homo sapiens
tattgagaccagtgcttgctta

SEQ ID NO: 25251 - DNA, 22 bp, Homo sapiens
tccacaggtccggcatgaacag

SEQ ID NO: 25252 - DNA, 22 bp, Homo sapiens
tagagatggggtcttgctatga

SEQ ID NO: 25253 - DNA, 22 bp, Homo sapiens
ccgcgaggtggaggttgcagtg

SEQ ID NO: 25254 - DNA, 22 bp, Homo sapiens
gccccagcctcccgagtagctg

SEQ ID NO: 25255 - DNA, 22 bp, Homo sapiens
ttttggttgttgggtaagagta

SEQ ID NO: 25256 - DNA, 22 bp, Homo sapiens
cttgtctgctataaaaatccag

SEQ ID NO: 25257 - DNA, 22 bp, Homo sapiens
agtctagtaggatctctgggct

SEQ ID NO: 25258 - DNA, 22 bp, Homo sapiens
ttttcagaattagcataccatt

SEQ ID NO: 25259 - DNA, 22 bp, Homo sapiens
tgcgcatgcgtggctctccggc

SEQ ID NO: 25260 - DNA, 22 bp, Homo sapiens
tatttcacatctatgaagtgag

SEQ ID NO: 25261 - DNA, 22 bp, Homo sapiens
acccaagttttccatgcctgtt

SEQ ID NO: 25262 - DNA, 22 bp, Homo sapiens
tttaatcataagaaggaaaata

SEQ ID NO: 25263 - DNA, 22 bp, Homo sapiens
gctgagactgacatgaagaggt

SEQ ID NO: 25264 - DNA, 22 bp, Homo sapiens
gatatcattgagcccaggagtt

SEQ ID NO: 25265 - DNA, 22 bp, Homo sapiens
aaagtaattgtggttcttgcca

SEQ ID NO: 25266 - DNA, 22 bp, Homo sapiens
atggtgtttataggcaaagatc

SEQ ID NO: 25267 - DNA, 22 bp, Homo sapiens
agatttctgggcttcaccacct

SEQ ID NO: 25268 - DNA, 22 bp, Homo sapiens
gaggtagacttcttggaagtag

SEQ ID NO: 25269 - DNA, 22 bp, Homo sapiens
gggtcgggcaggcgccctcgtc

SEQ ID NO: 25270 - DNA, 22 bp, Homo sapiens
atttttctctttccactgagat

SEQ ID NO: 25271 - DNA, 23 bp, Homo sapiens
tatgaactgcattgctggtgtgt

SEQ ID NO: 25272 - DNA, 22 bp, Homo sapiens
tgtgtcagaaggcaatggggat

SEQ ID NO: 25273 - DNA, 22 bp, Homo sapiens
gggggtttctgggctgagcaga

SEQ ID NO: 25274 - DNA, 22 bp, Homo sapiens
tcctgcagctgataaatacagt

SEQ ID NO: 25275 - DNA, 22 bp, Homo sapiens
cccagtttcaactttccagtgg

SEQ ID NO: 25276 - DNA, 22 bp, Homo sapiens
aggtggggaggagtgtctcttt

SEQ ID NO: 25277 - DNA, 17 bp, Homo sapiens
tgtatttatcatgtcag

SEQ ID NO: 25278 - DNA, 22 bp, Homo sapiens
gctgtcttgctcactcttgcag

SEQ ID NO: 25279 - DNA, 22 bp, Homo sapiens
gtgtgtctcccaagaaggccca

SEQ ID NO: 25280 - DNA, 22 bp, Homo sapiens
actgccctccagcctgggtgac

SEQ ID NO: 25281 - DNA, 23 bp, Homo sapiens
tgggttcattcttgaagtcagtg

SEQ ID NO: 25282 - DNA, 22 bp, Homo sapiens
tattgtccaataggatgttcct

SEQ ID NO: 25283 - DNA, 22 bp, Homo sapiens
tgatgcaattagattgtaattt

SEQ ID NO: 25284 - DNA, 22 bp, Homo sapiens
tcactgcactccagcctggtga

SEQ ID NO: 25285 - DNA, 22 bp, Homo sapiens
aggggctcctttgtgctgcgtc

SEQ ID NO: 25286 - DNA, 22 bp, Homo sapiens
tttctcctcatgactggttgtg

SEQ ID NO: 25287 - DNA, 22 bp, Homo sapiens
tttcataatactgtacatgaaa

SEQ ID NO: 25288 - DNA, 22 bp, Homo sapiens
gtccaaaagagccagccgggcg

SEQ ID NO: 25289 - DNA, 22 bp, Homo sapiens
atgaaaacggaccagagctatt

SEQ ID NO: 25290 - DNA, 22 bp, Homo sapiens
ctgggaggcggagcttgcagtg

SEQ ID NO: 25291 - DNA, 22 bp, Homo sapiens
gctgcagggagctggaaggctc

SEQ ID NO: 25292 - DNA, 22 bp, Homo sapiens
caagctgaacactgtcttcaag

SEQ ID NO: 25293 - DNA, 22 bp, Homo sapiens
cagcctgtagtctggtccaggt

SEQ ID NO: 25294 - DNA, 22 bp, Homo sapiens
ttctcctttcattccctgtaga

SEQ ID NO: 25295 - DNA, 22 bp, Homo sapiens
agcagctttcacctccccgcct

SEQ ID NO: 25296 - DNA, 22 bp, Homo sapiens
gcttggccaacatggtgaaacc

SEQ ID NO: 25297 - DNA, 22 bp, Homo sapiens
ggcttggcaggtgccctgcgca

SEQ ID NO: 25298 - DNA, 22 bp, Homo sapiens
agagaagagtcttgtcaaatta

SEQ ID NO: 25299 - DNA, 22 bp, Homo sapiens
ttcctccagccatgattgtaaa

SEQ ID NO: 25300 - DNA, 22 bp, Homo sapiens
aggctagaggcttctggcttca

SEQ ID NO: 25301 - DNA, 22 bp, Homo sapiens
agggccagcactcctggcagga

SEQ ID NO: 25302 - DNA, 22 bp, Homo sapiens
gctgaaggcccggaggacaggg

SEQ ID NO: 25303 - DNA, 22 bp, Homo sapiens
cagctggtgtcaggcactgcag

SEQ ID NO: 25304 - DNA, 22 bp, Homo sapiens
atgggatgatcacctgagctca

SEQ ID NO: 25305 - DNA, 22 bp, Homo sapiens
gccctgtgcaggtgtgcagcag

SEQ ID NO: 25306 - DNA, 22 bp, Homo sapiens
tcacccaggctggagtgcagtg

SEQ ID NO: 25307 - DNA, 22 bp, Homo sapiens
tctcccaggcaggagtgcagtg

SEQ ID NO: 25308 - DNA, 22 bp, Homo sapiens
cggaagagggacagcgccagcc

SEQ ID NO: 25309 - DNA, 22 bp, Homo sapiens
tggagtgaagggttggcacggt

SEQ ID NO: 25310 - DNA, 22 bp, Homo sapiens
aataggtttaggaaagcgtttt

SEQ ID NO: 25311 - DNA, 22 bp, Homo sapiens
atatatttgagaatattcatga

SEQ ID NO: 25312 - DNA, 22 bp, Homo sapiens
atcttcccaggctggggagagg

SEQ ID NO: 25313 - DNA, 22 bp, Homo sapiens
tacatagctcctagtgatgcat

SEQ ID NO: 25314 - DNA, 22 bp, Homo sapiens
agagaggtctcaggagaaacca

SEQ ID NO: 25315 - DNA, 22 bp, Homo sapiens
cttcagctgcagttatgtttag

SEQ ID NO: 25316 - DNA, 22 bp, Homo sapiens
cattgcactccagcctgggcca

SEQ ID NO: 25317 - DNA, 19 bp, Homo sapiens
tccaggggctccacctcct

SEQ ID NO: 25318 - DNA, 22 bp, Homo sapiens
cttgacactgtcactcaggcca

SEQ ID NO: 25319 - DNA, 20 bp, Homo sapiens
aaactaaaggtgtttggttt

SEQ ID NO: 25320 - DNA, 22 bp, Homo sapiens
atgaaatgctattttggctaga

SEQ ID NO: 25321 - DNA, 22 bp, Homo sapiens
cctcagctcccatgagatctgc

SEQ ID NO: 25322 - DNA, 22 bp, Homo sapiens
ttcttctccgaggagggctggt

SEQ ID NO: 25323 - DNA, 22 bp, Homo sapiens
gccggggctggggagagacatg

SEQ ID NO: 25324 - DNA, 22 bp, Homo sapiens
cctccaaccataggtccagggg

SEQ ID NO: 25325 - DNA, 22 bp, Homo sapiens
ttaagcatttagttgtattgcc

SEQ ID NO: 25326 - DNA, 22 bp, Homo sapiens
gctcgcttagattttcctctga

SEQ ID NO: 25327 - DNA, 22 bp, Homo sapiens
gcttggctttactagggggaca

SEQ ID NO: 25328 - DNA, 22 bp, Homo sapiens
tggaggagaccgcattttattt

SEQ ID NO: 25329 - DNA, 22 bp, Homo sapiens
aaaggcttcggatcagaaggta

SEQ ID NO: 25330 - DNA, 22 bp, Homo sapiens
acagagcaatgcgtgttctcta

SEQ ID NO: 25331 - DNA, 22 bp, Homo sapiens
cagcagcattgctctggattcc

SEQ ID NO: 25332 - DNA, 22 bp, Homo sapiens
ctcctgggaaaggctggacaca

SEQ ID NO: 25333 - DNA, 22 bp, Homo sapiens
cccatgtgtgacagtccatttg

SEQ ID NO: 25334 - DNA, 22 bp, Homo sapiens
aaaagaggaactcttatatact

SEQ ID NO: 25335 - DNA, 22 bp, Homo sapiens
ggaagaaaggtggacaacaggt

SEQ ID NO: 25336 - DNA, 22 bp, Homo sapiens
tctttggtttctgtctctgtaa

SEQ ID NO: 25337 - DNA, 22 bp, Homo sapiens
tctgagacaggaagtggagggt

SEQ ID NO: 25338 - DNA, 22 bp, Homo sapiens
ccacgtccagctaattttcgta

SEQ ID NO: 25339 - DNA, 22 bp, Homo sapiens
ccaggtgtgctctgcagtggat

SEQ ID NO: 25340 - DNA, 22 bp, Homo sapiens
tctgtgctaggcagcctggccc

SEQ ID NO: 25341 - DNA, 21 bp, Homo sapiens
cgtgactgggtccgtctggct

SEQ ID NO: 25342 - DNA, 20 bp, Homo sapiens
accccagtgtgtgcctcaag

SEQ ID NO: 25343 - DNA, 17 bp, Homo sapiens
aggtgggtggatcacct

SEQ ID NO: 25344 - DNA, 21 bp, Homo sapiens
ctggccactgcacctcttcct

SEQ ID NO: 25345 - DNA, 22 bp, Homo sapiens
gaagcttgaacagggccaggct

SEQ ID NO: 25346 - DNA, 22 bp, Homo sapiens
aaactgaggctcccgagggtgt

SEQ ID NO: 25347 - DNA, 22 bp, Homo sapiens
tctttggatggaaattggagtc

SEQ ID NO: 25348 - DNA, 22 bp, Homo sapiens
cttcccaccaaagcccttgttg

SEQ ID NO: 25349 - DNA, 22 bp, Homo sapiens
tggttgcctctcagagattccg

SEQ ID NO: 25350 - DNA, 22 bp, Homo sapiens
actgttgaagtgccagcttgat

SEQ ID NO: 25351 - DNA, 22 bp, Homo sapiens
aggctctgtcaggcggagcagc

SEQ ID NO: 25352 - DNA, 22 bp, Homo sapiens
agttatgtcctcagcaaatcaa

SEQ ID NO: 25353 - DNA, 22 bp, Homo sapiens
tcagtggagagcttccaggatt

SEQ ID NO: 25354 - DNA, 22 bp, Homo sapiens
gcctggattccttgtttctcag

SEQ ID NO: 25355 - DNA, 22 bp, Homo sapiens
gccgtggggagagagggtgcgt

SEQ ID NO: 25356 - DNA, 22 bp, Homo sapiens
tagagtgtcataacagtgccca

SEQ ID NO: 25357 - DNA, 19 bp, Homo sapiens
tctagttttgagagacttc

SEQ ID NO: 25358 - DNA, 21 bp, Homo sapiens
ttaaagcctccctcataagga

SEQ ID NO: 25359 - DNA, 22 bp, Homo sapiens
caggagttcaaggttgcagtga

SEQ ID NO: 25360 - DNA, 22 bp, Homo sapiens
agtcgctgttggtcgtggcact

SEQ ID NO: 25361 - DNA, 22 bp, Homo sapiens
gcttttgcctacatcttggtct

SEQ ID NO: 25362 - DNA, 22 bp, Homo sapiens
ggattgcaacaagctagtttag

SEQ ID NO: 25363 - DNA, 21 bp, Homo sapiens
tctctttctggaagcttccct

SEQ ID NO: 25364 - DNA, 22 bp, Homo sapiens
ccctcgtgcatccatcatttag

SEQ ID NO: 25365 - DNA, 22 bp, Homo sapiens
aggctgagataggtggatcatt

SEQ ID NO: 25366 - DNA, 22 bp, Homo sapiens
ctcattgcagctgcattactgt

SEQ ID NO: 25367 - DNA, 22 bp, Homo sapiens
ccattgcactccatcctgggca

SEQ ID NO: 25368 - DNA, 23 bp, Homo sapiens
ggagcctccggtgtgtgagaggc

SEQ ID NO: 25369 - DNA, 22 bp, Homo sapiens
acggtgaccaagcatcaccgag

SEQ ID NO: 25370 - DNA, 22 bp, Homo sapiens
cactgcagcctctgcctctcag

SEQ ID NO: 25371 - DNA, 22 bp, Homo sapiens
gccctgttgtcggacgtcaagg

SEQ ID NO: 25372 - DNA, 22 bp, Homo sapiens
cggggacacactggcagctcct

SEQ ID NO: 25373 - DNA, 22 bp, Homo sapiens
ttctcatgaaactcgcttcctc

SEQ ID NO: 25374 - DNA, 22 bp, Homo sapiens
gagcactgagctggaattggag

SEQ ID NO: 25375 - DNA, 22 bp, Homo sapiens
gtggattacaagacagttgaga

SEQ ID NO: 25376 - DNA, 22 bp, Homo sapiens
gaatgctaagcatgtgggagtt

SEQ ID NO: 25377 - DNA, 22 bp, Homo sapiens
acccatacacacatatttatgt

SEQ ID NO: 25378 - DNA, 19 bp, Homo sapiens
atgtacccagtgtcaatcc

SEQ ID NO: 25379 - DNA, 22 bp, Homo sapiens
ctggaaggcagaggttgcagtg

SEQ ID NO: 25380 - DNA, 22 bp, Homo sapiens
gtccccaaaattacaagacaca

SEQ ID NO: 25381 - DNA, 22 bp, Homo sapiens
tgtcctgcccaaggtcacatac

SEQ ID NO: 25382 - DNA, 22 bp, Homo sapiens
tgtctgggagactgatcacccg

SEQ ID NO: 25383 - DNA, 22 bp, Homo sapiens
caggaaggggctcactctggcc

SEQ ID NO: 25384 - DNA, 22 bp, Homo sapiens
aaggggtgcaagttaatcagca

SEQ ID NO: 25385 - DNA, 22 bp, Homo sapiens
ggtcgagtcacttgttgccttt

SEQ ID NO: 25386 - DNA, 22 bp, Homo sapiens
tgagccatgggactccaaggga

SEQ ID NO: 25387 - DNA, 22 bp, Homo sapiens
ctatggtgatagaaatcagaat

SEQ ID NO: 25388 - DNA, 22 bp, Homo sapiens
catgagatctgcagggatgggc

SEQ ID NO: 25389 - DNA, 22 bp, Homo sapiens
tcattgagttgcacttttacta

SEQ ID NO: 25390 - DNA, 22 bp, Homo sapiens
atgtatacgtgcaagtcacagg

SEQ ID NO: 25391 - DNA, 22 bp, Homo sapiens
ggcgcccccttcaaacagagca

SEQ ID NO: 25392 - DNA, 22 bp, Homo sapiens
cctaggagttcgaagctgcagt

SEQ ID NO: 25393 - DNA, 22 bp, Homo sapiens
agtgcattcctggggaagaagc

SEQ ID NO: 25394 - DNA, 20 bp, Homo sapiens
tttctgtgagaaacactgtt

SEQ ID NO: 25395 - DNA, 22 bp, Homo sapiens
tagtgccctcccctttgggata

SEQ ID NO: 25396 - DNA, 22 bp, Homo sapiens
tccaggattgtcagccagaagg

SEQ ID NO: 25397 - DNA, 22 bp, Homo sapiens
ggaggtcccaggcctggcagca

SEQ ID NO: 25398 - DNA, 22 bp, Homo sapiens
tgccctggctcttcttgttcca

SEQ ID NO: 25399 - DNA, 22 bp, Homo sapiens
tttgcttcacaagtatggttct

SEQ ID NO: 25400 - DNA, 22 bp, Homo sapiens
gagctcatccccatggtccgtc

SEQ ID NO: 25401 - DNA, 22 bp, Homo sapiens
ttcatataccttgcgtttcaca

SEQ ID NO: 25402 - DNA, 22 bp, Homo sapiens
cgtgccactgcactccagtctg

SEQ ID NO: 25403 - DNA, 22 bp, Homo sapiens
ggaggtagcctcaaaagcagct

SEQ ID NO: 25404 - DNA, 22 bp, Homo sapiens
cccaggaggtggagcttgcagt

SEQ ID NO: 25405 - DNA, 22 bp, Homo sapiens
attgaaaataaggccagaaaca

SEQ ID NO: 25406 - DNA, 22 bp, Homo sapiens
cccatggcttaggagggagtgt

SEQ ID NO: 25407 - DNA, 22 bp, Homo sapiens
gtgcaaaagtaattgtggtttt

SEQ ID NO: 25408 - DNA, 22 bp, Homo sapiens
ggaggagacagtaaaaagcacg

SEQ ID NO: 25409 - DNA, 22 bp, Homo sapiens
cgccgcctgctgcagcagctgt

SEQ ID NO: 25410 - DNA, 22 bp, Homo sapiens
aaaaaattatcatagttcctga

SEQ ID NO: 25411 - DNA, 22 bp, Homo sapiens
ggcttgaagggaggaaagcagg

SEQ ID NO: 25412 - DNA, 22 bp, Homo sapiens
ttgtaagtcacaccagggcagg

SEQ ID NO: 25413 - DNA, 22 bp, Homo sapiens
gaggctgaggcggatggatcac

SEQ ID NO: 25414 - DNA, 22 bp, Homo sapiens
aagtgcttccatgtttgagtgt

SEQ ID NO: 25415 - DNA, 22 bp, Homo sapiens
cttcctctgtggccagagtgta

SEQ ID NO: 25416 - DNA, 22 bp, Homo sapiens
gctggctgacagatttggggtg

SEQ ID NO: 25417 - DNA, 22 bp, Homo sapiens
tcccaggccacacttggggaac

SEQ ID NO: 25418 - DNA, 22 bp, Homo sapiens
ttctgattgctgatgaggccca

SEQ ID NO: 25419 - DNA, 22 bp, Homo sapiens
gcagatcaacactctctttcaa

SEQ ID NO: 25420 - DNA, 22 bp, Homo sapiens
aaccaccaccgtaatttaccca

SEQ ID NO: 25421 - DNA, 22 bp, Homo sapiens
tggtggcactgacatcagacac

SEQ ID NO: 25422 - DNA, 22 bp, Homo sapiens
gcccaggctggagtgcagtggt

SEQ ID NO: 25423 - DNA, 22 bp, Homo sapiens
acaaagtgctgacattacaggc

SEQ ID NO: 25424 - DNA, 22 bp, Homo sapiens
tggagtgcaatagtaataaggt

SEQ ID NO: 25425 - DNA, 22 bp, Homo sapiens
aagttactggcaagggctgcag

SEQ ID NO: 25426 - DNA, 22 bp, Homo sapiens
ggctagcaaggtagcagaatgc

SEQ ID NO: 25427 - DNA, 22 bp, Homo sapiens
cacttgttggtggtgaaatcac

SEQ ID NO: 25428 - DNA, 22 bp, Homo sapiens
cactgcactccagcctcggtga

SEQ ID NO: 25429 - DNA, 22 bp, Homo sapiens
caaagtgctaggattataggtg

SEQ ID NO: 25430 - DNA, 22 bp, Homo sapiens
cttttgattgagcagtttcaaa

SEQ ID NO: 25431 - DNA, 22 bp, Homo sapiens
aacgcccagccttgatcaaatg

SEQ ID NO: 25432 - DNA, 22 bp, Homo sapiens
gttcagtcacgtgcccaagttc

SEQ ID NO: 25433 - DNA, 22 bp, Homo sapiens
cttccttctcactagcagcgcc

SEQ ID NO: 25434 - DNA, 22 bp, Homo sapiens
tctcagctcatggcagccttga

SEQ ID NO: 25435 - DNA, 22 bp, Homo sapiens
ctgctaaacctctctgagagct

SEQ ID NO: 25436 - DNA, 18 bp, Homo sapiens
cagctgccagctcatgga

SEQ ID NO: 25437 - DNA, 22 bp, Homo sapiens
tcatctgaagattgctgttcaa

SEQ ID NO: 25438 - DNA, 22 bp, Homo sapiens
tacggtcagtccgtgccccaag

SEQ ID NO: 25439 - DNA, 22 bp, Homo sapiens
tgagacgaagtcttgctctgtt

SEQ ID NO: 25440 - DNA, 22 bp, Homo sapiens
aattgcactttagcaatggtga

SEQ ID NO: 25441 - DNA, 22 bp, Homo sapiens
tcactgcaacctccacctcctg

SEQ ID NO: 25442 - DNA, 22 bp, Homo sapiens
gacaggaggcagagctcaggtg

SEQ ID NO: 25443 - DNA, 22 bp, Homo sapiens
cctgggggccaggaaggtgtga

SEQ ID NO: 25444 - DNA, 21 bp, Homo sapiens
aagaggaagcattatggcata

SEQ ID NO: 25445 - DNA, 22 bp, Homo sapiens
agtggaccagaagactgaagct

SEQ ID NO: 25446 - DNA, 22 bp, Homo sapiens
tttggctcagctcacagatccc

SEQ ID NO: 25447 - DNA, 22 bp, Homo sapiens
gctctagtaggaatgtccctct

SEQ ID NO: 25448 - DNA, 22 bp, Homo sapiens
tctgcgcgctgctggtaccgaa

SEQ ID NO: 25449 - DNA, 22 bp, Homo sapiens
agttgctgggaaagatttcagt

SEQ ID NO: 25450 - DNA, 22 bp, Homo sapiens
taattataacatgctttctggc

SEQ ID NO: 25451 - DNA, 22 bp, Homo sapiens
tggctcactgtagccttgacct

SEQ ID NO: 25452 - DNA, 22 bp, Homo sapiens
aaggtccttttgcagtgtgatc

SEQ ID NO: 25453 - DNA, 22 bp, Homo sapiens
tggctaacaaggtgaaaccccg

SEQ ID NO: 25454 - DNA, 22 bp, Homo sapiens
aatcacttagaacccaggaagt

SEQ ID NO: 25455 - DNA, 22 bp, Homo sapiens
atggctagcaccgcgttgctgg

SEQ ID NO: 25456 - DNA, 22 bp, Homo sapiens
cattgcactccagcctgggcaa

SEQ ID NO: 25457 - DNA, 22 bp, Homo sapiens
gcctcctggggtgccatcatct

SEQ ID NO: 25458 - DNA, 22 bp, Homo sapiens
aagatattcaaagatttattag

SEQ ID NO: 25459 - DNA, 22 bp, Homo sapiens
cccaggggttctgagcagcagc

SEQ ID NO: 25460 - DNA, 22 bp, Homo sapiens
ggaggtggaggttgcagtgagc

SEQ ID NO: 25461 - DNA, 22 bp, Homo sapiens
ggaggcggaggttgcagtgagt

SEQ ID NO: 25462 - DNA, 22 bp, Homo sapiens
aaggagcgcttagggggcagaa

SEQ ID NO: 25463 - DNA, 22 bp, Homo sapiens
agtccaaagcagatgagggcca

SEQ ID NO: 25464 - DNA, 22 bp, Homo sapiens
ggttcacagtaaggtttgtgct

SEQ ID NO: 25465 - DNA, 22 bp, Homo sapiens
agagctgggtggacttgtagtt

SEQ ID NO: 25466 - DNA, 22 bp, Homo sapiens
tgggccactgctgcggaaggcg

SEQ ID NO: 25467 - DNA, 22 bp, Homo sapiens
ctggcttttttcccattatgca

SEQ ID NO: 25468 - DNA, 22 bp, Homo sapiens
gtgcccagcagcagcgtccccg

SEQ ID NO: 25469 - DNA, 22 bp, Homo sapiens
gcctgacttgtgtattttacat

SEQ ID NO: 25470 - DNA, 22 bp, Homo sapiens
caattcccagctgccgggctgc

SEQ ID NO: 25471 - DNA, 22 bp, Homo sapiens
tggatggctgtggtctttgccc

SEQ ID NO: 25472 - DNA, 22 bp, Homo sapiens
ccactattactgtgtggcagtc

SEQ ID NO: 25473 - DNA, 22 bp, Homo sapiens
tccagcagtccatgtgagacac

SEQ ID NO: 25474 - DNA, 22 bp, Homo sapiens
ctggaaggcggaggttgtagtg

SEQ ID NO: 25475 - DNA, 22 bp, Homo sapiens
gattccacagcttcgaggtctt

SEQ ID NO: 25476 - DNA, 22 bp, Homo sapiens
ggagtagctgcattccgagcac

SEQ ID NO: 25477 - DNA, 22 bp, Homo sapiens
tgtcacagtttgtactttatag

SEQ ID NO: 25478 - DNA, 22 bp, Homo sapiens
aatattatacagtcaacctctt

SEQ ID NO: 25479 - DNA, 22 bp, Homo sapiens
ttgtggttgactaaatttgtaa

SEQ ID NO: 25480 - DNA, 22 bp, Homo sapiens
tcaccagctctgcctcgccagt

SEQ ID NO: 25481 - DNA, 22 bp, Homo sapiens
tcacagagaaatgtggcacaaa

SEQ ID NO: 25482 - DNA, 22 bp, Homo sapiens
tgtagatatagaaaaagactga

SEQ ID NO: 25483 - DNA, 22 bp, Homo sapiens
gctgtagtgaatggccgcgttc

SEQ ID NO: 25484 - DNA, 22 bp, Homo sapiens
gggcagatcacctgaggtcagg

SEQ ID NO: 25485 - DNA, 22 bp, Homo sapiens
ctgtcaggttggtctcagagct

SEQ ID NO: 25486 - DNA, 22 bp, Homo sapiens
gtgcatgtcggggtgcatgtca

SEQ ID NO: 25487 - DNA, 22 bp, Homo sapiens
cccgtgtgtgcgaggctcccgc

SEQ ID NO: 25488 - DNA, 20 bp, Homo sapiens
cagcagtggatgagagtttt

SEQ ID NO: 25489 - DNA, 22 bp, Homo sapiens
tgtgtgcatgcttggggcagca

SEQ ID NO: 25490 - DNA, 22 bp, Homo sapiens
gtggcccatcacgtttcgcctt

SEQ ID NO: 25491 - DNA, 22 bp, Homo sapiens
tagagcaatgctctactccttg

SEQ ID NO: 25492 - DNA, 22 bp, Homo sapiens
tcacttagatggggatcatcac

SEQ ID NO: 25493 - DNA, 18 bp, Homo sapiens
ttgcttcttttctctagg

SEQ ID NO: 25494 - DNA, 22 bp, Homo sapiens
ttgattatagactcactaatct

SEQ ID NO: 25495 - DNA, 22 bp, Homo sapiens
tgatgggaggtgctgcaggacc

SEQ ID NO: 25496 - DNA, 22 bp, Homo sapiens
aaagaaggtagggctggtgact

SEQ ID NO: 25497 - DNA, 22 bp, Homo sapiens
ttcccttaaattatggcatcta

SEQ ID NO: 25498 - DNA, 22 bp, Homo sapiens
ctgtcctgtgctttttactgtc

SEQ ID NO: 25499 - DNA, 22 bp, Homo sapiens
aagctgttgttcatcctgaatt

SEQ ID NO: 25500 - DNA, 22 bp, Homo sapiens
ggccctgggccctctagcttgt

SEQ ID NO: 25501 - DNA, 22 bp, Homo sapiens
cagagctggtgtgtcctggcat

SEQ ID NO: 25502 - DNA, 22 bp, Homo sapiens
gggttgaggcggatgtcggcgg

SEQ ID NO: 25503 - DNA, 22 bp, Homo sapiens
aagtaaatatctgtagtcttta

SEQ ID NO: 25504 - DNA, 22 bp, Homo sapiens
atcattatcctcctatttgcct

SEQ ID NO: 25505 - DNA, 22 bp, Homo sapiens
tctcaagcttgttggtatgttt

SEQ ID NO: 25506 - DNA, 22 bp, Homo sapiens
atgtgccaacgtgcaggtttgt

SEQ ID NO: 25507 - DNA, 22 bp, Homo sapiens
gggcctgctgcaggttcaggat

SEQ ID NO: 25508 - DNA, 22 bp, Homo sapiens
tgggagcagcctcagcttcggg

SEQ ID NO: 25509 - DNA, 22 bp, Homo sapiens
gacgagagactccatccaccac

SEQ ID NO: 25510 - DNA, 22 bp, Homo sapiens
ttgtgggggctgccctgtacgg

SEQ ID NO: 25511 - DNA, 22 bp, Homo sapiens
tgatattttatgagctttcata

SEQ ID NO: 25512 - DNA, 22 bp, Homo sapiens
tccagatgctgcacattcctga

SEQ ID NO: 25513 - DNA, 20 bp, Homo sapiens
gcgtggcctgggatcccaag

SEQ ID NO: 25514 - DNA, 22 bp, Homo sapiens
tgactcagtacatctggagttg

SEQ ID NO: 25515 - DNA, 22 bp, Homo sapiens
atttgattgtgtctgagacgat

SEQ ID NO: 25516 - DNA, 22 bp, Homo sapiens
cacactgtctttatgagctgta

SEQ ID NO: 25517 - DNA, 17 bp, Homo sapiens
ttcttttctgagccttg

SEQ ID NO: 25518 - DNA, 22 bp, Homo sapiens
agcggcgccgagcttggccagg

SEQ ID NO: 25519 - DNA, 22 bp, Homo sapiens
tacaaaaaattgatactgacga

SEQ ID NO: 25520 - DNA, 22 bp, Homo sapiens
ctatacagcagcttactagtta

SEQ ID NO: 25521 - DNA, 22 bp, Homo sapiens
gcacctgcctgggactgaagat

SEQ ID NO: 25522 - DNA, 22 bp, Homo sapiens
cttcttgctgggggcctcagtg

SEQ ID NO: 25523 - DNA, 22 bp, Homo sapiens
atgttggagtcgtaaggcatgg

SEQ ID NO: 25524 - DNA, 22 bp, Homo sapiens
caaggtgccatgctgggcgggg

SEQ ID NO: 25525 - DNA, 22 bp, Homo sapiens
ccaatgatggtgcccacgatga

SEQ ID NO: 25526 - DNA, 18 bp, Homo sapiens
tggttccttgaaggggca

SEQ ID NO: 25527 - DNA, 22 bp, Homo sapiens
ctgaaattctttggagttttct

SEQ ID NO: 25528 - DNA, 22 bp, Homo sapiens
gtgcacatcgtgcaggtttgtt

SEQ ID NO: 25529 - DNA, 22 bp, Homo sapiens
cctacagttatattcttgattg

SEQ ID NO: 25530 - DNA, 22 bp, Homo sapiens
cccgtgtggatgcgctggtgct

SEQ ID NO: 25531 - DNA, 22 bp, Homo sapiens
ccttacctgattgctggcatcc

SEQ ID NO: 25532 - DNA, 22 bp, Homo sapiens
actggccagccaacaacaatag

SEQ ID NO: 25533 - DNA, 22 bp, Homo sapiens
gatggcctcatggctgcaggcc

SEQ ID NO: 25534 - DNA, 22 bp, Homo sapiens
caggaaagggatgggctgccac

SEQ ID NO: 25535 - DNA, 22 bp, Homo sapiens
aagtgctgggattacaggcatg

SEQ ID NO: 25536 - DNA, 22 bp, Homo sapiens
tgagcattacctgaggccactg

SEQ ID NO: 25537 - DNA, 22 bp, Homo sapiens
tgggggctttatgtaatgcaca

SEQ ID NO: 25538 - DNA, 22 bp, Homo sapiens
gaggtggatgttgcagtgagct

SEQ ID NO: 25539 - DNA, 22 bp, Homo sapiens
atgtatgtctaaaacggggagg

SEQ ID NO: 25540 - DNA, 22 bp, Homo sapiens
cctgggctctgtcagaattggg

SEQ ID NO: 25541 - DNA, 22 bp, Homo sapiens
tttatagtagcatgatttataa

SEQ ID NO: 25542 - DNA, 22 bp, Homo sapiens
agagtactgcctcagttatgaa

SEQ ID NO: 25543 - DNA, 18 bp, Homo sapiens
gcagtgaagaaagagctt

SEQ ID NO: 25544 - DNA, 22 bp, Homo sapiens
agccaccaccactgaaaggtta

SEQ ID NO: 25545 - DNA, 21 bp, Homo sapiens
tctgcaccccagcctgagtga

SEQ ID NO: 25546 - DNA, 23 bp, Homo sapiens
ttctgggctgtggaagcctcggg

SEQ ID NO: 25547 - DNA, 22 bp, Homo sapiens
tccccatgtctgcagggagggt

SEQ ID NO: 25548 - DNA, 18 bp, Homo sapiens
gacatagctcagagctca

SEQ ID NO: 25549 - DNA, 22 bp, Homo sapiens
ggttccacctggcgaggggtat

SEQ ID NO: 25550 - DNA, 22 bp, Homo sapiens
agcctctctgttagtcactggg

SEQ ID NO: 25551 - DNA, 22 bp, Homo sapiens
aattacagtcggagcagcactg

SEQ ID NO: 25552 - DNA, 22 bp, Homo sapiens
acagtccagcctagtatgtata

SEQ ID NO: 25553 - DNA, 22 bp, Homo sapiens
tgctaataaactccaggctgag

SEQ ID NO: 25554 - DNA, 22 bp, Homo sapiens
gaccctgtttctacaaataatt

SEQ ID NO: 25555 - DNA, 22 bp, Homo sapiens
accgagttagccaggatggtct

SEQ ID NO: 25556 - DNA, 22 bp, Homo sapiens
tgtcatagtgtggtagcagtgg

SEQ ID NO: 25557 - DNA, 22 bp, Homo sapiens
cccagacccagagggaggcagg

SEQ ID NO: 25558 - DNA, 22 bp, Homo sapiens
gggctgcactagggcaaggtga

SEQ ID NO: 25559 - DNA, 22 bp, Homo sapiens
gagaggtggaggttgcagtgag

SEQ ID NO: 25560 - DNA, 23 bp, Homo sapiens
gtcacagtgggtggtgcctacat

SEQ ID NO: 25561 - DNA, 22 bp, Homo sapiens
caggaagaccagggctgtggct

SEQ ID NO: 25562 - DNA, 22 bp, Homo sapiens
agaatagaattctcatagaatt

SEQ ID NO: 25563 - DNA, 22 bp, Homo sapiens
tctcatctgccatttgcaggag

SEQ ID NO: 25564 - DNA, 22 bp, Homo sapiens
ggcgccccatgatgagggctag

SEQ ID NO: 25565 - DNA, 22 bp, Homo sapiens
gctaagggataggctgcctcct

SEQ ID NO: 25566 - DNA, 22 bp, Homo sapiens
gaccttgtgatccacccgcctt

SEQ ID NO: 25567 - DNA, 22 bp, Homo sapiens
tcggagcgtcactggctggagg

SEQ ID NO: 25568 - DNA, 22 bp, Homo sapiens
tagcccaggctggagtgcaggg

SEQ ID NO: 25569 - DNA, 22 bp, Homo sapiens
gtggatggagctggaagccatt

SEQ ID NO: 25570 - DNA, 22 bp, Homo sapiens
cctgtctctgcagggccctgcc

SEQ ID NO: 25571 - DNA, 22 bp, Homo sapiens
gcagccagagggggtgtgatca

SEQ ID NO: 25572 - DNA, 22 bp, Homo sapiens
atgccacttcattccagcctcg

SEQ ID NO: 25573 - DNA, 22 bp, Homo sapiens
tgcgggtcccagggtcacaggc

SEQ ID NO: 25574 - DNA, 22 bp, Homo sapiens
gcaggcagaggtggaggagaca

SEQ ID NO: 25575 - DNA, 23 bp, Homo sapiens
agagtgcagagatatgcttgtgt

SEQ ID NO: 25576 - DNA, 22 bp, Homo sapiens
gtcgatcacctcgtcctccgtg

SEQ ID NO: 25577 - DNA, 22 bp, Homo sapiens
acctagaatttaaaacattgct

SEQ ID NO: 25578 - DNA, 22 bp, Homo sapiens
acccacgaagatgagcggcatg

SEQ ID NO: 25579 - DNA, 22 bp, Homo sapiens
actcttgattgatttagtcttt

SEQ ID NO: 25580 - DNA, 22 bp, Homo sapiens
caaagcaggaagctcctgacag

SEQ ID NO: 25581 - DNA, 22 bp, Homo sapiens
actggacagaggaaatatggag

SEQ ID NO: 25582 - DNA, 19 bp, Homo sapiens
ccagagagctaggtacaga

SEQ ID NO: 25583 - DNA, 22 bp, Homo sapiens
atgctatgtaactggcagatag

SEQ ID NO: 25584 - DNA, 22 bp, Homo sapiens
gtggcatgaaagcatctgtgat

SEQ ID NO: 25585 - DNA, 22 bp, Homo sapiens
agacagggtgatcgcttgagcc

SEQ ID NO: 25586 - DNA, 22 bp, Homo sapiens
acagacaagtagttcagacaag

SEQ ID NO: 25587 - DNA, 22 bp, Homo sapiens
ccagaggtgctctttggaagtg

SEQ ID NO: 25588 - DNA, 22 bp, Homo sapiens
aagaaggcggaccagaagggag

SEQ ID NO: 25589 - DNA, 22 bp, Homo sapiens
accatgttggccaagctggtct

SEQ ID NO: 25590 - DNA, 22 bp, Homo sapiens
tgctggatttgaccaagttgga

SEQ ID NO: 25591 - DNA, 22 bp, Homo sapiens
tttacacagaggacactgggct

SEQ ID NO: 25592 - DNA, 22 bp, Homo sapiens
ccactgccctgcaaaagctgga

SEQ ID NO: 25593 - DNA, 22 bp, Homo sapiens
tccattatacttctgattcaaa

SEQ ID NO: 25594 - DNA, 21 bp, Homo sapiens
acagtaagacagggcatttgc

SEQ ID NO: 25595 - DNA, 17 bp, Homo sapiens
gcgtgtccccgcgtctc

SEQ ID NO: 25596 - DNA, 22 bp, Homo sapiens
ggctctgcttgaggccagcctg

SEQ ID NO: 25597 - DNA, 22 bp, Homo sapiens
actgcactccaacctgggcaat

SEQ ID NO: 25598 - DNA, 22 bp, Homo sapiens
cctttcctgtgtccttttaagg

SEQ ID NO: 25599 - DNA, 22 bp, Homo sapiens
ggcggctactcctcctggtgag

SEQ ID NO: 25600 - DNA, 22 bp, Homo sapiens
tcaagcggactgagatactctg

SEQ ID NO: 25601 - DNA, 22 bp, Homo sapiens
ttgtgaatagtgctgcaataaa

SEQ ID NO: 25602 - DNA, 22 bp, Homo sapiens
gcatggcttcggggtgctgcct

SEQ ID NO: 25603 - DNA, 22 bp, Homo sapiens
ctaggctggagtgcagtggcac

SEQ ID NO: 25604 - DNA, 22 bp, Homo sapiens
aacactatctgccttacaggga

SEQ ID NO: 25605 - DNA, 22 bp, Homo sapiens
tttgattgcaatagttttatga

SEQ ID NO: 25606 - DNA, 22 bp, Homo sapiens
caaagtgggtgccctgatgctc

SEQ ID NO: 25607 - DNA, 22 bp, Homo sapiens
gagcagtaggagaaccctgagc

SEQ ID NO: 25608 - DNA, 22 bp, Homo sapiens
agaggccggccgagcccatggg

SEQ ID NO: 25609 - DNA, 20 bp, Homo sapiens
tatttctgggcaaccattta

SEQ ID NO: 25610 - DNA, 22 bp, Homo sapiens
ctcggcaggtggaggttgtagt

SEQ ID NO: 25611 - DNA, 22 bp, Homo sapiens
ccggtcccaggtgccccggtga

SEQ ID NO: 25612 - DNA, 22 bp, Homo sapiens
ttgtgaatagtgccgctataaa

SEQ ID NO: 25613 - DNA, 22 bp, Homo sapiens
gcttggccagcagccgggatgc

SEQ ID NO: 25614 - DNA, 22 bp, Homo sapiens
gcccgcgccagcctctccatct

SEQ ID NO: 25615 - DNA, 21 bp, Homo sapiens
tcgtgcagcagctgaggcttg

SEQ ID NO: 25616 - DNA, 22 bp, Homo sapiens
tgtattctaaatacatcttacc

SEQ ID NO: 25617 - DNA, 22 bp, Homo sapiens
tggccttggccgtgctggggtc

SEQ ID NO: 25618 - DNA, 18 bp, Homo sapiens
cagggctgtggggtcact

SEQ ID NO: 25619 - DNA, 22 bp, Homo sapiens
caattttcaattccttcagata

SEQ ID NO: 25620 - DNA, 22 bp, Homo sapiens
ccggctactcgggaggctgacg

SEQ ID NO: 25621 - DNA, 22 bp, Homo sapiens
ataatggtagatgtccacgcag

SEQ ID NO: 25622 - DNA, 18 bp, Homo sapiens
tgtccctgcaaataacat

SEQ ID NO: 25623 - DNA, 23 bp, Homo sapiens
aggatgtaggatgtatggcagag

SEQ ID NO: 25624 - DNA, 22 bp, Homo sapiens
ggaaggcagaggtgtcgtgggg

SEQ ID NO: 25625 - DNA, 20 bp, Homo sapiens
taagcatagttgtcagggtc

SEQ ID NO: 25626 - DNA, 22 bp, Homo sapiens
gggctgcatcagcaggacccgg

SEQ ID NO: 25627 - DNA, 22 bp, Homo sapiens
cctgcgcgtctgggtctgtctc

SEQ ID NO: 25628 - DNA, 22 bp, Homo sapiens
gcccagagttcaaggctgcagt

SEQ ID NO: 25629 - DNA, 22 bp, Homo sapiens
tcggcgctggaacgcagtagct

SEQ ID NO: 25630 - DNA, 20 bp, Homo sapiens
atggggtgagtgacgccctc

SEQ ID NO: 25631 - DNA, 21 bp, Homo sapiens
ctagaaagaatgttgtcgtct

SEQ ID NO: 25632 - DNA, 22 bp, Homo sapiens
aagcacctgcaccggtcgcctt

SEQ ID NO: 25633 - DNA, 22 bp, Homo sapiens
gctgtgcagaggtgagaatcca

SEQ ID NO: 25634 - DNA, 22 bp, Homo sapiens
acaagcgggccacagtgctggt

SEQ ID NO: 25635 - DNA, 22 bp, Homo sapiens
tccgttttcacactgctataaa

SEQ ID NO: 25636 - DNA, 22 bp, Homo sapiens
tcacccaggctggactgcagtg

SEQ ID NO: 25637 - DNA, 22 bp, Homo sapiens
tctcacatgcaaacagtccaca

SEQ ID NO: 25638 - DNA, 22 bp, Homo sapiens
ttcagatgattagaatagtatt

SEQ ID NO: 25639 - DNA, 22 bp, Homo sapiens
ctggtgtggactccgcgcggag

SEQ ID NO: 25640 - DNA, 22 bp, Homo sapiens
tgtggactcgcatggctgaggc

SEQ ID NO: 25641 - DNA, 22 bp, Homo sapiens
ctccagattccgtttattcagg

SEQ ID NO: 25642 - DNA, 22 bp, Homo sapiens
gtgacatggtttgccgtccctg

SEQ ID NO: 25643 - DNA, 22 bp, Homo sapiens
cttctcggccgtgtggatgcgc

SEQ ID NO: 25644 - DNA, 22 bp, Homo sapiens
aggcgaagggaccagacggtag

SEQ ID NO: 25645 - DNA, 21 bp, Homo sapiens
accactgcctccaaggttcag

SEQ ID NO: 25646 - DNA, 22 bp, Homo sapiens
ggttttatcctacccacacagc

SEQ ID NO: 25647 - DNA, 22 bp, Homo sapiens
acagattcactgcactggccat

SEQ ID NO: 25648 - DNA, 22 bp, Homo sapiens
agacgctattttgaggggtcta

SEQ ID NO: 25649 - DNA, 22 bp, Homo sapiens
tttgaagggcacgacaatagtt

SEQ ID NO: 25650 - DNA, 22 bp, Homo sapiens
tccagcccaggctggagtgtag

SEQ ID NO: 25651 - DNA, 22 bp, Homo sapiens
ggtgccctggaagctgctgcat

SEQ ID NO: 25652 - DNA, 19 bp, Homo sapiens
aggagcactgccagcacca

SEQ ID NO: 25653 - DNA, 22 bp, Homo sapiens
aaatcggttggttcaaggtaat

SEQ ID NO: 25654 - DNA, 22 bp, Homo sapiens
ggtgggagccaacacccttctg

SEQ ID NO: 25655 - DNA, 17 bp, Homo sapiens
cgggcatggagggcagg

SEQ ID NO: 25656 - DNA, 19 bp, Homo sapiens
tcctgcccaccagccaggg

SEQ ID NO: 25657 - DNA, 22 bp, Homo sapiens
ggtaccaccaattcagctgcca

SEQ ID NO: 25658 - DNA, 22 bp, Homo sapiens
attggtagttttgtatttctct

SEQ ID NO: 25659 - DNA, 22 bp, Homo sapiens
tcacttcgtaaacccctcccat

SEQ ID NO: 25660 - DNA, 22 bp, Homo sapiens
gtctgaatacgtacttgtgaag

SEQ ID NO: 25661 - DNA, 22 bp, Homo sapiens
tggcaaaatgagcaattacttt

SEQ ID NO: 25662 - DNA, 22 bp, Homo sapiens
ggacacgtggctgaaggcggcc

SEQ ID NO: 25663 - DNA, 22 bp, Homo sapiens
gggcccctgggaattctgtgat

SEQ ID NO: 25664 - DNA, 22 bp, Homo sapiens
agcgccactgcactccagcctg

SEQ ID NO: 25665 - DNA, 22 bp, Homo sapiens
aaagattaaatcaaattggtca

SEQ ID NO: 25666 - DNA, 22 bp, Homo sapiens
gcccagagtttgaagatacagt

SEQ ID NO: 25667 - DNA, 22 bp, Homo sapiens
aaggcaaaagaggtgtcatcac

SEQ ID NO: 25668 - DNA, 22 bp, Homo sapiens
accagggaccgccacactgcaa

SEQ ID NO: 25669 - DNA, 22 bp, Homo sapiens
tcgtacagcagactgaagtcct

SEQ ID NO: 25670 - DNA, 22 bp, Homo sapiens
aacagaatgcaggggatgctgc

SEQ ID NO: 25671 - DNA, 18 bp, Homo sapiens
tctgccccagccgcactg

SEQ ID NO: 25672 - DNA, 22 bp, Homo sapiens
aggtacatggggtgtgtgcacg

SEQ ID NO: 25673 - DNA, 22 bp, Homo sapiens
ctgctgggatagaagtatctca

SEQ ID NO: 25674 - DNA, 22 bp, Homo sapiens
aatatgcactctgatttagcag

SEQ ID NO: 25675 - DNA, 22 bp, Homo sapiens
ctgagccaaggggacagtgaca

SEQ ID NO: 25676 - DNA, 22 bp, Homo sapiens
gggcagccccagcgcgttggct

SEQ ID NO: 25677 - DNA, 22 bp, Homo sapiens
ctcgcgttccagctgcgggccg

SEQ ID NO: 25678 - DNA, 23 bp, Homo sapiens
cagtctgcagcccacttgggcag

SEQ ID NO: 25679 - DNA, 19 bp, Homo sapiens
gactcacaccttccgctgt

SEQ ID NO: 25680 - DNA, 22 bp, Homo sapiens
tgatctggtcctactgtgggca

SEQ ID NO: 25681 - DNA, 22 bp, Homo sapiens
agtctacaaagggaagcccttt

SEQ ID NO: 25682 - DNA, 22 bp, Homo sapiens
tgtggccattcttgaggtcgac

SEQ ID NO: 25683 - DNA, 22 bp, Homo sapiens
tgttgcccaggttctctcctgc

SEQ ID NO: 25684 - DNA, 22 bp, Homo sapiens
aagtagttaggaacattctctc

SEQ ID NO: 25685 - DNA, 22 bp, Homo sapiens
gcacttgtggatttgatataca

SEQ ID NO: 25686 - DNA, 22 bp, Homo sapiens
agtggctgagtgactgtgactc

SEQ ID NO: 25687 - DNA, 22 bp, Homo sapiens
ctcactgaaacctccgcctccc

SEQ ID NO: 25688 - DNA, 20 bp, Homo sapiens
tctcgcactcggagcagccg

SEQ ID NO: 25689 - DNA, 22 bp, Homo sapiens
tgagcttccctcctgcactaca

SEQ ID NO: 25690 - DNA, 22 bp, Homo sapiens
tcacttcccagacggggtggca

SEQ ID NO: 25691 - DNA, 20 bp, Homo sapiens
tctgccacgtctggtgactg

SEQ ID NO: 25692 - DNA, 22 bp, Homo sapiens
tgcgcatgagtctgtgcataca

SEQ ID NO: 25693 - DNA, 22 bp, Homo sapiens
agcccaggctggagtgcagtgg

SEQ ID NO: 25694 - DNA, 22 bp, Homo sapiens
tgtcagttctctgcattgtctc

SEQ ID NO: 25695 - DNA, 22 bp, Homo sapiens
cagcagagaaattacatatttg

SEQ ID NO: 25696 - DNA, 22 bp, Homo sapiens
cgggcagcggcgtggccatggt

SEQ ID NO: 25697 - DNA, 22 bp, Homo sapiens
ctgggaggcagaggttgcagtg

SEQ ID NO: 25698 - DNA, 22 bp, Homo sapiens
gctgcgccggatcccacgttcc

SEQ ID NO: 25699 - DNA, 22 bp, Homo sapiens
gggcaggaacaaatcaaatgat

SEQ ID NO: 25700 - DNA, 22 bp, Homo sapiens
tggggagtgatgcctcggataa

SEQ ID NO: 25701 - DNA, 22 bp, Homo sapiens
ggccgctctccggtgtggatct

SEQ ID NO: 25702 - DNA, 22 bp, Homo sapiens
gggggctaccgtctctggagct

SEQ ID NO: 25703 - DNA, 22 bp, Homo sapiens
ccaggtagccaaggggtctggg

SEQ ID NO: 25704 - DNA, 22 bp, Homo sapiens
ttctttgcccatgtttcctaag

SEQ ID NO: 25705 - DNA, 22 bp, Homo sapiens
gaagctgagctgaggcatgttg

SEQ ID NO: 25706 - DNA, 20 bp, Homo sapiens
tcccagtctttggtctgagc

SEQ ID NO: 25707 - DNA, 22 bp, Homo sapiens
taggcatgcaaataaatgtgca

SEQ ID NO: 25708 - DNA, 22 bp, Homo sapiens
aaagtgctgggattccaggcgt

SEQ ID NO: 25709 - DNA, 22 bp, Homo sapiens
gtgggcatcaccagggcctcca

SEQ ID NO: 25710 - DNA, 22 bp, Homo sapiens
gagagtctaggaacctcatata

SEQ ID NO: 25711 - DNA, 22 bp, Homo sapiens
cgtcacttcttagtctattttc

SEQ ID NO: 25712 - DNA, 22 bp, Homo sapiens
tggcagtggcgggactcagggc

SEQ ID NO: 25713 - DNA, 22 bp, Homo sapiens
ggtggctgcaatggctaacttc

SEQ ID NO: 25714 - DNA, 22 bp, Homo sapiens
ctgccaggattctgtgaacccc

SEQ ID NO: 25715 - DNA, 22 bp, Homo sapiens
tgcctgcctaggaagctgtgaa

SEQ ID NO: 25716 - DNA, 22 bp, Homo sapiens
aaggagtggggcatatcacaga

SEQ ID NO: 25717 - DNA, 22 bp, Homo sapiens
tgcctcaagccctccactgcac

SEQ ID NO: 25718 - DNA, 22 bp, Homo sapiens
aactatgttaataagtttcatt

SEQ ID NO: 25719 - DNA, 22 bp, Homo sapiens
ttgcccaggctggagtgcagtg

SEQ ID NO: 25720 - DNA, 22 bp, Homo sapiens
ggactgggaatcagggagatgc

SEQ ID NO: 25721 - DNA, 19 bp, Homo sapiens
ggcatggggtccggggacc

SEQ ID NO: 25722 - DNA, 22 bp, Homo sapiens
agggaagtggtctgggaacttg

SEQ ID NO: 25723 - DNA, 21 bp, Homo sapiens
tgctgggtttgcccatcaggc

SEQ ID NO: 25724 - DNA, 22 bp, Homo sapiens
ggtagtcggccttgccctgggc

SEQ ID NO: 25725 - DNA, 22 bp, Homo sapiens
gcaccctgtcaaaatggaccaa

SEQ ID NO: 25726 - DNA, 18 bp, Homo sapiens
tggaggaaaaatctcatg

SEQ ID NO: 25727 - DNA, 22 bp, Homo sapiens
ttccagtcacaaaacatattaa

SEQ ID NO: 25728 - DNA, 21 bp, Homo sapiens
gagagctaacagtgacagctc

SEQ ID NO: 25729 - DNA, 22 bp, Homo sapiens
cattgcactccagcctgggtaa

SEQ ID NO: 25730 - DNA, 22 bp, Homo sapiens
gaataatcatgaaattcagtga

SEQ ID NO: 25731 - DNA, 22 bp, Homo sapiens
actgcaacctccgcctgccagg

SEQ ID NO: 25732 - DNA, 22 bp, Homo sapiens
ctgtggctcaggcctgtaagcc

SEQ ID NO: 25733 - DNA, 22 bp, Homo sapiens
gcgacgcaggcacgacgtgttg

SEQ ID NO: 25734 - DNA, 22 bp, Homo sapiens
caagtagaacagagctaccttg

SEQ ID NO: 25735 - DNA, 22 bp, Homo sapiens
ttcttctcagggtcccacatgg

SEQ ID NO: 25736 - DNA, 22 bp, Homo sapiens
cccaggaggtcgaagctgcagt

SEQ ID NO: 25737 - DNA, 22 bp, Homo sapiens
cccagaaggtcgaggctgcagt

SEQ ID NO: 25738 - DNA, 22 bp, Homo sapiens
cttctcaaagttgtgaatcagg

SEQ ID NO: 25739 - DNA, 22 bp, Homo sapiens
gggacatctttctagtcagggt

SEQ ID NO: 25740 - DNA, 22 bp, Homo sapiens
ggcaagagggcagatggagtgc

SEQ ID NO: 25741 - DNA, 22 bp, Homo sapiens
ctgagggtcaacttgattgtat

SEQ ID NO: 25742 - DNA, 22 bp, Homo sapiens
gctgggctgcgtcggggaagcc

SEQ ID NO: 25743 - DNA, 22 bp, Homo sapiens
tcatcataatatggaatcttgt

SEQ ID NO: 25744 - DNA, 22 bp, Homo sapiens
gtcctgacggctgattggcctg

SEQ ID NO: 25745 - DNA, 21 bp, Homo sapiens
acataggcgaatgttcgggag

SEQ ID NO: 25746 - DNA, 20 bp, Homo sapiens
caaatccctgctctgtgctg

SEQ ID NO: 25747 - DNA, 22 bp, Homo sapiens
taatgtataacaaatactcatc

SEQ ID NO: 25748 - DNA, 22 bp, Homo sapiens
tgtgctctgactttctcctggt

SEQ ID NO: 25749 - DNA, 22 bp, Homo sapiens
aaagttctctatggtgtaaaaa

SEQ ID NO: 25750 - DNA, 20 bp, Homo sapiens
acgtggccaccagtggctta

SEQ ID NO: 25751 - DNA, 22 bp, Homo sapiens
actagaaagaagttttttgaga

SEQ ID NO: 25752 - DNA, 22 bp, Homo sapiens
tacccagtgccaccctctgagg

SEQ ID NO: 25753 - DNA, 22 bp, Homo sapiens
agtccggggtctggacacctgg

SEQ ID NO: 25754 - DNA, 22 bp, Homo sapiens
ggtgttcaaatgaacacatgca

SEQ ID NO: 25755 - DNA, 22 bp, Homo sapiens
ttgcatgttccaaagaattttg

SEQ ID NO: 25756 - DNA, 22 bp, Homo sapiens
ttgagtgtactttagtcatctg

SEQ ID NO: 25757 - DNA, 22 bp, Homo sapiens
tagagctggccgggacagctgg

SEQ ID NO: 25758 - DNA, 22 bp, Homo sapiens
atcgccgaggtcctgctccaag

SEQ ID NO: 25759 - DNA, 22 bp, Homo sapiens
atacataattacttccgatgtt

SEQ ID NO: 25760 - DNA, 22 bp, Homo sapiens
tcactgcaacctctgcctcccg

SEQ ID NO: 25761 - DNA, 22 bp, Homo sapiens
cagtgcccgccgccgttcctgg

SEQ ID NO: 25762 - DNA, 22 bp, Homo sapiens
accagcacttccagaggtcagg

SEQ ID NO: 25763 - DNA, 22 bp, Homo sapiens
ggctgggcaggtctgcacaggg

SEQ ID NO: 25764 - DNA, 22 bp, Homo sapiens
gcagctctatgtgatggtaaat

SEQ ID NO: 25765 - DNA, 22 bp, Homo sapiens
aaagtgctgggattataggcat

SEQ ID NO: 25766 - DNA, 22 bp, Homo sapiens
aaggtggaggttgcagtgagct

SEQ ID NO: 25767 - DNA, 22 bp, Homo sapiens
aaggctgagacagcacaggtcc

SEQ ID NO: 25768 - DNA, 22 bp, Homo sapiens
ctggctcctgtttaaccagctg

SEQ ID NO: 25769 - DNA, 22 bp, Homo sapiens
ttatgatttgccacagattggt

SEQ ID NO: 25770 - DNA, 22 bp, Homo sapiens
gtgctttgtcttcaggatcata

SEQ ID NO: 25771 - DNA, 22 bp, Homo sapiens
cgcaactcagcaacttaactgc

SEQ ID NO: 25772 - DNA, 22 bp, Homo sapiens
ggtgaggggctcctctgcccgg

SEQ ID NO: 25773 - DNA, 22 bp, Homo sapiens
tccttagacaaagagtgggctt

SEQ ID NO: 25774 - DNA, 22 bp, Homo sapiens
gatctggaatctgaaggctgag

SEQ ID NO: 25775 - DNA, 22 bp, Homo sapiens
tccaggattgcaggtgcacaac

SEQ ID NO: 25776 - DNA, 22 bp, Homo sapiens
attgagaagaaaatctaatata

SEQ ID NO: 25777 - DNA, 22 bp, Homo sapiens
ggctgtggagctgcagagttgg

SEQ ID NO: 25778 - DNA, 22 bp, Homo sapiens
acacagggctgcgcctgacccc

SEQ ID NO: 25779 - DNA, 22 bp, Homo sapiens
acgatgatgaaagagaacattc

SEQ ID NO: 25780 - DNA, 22 bp, Homo sapiens
tgccatagcaatggtaagctga

SEQ ID NO: 25781 - DNA, 22 bp, Homo sapiens
tctgtgagaaccagtgccaggg

SEQ ID NO: 25782 - DNA, 22 bp, Homo sapiens
gagtttcttcatggtgcagagg

SEQ ID NO: 25783 - DNA, 22 bp, Homo sapiens
acctcctccaaggagccatagg

SEQ ID NO: 25784 - DNA, 22 bp, Homo sapiens
atatgggggggcgtgcagagga

SEQ ID NO: 25785 - DNA, 22 bp, Homo sapiens
ggagagcagggaggctgctctg

SEQ ID NO: 25786 - DNA, 22 bp, Homo sapiens
caccagcagcggtgtgagggtg

SEQ ID NO: 25787 - DNA, 22 bp, Homo sapiens
cgggcagtgtggctccagagtc

SEQ ID NO: 25788 - DNA, 22 bp, Homo sapiens
ccgggaggcagaggttgcagtg

SEQ ID NO: 25789 - DNA, 22 bp, Homo sapiens
ctgggaggcagaggttgtagtg

SEQ ID NO: 25790 - DNA, 22 bp, Homo sapiens
tggcaggcgggagccatagagg

SEQ ID NO: 25791 - DNA, 22 bp, Homo sapiens
gcaccaggtgcagccgggcccc

SEQ ID NO: 25792 - DNA, 19 bp, Homo sapiens
ttttggaaatgtgaacagc

SEQ ID NO: 25793 - DNA, 22 bp, Homo sapiens
tgtaatcccagctactcgggag

SEQ ID NO: 25794 - DNA, 19 bp, Homo sapiens
cccaggaagcggaggttgc

SEQ ID NO: 25795 - DNA, 22 bp, Homo sapiens
ttggaggcaatgggaaggaggc

SEQ ID NO: 25796 - DNA, 22 bp, Homo sapiens
ttaggtcacatcggtgaccaaa

SEQ ID NO: 25797 - DNA, 22 bp, Homo sapiens
ttgcactataggaaaatgtgtc

SEQ ID NO: 25798 - DNA, 22 bp, Homo sapiens
tggtctgtcccactctgccctt

SEQ ID NO: 25799 - DNA, 22 bp, Homo sapiens
aggggttggacataagacagaa

SEQ ID NO: 25800 - DNA, 17 bp, Homo sapiens
ggcctgcacctcctgct

SEQ ID NO: 25801 - DNA, 22 bp, Homo sapiens
gcagtgccgaaggtagtggttg

SEQ ID NO: 25802 - DNA, 22 bp, Homo sapiens
gtcggccacgcaggtgcggtag

SEQ ID NO: 25803 - DNA, 22 bp, Homo sapiens
ggacctgaacataaaacgaggc

SEQ ID NO: 25804 - DNA, 22 bp, Homo sapiens
ttttgcaatgagatgcttgtca

SEQ ID NO: 25805 - DNA, 22 bp, Homo sapiens
ccagcttgaagatgtgctggtt

SEQ ID NO: 25806 - DNA, 22 bp, Homo sapiens
accccagaggcggaggctgcag

SEQ ID NO: 25807 - DNA, 22 bp, Homo sapiens
gggagtgtgcacacatggtata

SEQ ID NO: 25808 - DNA, 20 bp, Homo sapiens
tgaggcccagcagagtcggg

SEQ ID NO: 25809 - DNA, 22 bp, Homo sapiens
tctgcaacagtgccctgtaaat

SEQ ID NO: 25810 - DNA, 22 bp, Homo sapiens
tagaagaaagtgaagctgggga

SEQ ID NO: 25811 - DNA, 22 bp, Homo sapiens
gtccttccacatggccaacttc

SEQ ID NO: 25812 - DNA, 22 bp, Homo sapiens
tcaccaccagaagagctattct

SEQ ID NO: 25813 - DNA, 22 bp, Homo sapiens
ccaggaggcagaagttgcagtg

SEQ ID NO: 25814 - DNA, 22 bp, Homo sapiens
cggaggttgaggctgcagtgag

SEQ ID NO: 25815 - DNA, 22 bp, Homo sapiens
gggggactggaccgtcctgggt

SEQ ID NO: 25816 - DNA, 22 bp, Homo sapiens
tgcaggcctggactgatgtggt

SEQ ID NO: 25817 - DNA, 22 bp, Homo sapiens
gtgggcatctccttggaagcca

SEQ ID NO: 25818 - DNA, 22 bp, Homo sapiens
ctggtagtttgcaaaatggtgt

SEQ ID NO: 25819 - DNA, 22 bp, Homo sapiens
ctgggaagaagggacaacagcg

SEQ ID NO: 25820 - DNA, 22 bp, Homo sapiens
ctgggcgcgtcccctgaggcgg

SEQ ID NO: 25821 - DNA, 22 bp, Homo sapiens
atgggtaaagcaggaagagagt

SEQ ID NO: 25822 - DNA, 22 bp, Homo sapiens
tagctgcttgaccaggcagtgg

SEQ ID NO: 25823 - DNA, 22 bp, Homo sapiens
cctgcacagccggacccctgct

SEQ ID NO: 25824 - DNA, 22 bp, Homo sapiens
tcaaaattaaaccaacgtccag

SEQ ID NO: 25825 - DNA, 22 bp, Homo sapiens
gaactagaatgttctgatggag

SEQ ID NO: 25826 - DNA, 22 bp, Homo sapiens
cctgcctatgagacgttttgcc

SEQ ID NO: 25827 - DNA, 22 bp, Homo sapiens
agaggcaggaggttgacttgag

SEQ ID NO: 25828 - DNA, 22 bp, Homo sapiens
ctgagctcacgccattctcctt

SEQ ID NO: 25829 - DNA, 22 bp, Homo sapiens
caggtagaggctgccatcagct

SEQ ID NO: 25830 - DNA, 22 bp, Homo sapiens
ctcactgcaagctctgcctccc

SEQ ID NO: 25831 - DNA, 22 bp, Homo sapiens
ctttggaacacccagctctgtg

SEQ ID NO: 25832 - DNA, 22 bp, Homo sapiens
acctctgtacctcctctgacag

SEQ ID NO: 25833 - DNA, 22 bp, Homo sapiens
ttatttaatgtgatctgaagag

SEQ ID NO: 25834 - DNA, 22 bp, Homo sapiens
ttgcacagaatgacaatatgta

SEQ ID NO: 25835 - DNA, 22 bp, Homo sapiens
gcgggttgaagggcgcatcgaa

SEQ ID NO: 25836 - DNA, 22 bp, Homo sapiens
agcaggcctgccacctcggggt

SEQ ID NO: 25837 - DNA, 22 bp, Homo sapiens
gatgtgtttccaggatttgttt

SEQ ID NO: 25838 - DNA, 19 bp, Homo sapiens
gcctcatttccacctcccc

SEQ ID NO: 25839 - DNA, 22 bp, Homo sapiens
gaccttcttgctgtgtcctaac

SEQ ID NO: 25840 - DNA, 22 bp, Homo sapiens
ggtgacctcacctggtcccacc

SEQ ID NO: 25841 - DNA, 22 bp, Homo sapiens
ttgtctctggaaggaaaaagca

SEQ ID NO: 25842 - DNA, 22 bp, Homo sapiens
gacatagctcagagctcagcac

SEQ ID NO: 25843 - DNA, 22 bp, Homo sapiens
cggggccctggggctgaaggtc

SEQ ID NO: 25844 - DNA, 22 bp, Homo sapiens
gtagatgagctcacatgacctt

SEQ ID NO: 25845 - DNA, 22 bp, Homo sapiens
gtgaccatcatctcagctagtt

SEQ ID NO: 25846 - DNA, 22 bp, Homo sapiens
gagtccaagctagagccactca

SEQ ID NO: 25847 - DNA, 22 bp, Homo sapiens
accctggacatcttgtcatagc

SEQ ID NO: 25848 - DNA, 22 bp, Homo sapiens
ttcttcagcctaccttgacctc

SEQ ID NO: 25849 - DNA, 22 bp, Homo sapiens
ttggaggttccatgatttgtct

SEQ ID NO: 25850 - DNA, 22 bp, Homo sapiens
cccaggaagtggaggttgcagt

SEQ ID NO: 25851 - DNA, 22 bp, Homo sapiens
gtgtgggctgcagaggcacagc

SEQ ID NO: 25852 - DNA, 22 bp, Homo sapiens
tgtgaatggacaattaaatcta

SEQ ID NO: 25853 - DNA, 22 bp, Homo sapiens
tgagccaggagtttgaggctgt

SEQ ID NO: 25854 - DNA, 22 bp, Homo sapiens
ggccttggcctagccctccagg

SEQ ID NO: 25855 - DNA, 22 bp, Homo sapiens
gctcactgcaagctccgcctcc

SEQ ID NO: 25856 - DNA, 22 bp, Homo sapiens
gaggctgaggttgcagtgagct

SEQ ID NO: 25857 - DNA, 22 bp, Homo sapiens
actatagatgctggcgaggctg

SEQ ID NO: 25858 - DNA, 22 bp, Homo sapiens
gttcagaaattaggagaataaa

SEQ ID NO: 25859 - DNA, 22 bp, Homo sapiens
gagagagctctgtgcctgggat

SEQ ID NO: 25860 - DNA, 22 bp, Homo sapiens
attggtggtgaggacatgccag

SEQ ID NO: 25861 - DNA, 22 bp, Homo sapiens
tgcgcctctaatctcgggcgtc

SEQ ID NO: 25862 - DNA, 22 bp, Homo sapiens
cagagactggagtgcagtggcg

SEQ ID NO: 25863 - DNA, 22 bp, Homo sapiens
tcttcaggtagtgagtggggtg

SEQ ID NO: 25864 - DNA, 22 bp, Homo sapiens
acagtctgtcccccaggtgcta

SEQ ID NO: 25865 - DNA, 19 bp, Homo sapiens
tgaaggacagtgcacatca

SEQ ID NO: 25866 - DNA, 22 bp, Homo sapiens
ttttggccacatccttttgagt

SEQ ID NO: 25867 - DNA, 22 bp, Homo sapiens
gcctccggagttgcagtgtctt

SEQ ID NO: 25868 - DNA, 22 bp, Homo sapiens
caagtgatcctcccatcttggc

SEQ ID NO: 25869 - DNA, 18 bp, Homo sapiens
ggctggataccttaggaa

SEQ ID NO: 25870 - DNA, 22 bp, Homo sapiens
tcctgggacaagccgtggaagt

SEQ ID NO: 25871 - DNA, 22 bp, Homo sapiens
ttgggctcaggagtttgagacc

SEQ ID NO: 25872 - DNA, 22 bp, Homo sapiens
gtgcaattcactgttatgtctg

SEQ ID NO: 25873 - DNA, 22 bp, Homo sapiens
gcagggtttagcacctgtagct

SEQ ID NO: 25874 - DNA, 22 bp, Homo sapiens
tcacaaatgtttgcatgtgtct

SEQ ID NO: 25875 - DNA, 22 bp, Homo sapiens
atttactttgctgagatccatc

SEQ ID NO: 25876 - DNA, 22 bp, Homo sapiens
agaaatatgctgattagatgaa

SEQ ID NO: 25877 - DNA, 22 bp, Homo sapiens
agtgagagtattaatgtgaact

SEQ ID NO: 25878 - DNA, 22 bp, Homo sapiens
ccacccttgggttcggaggccg

SEQ ID NO: 25879 - DNA, 18 bp, Homo sapiens
gcagctagccaggggggc

SEQ ID NO: 25880 - DNA, 22 bp, Homo sapiens
ggggatggaggcgtgtggtcct

SEQ ID NO: 25881 - DNA, 22 bp, Homo sapiens
atctcctggtccacccgggcgg

SEQ ID NO: 25882 - DNA, 22 bp, Homo sapiens
taaagctctgggtttctagatc

SEQ ID NO: 25883 - DNA, 23 bp, Homo sapiens
ccccactaccgtgatgtgcgagg

SEQ ID NO: 25884 - DNA, 22 bp, Homo sapiens
atttagaactttgtttgccaat

SEQ ID NO: 25885 - DNA, 22 bp, Homo sapiens
taaagattgctcaaaactgtga

SEQ ID NO: 25886 - DNA, 22 bp, Homo sapiens
ccggcgccttcacggggcttag

SEQ ID NO: 25887 - DNA, 22 bp, Homo sapiens
agcgctgtgggcgtgcgaggag

SEQ ID NO: 25888 - DNA, 21 bp, Homo sapiens
cgcagagcgaacttgcggcgc

SEQ ID NO: 25889 - DNA, 23 bp, Homo sapiens
aagtggttttgaacccggaccct

SEQ ID NO: 25890 - DNA, 22 bp, Homo sapiens
gcaggcaggcttccttgaactg

SEQ ID NO: 25891 - DNA, 22 bp, Homo sapiens
gagatgggcgagaaggtggact

SEQ ID NO: 25892 - DNA, 23 bp, Homo sapiens
ccaagactgttaggagtggggag

SEQ ID NO: 25893 - DNA, 22 bp, Homo sapiens
tgtgtctgtgtatacacggcat

SEQ ID NO: 25894 - DNA, 22 bp, Homo sapiens
tgagcccagagatctgagctat

SEQ ID NO: 25895 - DNA, 22 bp, Homo sapiens
acgcctgtaatcccagcacttt

SEQ ID NO: 25896 - DNA, 22 bp, Homo sapiens
caaagtgctggaattacaggtg

SEQ ID NO: 25897 - DNA, 22 bp, Homo sapiens
tcttcctggatgggggttgatg

SEQ ID NO: 25898 - DNA, 22 bp, Homo sapiens
gcagagctcatgcctgcacctc

SEQ ID NO: 25899 - DNA, 22 bp, Homo sapiens
tctgcaacattcctctccccac

SEQ ID NO: 25900 - DNA, 22 bp, Homo sapiens
agatttatgtggtcacactcag

SEQ ID NO: 25901 - DNA, 22 bp, Homo sapiens
tgaaggtgggaattcaccaggt

SEQ ID NO: 25902 - DNA, 22 bp, Homo sapiens
atcatccaagcgtagttcttct

SEQ ID NO: 25903 - DNA, 22 bp, Homo sapiens
aggctccctgaatcgcccgttc

SEQ ID NO: 25904 - DNA, 22 bp, Homo sapiens
atggctgcctgggcgctggccg

SEQ ID NO: 25905 - DNA, 22 bp, Homo sapiens
agcttttagctcctggttgcaa

SEQ ID NO: 25906 - DNA, 22 bp, Homo sapiens
aaacaacctaaagttactgatc

SEQ ID NO: 25907 - DNA, 22 bp, Homo sapiens
tgtgtctcaagtcagagcatca

SEQ ID NO: 25908 - DNA, 22 bp, Homo sapiens
cctgcctactgagttttatatt

SEQ ID NO: 25909 - DNA, 22 bp, Homo sapiens
acggcctggtgcagcaggtcgc

SEQ ID NO: 25910 - DNA, 22 bp, Homo sapiens
gcttttcatgacaactcagcga

SEQ ID NO: 25911 - DNA, 22 bp, Homo sapiens
ggagtgcagtggcgtgagctcg

SEQ ID NO: 25912 - DNA, 22 bp, Homo sapiens
ggtctcttgtccaaggtcacac

SEQ ID NO: 25913 - DNA, 22 bp, Homo sapiens
tgggaggtgattaaattatggg

SEQ ID NO: 25914 - DNA, 22 bp, Homo sapiens
gggaagagggagctggaatgat

SEQ ID NO: 25915 - DNA, 22 bp, Homo sapiens
ctcagggccaaggatgctgttg

SEQ ID NO: 25916 - DNA, 22 bp, Homo sapiens
tggccttgagagatcaaaaggt

SEQ ID NO: 25917 - DNA, 22 bp, Homo sapiens
atgcagtggcttcagtgtcagt

SEQ ID NO: 25918 - DNA, 22 bp, Homo sapiens
aagtttgtgtagtttagcatcc

SEQ ID NO: 25919 - DNA, 22 bp, Homo sapiens
ctcccgaggagcctcagcgctc

SEQ ID NO: 25920 - DNA, 22 bp, Homo sapiens
tattatccaaagagctgggagc

SEQ ID NO: 25921 - DNA, 22 bp, Homo sapiens
aaagtgctaggattacaagcgt

SEQ ID NO: 25922 - DNA, 22 bp, Homo sapiens
gacggagctggttgctgcggct

SEQ ID NO: 25923 - DNA, 22 bp, Homo sapiens
aggatttctgtgcctggaaaat

SEQ ID NO: 25924 - DNA, 22 bp, Homo sapiens
tgtgagttcttagaaagtcagt

SEQ ID NO: 25925 - DNA, 22 bp, Homo sapiens
gcgggcgggggttcccaggtct

SEQ ID NO: 25926 - DNA, 22 bp, Homo sapiens
gtcaccagtgctaagaggtgga

SEQ ID NO: 25927 - DNA, 22 bp, Homo sapiens
attaagtgttttacatacatta

SEQ ID NO: 25928 - DNA, 22 bp, Homo sapiens
cattggccttttatcctagagg

SEQ ID NO: 25929 - DNA, 22 bp, Homo sapiens
ttgagaaccactgagttagata

SEQ ID NO: 25930 - DNA, 22 bp, Homo sapiens
gatgaatgatggcttgtttctg

SEQ ID NO: 25931 - DNA, 22 bp, Homo sapiens
tctgactcccatattccacttc

SEQ ID NO: 25932 - DNA, 22 bp, Homo sapiens
tgttcttgagcctttagaccta

SEQ ID NO: 25933 - DNA, 22 bp, Homo sapiens
caaatactacgattcttgcagt

SEQ ID NO: 25934 - DNA, 22 bp, Homo sapiens
tttgcattgcattaagtattct

SEQ ID NO: 25935 - DNA, 22 bp, Homo sapiens
cttgtccgaggagacgcggaag

SEQ ID NO: 25936 - DNA, 22 bp, Homo sapiens
tgcgatgcaacagcttggcgga

SEQ ID NO: 25937 - DNA, 22 bp, Homo sapiens
ctcctccacccgctggggccca

SEQ ID NO: 25938 - DNA, 22 bp, Homo sapiens
gacaagctcccggtggccctcc

SEQ ID NO: 25939 - DNA, 19 bp, Homo sapiens
gctgttaaggaccctcgga

SEQ ID NO: 25940 - DNA, 22 bp, Homo sapiens
tggttcagttgcacaggctgtt

SEQ ID NO: 25941 - DNA, 22 bp, Homo sapiens
ccgcgccacccattcccactga

SEQ ID NO: 25942 - DNA, 21 bp, Homo sapiens
acctgagctccacctcctgcc

SEQ ID NO: 25943 - DNA, 22 bp, Homo sapiens
tgctggtaccgcgcctccgcca

SEQ ID NO: 25944 - DNA, 21 bp, Homo sapiens
tttgtggaattctcactcttc

SEQ ID NO: 25945 - DNA, 22 bp, Homo sapiens
ggctgatgggcatgagctgtca

SEQ ID NO: 25946 - DNA, 22 bp, Homo sapiens
ggagcatgcgctctgtgaccga

SEQ ID NO: 25947 - DNA, 22 bp, Homo sapiens
aatttaagagcatagctccaac

SEQ ID NO: 25948 - DNA, 23 bp, Homo sapiens
acctgtctgcctcccaccatcaa

SEQ ID NO: 25949 - DNA, 22 bp, Homo sapiens
atagaatatgacttttagatcc

SEQ ID NO: 25950 - DNA, 22 bp, Homo sapiens
actgcactccaacctgggtgac

SEQ ID NO: 25951 - DNA, 22 bp, Homo sapiens
actgcactccagcctgggtaac

SEQ ID NO: 25952 - DNA, 22 bp, Homo sapiens
taagcctgcatgaaccatgaga

SEQ ID NO: 25953 - DNA, 22 bp, Homo sapiens
acagcagcaatagcagtgacat

SEQ ID NO: 25954 - DNA, 22 bp, Homo sapiens
gaggcagaggttgttgcagtga

SEQ ID NO: 25955 - DNA, 22 bp, Homo sapiens
tacagtcacattctgaggtctt

SEQ ID NO: 25956 - DNA, 22 bp, Homo sapiens
cgatcaccgtggccactttgag

SEQ ID NO: 25957 - DNA, 22 bp, Homo sapiens
ccaattttattcttctgcaagt

SEQ ID NO: 25958 - DNA, 22 bp, Homo sapiens
aaacactcatgtgttactctcc

SEQ ID NO: 25959 - DNA, 19 bp, Homo sapiens
aggaatggaattaattctg

SEQ ID NO: 25960 - DNA, 22 bp, Homo sapiens
ctgaaatgacggtttggggcaa

SEQ ID NO: 25961 - DNA, 17 bp, Homo sapiens
cagtcgaggaggacctg

SEQ ID NO: 25962 - DNA, 22 bp, Homo sapiens
ctgaagagaaagggagctcttc

SEQ ID NO: 25963 - DNA, 22 bp, Homo sapiens
ggatcagggctggggatattct

SEQ ID NO: 25964 - DNA, 22 bp, Homo sapiens
tatactacgcaccaaacaaagg

SEQ ID NO: 25965 - DNA, 22 bp, Homo sapiens
tggtcacctatagaggagatgt

SEQ ID NO: 25966 - DNA, 22 bp, Homo sapiens
aggctcgcatgccctgcaccac

SEQ ID NO: 25967 - DNA, 20 bp, Homo sapiens
gggcagagccagccagtccc

SEQ ID NO: 25968 - DNA, 22 bp, Homo sapiens
ggtggcctgttttcaggtttgc

SEQ ID NO: 25969 - DNA, 22 bp, Homo sapiens
gtgggccttcaaccctgtctgg

SEQ ID NO: 25970 - DNA, 22 bp, Homo sapiens
tccgccaggactgagggcccat

SEQ ID NO: 25971 - DNA, 22 bp, Homo sapiens
ttaattctgcctttcatgtaac

SEQ ID NO: 25972 - DNA, 22 bp, Homo sapiens
aggtgtctggacttgtgaagca

SEQ ID NO: 25973 - DNA, 17 bp, Homo sapiens
ggctgcagtccaggagg

SEQ ID NO: 25974 - DNA, 22 bp, Homo sapiens
ggttccccaggcggcccttgga

SEQ ID NO: 25975 - DNA, 22 bp, Homo sapiens
aaggcaaggcttccagctcccc

SEQ ID NO: 25976 - DNA, 22 bp, Homo sapiens
aagcctaggcctactctggttt

SEQ ID NO: 25977 - DNA, 22 bp, Homo sapiens
ggcaggaacacagatggtgccg

SEQ ID NO: 25978 - DNA, 22 bp, Homo sapiens
ctgctcctgtccagcagggcca

SEQ ID NO: 25979 - DNA, 22 bp, Homo sapiens
agcgcccaggggcagggctctc

SEQ ID NO: 25980 - DNA, 22 bp, Homo sapiens
ggaaggggtgggtgagcctcag

SEQ ID NO: 25981 - DNA, 22 bp, Homo sapiens
tcttatacccctaaactgcagc

SEQ ID NO: 25982 - DNA, 20 bp, Homo sapiens
tgatatggtttggctgtgtt

SEQ ID NO: 25983 - DNA, 22 bp, Homo sapiens
ctctcgccagcggggctgcgct

SEQ ID NO: 25984 - DNA, 22 bp, Homo sapiens
ctgaggggatgtttttgacgga

SEQ ID NO: 25985 - DNA, 22 bp, Homo sapiens
tggcaagaaccgcaattacttt

SEQ ID NO: 25986 - DNA, 22 bp, Homo sapiens
gaagggaactgggtctccttgt

SEQ ID NO: 25987 - DNA, 20 bp, Homo sapiens
actgcactccagccttccag

SEQ ID NO: 25988 - DNA, 22 bp, Homo sapiens
gttctgggagatcttgagcttc

SEQ ID NO: 25989 - DNA, 22 bp, Homo sapiens
ccatgaattcactccatgctag

SEQ ID NO: 25990 - DNA, 22 bp, Homo sapiens
tttggtattgcacactgtcttc

SEQ ID NO: 25991 - DNA, 22 bp, Homo sapiens
ttaaacatttatggaggcagca

SEQ ID NO: 25992 - DNA, 22 bp, Homo sapiens
aaccccgctcaggctgggtgag

SEQ ID NO: 25993 - DNA, 22 bp, Homo sapiens
cccatgcaccctctaagaagga

SEQ ID NO: 25994 - DNA, 22 bp, Homo sapiens
tcctcagtcacggtagcacatt

SEQ ID NO: 25995 - DNA, 21 bp, Homo sapiens
tcactagtgccttctgtcatt

SEQ ID NO: 25996 - DNA, 22 bp, Homo sapiens
agctgctgagccaggctgatgt

SEQ ID NO: 25997 - DNA, 22 bp, Homo sapiens
gatccttcagttcgatggggat

SEQ ID NO: 25998 - DNA, 17 bp, Homo sapiens
tggctctgtcctcagct

SEQ ID NO: 25999 - DNA, 22 bp, Homo sapiens
cactctcagcataatgaatgtg

SEQ ID NO: 26000 - DNA, 20 bp, Homo sapiens
aaacgagccatcattctggt

SEQ ID NO: 26001 - DNA, 22 bp, Homo sapiens
gctgccgacccacaggggttaa

SEQ ID NO: 26002 - DNA, 22 bp, Homo sapiens
catgaaattgtattggcctcaa

SEQ ID NO: 26003 - DNA, 22 bp, Homo sapiens
atgtgggccgtgcgggtgtcct

SEQ ID NO: 26004 - DNA, 22 bp, Homo sapiens
ctccaggctcgtccaagatcga

SEQ ID NO: 26005 - DNA, 23 bp, Homo sapiens
gcctgccgcctggctgagaactg

SEQ ID NO: 26006 - DNA, 22 bp, Homo sapiens
attgcactccagcctgggggac

SEQ ID NO: 26007 - DNA, 22 bp, Homo sapiens
ttgatacccaagtgttatgggt

SEQ ID NO: 26008 - DNA, 22 bp, Homo sapiens
gtgggggagatgcttaggtccg

SEQ ID NO: 26009 - DNA, 22 bp, Homo sapiens
gatatcatgggaaggtgtactt

SEQ ID NO: 26010 - DNA, 22 bp, Homo sapiens
ggcagggcaggaaagtcaggaa

SEQ ID NO: 26011 - DNA, 22 bp, Homo sapiens
ccactgcactccagcctgccaa

SEQ ID NO: 26012 - DNA, 20 bp, Homo sapiens
gggactgtcccatcctcatc

SEQ ID NO: 26013 - DNA, 22 bp, Homo sapiens
gcctgctcccagttggcgcctc

SEQ ID NO: 26014 - DNA, 22 bp, Homo sapiens
acccggcggagcctgcagtgag

SEQ ID NO: 26015 - DNA, 22 bp, Homo sapiens
gcaagacctatctagttgctgt

SEQ ID NO: 26016 - DNA, 22 bp, Homo sapiens
tgcaatccccgcctcaacagga

SEQ ID NO: 26017 - DNA, 22 bp, Homo sapiens
caatttgccctgttaaattttc

SEQ ID NO: 26018 - DNA, 22 bp, Homo sapiens
agcaggaaggggatgatgggca

SEQ ID NO: 26019 - DNA, 22 bp, Homo sapiens
agtgaccgaggcacttggcaac

SEQ ID NO: 26020 - DNA, 22 bp, Homo sapiens
catctgctgttccttggactca

SEQ ID NO: 26021 - DNA, 22 bp, Homo sapiens
taggcctggatctctgggagca

SEQ ID NO: 26022 - DNA, 22 bp, Homo sapiens
gccactgagcccggccattgtt

SEQ ID NO: 26023 - DNA, 22 bp, Homo sapiens
agagcagctcgctacctctcta

SEQ ID NO: 26024 - DNA, 22 bp, Homo sapiens
cacatttttactgccaacttaa

SEQ ID NO: 26025 - DNA, 22 bp, Homo sapiens
ataatggaggaagctatgtgga

SEQ ID NO: 26026 - DNA, 22 bp, Homo sapiens
tgggaagggtcaacagctggaa

SEQ ID NO: 26027 - DNA, 20 bp, Homo sapiens
ggtcactgtggctgcaggat

SEQ ID NO: 26028 - DNA, 22 bp, Homo sapiens
tgtttcaaattacttgaggatt

SEQ ID NO: 26029 - DNA, 22 bp, Homo sapiens
ccagccgcggtgagggtggctg

SEQ ID NO: 26030 - DNA, 22 bp, Homo sapiens
aaccaccattctctcctcttcc

SEQ ID NO: 26031 - DNA, 22 bp, Homo sapiens
cctactctgagcgcctccgcat

SEQ ID NO: 26032 - DNA, 22 bp, Homo sapiens
ttaccaaatgaaatagagattt

SEQ ID NO: 26033 - DNA, 22 bp, Homo sapiens
cggatcctcagtcgtgcgggag

SEQ ID NO: 26034 - DNA, 22 bp, Homo sapiens
ttaataaagtatgaattggaaa

SEQ ID NO: 26035 - DNA, 22 bp, Homo sapiens
tgccctttatttctggggcaga

SEQ ID NO: 26036 - DNA, 22 bp, Homo sapiens
gagggaaaggttaatacatgat

SEQ ID NO: 26037 - DNA, 22 bp, Homo sapiens
tgtcaccatgcgaggctaattt

SEQ ID NO: 26038 - DNA, 22 bp, Homo sapiens
gtcttgggacccgcactgtggg

SEQ ID NO: 26039 - DNA, 22 bp, Homo sapiens
tagccgggtgtggtggaactcc

SEQ ID NO: 26040 - DNA, 22 bp, Homo sapiens
aaatgcctcattttctctcact

SEQ ID NO: 26041 - DNA, 22 bp, Homo sapiens
atgatactctaggtgatttaca

SEQ ID NO: 26042 - DNA, 22 bp, Homo sapiens
ttcccactgtggcagagcctcg

SEQ ID NO: 26043 - DNA, 22 bp, Homo sapiens
cctgggaggctgaggctgcagt

SEQ ID NO: 26044 - DNA, 19 bp, Homo sapiens
acccagcccaggagtggca

SEQ ID NO: 26045 - DNA, 22 bp, Homo sapiens
tctcatttacttccacaggctg

SEQ ID NO: 26046 - DNA, 22 bp, Homo sapiens
ggctgacttttatgcacactaa

SEQ ID NO: 26047 - DNA, 22 bp, Homo sapiens
ttgccttgttattctctcagaa

SEQ ID NO: 26048 - DNA, 22 bp, Homo sapiens
cagtttcttcctcccccagaga

SEQ ID NO: 26049 - DNA, 22 bp, Homo sapiens
agggaagcagcagccgcctgtc

SEQ ID NO: 26050 - DNA, 22 bp, Homo sapiens
ctggcctaaaaatacagaacaa

SEQ ID NO: 26051 - DNA, 22 bp, Homo sapiens
tcccagtttttctccactaagg

SEQ ID NO: 26052 - DNA, 22 bp, Homo sapiens
aaaatggtctcagctggcacca

SEQ ID NO: 26053 - DNA, 22 bp, Homo sapiens
ctgtccccacccaaatctcatc

SEQ ID NO: 26054 - DNA, 22 bp, Homo sapiens
ctgaccaacatggtgaaacctt

SEQ ID NO: 26055 - DNA, 22 bp, Homo sapiens
gtctttcttaaacaacagaaca

SEQ ID NO: 26056 - DNA, 22 bp, Homo sapiens
tgataaacttagaaagaatgtt

SEQ ID NO: 26057 - DNA, 22 bp, Homo sapiens
aagatgcggttgaccatggtgt

SEQ ID NO: 26058 - DNA, 22 bp, Homo sapiens
accttcaggtgagcacacagat

SEQ ID NO: 26059 - DNA, 23 bp, Homo sapiens
caccactttctccttctccttgg

SEQ ID NO: 26060 - DNA, 22 bp, Homo sapiens
acatgtttaagtttgttatatg

SEQ ID NO: 26061 - DNA, 22 bp, Homo sapiens
gggcaggggtcagtggccccaa

SEQ ID NO: 26062 - DNA, 20 bp, Homo sapiens
gtctccactgggggttaacc

SEQ ID NO: 26063 - DNA, 22 bp, Homo sapiens
cggcatgggcgtccccctcact

SEQ ID NO: 26064 - DNA, 21 bp, Homo sapiens
cagggccaatcctgacctcta

SEQ ID NO: 26065 - DNA, 22 bp, Homo sapiens
tctcagggctcagagctcaggc

SEQ ID NO: 26066 - DNA, 22 bp, Homo sapiens
gttgattccggggccatttcaa

SEQ ID NO: 26067 - DNA, 22 bp, Homo sapiens
ctgaggaggctaatttgaggat

SEQ ID NO: 26068 - DNA, 22 bp, Homo sapiens
tatttccttgagacggagtctc

SEQ ID NO: 26069 - DNA, 22 bp, Homo sapiens
agcccaggtccagttcactgca

SEQ ID NO: 26070 - DNA, 22 bp, Homo sapiens
gaggtaacactgttcagtgggc

SEQ ID NO: 26071 - DNA, 22 bp, Homo sapiens
gttcccaccatgctgcacccat

SEQ ID NO: 26072 - DNA, 22 bp, Homo sapiens
cgagagttagctaggagtcaca

SEQ ID NO: 26073 - DNA, 23 bp, Homo sapiens
gaggtggcaatgagggcagttgg

SEQ ID NO: 26074 - DNA, 22 bp, Homo sapiens
gaggcctcagcctgccctgaac

SEQ ID NO: 26075 - DNA, 22 bp, Homo sapiens
taccagggaacagggatattaa

SEQ ID NO: 26076 - DNA, 22 bp, Homo sapiens
gggaagatagtgttgagggccc

SEQ ID NO: 26077 - DNA, 22 bp, Homo sapiens
ccgggcctcgggacaccgggta

SEQ ID NO: 26078 - DNA, 17 bp, Homo sapiens
tggtccaggtggagcca

SEQ ID NO: 26079 - DNA, 22 bp, Homo sapiens
gctgggttttcttccgggccta

SEQ ID NO: 26080 - DNA, 22 bp, Homo sapiens
tgtgcctagttctgtatttaca

SEQ ID NO: 26081 - DNA, 22 bp, Homo sapiens
gggcctgtgtgttcaggagcct

SEQ ID NO: 26082 - DNA, 22 bp, Homo sapiens
atattgttagtaatatttcgaa

SEQ ID NO: 26083 - DNA, 22 bp, Homo sapiens
gcggaggtggagcaccaagggc

SEQ ID NO: 26084 - DNA, 22 bp, Homo sapiens
atttcacttagtgtaatgtctt

SEQ ID NO: 26085 - DNA, 22 bp, Homo sapiens
agtgggtgacagttaacaggtt

SEQ ID NO: 26086 - DNA, 22 bp, Homo sapiens
ctagcctgggatttgaacttat

SEQ ID NO: 26087 - DNA, 22 bp, Homo sapiens
tcgaatggcaaggaaagaggct

SEQ ID NO: 26088 - DNA, 22 bp, Homo sapiens
cacctctcatttctacagattc

SEQ ID NO: 26089 - DNA, 22 bp, Homo sapiens
tcactacaaccgctacctgaca

SEQ ID NO: 26090 - DNA, 22 bp, Homo sapiens
catgagatttgggaggggccag

SEQ ID NO: 26091 - DNA, 22 bp, Homo sapiens
agagcactttcgagagccggag

SEQ ID NO: 26092 - DNA, 22 bp, Homo sapiens
cccaggaggcagaagttgcagt

SEQ ID NO: 26093 - DNA, 21 bp, Homo sapiens
agaaggcaaaagcagacatct

SEQ ID NO: 26094 - DNA, 22 bp, Homo sapiens
aatttaagaacatttcaggact

SEQ ID NO: 26095 - DNA, 22 bp, Homo sapiens
ttaaatattatgttgtctgcaa

SEQ ID NO: 26096 - DNA, 22 bp, Homo sapiens
ctccacagctgtaaatataggg

SEQ ID NO: 26097 - DNA, 22 bp, Homo sapiens
tagatgtgttgcctggagttgt

SEQ ID NO: 26098 - DNA, 22 bp, Homo sapiens
agtcacagggggcccctgcaac

SEQ ID NO: 26099 - DNA, 20 bp, Homo sapiens
tatctcagtttgtcctaaac

SEQ ID NO: 26100 - DNA, 22 bp, Homo sapiens
aaggggaagagaccgcagagtc

SEQ ID NO: 26101 - DNA, 22 bp, Homo sapiens
gtgtctcttagcctgctaatgc

SEQ ID NO: 26102 - DNA, 22 bp, Homo sapiens
cttttcattgtttgtacatgca

SEQ ID NO: 26103 - DNA, 22 bp, Homo sapiens
gctgtatgtgaggccacagtga

SEQ ID NO: 26104 - DNA, 22 bp, Homo sapiens
tgcaccactgcattccagcctg

SEQ ID NO: 26105 - DNA, 22 bp, Homo sapiens
ggaggtgggctaaggactctct

SEQ ID NO: 26106 - DNA, 22 bp, Homo sapiens
ctactttaacatggaggcactt

SEQ ID NO: 26107 - DNA, 22 bp, Homo sapiens
ggagggcgacagggcgaccgcg

SEQ ID NO: 26108 - DNA, 22 bp, Homo sapiens
cagcagtgtacaaggtgtcaga

SEQ ID NO: 26109 - DNA, 22 bp, Homo sapiens
ttttcatttttgtagatgcaag

SEQ ID NO: 26110 - DNA, 22 bp, Homo sapiens
ttgaagaaccatctgtgccact

SEQ ID NO: 26111 - DNA, 22 bp, Homo sapiens
aagctggagtgcagtgcaatgg

SEQ ID NO: 26112 - DNA, 22 bp, Homo sapiens
gagcacgttgaagcgcactgtc

SEQ ID NO: 26113 - DNA, 22 bp, Homo sapiens
ttactcgtgacaatgtccttga

SEQ ID NO: 26114 - DNA, 23 bp, Homo sapiens
tgaggcaggcggatcacgaggtc

SEQ ID NO: 26115 - DNA, 22 bp, Homo sapiens
attgttgggtctcactcctaga

SEQ ID NO: 26116 - DNA, 22 bp, Homo sapiens
ataaagctattcctctcttttt

SEQ ID NO: 26117 - DNA, 22 bp, Homo sapiens
gggcagccgcgtgacctgccag

SEQ ID NO: 26118 - DNA, 22 bp, Homo sapiens
ttgcccagagtcacccagctca

SEQ ID NO: 26119 - DNA, 22 bp, Homo sapiens
tgggcttggtttctaggtaggt

SEQ ID NO: 26120 - DNA, 22 bp, Homo sapiens
tacttttctataggtttgaaat

SEQ ID NO: 26121 - DNA, 22 bp, Homo sapiens
cctttaggagtgaggaccgagc

SEQ ID NO: 26122 - DNA, 22 bp, Homo sapiens
tgtgtcattgccatgaaaaggc

SEQ ID NO: 26123 - DNA, 22 bp, Homo sapiens
aaagtgcaaggattacaggcat

SEQ ID NO: 26124 - DNA, 22 bp, Homo sapiens
gtaggtcagacataagaggaca

SEQ ID NO: 26125 - DNA, 22 bp, Homo sapiens
actgcactcctgcctgggtaac

SEQ ID NO: 26126 - DNA, 22 bp, Homo sapiens
cctggctctgccacttactgcc

SEQ ID NO: 26127 - DNA, 22 bp, Homo sapiens
aaggaatttgaggctgcagtga

SEQ ID NO: 26128 - DNA, 22 bp, Homo sapiens
caacatggtgaaaccccgtctc

SEQ ID NO: 26129 - DNA, 22 bp, Homo sapiens
ccaggctagagtgcaatggcat

SEQ ID NO: 26130 - DNA, 22 bp, Homo sapiens
ccaggctggagtatagtggcgc

SEQ ID NO: 26131 - DNA, 22 bp, Homo sapiens
acgcccagactcccatactttg

SEQ ID NO: 26132 - DNA, 22 bp, Homo sapiens
tttgaaatatgtgtcttttgaa

SEQ ID NO: 26133 - DNA, 22 bp, Homo sapiens
tagtcccggaactccttcaggt

SEQ ID NO: 26134 - DNA, 23 bp, Homo sapiens
aggttatgattatagagcgagga

SEQ ID NO: 26135 - DNA, 22 bp, Homo sapiens
gttactcctggttgagcttggt

SEQ ID NO: 26136 - DNA, 22 bp, Homo sapiens
tcactgcactccagcactcagg

SEQ ID NO: 26137 - DNA, 22 bp, Homo sapiens
tgttacagcagaattgaaagag

SEQ ID NO: 26138 - DNA, 22 bp, Homo sapiens
agcaagattgaggcttcctcag

SEQ ID NO: 26139 - DNA, 22 bp, Homo sapiens
ccctctacagggaagcgctttc

SEQ ID NO: 26140 - DNA, 22 bp, Homo sapiens
tttgagtagtgagactaggcag

SEQ ID NO: 26141 - DNA, 22 bp, Homo sapiens
tggtattctttctgtagatcat

SEQ ID NO: 26142 - DNA, 22 bp, Homo sapiens
gccgcggcactggcctggctcc

SEQ ID NO: 26143 - DNA, 20 bp, Homo sapiens
agaattcccaagcatgacca

SEQ ID NO: 26144 - DNA, 22 bp, Homo sapiens
tattactgtcaatatcacagaa

SEQ ID NO: 26145 - DNA, 22 bp, Homo sapiens
ccagaagtcaagtaagatgaag

SEQ ID NO: 26146 - DNA, 22 bp, Homo sapiens
gggccgtagaccacgtccgggc

SEQ ID NO: 26147 - DNA, 22 bp, Homo sapiens
ctgccctttgaaagaacgtctt

SEQ ID NO: 26148 - DNA, 22 bp, Homo sapiens
cgttgtttgagattttcagaat

SEQ ID NO: 26149 - DNA, 22 bp, Homo sapiens
ggccactgacctacatctgggg

SEQ ID NO: 26150 - DNA, 22 bp, Homo sapiens
ttggatctcatctaagtgcgtg

SEQ ID NO: 26151 - DNA, 22 bp, Homo sapiens
cattctggaccaagctgggtgc

SEQ ID NO: 26152 - DNA, 22 bp, Homo sapiens
tcgctgcatgaagccaggccag

SEQ ID NO: 26153 - DNA, 22 bp, Homo sapiens
gctggaggatggactggaagaa

SEQ ID NO: 26154 - DNA, 18 bp, Homo sapiens
tttgaccctcagtgccat

SEQ ID NO: 26155 - DNA, 22 bp, Homo sapiens
tgcagcattgcactccagcctg

SEQ ID NO: 26156 - DNA, 22 bp, Homo sapiens
gactccccacgttaaggaatgt

SEQ ID NO: 26157 - DNA, 22 bp, Homo sapiens
ccaaaaggaactttttgaaggt

SEQ ID NO: 26158 - DNA, 22 bp, Homo sapiens
aagacacaatgtagcccagcac

SEQ ID NO: 26159 - DNA, 22 bp, Homo sapiens
agaacagaggccttatgtttca

SEQ ID NO: 26160 - DNA, 18 bp, Homo sapiens
gagtcgtcggagagtctg

SEQ ID NO: 26161 - DNA, 22 bp, Homo sapiens
aggggcacgagtagagctctag

SEQ ID NO: 26162 - DNA, 22 bp, Homo sapiens
tgacagagtgacactcttgtct

SEQ ID NO: 26163 - DNA, 22 bp, Homo sapiens
gctgcactttgactgctggggt

SEQ ID NO: 26164 - DNA, 22 bp, Homo sapiens
cactgcactccagcctgggtga

SEQ ID NO: 26165 - DNA, 22 bp, Homo sapiens
cattgcactctagcctgggtga

SEQ ID NO: 26166 - DNA, 22 bp, Homo sapiens
acagtgcttagcacagagtaga

SEQ ID NO: 26167 - DNA, 22 bp, Homo sapiens
ttttttgttgggtagaacggaa

SEQ ID NO: 26168 - DNA, 22 bp, Homo sapiens
ctgagtgaaagaagccagacat

SEQ ID NO: 26169 - DNA, 22 bp, Homo sapiens
acaagcatgggctttgacatca

SEQ ID NO: 26170 - DNA, 23 bp, Homo sapiens
gtgtgttcccggagtagctcccg

SEQ ID NO: 26171 - DNA, 22 bp, Homo sapiens
ttgacacagtcaacttgatttt

SEQ ID NO: 26172 - DNA, 22 bp, Homo sapiens
agtggtcttagcttgctgggct

SEQ ID NO: 26173 - DNA, 22 bp, Homo sapiens
ggaggactcaggtctggccatg

SEQ ID NO: 26174 - DNA, 22 bp, Homo sapiens
aagaatgagctcaaagatctta

SEQ ID NO: 26175 - DNA, 22 bp, Homo sapiens
ctgggcagctgtatcagggagt

SEQ ID NO: 26176 - DNA, 21 bp, Homo sapiens
agctgcctccacttctgaggc

SEQ ID NO: 26177 - DNA, 22 bp, Homo sapiens
catgagataatttttctccagt

SEQ ID NO: 26178 - DNA, 18 bp, Homo sapiens
tgggaagaaattcttctc

SEQ ID NO: 26179 - DNA, 20 bp, Homo sapiens
ttgcaactgtaagaagcagg

SEQ ID NO: 26180 - DNA, 22 bp, Homo sapiens
tgctgttagtaaggaacatgac

SEQ ID NO: 26181 - DNA, 22 bp, Homo sapiens
cttagatgaagtcacagaaccc

SEQ ID NO: 26182 - DNA, 22 bp, Homo sapiens
tcttgcacttcatgaatatgtt

SEQ ID NO: 26183 - DNA, 22 bp, Homo sapiens
gttcatcactcagagacctccc

SEQ ID NO: 26184 - DNA, 22 bp, Homo sapiens
cgcaccccactgtccctcaacc

SEQ ID NO: 26185 - DNA, 22 bp, Homo sapiens
ccaggaggcggaggttgcagtg

SEQ ID NO: 26186 - DNA, 22 bp, Homo sapiens
gtagggctcagtaaatactttg

SEQ ID NO: 26187 - DNA, 22 bp, Homo sapiens
ctcggggatccatccacgtggc

SEQ ID NO: 26188 - DNA, 22 bp, Homo sapiens
taaatcttctacatcatcataa

SEQ ID NO: 26189 - DNA, 22 bp, Homo sapiens
ggccagaagttggaaaagagcc

SEQ ID NO: 26190 - DNA, 22 bp, Homo sapiens
caaagtgctaggattacaggcc

SEQ ID NO: 26191 - DNA, 22 bp, Homo sapiens
gaggctgaggcaggaggatcac

SEQ ID NO: 26192 - DNA, 22 bp, Homo sapiens
tacccagtctggagtgcagtga

SEQ ID NO: 26193 - DNA, 22 bp, Homo sapiens
ggatgcacgaaggcgcctcgga

SEQ ID NO: 26194 - DNA, 22 bp, Homo sapiens
tgggagcagttgcatctccagt

SEQ ID NO: 26195 - DNA, 22 bp, Homo sapiens
tgctgggggtagctctgcgtag

SEQ ID NO: 26196 - DNA, 22 bp, Homo sapiens
ctcactgcaacctccgtctccc

SEQ ID NO: 26197 - DNA, 22 bp, Homo sapiens
ttcactgcaacctccgcctccc

SEQ ID NO: 26198 - DNA, 22 bp, Homo sapiens
atttcatactaaggctcaaaaa

SEQ ID NO: 26199 - DNA, 22 bp, Homo sapiens
ggcgtttcaccatgttgaccag

SEQ ID NO: 26200 - DNA, 22 bp, Homo sapiens
tgagccaagttcacaccattgc

SEQ ID NO: 26201 - DNA, 22 bp, Homo sapiens
ttgagacacagtttcactctgt

SEQ ID NO: 26202 - DNA, 22 bp, Homo sapiens
gcctgtgtggatgcgccggtgc

SEQ ID NO: 26203 - DNA, 22 bp, Homo sapiens
aaggttcctctctccacccagc

SEQ ID NO: 26204 - DNA, 22 bp, Homo sapiens
ccagctatggctattcaaggtc

SEQ ID NO: 26205 - DNA, 22 bp, Homo sapiens
atctattttaaatggcagtaaa

SEQ ID NO: 26206 - DNA, 22 bp, Homo sapiens
gcaggtggatcacctgaggtca

SEQ ID NO: 26207 - DNA, 22 bp, Homo sapiens
ttggatgagagggtgtggtaca

SEQ ID NO: 26208 - DNA, 23 bp, Homo sapiens
tgctggagaagcaaagttctgag

SEQ ID NO: 26209 - DNA, 22 bp, Homo sapiens
aggccctattcaatggggccca

SEQ ID NO: 26210 - DNA, 22 bp, Homo sapiens
aaaggtcaaaatcgtgacattg

SEQ ID NO: 26211 - DNA, 20 bp, Homo sapiens
ttgagcttttagtacagaca

SEQ ID NO: 26212 - DNA, 18 bp, Homo sapiens
gaggatggaaggagatgc

SEQ ID NO: 26213 - DNA, 22 bp, Homo sapiens
ccaggcaggcgatggtgcagtg

SEQ ID NO: 26214 - DNA, 22 bp, Homo sapiens
tgggttttatatgtggtggaca

SEQ ID NO: 26215 - DNA, 22 bp, Homo sapiens
cactgggagcagctccaacatt

SEQ ID NO: 26216 - DNA, 22 bp, Homo sapiens
tttaagaagttatgttataaat

SEQ ID NO: 26217 - DNA, 18 bp, Homo sapiens
aggcttacagcagcaggc

SEQ ID NO: 26218 - DNA, 22 bp, Homo sapiens
cttgatgagtcagaactgaagg

SEQ ID NO: 26219 - DNA, 22 bp, Homo sapiens
atcctccagctcctgcttctgc

SEQ ID NO: 26220 - DNA, 22 bp, Homo sapiens
aagaggtagcagtcacaaaaga

SEQ ID NO: 26221 - DNA, 22 bp, Homo sapiens
tctgcgttgctcacgctgggag

SEQ ID NO: 26222 - DNA, 22 bp, Homo sapiens
ttggaagacaatgctgattctc

SEQ ID NO: 26223 - DNA, 22 bp, Homo sapiens
ctatgaccccagcatgaataag

SEQ ID NO: 26224 - DNA, 22 bp, Homo sapiens
gacttttgaataaggtaggata

SEQ ID NO: 26225 - DNA, 22 bp, Homo sapiens
tttccctttagcctgagaatcc

SEQ ID NO: 26226 - DNA, 20 bp, Homo sapiens
ttgttagaggaatgccatag

SEQ ID NO: 26227 - DNA, 23 bp, Homo sapiens
atcattaacagtgcaggggtagg

SEQ ID NO: 26228 - DNA, 22 bp, Homo sapiens
ggtccccgtggaggctggagcg

SEQ ID NO: 26229 - DNA, 22 bp, Homo sapiens
gaagcctgtcatgtgacgctga

SEQ ID NO: 26230 - DNA, 22 bp, Homo sapiens
agagcacagggttttgtgccgg

SEQ ID NO: 26231 - DNA, 22 bp, Homo sapiens
gtgctggggagataggaagaga

SEQ ID NO: 26232 - DNA, 23 bp, Homo sapiens
aaaacagcttcctccagtggctc

SEQ ID NO: 26233 - DNA, 22 bp, Homo sapiens
cagcggagggcagccttgcagc

SEQ ID NO: 26234 - DNA, 22 bp, Homo sapiens
ccacgcatccctccacagagag

SEQ ID NO: 26235 - DNA, 22 bp, Homo sapiens
tgaagctttaggatgggttcat

SEQ ID NO: 26236 - DNA, 22 bp, Homo sapiens
tgagctgtctgaatggtgagga

SEQ ID NO: 26237 - DNA, 22 bp, Homo sapiens
tgtaccgcaaatgctgctgcct

SEQ ID NO: 26238 - DNA, 22 bp, Homo sapiens
aactctatttaccctactaaac

SEQ ID NO: 26239 - DNA, 22 bp, Homo sapiens
tacactgtttgaactgtggtcg

SEQ ID NO: 26240 - DNA, 22 bp, Homo sapiens
agtgcagtggttaggagccagg

SEQ ID NO: 26241 - DNA, 22 bp, Homo sapiens
gagatcggtaaagagcatgcac

SEQ ID NO: 26242 - DNA, 22 bp, Homo sapiens
gagcagtgtttgtggacctgga

SEQ ID NO: 26243 - DNA, 22 bp, Homo sapiens
tggtcgaccagttggaaagtaa

SEQ ID NO: 26244 - DNA, 22 bp, Homo sapiens
gtaaaaaggccaagcccttgtg

SEQ ID NO: 26245 - DNA, 22 bp, Homo sapiens
gtctcgtcaatggcaggttccc

SEQ ID NO: 26246 - DNA, 22 bp, Homo sapiens
gcaggcagatcacctgtcagga

SEQ ID NO: 26247 - DNA, 22 bp, Homo sapiens
gtttcgtcaggcttattctatc

SEQ ID NO: 26248 - DNA, 19 bp, Homo sapiens
ccctcttgcacaaagcaaa

SEQ ID NO: 26249 - DNA, 22 bp, Homo sapiens
tggagccagcggcctgctgagg

SEQ ID NO: 26250 - DNA, 21 bp, Homo sapiens
cctcaaagatgatggggtttc

SEQ ID NO: 26251 - DNA, 22 bp, Homo sapiens
tttcccaggctggaatgcagtg

SEQ ID NO: 26252 - DNA, 22 bp, Homo sapiens
ttccaatagtgtgaccttatag

SEQ ID NO: 26253 - DNA, 22 bp, Homo sapiens
cttgcacgtcagatcttcctca

SEQ ID NO: 26254 - DNA, 22 bp, Homo sapiens
tgaggcaggtggattacaaggt

SEQ ID NO: 26255 - DNA, 22 bp, Homo sapiens
attgtactacaccatagtactg

SEQ ID NO: 26256 - DNA, 22 bp, Homo sapiens
ttcgactctgtgcctgaagagc

SEQ ID NO: 26257 - DNA, 22 bp, Homo sapiens
gcctggccaacgtggtgaaacc

SEQ ID NO: 26258 - DNA, 22 bp, Homo sapiens
ttagtattaggatcatatttga

SEQ ID NO: 26259 - DNA, 22 bp, Homo sapiens
atccccctgtatctggaagaat

SEQ ID NO: 26260 - DNA, 22 bp, Homo sapiens
ggaggctgagaggtcgcagtgg

SEQ ID NO: 26261 - DNA, 22 bp, Homo sapiens
tagcaaaggatgactatgtacc

SEQ ID NO: 26262 - DNA, 22 bp, Homo sapiens
tgtgaagaattaatgtgaatca

SEQ ID NO: 26263 - DNA, 22 bp, Homo sapiens
tagcagtattccggaatacttt

SEQ ID NO: 26264 - DNA, 22 bp, Homo sapiens
agatcggctttgcagacctcat

SEQ ID NO: 26265 - DNA, 22 bp, Homo sapiens
tagcacagggctcctcaaccca

SEQ ID NO: 26266 - DNA, 22 bp, Homo sapiens
cttctcttcctttgtcaactga

SEQ ID NO: 26267 - DNA, 22 bp, Homo sapiens
aaattctgatttaataagtgta

SEQ ID NO: 26268 - DNA, 22 bp, Homo sapiens
gaagagctgacagtgtcatcct

SEQ ID NO: 26269 - DNA, 22 bp, Homo sapiens
caatccatcaattacacaggct

SEQ ID NO: 26270 - DNA, 21 bp, Homo sapiens
aggtgctggcgccccaggaga

SEQ ID NO: 26271 - DNA, 22 bp, Homo sapiens
tgttgagtatatacctacaagt

SEQ ID NO: 26272 - DNA, 22 bp, Homo sapiens
ctggagtagccggacgggtctg

SEQ ID NO: 26273 - DNA, 22 bp, Homo sapiens
ctgagatggagtttcgctcttc

SEQ ID NO: 26274 - DNA, 22 bp, Homo sapiens
gtagttctgcagtgtcacctga

SEQ ID NO: 26275 - DNA, 22 bp, Homo sapiens
tcacagagatgaacttttgata

SEQ ID NO: 26276 - DNA, 22 bp, Homo sapiens
aaagtgcttccttttagaggct

SEQ ID NO: 26277 - DNA, 22 bp, Homo sapiens
actgggcctacccagattggca

SEQ ID NO: 26278 - DNA, 22 bp, Homo sapiens
gggatgcagactacagggctta

SEQ ID NO: 26279 - DNA, 22 bp, Homo sapiens
caggtggcagtgcctgcattct

SEQ ID NO: 26280 - DNA, 22 bp, Homo sapiens
gcctgtcccgcaccggagcccg

SEQ ID NO: 26281 - DNA, 22 bp, Homo sapiens
tagcgaggtgtttctaggactg

SEQ ID NO: 26282 - DNA, 22 bp, Homo sapiens
ttcttctttccaattacatggt

SEQ ID NO: 26283 - DNA, 22 bp, Homo sapiens
gggcctcaggttctggagaagg

SEQ ID NO: 26284 - DNA, 22 bp, Homo sapiens
cccactgctgcgccgggcgccg

SEQ ID NO: 26285 - DNA, 22 bp, Homo sapiens
tcatctaagagtcttacattta

SEQ ID NO: 26286 - DNA, 22 bp, Homo sapiens
acgggccttctcttcaggcgag

SEQ ID NO: 26287 - DNA, 22 bp, Homo sapiens
agcccaggagtttgaggctgtg

SEQ ID NO: 26288 - DNA, 22 bp, Homo sapiens
ggagaggcttccagagtcgtgc

SEQ ID NO: 26289 - DNA, 22 bp, Homo sapiens
gaagccttgaactgcaaacccc

SEQ ID NO: 26290 - DNA, 18 bp, Homo sapiens
gctgtggaagtctttata

SEQ ID NO: 26291 - DNA, 22 bp, Homo sapiens
gagccccaccctagacattctg

SEQ ID NO: 26292 - DNA, 22 bp, Homo sapiens
gtgggtggacggtgcttttgtt

SEQ ID NO: 26293 - DNA, 22 bp, Homo sapiens
tgagacaggcttccttcttggg

SEQ ID NO: 26294 - DNA, 22 bp, Homo sapiens
gctgtatgtttatttgggaatt

SEQ ID NO: 26295 - DNA, 22 bp, Homo sapiens
tctcccctggtctcgcgcgctg

SEQ ID NO: 26296 - DNA, 22 bp, Homo sapiens
agaatgggggctacaggccaca

SEQ ID NO: 26297 - DNA, 22 bp, Homo sapiens
gtgattttctcctcctagaagt

SEQ ID NO: 26298 - DNA, 22 bp, Homo sapiens
gaggtgggcggatcacaaggtc

SEQ ID NO: 26299 - DNA, 22 bp, Homo sapiens
cctcttctaggacgtccttgtg

SEQ ID NO: 26300 - DNA, 22 bp, Homo sapiens
gaggtgggtgtatcacaggtca

SEQ ID NO: 26301 - DNA, 22 bp, Homo sapiens
cagtgggtcctgcgtctgccag

SEQ ID NO: 26302 - DNA, 21 bp, Homo sapiens
gttgtggttggggctgcagct

SEQ ID NO: 26303 - DNA, 22 bp, Homo sapiens
agggactatttacccatctcac

SEQ ID NO: 26304 - DNA, 22 bp, Homo sapiens
gggaaggaaagttattagcaga

SEQ ID NO: 26305 - DNA, 19 bp, Homo sapiens
agggttacccgctgccacc

SEQ ID NO: 26306 - DNA, 22 bp, Homo sapiens
acccatggtctggtggggccct

SEQ ID NO: 26307 - DNA, 22 bp, Homo sapiens
tcttcattttacaggcagacct

SEQ ID NO: 26308 - DNA, 22 bp, Homo sapiens
tctctctgcagcccgggacact

SEQ ID NO: 26309 - DNA, 22 bp, Homo sapiens
gctttggacaataactgctttt

SEQ ID NO: 26310 - DNA, 22 bp, Homo sapiens
ccctttagcccctgcagagact

SEQ ID NO: 26311 - DNA, 22 bp, Homo sapiens
ggaacttaataagttttgtaat

SEQ ID NO: 26312 - DNA, 22 bp, Homo sapiens
ttgggacagctgtggtagtgag

SEQ ID NO: 26313 - DNA, 22 bp, Homo sapiens
gggaaacaacaaagtatctatg

SEQ ID NO: 26314 - DNA, 22 bp, Homo sapiens
gtcttttgctagccagagagct

SEQ ID NO: 26315 - DNA, 22 bp, Homo sapiens
gagggccctggctggctccagc

SEQ ID NO: 26316 - DNA, 22 bp, Homo sapiens
cttgtgcatttcattcctcagg

SEQ ID NO: 26317 - DNA, 22 bp, Homo sapiens
cagggtttcaccatgttagcag

SEQ ID NO: 26318 - DNA, 22 bp, Homo sapiens
agccggccatgtggtcttgtgc

SEQ ID NO: 26319 - DNA, 22 bp, Homo sapiens
aactgaggtatctgctgtgttt

SEQ ID NO: 26320 - DNA, 22 bp, Homo sapiens
ggggagatgcttaggtccgggg

SEQ ID NO: 26321 - DNA, 22 bp, Homo sapiens
caggctggagtgcagtggcgcc

SEQ ID NO: 26322 - DNA, 22 bp, Homo sapiens
ccccatgaagtagggtctctga

SEQ ID NO: 26323 - DNA, 22 bp, Homo sapiens
acccagtctggagtgcagtgac

SEQ ID NO: 26324 - DNA, 22 bp, Homo sapiens
cgggcgcactccgggcagctgt

SEQ ID NO: 26325 - DNA, 22 bp, Homo sapiens
ggagaccagaaggaagcttcga

SEQ ID NO: 26326 - DNA, 22 bp, Homo sapiens
tgtggctcaggcggcttctcct

SEQ ID NO: 26327 - DNA, 22 bp, Homo sapiens
ctgctccccagcctgcgccttt

SEQ ID NO: 26328 - DNA, 22 bp, Homo sapiens
tcatcagggatattggcctgaa

SEQ ID NO: 26329 - DNA, 22 bp, Homo sapiens
aagtaggtaccgcgcagcaggg

SEQ ID NO: 26330 - DNA, 22 bp, Homo sapiens
cagtgcacgggccagtcctgcc

SEQ ID NO: 26331 - DNA, 22 bp, Homo sapiens
tcaccgccttgcccggccgggc

SEQ ID NO: 26332 - DNA, 22 bp, Homo sapiens
caatagtgtctgcttgtttcta

SEQ ID NO: 26333 - DNA, 22 bp, Homo sapiens
gcccagtagttcaaggttgcag

SEQ ID NO: 26334 - DNA, 22 bp, Homo sapiens
tgtcaatatgtaataactgaat

SEQ ID NO: 26335 - DNA, 22 bp, Homo sapiens
ttgcttcctctagtttcttgaa

SEQ ID NO: 26336 - DNA, 22 bp, Homo sapiens
tcctgagccctactctagacga

SEQ ID NO: 26337 - DNA, 22 bp, Homo sapiens
agcctgcgatcccacctggcct

SEQ ID NO: 26338 - DNA, 22 bp, Homo sapiens
ttccagctaactcacatccctt

SEQ ID NO: 26339 - DNA, 22 bp, Homo sapiens
agcactgtgagcaccagcacgc

SEQ ID NO: 26340 - DNA, 22 bp, Homo sapiens
gcggggggaggaacatcttgca

SEQ ID NO: 26341 - DNA, 22 bp, Homo sapiens
ccaccgccatggcgttgtacag

SEQ ID NO: 26342 - DNA, 22 bp, Homo sapiens
tgtatgtatgaataagcaagat

SEQ ID NO: 26343 - DNA, 22 bp, Homo sapiens
gtactagagatgtgtgcgggta

SEQ ID NO: 26344 - DNA, 22 bp, Homo sapiens
aaaaagtattggccatggttga

SEQ ID NO: 26345 - DNA, 22 bp, Homo sapiens
gaggctgaggttgcagtgagcc

SEQ ID NO: 26346 - DNA, 22 bp, Homo sapiens
ggcgccgcactcggtgcagccg

SEQ ID NO: 26347 - DNA, 22 bp, Homo sapiens
gcggggcccggacccagcctct

SEQ ID NO: 26348 - DNA, 22 bp, Homo sapiens
aagccctggacggcccttcccc

SEQ ID NO: 26349 - DNA, 22 bp, Homo sapiens
aagcactttatgtcaatgtcct

SEQ ID NO: 26350 - DNA, 22 bp, Homo sapiens
ttgctgacctttgctctccgtt

SEQ ID NO: 26351 - DNA, 22 bp, Homo sapiens
ccggagtgtctggcctgctggg

SEQ ID NO: 26352 - DNA, 22 bp, Homo sapiens
gaggtgtcatcaggcagctctg

SEQ ID NO: 26353 - DNA, 22 bp, Homo sapiens
gcagctggaagtgacactctgt

SEQ ID NO: 26354 - DNA, 22 bp, Homo sapiens
tggcttccccggagtgacatgt

SEQ ID NO: 26355 - DNA, 22 bp, Homo sapiens
acatccgcaggttataaagccc

SEQ ID NO: 26356 - DNA, 22 bp, Homo sapiens
catgcctgtaatcccagcactt

SEQ ID NO: 26357 - DNA, 22 bp, Homo sapiens
cctcctgcacctccaggaactc

SEQ ID NO: 26358 - DNA, 22 bp, Homo sapiens
tccacgtgagcttcgtgtgcag

SEQ ID NO: 26359 - DNA, 22 bp, Homo sapiens
caggagtccatctggcctggtg

SEQ ID NO: 26360 - DNA, 22 bp, Homo sapiens
aaatggaagctatttatgattc

SEQ ID NO: 26361 - DNA, 22 bp, Homo sapiens
tgtttcctttctggtgagcata

SEQ ID NO: 26362 - DNA, 22 bp, Homo sapiens
agtgttgtcaaacggctcagca

SEQ ID NO: 26363 - DNA, 22 bp, Homo sapiens
gcagggcacaaggacgcacagg

SEQ ID NO: 26364 - DNA, 22 bp, Homo sapiens
catggcagctcctccagtgtga

SEQ ID NO: 26365 - DNA, 22 bp, Homo sapiens
ccagctttatagcttcaaagga

SEQ ID NO: 26366 - DNA, 22 bp, Homo sapiens
gttggccaggctggtctcaaac

SEQ ID NO: 26367 - DNA, 22 bp, Homo sapiens
gcccatgaggtggaggctgcag

SEQ ID NO: 26368 - DNA, 22 bp, Homo sapiens
acttgtgttaccaaggtttggt

SEQ ID NO: 26369 - DNA, 22 bp, Homo sapiens
tctgagaatggtggatgtggtg

SEQ ID NO: 26370 - DNA, 22 bp, Homo sapiens
tcccgcccttgtacttgccgag

SEQ ID NO: 26371 - DNA, 22 bp, Homo sapiens
tccagctctgctgtgcgccggt

SEQ ID NO: 26372 - DNA, 22 bp, Homo sapiens
cattctgaccctatgatttaag

SEQ ID NO: 26373 - DNA, 22 bp, Homo sapiens
cctggctgacagcttaattcca

SEQ ID NO: 26374 - DNA, 22 bp, Homo sapiens
catgtctgtgtacacatgcaca

SEQ ID NO: 26375 - DNA, 22 bp, Homo sapiens
acacatcctgaccaagttcagg

SEQ ID NO: 26376 - DNA, 22 bp, Homo sapiens
tccagtgtttttcttcacaggt

SEQ ID NO: 26377 - DNA, 22 bp, Homo sapiens
tctaaattactttgggcagtat

SEQ ID NO: 26378 - DNA, 22 bp, Homo sapiens
aggccagcagcatgacggcatc

SEQ ID NO: 26379 - DNA, 22 bp, Homo sapiens
tgggtactcctattagttcagt

SEQ ID NO: 26380 - DNA, 22 bp, Homo sapiens
tgtccccacccaaatctcatct

SEQ ID NO: 26381 - DNA, 22 bp, Homo sapiens
ggcaagaacctcaattaccttt

SEQ ID NO: 26382 - DNA, 22 bp, Homo sapiens
attgcacttcagcctgggtgac

SEQ ID NO: 26383 - DNA, 22 bp, Homo sapiens
ttgagcaggatggctatgcaca

SEQ ID NO: 26384 - DNA, 22 bp, Homo sapiens
attgtactccagcctgggtgac

SEQ ID NO: 26385 - DNA, 22 bp, Homo sapiens
agcgcttgccgcactccaagca

SEQ ID NO: 26386 - DNA, 22 bp, Homo sapiens
tctcgtgcaggccttgctcgga

SEQ ID NO: 26387 - DNA, 20 bp, Homo sapiens
tgttctgtcgtctttcttca

SEQ ID NO: 26388 - DNA, 22 bp, Homo sapiens
tcgccatggaagtccttgcgga

SEQ ID NO: 26389 - DNA, 22 bp, Homo sapiens
ctatcacagagggttgttttga

SEQ ID NO: 26390 - DNA, 22 bp, Homo sapiens
tatattgagatttgagcattgt

SEQ ID NO: 26391 - DNA, 22 bp, Homo sapiens
gatttctctgcacccactcagg

SEQ ID NO: 26392 - DNA, 22 bp, Homo sapiens
tgccatggcctagacctgtgat

SEQ ID NO: 26393 - DNA, 22 bp, Homo sapiens
cccagcaggaggaggttgcagt

SEQ ID NO: 26394 - DNA, 22 bp, Homo sapiens
aggtgacaggacaggagctggt

SEQ ID NO: 26395 - DNA, 22 bp, Homo sapiens
ttatatgtttctgtttggaggc

SEQ ID NO: 26396 - DNA, 22 bp, Homo sapiens
gtctatatattgcttgaataat

SEQ ID NO: 26397 - DNA, 22 bp, Homo sapiens
aaaggctttaaaatgtacatat

SEQ ID NO: 26398 - DNA, 19 bp, Homo sapiens
taggaccctggtggccccc

SEQ ID NO: 26399 - DNA, 22 bp, Homo sapiens
ctcactgcaagctctgcctcca

SEQ ID NO: 26400 - DNA, 22 bp, Homo sapiens
tatttcttttcgtgacttattg

SEQ ID NO: 26401 - DNA, 22 bp, Homo sapiens
acctggccagtggggccgcgct

SEQ ID NO: 26402 - DNA, 19 bp, Homo sapiens
tgagggtgagctttggaga

SEQ ID NO: 26403 - DNA, 22 bp, Homo sapiens
aattgaaaatattgtagaccat

SEQ ID NO: 26404 - DNA, 22 bp, Homo sapiens
acccaaaagtcactcaggagca

SEQ ID NO: 26405 - DNA, 22 bp, Homo sapiens
ctccgcagcgggccaatccgga

SEQ ID NO: 26406 - DNA, 22 bp, Homo sapiens
ggcttagcaactcctgaggctc

SEQ ID NO: 26407 - DNA, 22 bp, Homo sapiens
tctcttgagctcagttctgatg

SEQ ID NO: 26408 - DNA, 22 bp, Homo sapiens
actgtactcaagcctgggcaat

SEQ ID NO: 26409 - DNA, 22 bp, Homo sapiens
ctcactgcaacctccgcctcct

SEQ ID NO: 26410 - DNA, 22 bp, Homo sapiens
ggcctcttatctggctcctgca

SEQ ID NO: 26411 - DNA, 22 bp, Homo sapiens
agtgccaaatcgagggctctga

SEQ ID NO: 26412 - DNA, 22 bp, Homo sapiens
ttgaggcaggtccgggtccttc

SEQ ID NO: 26413 - DNA, 22 bp, Homo sapiens
tccactgctacaacctcccaga

SEQ ID NO: 26414 - DNA, 22 bp, Homo sapiens
aacatagaataaatgagttagg

SEQ ID NO: 26415 - DNA, 22 bp, Homo sapiens
gaagaaagatcaaatagtttcc

SEQ ID NO: 26416 - DNA, 22 bp, Homo sapiens
ggggtctgggcttagctggaat

SEQ ID NO: 26417 - DNA, 22 bp, Homo sapiens
ttttctgtttgcttcaagacat

SEQ ID NO: 26418 - DNA, 22 bp, Homo sapiens
acacagagccaaaccatatcac

SEQ ID NO: 26419 - DNA, 22 bp, Homo sapiens
tcacagctctgtcaattttata

SEQ ID NO: 26420 - DNA, 22 bp, Homo sapiens
tccacgctgtgtgaccttgggc

SEQ ID NO: 26421 - DNA, 22 bp, Homo sapiens
tgtgcacctcatccaccagacc

SEQ ID NO: 26422 - DNA, 22 bp, Homo sapiens
tcaatcacgtgttccatgttct

SEQ ID NO: 26423 - DNA, 22 bp, Homo sapiens
ggagagggtaggggtcctgccc

SEQ ID NO: 26424 - DNA, 22 bp, Homo sapiens
aactcaaagatgcatgacgctt

SEQ ID NO: 26425 - DNA, 22 bp, Homo sapiens
tcaggagtgccagtaccttttg

SEQ ID NO: 26426 - DNA, 22 bp, Homo sapiens
aacccaggaggcagatgttgtg

SEQ ID NO: 26427 - DNA, 22 bp, Homo sapiens
agatggggtttcatcatgttgg

SEQ ID NO: 26428 - DNA, 22 bp, Homo sapiens
cactgcaacctccacctcctgg

SEQ ID NO: 26429 - DNA, 22 bp, Homo sapiens
cccaggagttagaggttgtggt

SEQ ID NO: 26430 - DNA, 22 bp, Homo sapiens
gcaccgagaaggaagcatgcct

SEQ ID NO: 26431 - DNA, 22 bp, Homo sapiens
tgagcctgggagatggaggctg

SEQ ID NO: 26432 - DNA, 22 bp, Homo sapiens
ttgaccactgaatggttctgaa

SEQ ID NO: 26433 - DNA, 22 bp, Homo sapiens
gggcatggtggcaggcacctgt

SEQ ID NO: 26434 - DNA, 22 bp, Homo sapiens
gtgacaggccactgcggctctg

SEQ ID NO: 26435 - DNA, 22 bp, Homo sapiens
aagtgatgctacgactttgaca

SEQ ID NO: 26436 - DNA, 22 bp, Homo sapiens
ctcctgcttcacgggcaccgcc

SEQ ID NO: 26437 - DNA, 22 bp, Homo sapiens
agtgaagctggagaaaggcagt

SEQ ID NO: 26438 - DNA, 22 bp, Homo sapiens
tctgtagtaggttgtagttctt

SEQ ID NO: 26439 - DNA, 22 bp, Homo sapiens
gcaaatacatgttgagcaccta

SEQ ID NO: 26440 - DNA, 22 bp, Homo sapiens
gaagccagtgtttgaagaattt

SEQ ID NO: 26441 - DNA, 22 bp, Homo sapiens
gattgggggtcaggctcaggtc

SEQ ID NO: 26442 - DNA, 22 bp, Homo sapiens
cacggtggcccacaggtgcaag

SEQ ID NO: 26443 - DNA, 22 bp, Homo sapiens
tccaaggagcagtcttcaacct

SEQ ID NO: 26444 - DNA, 22 bp, Homo sapiens
catctttgcccatccacttcca

SEQ ID NO: 26445 - DNA, 22 bp, Homo sapiens
actacagtgtgataagaggggc

SEQ ID NO: 26446 - DNA, 22 bp, Homo sapiens
gattgtggaagtcagtggttct

SEQ ID NO: 26447 - DNA, 22 bp, Homo sapiens
caaagtgctaggattacaggcg

SEQ ID NO: 26448 - DNA, 22 bp, Homo sapiens
ttgatgtaggtttatctattgt

SEQ ID NO: 26449 - DNA, 22 bp, Homo sapiens
ctgaaggatgtgtggtgggagt

SEQ ID NO: 26450 - DNA, 22 bp, Homo sapiens
agaaacgcctgtgaaattatct

SEQ ID NO: 26451 - DNA, 20 bp, Homo sapiens
aggaaaaatggaaactggag

SEQ ID NO: 26452 - DNA, 22 bp, Homo sapiens
attgacctgattgttcctggaa

SEQ ID NO: 26453 - DNA, 22 bp, Homo sapiens
atccccagaaagaccgatgtac

SEQ ID NO: 26454 - DNA, 22 bp, Homo sapiens
aatctcatttacaacatgagga

SEQ ID NO: 26455 - DNA, 22 bp, Homo sapiens
ccagactgcttgcttcccagcc

SEQ ID NO: 26456 - DNA, 22 bp, Homo sapiens
tctcgacagcctggcacagtgg

SEQ ID NO: 26457 - DNA, 22 bp, Homo sapiens
gtcactcaggctggagttcagt

SEQ ID NO: 26458 - DNA, 19 bp, Homo sapiens
gctgaaggaggtgcctgca

SEQ ID NO: 26459 - DNA, 22 bp, Homo sapiens
gggctgtgaggtgagaacttac

SEQ ID NO: 26460 - DNA, 22 bp, Homo sapiens
tatactctgagaaacgtgtcac

SEQ ID NO: 26461 - DNA, 22 bp, Homo sapiens
cagcagcccacgcgtgctgtcc

SEQ ID NO: 26462 - DNA, 22 bp, Homo sapiens
gcccagctgcaccctggtgggt

SEQ ID NO: 26463 - DNA, 23 bp, Homo sapiens
aatatcaaggtgatgttcccaga

SEQ ID NO: 26464 - DNA, 22 bp, Homo sapiens
tgagccgtggtctctgagggtg

SEQ ID NO: 26465 - DNA, 22 bp, Homo sapiens
cactgcactccagcccgggcaa

SEQ ID NO: 26466 - DNA, 22 bp, Homo sapiens
cttttgtgattcctcagttact

SEQ ID NO: 26467 - DNA, 22 bp, Homo sapiens
actggggactctggccttttga

SEQ ID NO: 26468 - DNA, 22 bp, Homo sapiens
gtgtttggtcagacgtccgggg

SEQ ID NO: 26469 - DNA, 22 bp, Homo sapiens
tgttctctaagccacccatttt

SEQ ID NO: 26470 - DNA, 22 bp, Homo sapiens
ggccactgctctccagcctggg

SEQ ID NO: 26471 - DNA, 22 bp, Homo sapiens
tacaacaatttccacattagaa

SEQ ID NO: 26472 - DNA, 22 bp, Homo sapiens
agctgaaacttcccattaattg

SEQ ID NO: 26473 - DNA, 22 bp, Homo sapiens
tccttcagcctcccagctcaaa

SEQ ID NO: 26474 - DNA, 22 bp, Homo sapiens
ctgctgtttctcaaaattaagt

SEQ ID NO: 26475 - DNA, 22 bp, Homo sapiens
tcactacaacctccgcctcctg

SEQ ID NO: 26476 - DNA, 22 bp, Homo sapiens
ggccggggcctgctcgcctgtg

SEQ ID NO: 26477 - DNA, 22 bp, Homo sapiens
ctttttcactgtgtcctcacac

SEQ ID NO: 26478 - DNA, 22 bp, Homo sapiens
tagaataatctgaggaaatgct

SEQ ID NO: 26479 - DNA, 22 bp, Homo sapiens
catcatcaaaagtgacagagaa

SEQ ID NO: 26480 - DNA, 20 bp, Homo sapiens
aggccccaggtggacactag

SEQ ID NO: 26481 - DNA, 22 bp, Homo sapiens
ccctctgcatacaggcgaggag

SEQ ID NO: 26482 - DNA, 22 bp, Homo sapiens
cttctgagatgttgttttacag

SEQ ID NO: 26483 - DNA, 22 bp, Homo sapiens
ggagtgcagtggtgggatctca

SEQ ID NO: 26484 - DNA, 22 bp, Homo sapiens
ggcaaggggtcaggctgagaca

SEQ ID NO: 26485 - DNA, 22 bp, Homo sapiens
acgtgcaggatctggttggcga

SEQ ID NO: 26486 - DNA, 22 bp, Homo sapiens
aggtcaccatggcatgctccac

SEQ ID NO: 26487 - DNA, 22 bp, Homo sapiens
tgtacacatggtgtacactccc

SEQ ID NO: 26488 - DNA, 22 bp, Homo sapiens
cccctacacacccctcttggca

SEQ ID NO: 26489 - DNA, 22 bp, Homo sapiens
ggagagtggattccagctgtat

SEQ ID NO: 26490 - DNA, 22 bp, Homo sapiens
gggaagtgatggagccaggatt

SEQ ID NO: 26491 - DNA, 22 bp, Homo sapiens
acagaactgggaaatgcacata

SEQ ID NO: 26492 - DNA, 21 bp, Homo sapiens
ctggaggcaggtggtgccagg

SEQ ID NO: 26493 - DNA, 22 bp, Homo sapiens
gggggggtcttcagacctcaga

SEQ ID NO: 26494 - DNA, 22 bp, Homo sapiens
agggtggcactggtggctctat

SEQ ID NO: 26495 - DNA, 22 bp, Homo sapiens
ctgtctgcaggatagtaccctc

SEQ ID NO: 26496 - DNA, 22 bp, Homo sapiens
gtggcctggctggcaccacctc

SEQ ID NO: 26497 - DNA, 22 bp, Homo sapiens
tgagccaagatcatgccgttgt

SEQ ID NO: 26498 - DNA, 22 bp, Homo sapiens
gtgaaatatttaacgtccaggt

SEQ ID NO: 26499 - DNA, 22 bp, Homo sapiens
atgacaagagtgttcagggaga

SEQ ID NO: 26500 - DNA, 22 bp, Homo sapiens
ttggggtcccacaggctgcctg

SEQ ID NO: 26501 - DNA, 23 bp, Homo sapiens
aatgggtgcaactatccatgaca

SEQ ID NO: 26502 - DNA, 22 bp, Homo sapiens
tttcttctatgtgtgatatttt

SEQ ID NO: 26503 - DNA, 22 bp, Homo sapiens
ttagaggaaagactgggactaa

SEQ ID NO: 26504 - DNA, 22 bp, Homo sapiens
tccctgcaggtgtgcaagctga

SEQ ID NO: 26505 - DNA, 16 bp, Homo sapiens
gcgcctcctcggcctc

SEQ ID NO: 26506 - DNA, 22 bp, Homo sapiens
tttggaaatgaccccgtctaag

SEQ ID NO: 26507 - DNA, 21 bp, Homo sapiens
cgggaaggaggttctgaccct

SEQ ID NO: 26508 - DNA, 22 bp, Homo sapiens
agaaagtgcttccctttggtga

SEQ ID NO: 26509 - DNA, 22 bp, Homo sapiens
cgcaccactgaattccagcctg

SEQ ID NO: 26510 - DNA, 22 bp, Homo sapiens
gttttgaatactactagaactt

SEQ ID NO: 26511 - DNA, 22 bp, Homo sapiens
gtggcaagatgactactcactg

SEQ ID NO: 26512 - DNA, 22 bp, Homo sapiens
gtccacagctctgaggtctccc

SEQ ID NO: 26513 - DNA, 22 bp, Homo sapiens
tgggactcactcttttggccag

SEQ ID NO: 26514 - DNA, 22 bp, Homo sapiens
aaaagtaattgtggttttggcc

SEQ ID NO: 26515 - DNA, 22 bp, Homo sapiens
ggttggtaactccctgtgcagt

SEQ ID NO: 26516 - DNA, 22 bp, Homo sapiens
agcccttagtacatttctcaag

SEQ ID NO: 26517 - DNA, 20 bp, Homo sapiens
aaaatatgtataactcttct

SEQ ID NO: 26518 - DNA, 22 bp, Homo sapiens
agggctgcccagtgtgagagct

SEQ ID NO: 26519 - DNA, 22 bp, Homo sapiens
aactcctctctggtggttcgtc

SEQ ID NO: 26520 - DNA, 22 bp, Homo sapiens
gccatcctgatgacaggccact

SEQ ID NO: 26521 - DNA, 20 bp, Homo sapiens
gggcaaggaaacagccccca

SEQ ID NO: 26522 - DNA, 22 bp, Homo sapiens
tccaccatgtaacaagctctgt

SEQ ID NO: 26523 - DNA, 22 bp, Homo sapiens
gagacacaggcacagaagaggc

SEQ ID NO: 26524 - DNA, 23 bp, Homo sapiens
agcagccagagatcctcggccct

SEQ ID NO: 26525 - DNA, 21 bp, Homo sapiens
tcctgtaagcttgggtggctc

SEQ ID NO: 26526 - DNA, 22 bp, Homo sapiens
gctgctaagcgtttctgttcca

SEQ ID NO: 26527 - DNA, 22 bp, Homo sapiens
tgtgttgtgacattcttggatg

SEQ ID NO: 26528 - DNA, 22 bp, Homo sapiens
ctctggaggtggaggttgcagt

SEQ ID NO: 26529 - DNA, 22 bp, Homo sapiens
tgaggcaggaggttgagaactg

SEQ ID NO: 26530 - DNA, 22 bp, Homo sapiens
cagaccagaaggaagccgacaa

SEQ ID NO: 26531 - DNA, 22 bp, Homo sapiens
gcatatgatcacgtgtgtcggt

SEQ ID NO: 26532 - DNA, 22 bp, Homo sapiens
acgcagtttgtggacatttttt

SEQ ID NO: 26533 - DNA, 22 bp, Homo sapiens
aacatgatttcatgcatttaga

SEQ ID NO: 26534 - DNA, 22 bp, Homo sapiens
tgtggttttggttcagaaacaa

SEQ ID NO: 26535 - DNA, 22 bp, Homo sapiens
ctctggaccctcctgctgagag

SEQ ID NO: 26536 - DNA, 22 bp, Homo sapiens
caaagttgcagttatgtgatta

SEQ ID NO: 26537 - DNA, 22 bp, Homo sapiens
tcttttgtgattctttagttac

SEQ ID NO: 26538 - DNA, 21 bp, Homo sapiens
tcacgtggtcacatgagcttt

SEQ ID NO: 26539 - DNA, 20 bp, Homo sapiens
ggccggggagctctccaggg

SEQ ID NO: 26540 - DNA, 22 bp, Homo sapiens
ggggtccctgcaccagcatgtc

SEQ ID NO: 26541 - DNA, 22 bp, Homo sapiens
ggaggcccagaaggaagcccag

SEQ ID NO: 26542 - DNA, 19 bp, Homo sapiens
agtcctggcctgggggacc

SEQ ID NO: 26543 - DNA, 22 bp, Homo sapiens
tatgctctgagacctttgtgca

SEQ ID NO: 26544 - DNA, 22 bp, Homo sapiens
ttgagggtctggatctgctgct

SEQ ID NO: 26545 - DNA, 22 bp, Homo sapiens
aatgttgtgcatgtattttgta

SEQ ID NO: 26546 - DNA, 22 bp, Homo sapiens
tctcagaacctcagtttgctct

SEQ ID NO: 26547 - DNA, 22 bp, Homo sapiens
tggaagctcaaggcagggtgag

SEQ ID NO: 26548 - DNA, 22 bp, Homo sapiens
ggctctgtaagtgttgcaggta

SEQ ID NO: 26549 - DNA, 22 bp, Homo sapiens
gagaaagcttctttcccacagg

SEQ ID NO: 26550 - DNA, 22 bp, Homo sapiens
gaggtggctgcttgctgggaaa

SEQ ID NO: 26551 - DNA, 22 bp, Homo sapiens
tcctagttctctgccagtcgct

SEQ ID NO: 26552 - DNA, 21 bp, Homo sapiens
cactccacttagaacagggtt

SEQ ID NO: 26553 - DNA, 22 bp, Homo sapiens
ccaggggttggaggttgcagtg

SEQ ID NO: 26554 - DNA, 22 bp, Homo sapiens
gctgtctgtcttcacatctcgc

SEQ ID NO: 26555 - DNA, 22 bp, Homo sapiens
ggctagggatctagaccaggac

SEQ ID NO: 26556 - DNA, 22 bp, Homo sapiens
ggcagggagtggagactcccta

SEQ ID NO: 26557 - DNA, 22 bp, Homo sapiens
tctgtataaagtaccggtggca

SEQ ID NO: 26558 - DNA, 22 bp, Homo sapiens
cccaggaggcagagatagcagt

SEQ ID NO: 26559 - DNA, 22 bp, Homo sapiens
ctccggccgcggtgcccagcgc

SEQ ID NO: 26560 - DNA, 22 bp, Homo sapiens
gcccaggctggagtgcagtggc

SEQ ID NO: 26561 - DNA, 22 bp, Homo sapiens
tgaggcactccaggatgctgtt

SEQ ID NO: 26562 - DNA, 22 bp, Homo sapiens
agcctattccaggatgagctca

SEQ ID NO: 26563 - DNA, 22 bp, Homo sapiens
cctggagagctcgggccaggca

SEQ ID NO: 26564 - DNA, 22 bp, Homo sapiens
ctgtatctgtgttggatgagtt

SEQ ID NO: 26565 - DNA, 22 bp, Homo sapiens
cctgcagacacttgtccagcaa

SEQ ID NO: 26566 - DNA, 22 bp, Homo sapiens
ctgtaatcccagctacctggga

SEQ ID NO: 26567 - DNA, 22 bp, Homo sapiens
cgtgatttctggctttctatat

SEQ ID NO: 26568 - DNA, 22 bp, Homo sapiens
tagcagcatttttgtagagtat

SEQ ID NO: 26569 - DNA, 22 bp, Homo sapiens
tgcagcttcactcctgaagcca

SEQ ID NO: 26570 - DNA, 22 bp, Homo sapiens
ccagagtcccttgcagctcagt

SEQ ID NO: 26571 - DNA, 22 bp, Homo sapiens
ggcttggaccagtcacagtggt

SEQ ID NO: 26572 - DNA, 22 bp, Homo sapiens
accctaataatcacagactagt

SEQ ID NO: 26573 - DNA, 22 bp, Homo sapiens
gcctgttctccagcatccaggt

SEQ ID NO: 26574 - DNA, 22 bp, Homo sapiens
ctccatgtctgtaacacatgac

SEQ ID NO: 26575 - DNA, 22 bp, Homo sapiens
agatgcttactatggttgtatg

SEQ ID NO: 26576 - DNA, 22 bp, Homo sapiens
tggagaattctatgttgagggg

SEQ ID NO: 26577 - DNA, 22 bp, Homo sapiens
tgaacatgctgttgatggcctg

SEQ ID NO: 26578 - DNA, 22 bp, Homo sapiens
tcttgccgcgcaggcgcagttc

SEQ ID NO: 26579 - DNA, 22 bp, Homo sapiens
gcaggcggaggttgcagtgagc

SEQ ID NO: 26580 - DNA, 22 bp, Homo sapiens
gccttgtttcattacacgtggt

SEQ ID NO: 26581 - DNA, 22 bp, Homo sapiens
tggaagactcaaggtggtgaat

SEQ ID NO: 26582 - DNA, 22 bp, Homo sapiens
tggtaaggttccagatctagaa

SEQ ID NO: 26583 - DNA, 22 bp, Homo sapiens
cccgggaggcggaggttgcagt

SEQ ID NO: 26584 - DNA, 22 bp, Homo sapiens
ctgtggctctcagaggctgctg

SEQ ID NO: 26585 - DNA, 22 bp, Homo sapiens
accagcctggccaacatggtga

SEQ ID NO: 26586 - DNA, 22 bp, Homo sapiens
cgcccaggctggagtgcagtgg

SEQ ID NO: 26587 - DNA, 22 bp, Homo sapiens
agtggcaggatctcggttcact

SEQ ID NO: 26588 - DNA, 22 bp, Homo sapiens
taacagtatatttaccaaacct

SEQ ID NO: 26589 - DNA, 22 bp, Homo sapiens
gtgttgatgacattttagaaac

SEQ ID NO: 26590 - DNA, 20 bp, Homo sapiens
gttaggaggttggacatgga

SEQ ID NO: 26591 - DNA, 22 bp, Homo sapiens
tttcacagaggaggaagctgag

SEQ ID NO: 26592 - DNA, 22 bp, Homo sapiens
attcaccttgataaggggatca

SEQ ID NO: 26593 - DNA, 22 bp, Homo sapiens
aggtcaagggagctgagggcca

SEQ ID NO: 26594 - DNA, 17 bp, Homo sapiens
tgcatgtcctttgttcc

SEQ ID NO: 26595 - DNA, 23 bp, Homo sapiens
cgggttcacgccattctcctgcc

SEQ ID NO: 26596 - DNA, 22 bp, Homo sapiens
ccatgtacatgaacacggcggc

SEQ ID NO: 26597 - DNA, 22 bp, Homo sapiens
ggcctcgcggcttctggtggct

SEQ ID NO: 26598 - DNA, 23 bp, Homo sapiens
ttaacaggatctcgggcaagagg

SEQ ID NO: 26599 - DNA, 22 bp, Homo sapiens
ccgggctggagtgcaatggctc

SEQ ID NO: 26600 - DNA, 22 bp, Homo sapiens
aggatgagccgcgcaagctgac

SEQ ID NO: 26601 - DNA, 22 bp, Homo sapiens
agcctgggcaacagagcaaaac

SEQ ID NO: 26602 - DNA, 22 bp, Homo sapiens
ttccatttggcacttcactgag

SEQ ID NO: 26603 - DNA, 22 bp, Homo sapiens
ttgtggttaaccgcacattttt

SEQ ID NO: 26604 - DNA, 20 bp, Homo sapiens
cagagccagggttttgtttt

SEQ ID NO: 26605 - DNA, 23 bp, Homo sapiens
ctggggctttcaaatctgggcag

SEQ ID NO: 26606 - DNA, 22 bp, Homo sapiens
atgtgctgagtgtgtatataca

SEQ ID NO: 26607 - DNA, 22 bp, Homo sapiens
gaagtgtagtcttgagccccca

SEQ ID NO: 26608 - DNA, 22 bp, Homo sapiens
cccaggaggtcaaggctgcagt

SEQ ID NO: 26609 - DNA, 22 bp, Homo sapiens
agtggagcttttcctatcagag

SEQ ID NO: 26610 - DNA, 22 bp, Homo sapiens
aatgtattcttcaaccttgcta

SEQ ID NO: 26611 - DNA, 22 bp, Homo sapiens
aaaggggtaatctaaggaattc

SEQ ID NO: 26612 - DNA, 22 bp, Homo sapiens
tgtgtgattgcaggagatgtgg

SEQ ID NO: 26613 - DNA, 22 bp, Homo sapiens
gttggagtgcagcttgtgcgat

SEQ ID NO: 26614 - DNA, 22 bp, Homo sapiens
tgagtagagaattcagctaagg

SEQ ID NO: 26615 - DNA, 21 bp, Homo sapiens
gtggttctagagaaacagaat

SEQ ID NO: 26616 - DNA, 22 bp, Homo sapiens
tttatagtagcatgatttatag

SEQ ID NO: 26617 - DNA, 22 bp, Homo sapiens
cagagcccctcgtctccaccac

SEQ ID NO: 26618 - DNA, 22 bp, Homo sapiens
gatcatgcttaaagttggagtc

SEQ ID NO: 26619 - DNA, 22 bp, Homo sapiens
atcatcctagaaggaagctagg

SEQ ID NO: 26620 - DNA, 22 bp, Homo sapiens
cacctgtacagggccgggctgg

SEQ ID NO: 26621 - DNA, 22 bp, Homo sapiens
tgtttacagctgatcaggcatc

SEQ ID NO: 26622 - DNA, 22 bp, Homo sapiens
cagctcacccatcacgtctgct

SEQ ID NO: 26623 - DNA, 22 bp, Homo sapiens
tgcctaggctggagtgtagtgg

SEQ ID NO: 26624 - DNA, 22 bp, Homo sapiens
gacctggtccttgtactttgaa

SEQ ID NO: 26625 - DNA, 22 bp, Homo sapiens
tgtcatctgcgggtggcactgc

SEQ ID NO: 26626 - DNA, 22 bp, Homo sapiens
ttgaagtgagaggggctggggt

SEQ ID NO: 26627 - DNA, 22 bp, Homo sapiens
gacactgcacttggggcccaca

SEQ ID NO: 26628 - DNA, 22 bp, Homo sapiens
ggtccccccatggtgagcactg

SEQ ID NO: 26629 - DNA, 22 bp, Homo sapiens
aaccaggtgactcatggtgagc

SEQ ID NO: 26630 - DNA, 22 bp, Homo sapiens
cgtgccactgcactctagcctg

SEQ ID NO: 26631 - DNA, 22 bp, Homo sapiens
tagaggctttcagcggtaggtc

SEQ ID NO: 26632 - DNA, 18 bp, Homo sapiens
ctgtaccaccctgagggc

SEQ ID NO: 26633 - DNA, 22 bp, Homo sapiens
gtcatcatcaggcagatgctgc

SEQ ID NO: 26634 - DNA, 22 bp, Homo sapiens
aagggctctgtgcttgtcccat

SEQ ID NO: 26635 - DNA, 22 bp, Homo sapiens
taactctgaatcctcacagcag

SEQ ID NO: 26636 - DNA, 22 bp, Homo sapiens
acccaggccattggcaagagtc

SEQ ID NO: 26637 - DNA, 22 bp, Homo sapiens
tgaggtgcagcaatcctcatgt

SEQ ID NO: 26638 - DNA, 22 bp, Homo sapiens
cttgtagaattgaaatggtctc

SEQ ID NO: 26639 - DNA, 22 bp, Homo sapiens
tggcctctcctggctgagtttc

SEQ ID NO: 26640 - DNA, 22 bp, Homo sapiens
actgcattctttatcccacaac

SEQ ID NO: 26641 - DNA, 22 bp, Homo sapiens
tcttgaattgtactcccataag

SEQ ID NO: 26642 - DNA, 22 bp, Homo sapiens
tgaggccggagacaagagactt

SEQ ID NO: 26643 - DNA, 22 bp, Homo sapiens
agcatgcgcttgatcagctcca

SEQ ID NO: 26644 - DNA, 18 bp, Homo sapiens
tctggaacaacttcatgt

SEQ ID NO: 26645 - DNA, 22 bp, Homo sapiens
gataccagacagggagggagaa

SEQ ID NO: 26646 - DNA, 22 bp, Homo sapiens
ggctcactgcaacctccacctc

SEQ ID NO: 26647 - DNA, 22 bp, Homo sapiens
caaagtgctgggattacaggct

SEQ ID NO: 26648 - DNA, 22 bp, Homo sapiens
agggagcattgtgacatatcac

SEQ ID NO: 26649 - DNA, 22 bp, Homo sapiens
caggcagaagaagtggaaggac

SEQ ID NO: 26650 - DNA, 22 bp, Homo sapiens
ttactggctgggcctgagggct

SEQ ID NO: 26651 - DNA, 22 bp, Homo sapiens
gagcaacacgcagtagtatacg

SEQ ID NO: 26652 - DNA, 22 bp, Homo sapiens
tgaggtgccacccaagagcctt

SEQ ID NO: 26653 - DNA, 22 bp, Homo sapiens
atcatgacatacttttgagaag

SEQ ID NO: 26654 - DNA, 22 bp, Homo sapiens
aatgccagtgtgttgattccag

SEQ ID NO: 26655 - DNA, 22 bp, Homo sapiens
aggtgactggtttatctggcag

SEQ ID NO: 26656 - DNA, 22 bp, Homo sapiens
gggtgctttggctcacgcctgt

SEQ ID NO: 26657 - DNA, 22 bp, Homo sapiens
aaattagtcatgttgtattact

SEQ ID NO: 26658 - DNA, 22 bp, Homo sapiens
aaagcttaccttttcagtcttt

SEQ ID NO: 26659 - DNA, 22 bp, Homo sapiens
ctctgcaacttctagcagtgtc

SEQ ID NO: 26660 - DNA, 22 bp, Homo sapiens
atgggctgtccattgctggctg

SEQ ID NO: 26661 - DNA, 22 bp, Homo sapiens
tcctggtgctgacacccatagc

SEQ ID NO: 26662 - DNA, 21 bp, Homo sapiens
cttccccaggctggtctgtat

SEQ ID NO: 26663 - DNA, 22 bp, Homo sapiens
ggctgccttccctgagccccgg

SEQ ID NO: 26664 - DNA, 22 bp, Homo sapiens
gaccttgtgctccgaggcgggc

SEQ ID NO: 26665 - DNA, 22 bp, Homo sapiens
tccgggaggcagaggttgcagt

SEQ ID NO: 26666 - DNA, 22 bp, Homo sapiens
ggcggaggttgcagtaagccga

SEQ ID NO: 26667 - DNA, 22 bp, Homo sapiens
ggtctcatctttcagcgtcgag

SEQ ID NO: 26668 - DNA, 22 bp, Homo sapiens
agtgctgggctatctactgcta

SEQ ID NO: 26669 - DNA, 22 bp, Homo sapiens
gcagcgaggtgatgaaatagct

SEQ ID NO: 26670 - DNA, 22 bp, Homo sapiens
gggagctggagctggaagactc

SEQ ID NO: 26671 - DNA, 22 bp, Homo sapiens
gcgtggcttagagtggggtacc

SEQ ID NO: 26672 - DNA, 22 bp, Homo sapiens
tactgcgccttcaccaagcggc

SEQ ID NO: 26673 - DNA, 21 bp, Homo sapiens
gccagcggccgccctccagga

SEQ ID NO: 26674 - DNA, 22 bp, Homo sapiens
tgagacttaagaggtcatgttg

SEQ ID NO: 26675 - DNA, 22 bp, Homo sapiens
agttggcttcaaaggcagagag

SEQ ID NO: 26676 - DNA, 22 bp, Homo sapiens
tagtttcatctccaccctgccc

SEQ ID NO: 26677 - DNA, 22 bp, Homo sapiens
aagcagaatagaggcccttccc

SEQ ID NO: 26678 - DNA, 22 bp, Homo sapiens
ttttgacaatgctaatctcaat

SEQ ID NO: 26679 - DNA, 22 bp, Homo sapiens
tcggggtctttgacacgctctg

SEQ ID NO: 26680 - DNA, 22 bp, Homo sapiens
cgtctggcttctccacggtaaa

SEQ ID NO: 26681 - DNA, 22 bp, Homo sapiens
ctggcaggttatagagctgccc

SEQ ID NO: 26682 - DNA, 22 bp, Homo sapiens
atgtctgtttgctgagcccggc

SEQ ID NO: 26683 - DNA, 22 bp, Homo sapiens
gtggctgcagcggctgtggaga

SEQ ID NO: 26684 - DNA, 22 bp, Homo sapiens
acacttggagcaacacttatgg

SEQ ID NO: 26685 - DNA, 19 bp, Homo sapiens
aatgtcagcatgttaattt

SEQ ID NO: 26686 - DNA, 22 bp, Homo sapiens
gtctccttgtggatctcaagga

SEQ ID NO: 26687 - DNA, 22 bp, Homo sapiens
ctcactgcaatctccgtctccc

SEQ ID NO: 26688 - DNA, 22 bp, Homo sapiens
agatgtgtttctagttcctgca

SEQ ID NO: 26689 - DNA, 22 bp, Homo sapiens
aggtccaaggtagggcccagac

SEQ ID NO: 26690 - DNA, 22 bp, Homo sapiens
tcaaagtccttgctttttctgt

SEQ ID NO: 26691 - DNA, 22 bp, Homo sapiens
gaaccattgttgaaaagaatag

SEQ ID NO: 26692 - DNA, 22 bp, Homo sapiens
cacgggagacgtgatcttggac

SEQ ID NO: 26693 - DNA, 22 bp, Homo sapiens
gcataaactccaaaaggcaggg

SEQ ID NO: 26694 - DNA, 22 bp, Homo sapiens
gtgggctgcccttgaggtcagc

SEQ ID NO: 26695 - DNA, 22 bp, Homo sapiens
tagtggatgttcagagatttga

SEQ ID NO: 26696 - DNA, 22 bp, Homo sapiens
gtcatcttgctgttttagatct

SEQ ID NO: 26697 - DNA, 20 bp, Homo sapiens
tcagccttgaatgcttgaaa

SEQ ID NO: 26698 - DNA, 22 bp, Homo sapiens
ttcttcatgggttcttttagga

SEQ ID NO: 26699 - DNA, 22 bp, Homo sapiens
gttgaggtgatgccagccctgc

SEQ ID NO: 26700 - DNA, 22 bp, Homo sapiens
tgcagaaacaagccatcattca

SEQ ID NO: 26701 - DNA, 22 bp, Homo sapiens
gaaggaagtcattagtgcagac

SEQ ID NO: 26702 - DNA, 22 bp, Homo sapiens
aataaacaaaggacaaggaggt

SEQ ID NO: 26703 - DNA, 22 bp, Homo sapiens
atgttatgtctgggaaggggta

SEQ ID NO: 26704 - DNA, 22 bp, Homo sapiens
accagaagctggagcacaagga

SEQ ID NO: 26705 - DNA, 22 bp, Homo sapiens
taggtagatttaaagattttct

SEQ ID NO: 26706 - DNA, 22 bp, Homo sapiens
agcctggcctgggcaggcacat

SEQ ID NO: 26707 - DNA, 22 bp, Homo sapiens
tagcatgtcagtcgccacacgt

SEQ ID NO: 26708 - DNA, 21 bp, Homo sapiens
aggcatgagccctgcatggac

SEQ ID NO: 26709 - DNA, 22 bp, Homo sapiens
tattagttgcaaaacattgact

SEQ ID NO: 26710 - DNA, 20 bp, Homo sapiens
cgcccagtgcggttctgacc

SEQ ID NO: 26711 - DNA, 22 bp, Homo sapiens
atctggttttggctgtgtccct

SEQ ID NO: 26712 - DNA, 22 bp, Homo sapiens
attgcactccagcctgggcaac

SEQ ID NO: 26713 - DNA, 22 bp, Homo sapiens
gattgagtctgaggatgctgca

SEQ ID NO: 26714 - DNA, 22 bp, Homo sapiens
ggctgagttgagaggattactt

SEQ ID NO: 26715 - DNA, 22 bp, Homo sapiens
acaccatactcatgttggttcc

SEQ ID NO: 26716 - DNA, 22 bp, Homo sapiens
tgcctccaacagcccatcctag

SEQ ID NO: 26717 - DNA, 22 bp, Homo sapiens
cagccctcctaccctgccaggc

SEQ ID NO: 26718 - DNA, 22 bp, Homo sapiens
cacattccttacattcatagag

SEQ ID NO: 26719 - DNA, 22 bp, Homo sapiens
ttgggctgaaccctgcagctga

SEQ ID NO: 26720 - DNA, 22 bp, Homo sapiens
aaacttgagccaagggcttggg

SEQ ID NO: 26721 - DNA, 22 bp, Homo sapiens
caatttgattaataccatactt

SEQ ID NO: 26722 - DNA, 22 bp, Homo sapiens
aagggggcggcagccagtggaa

SEQ ID NO: 26723 - DNA, 22 bp, Homo sapiens
tgaggctccttgtagagagtgg

SEQ ID NO: 26724 - DNA, 22 bp, Homo sapiens
ctggccaagatggtgaaacccc

SEQ ID NO: 26725 - DNA, 22 bp, Homo sapiens
ccttggcaggcacgtcctgcgg

SEQ ID NO: 26726 - DNA, 22 bp, Homo sapiens
gcccatttttagtagatttagt

SEQ ID NO: 26727 - DNA, 22 bp, Homo sapiens
accaggggatggttggcactgt

SEQ ID NO: 26728 - DNA, 23 bp, Homo sapiens
gtgcgccaggacaacctgacgga

SEQ ID NO: 26729 - DNA, 22 bp, Homo sapiens
ttgccaggctggagtgcagtgg

SEQ ID NO: 26730 - DNA, 22 bp, Homo sapiens
tgggctgcaggggttgagagct

SEQ ID NO: 26731 - DNA, 22 bp, Homo sapiens
acactctagagggaagcgcttt

SEQ ID NO: 26732 - DNA, 22 bp, Homo sapiens
cttcttgttgttagggtcctgt

SEQ ID NO: 26733 - DNA, 22 bp, Homo sapiens
cccagcaaggccagctcagggc

SEQ ID NO: 26734 - DNA, 22 bp, Homo sapiens
ccctgctgtgtagcggaggaac

SEQ ID NO: 26735 - DNA, 17 bp, Homo sapiens
cactagtagtctctggc

SEQ ID NO: 26736 - DNA, 22 bp, Homo sapiens
tgtacttgaacttgactgtaga

SEQ ID NO: 26737 - DNA, 22 bp, Homo sapiens
tctatgtctcgacccaagacaa

SEQ ID NO: 26738 - DNA, 22 bp, Homo sapiens
gaggcggaggttgcagtgagcc

SEQ ID NO: 26739 - DNA, 22 bp, Homo sapiens
gaggtaggtgtaggaggcctgc

SEQ ID NO: 26740 - DNA, 20 bp, Homo sapiens
aactcctagcctcaagtgat

SEQ ID NO: 26741 - DNA, 22 bp, Homo sapiens
caccgagtgacagtagccatca

SEQ ID NO: 26742 - DNA, 22 bp, Homo sapiens
ctggagagaatgtggaatgatt

SEQ ID NO: 26743 - DNA, 22 bp, Homo sapiens
ttagtgcttggcacacaataca

SEQ ID NO: 26744 - DNA, 19 bp, Homo sapiens
ggagtttccaatgggtaaa

SEQ ID NO: 26745 - DNA, 19 bp, Homo sapiens
catctggatgattctcctg

SEQ ID NO: 26746 - DNA, 22 bp, Homo sapiens
gcctccagggatgattccttcc

SEQ ID NO: 26747 - DNA, 22 bp, Homo sapiens
tcttgggcagcttgctcgcccc

SEQ ID NO: 26748 - DNA, 22 bp, Homo sapiens
tggagccagagcgcagcctggg

SEQ ID NO: 26749 - DNA, 22 bp, Homo sapiens
tttgtttgccacacaaaacagt

SEQ ID NO: 26750 - DNA, 22 bp, Homo sapiens
ttcatgtgtttgttgtcaaggg

SEQ ID NO: 26751 - DNA, 22 bp, Homo sapiens
gtggcttgagcaggggcagagg

SEQ ID NO: 26752 - DNA, 22 bp, Homo sapiens
cccagggaggcccaggctctgc

SEQ ID NO: 26753 - DNA, 22 bp, Homo sapiens
ggtcttcctatggcggggccct

SEQ ID NO: 26754 - DNA, 22 bp, Homo sapiens
aaacatctactgtaggctggag

SEQ ID NO: 26755 - DNA, 22 bp, Homo sapiens
ttacaattacttgatctcagct

SEQ ID NO: 26756 - DNA, 22 bp, Homo sapiens
tgagcacatgccagcccttctc

SEQ ID NO: 26757 - DNA, 22 bp, Homo sapiens
tctctagtctcctttaacctga

SEQ ID NO: 26758 - DNA, 22 bp, Homo sapiens
cactgggcgtgtcctgggtgag

SEQ ID NO: 26759 - DNA, 22 bp, Homo sapiens
gtagcccacctggggagggcga

SEQ ID NO: 26760 - DNA, 22 bp, Homo sapiens
cgtggcctctatggctcccgcc

SEQ ID NO: 26761 - DNA, 22 bp, Homo sapiens
tgatttatgcattatactgttg

SEQ ID NO: 26762 - DNA, 22 bp, Homo sapiens
gcaggagaacaaagcaagctgc

SEQ ID NO: 26763 - DNA, 22 bp, Homo sapiens
tgagcctgtcattattcagaga

SEQ ID NO: 26764 - DNA, 22 bp, Homo sapiens
gcaggctgtctaaagttagagt

SEQ ID NO: 26765 - DNA, 22 bp, Homo sapiens
cggccaagccggggccccgaag

SEQ ID NO: 26766 - DNA, 19 bp, Homo sapiens
gataggcagccatgagccc

SEQ ID NO: 26767 - DNA, 22 bp, Homo sapiens
ttctcccatctcagtcttacat

SEQ ID NO: 26768 - DNA, 22 bp, Homo sapiens
ttctaattaaatctacgctagg

SEQ ID NO: 26769 - DNA, 22 bp, Homo sapiens
cccgggaggcagaggttgcagt

SEQ ID NO: 26770 - DNA, 21 bp, Homo sapiens
tgactgaggcttcttcacaca

SEQ ID NO: 26771 - DNA, 22 bp, Homo sapiens
ggtgcagaggagccagctgggg

SEQ ID NO: 26772 - DNA, 22 bp, Homo sapiens
ccggtctgtgtacttgctggcc

SEQ ID NO: 26773 - DNA, 22 bp, Homo sapiens
cattacagaatatgtaatgatc

SEQ ID NO: 26774 - DNA, 22 bp, Homo sapiens
atgaaatatcttgaagaaattc

SEQ ID NO: 26775 - DNA, 22 bp, Homo sapiens
actgggcagcagctcgagccgc

SEQ ID NO: 26776 - DNA, 22 bp, Homo sapiens
ccctagtccacaggttcctgga

SEQ ID NO: 26777 - DNA, 22 bp, Homo sapiens
ccctctcgcggggcagcggagg

SEQ ID NO: 26778 - DNA, 22 bp, Homo sapiens
gctcagacctgtaatcttagca

SEQ ID NO: 26779 - DNA, 22 bp, Homo sapiens
accagcctggccaacatggcaa

SEQ ID NO: 26780 - DNA, 23 bp, Homo sapiens
gggggccgtcctggggattatag

SEQ ID NO: 26781 - DNA, 22 bp, Homo sapiens
gcccaggagttcaagtctagtg

SEQ ID NO: 26782 - DNA, 22 bp, Homo sapiens
tgcctctgaggaagattgtgtt

SEQ ID NO: 26783 - DNA, 23 bp, Homo sapiens
agcttttaggtggaaatggcact

SEQ ID NO: 26784 - DNA, 22 bp, Homo sapiens
cagtaatgggcaagacaatatg

SEQ ID NO: 26785 - DNA, 22 bp, Homo sapiens
aaatcccatcggagaggaggat

SEQ ID NO: 26786 - DNA, 22 bp, Homo sapiens
acatgagactgggtttgtaggg

SEQ ID NO: 26787 - DNA, 22 bp, Homo sapiens
accacatcgggcggacactggg

SEQ ID NO: 26788 - DNA, 22 bp, Homo sapiens
agccccttgtgggcgcacagca

SEQ ID NO: 26789 - DNA, 22 bp, Homo sapiens
agaaaatttaaagagacacaca

SEQ ID NO: 26790 - DNA, 22 bp, Homo sapiens
gagctctgactgctgggtgaca

SEQ ID NO: 26791 - DNA, 21 bp, Homo sapiens
agcctcaggttgttggttctt

SEQ ID NO: 26792 - DNA, 22 bp, Homo sapiens
ctggctctcaggctggtcccca

SEQ ID NO: 26793 - DNA, 22 bp, Homo sapiens
cggggcgagcagacggcggcaa

SEQ ID NO: 26794 - DNA, 22 bp, Homo sapiens
cactaggcgccgggtggctgtg

SEQ ID NO: 26795 - DNA, 22 bp, Homo sapiens
taggtttactgaattagtggaa

SEQ ID NO: 26796 - DNA, 22 bp, Homo sapiens
attaggtcatggggaggcccta

SEQ ID NO: 26797 - DNA, 22 bp, Homo sapiens
ttccagagagttattcccctgg

SEQ ID NO: 26798 - DNA, 22 bp, Homo sapiens
tgctcattggcgatctgaggga

SEQ ID NO: 26799 - DNA, 22 bp, Homo sapiens
aggtaaagacagtgaaagaggg

SEQ ID NO: 26800 - DNA, 22 bp, Homo sapiens
cactctcacatgccctgtcagt

SEQ ID NO: 26801 - DNA, 22 bp, Homo sapiens
aaagggaagttgcacatgttcc

SEQ ID NO: 26802 - DNA, 22 bp, Homo sapiens
cactctgcgctgggcgccagcg

SEQ ID NO: 26803 - DNA, 22 bp, Homo sapiens
gggcagcagccactcatttagc

SEQ ID NO: 26804 - DNA, 22 bp, Homo sapiens
gcgctcagaaaagattttcttc

SEQ ID NO: 26805 - DNA, 20 bp, Homo sapiens
cttctggctggtcaaggact

SEQ ID NO: 26806 - DNA, 22 bp, Homo sapiens
tgtgggagaaggaagcaagctg

SEQ ID NO: 26807 - DNA, 22 bp, Homo sapiens
ggccaattccaggagccggcgg

SEQ ID NO: 26808 - DNA, 22 bp, Homo sapiens
catccaccgcgtgcacctctac

SEQ ID NO: 26809 - DNA, 22 bp, Homo sapiens
actaaagctcacagagttgaac

SEQ ID NO: 26810 - DNA, 18 bp, Homo sapiens
tcaagtgattctcctgcc

SEQ ID NO: 26811 - DNA, 22 bp, Homo sapiens
tagatctgatacaattcatctg

SEQ ID NO: 26812 - DNA, 22 bp, Homo sapiens
gcctggccgggtcttggatttt

SEQ ID NO: 26813 - DNA, 22 bp, Homo sapiens
tgaccctgagagctgaatggct

SEQ ID NO: 26814 - DNA, 22 bp, Homo sapiens
gtctatgatattttgttatagc

SEQ ID NO: 26815 - DNA, 22 bp, Homo sapiens
cagagagaatcttggcagctga

SEQ ID NO: 26816 - DNA, 22 bp, Homo sapiens
ttttctaacatctagtaatttg

SEQ ID NO: 26817 - DNA, 22 bp, Homo sapiens
caggcaggtcagtgaagaagga

SEQ ID NO: 26818 - DNA, 22 bp, Homo sapiens
ctggaggtgcttcgctggccac

SEQ ID NO: 26819 - DNA, 22 bp, Homo sapiens
gtgtggaatggagtttttgccc

SEQ ID NO: 26820 - DNA, 22 bp, Homo sapiens
atccccactgctgctggtgtag

SEQ ID NO: 26821 - DNA, 22 bp, Homo sapiens
tcagccccacggggtcagccaa

SEQ ID NO: 26822 - DNA, 22 bp, Homo sapiens
gggcatgtcccgctgtgcaccg

SEQ ID NO: 26823 - DNA, 22 bp, Homo sapiens
tagtaacccacacaacagtaga

SEQ ID NO: 26824 - DNA, 22 bp, Homo sapiens
ttgatcaaatcagctactgagg

SEQ ID NO: 26825 - DNA, 23 bp, Homo sapiens
atgtttgcagtaacccatcctgg

SEQ ID NO: 26826 - DNA, 22 bp, Homo sapiens
tgcccagggtggagtgcagtgg

SEQ ID NO: 26827 - DNA, 22 bp, Homo sapiens
ctcacctccaggagctgctggc

SEQ ID NO: 26828 - DNA, 22 bp, Homo sapiens
atgccactgacatggacaattt

SEQ ID NO: 26829 - DNA, 22 bp, Homo sapiens
tgggatgctcagggcctggagc

SEQ ID NO: 26830 - DNA, 22 bp, Homo sapiens
gggctgactcctattggatgaa

SEQ ID NO: 26831 - DNA, 22 bp, Homo sapiens
tctagctctgcttatcatggct

SEQ ID NO: 26832 - DNA, 22 bp, Homo sapiens
ctgggaggcggaggttgcagtg

SEQ ID NO: 26833 - DNA, 22 bp, Homo sapiens
ggcccaggctggagtgcagtgg

SEQ ID NO: 26834 - DNA, 22 bp, Homo sapiens
tgcaggctcttggtgacgtggg

SEQ ID NO: 26835 - DNA, 22 bp, Homo sapiens
tcgaactcatagtcgtagctgt

SEQ ID NO: 26836 - DNA, 21 bp, Homo sapiens
cagtggcacgatttcggctca

SEQ ID NO: 26837 - DNA, 22 bp, Homo sapiens
ataccaccatctatgaaaggta

SEQ ID NO: 26838 - DNA, 22 bp, Homo sapiens
agcagcagtgttctggaattct

SEQ ID NO: 26839 - DNA, 23 bp, Homo sapiens
ttttgcaataagtcactggaata

SEQ ID NO: 26840 - DNA, 22 bp, Homo sapiens
ccaagcaaataatcacccacta

SEQ ID NO: 26841 - DNA, 22 bp, Homo sapiens
gagggcccgcacctcgaaactc

SEQ ID NO: 26842 - DNA, 21 bp, Homo sapiens
agtttcaggaagttcagctgc

SEQ ID NO: 26843 - DNA, 22 bp, Homo sapiens
gaaggagccgagctcttcccca

SEQ ID NO: 26844 - DNA, 22 bp, Homo sapiens
tttgtcttatccaatctctcag

SEQ ID NO: 26845 - DNA, 22 bp, Homo sapiens
tcagcctggcaggatggcctgg

SEQ ID NO: 26846 - DNA, 22 bp, Homo sapiens
catagacagatggtaagaagct

SEQ ID NO: 26847 - DNA, 22 bp, Homo sapiens
acactgatgttggccctggtca

SEQ ID NO: 26848 - DNA, 22 bp, Homo sapiens
aagcttcctgcatgggactgct

SEQ ID NO: 26849 - DNA, 22 bp, Homo sapiens
ggctttctgtctgcgtctgtgt

SEQ ID NO: 26850 - DNA, 22 bp, Homo sapiens
gtagaccatttatctggggagt

SEQ ID NO: 26851 - DNA, 22 bp, Homo sapiens
taaggggcccagaccgggcgcc

SEQ ID NO: 26852 - DNA, 22 bp, Homo sapiens
ggtcgggcactctccagggctg

SEQ ID NO: 26853 - DNA, 22 bp, Homo sapiens
agagcacggccaccatttacaa

SEQ ID NO: 26854 - DNA, 22 bp, Homo sapiens
tgatctcctgaccttgtaatcc

SEQ ID NO: 26855 - DNA, 22 bp, Homo sapiens
gggtacttaatatttacggggt

SEQ ID NO: 26856 - DNA, 23 bp, Homo sapiens
gtctctagagtgtggagcaaaga

SEQ ID NO: 26857 - DNA, 22 bp, Homo sapiens
tagggggctttgctgcttgaca

SEQ ID NO: 26858 - DNA, 22 bp, Homo sapiens
cacagcctcctctggctcacgg

SEQ ID NO: 26859 - DNA, 22 bp, Homo sapiens
gtgctgatgttgcttcccttgg

SEQ ID NO: 26860 - DNA, 22 bp, Homo sapiens
tgatggctgtagggtccggggc

SEQ ID NO: 26861 - DNA, 22 bp, Homo sapiens
ggagttgattttggatatatta

SEQ ID NO: 26862 - DNA, 22 bp, Homo sapiens
tctgaggctgaatggactccgt

SEQ ID NO: 26863 - DNA, 22 bp, Homo sapiens
aaaagcaattgcgggttttgcc

SEQ ID NO: 26864 - DNA, 22 bp, Homo sapiens
gcggggggcaggcagtacgttg

SEQ ID NO: 26865 - DNA, 20 bp, Homo sapiens
tgtcattcttctttcacagg

SEQ ID NO: 26866 - DNA, 22 bp, Homo sapiens
atcaagagcacagtgctggcat

SEQ ID NO: 26867 - DNA, 23 bp, Homo sapiens
aggtaggttattgctgctacctg

SEQ ID NO: 26868 - DNA, 22 bp, Homo sapiens
ttgctaccattgataccagcac

SEQ ID NO: 26869 - DNA, 20 bp, Homo sapiens
tcactgtaacatttgggggg

SEQ ID NO: 26870 - DNA, 22 bp, Homo sapiens
atctgggagcggaggttgcagt

SEQ ID NO: 26871 - DNA, 22 bp, Homo sapiens
agtgtggagcatcgagggcaga

SEQ ID NO: 26872 - DNA, 22 bp, Homo sapiens
tctccattagtgggtggcagtg

SEQ ID NO: 26873 - DNA, 22 bp, Homo sapiens
caggctgctgcctagaatgaca

SEQ ID NO: 26874 - DNA, 22 bp, Homo sapiens
acagaagcctttggccatttga

SEQ ID NO: 26875 - DNA, 22 bp, Homo sapiens
ggtgtcagactttgcatatcct

SEQ ID NO: 26876 - DNA, 22 bp, Homo sapiens
tacagctgctggtgctccatgc

SEQ ID NO: 26877 - DNA, 22 bp, Homo sapiens
gagctgggcctgcgagtgctgc

SEQ ID NO: 26878 - DNA, 22 bp, Homo sapiens
actgcactccagcctgggcaca

SEQ ID NO: 26879 - DNA, 22 bp, Homo sapiens
aaaggacacacaggaggtgtct

SEQ ID NO: 26880 - DNA, 22 bp, Homo sapiens
atgccactgcactccagcctag

SEQ ID NO: 26881 - DNA, 22 bp, Homo sapiens
ctgtgctccctctggcgccccg

SEQ ID NO: 26882 - DNA, 22 bp, Homo sapiens
aatgccttggagagcctagagg

SEQ ID NO: 26883 - DNA, 22 bp, Homo sapiens
ggcatcttgttgctcaaatcta

SEQ ID NO: 26884 - DNA, 22 bp, Homo sapiens
cacagagatggtctggcaggtg

SEQ ID NO: 26885 - DNA, 22 bp, Homo sapiens
tcctggtcttcaggttgcaaaa

SEQ ID NO: 26886 - DNA, 22 bp, Homo sapiens
ttcccacattctttacattcat

SEQ ID NO: 26887 - DNA, 22 bp, Homo sapiens
tagtatagattgaagcagatca

SEQ ID NO: 26888 - DNA, 22 bp, Homo sapiens
cggctggtgtcgggcacagcaa

SEQ ID NO: 26889 - DNA, 22 bp, Homo sapiens
aggtcacatacaaatgctcctt

SEQ ID NO: 26890 - DNA, 22 bp, Homo sapiens
tgtgacgttgttctggattccc

SEQ ID NO: 26891 - DNA, 22 bp, Homo sapiens
attctaaatcagagagctctgt

SEQ ID NO: 26892 - DNA, 22 bp, Homo sapiens
agagggtgggcacgtgatggat

SEQ ID NO: 26893 - DNA, 22 bp, Homo sapiens
tcgaagattctttttgttagta

SEQ ID NO: 26894 - DNA, 22 bp, Homo sapiens
cgacgggctcggtccgcttcct

SEQ ID NO: 26895 - DNA, 22 bp, Homo sapiens
caaatgtataaatgtactttct

SEQ ID NO: 26896 - DNA, 23 bp, Homo sapiens
gcagccatgttcccgtctcagct

SEQ ID NO: 26897 - DNA, 22 bp, Homo sapiens
gaatttcacaaggtgaggataa

SEQ ID NO: 26898 - DNA, 22 bp, Homo sapiens
gaggccaactttggagaacagg

SEQ ID NO: 26899 - DNA, 20 bp, Homo sapiens
aatgctgcttctttttgcat

SEQ ID NO: 26900 - DNA, 22 bp, Homo sapiens
ttcatagtgtttccttccagtg

SEQ ID NO: 26901 - DNA, 17 bp, Homo sapiens
caggtgacctggtgatg

SEQ ID NO: 26902 - DNA, 22 bp, Homo sapiens
ccaggagttggaagctgccatg

SEQ ID NO: 26903 - DNA, 22 bp, Homo sapiens
tcccctggtgccacgatctgct

SEQ ID NO: 26904 - DNA, 22 bp, Homo sapiens
gagggggctagcgcagtgccca

SEQ ID NO: 26905 - DNA, 22 bp, Homo sapiens
tctgagctgggtcttgacagct

SEQ ID NO: 26906 - DNA, 22 bp, Homo sapiens
gaggcagaagttgcagtgagca

SEQ ID NO: 26907 - DNA, 22 bp, Homo sapiens
tgagaattacaaatgagtcaca

SEQ ID NO: 26908 - DNA, 22 bp, Homo sapiens
agcctgggccctgcctcttctc

SEQ ID NO: 26909 - DNA, 22 bp, Homo sapiens
tctgagtggactgtcctgcagg

SEQ ID NO: 26910 - DNA, 22 bp, Homo sapiens
gcctacatttcccagttgaatg

SEQ ID NO: 26911 - DNA, 17 bp, Homo sapiens
gacctcaggtgatctgc

SEQ ID NO: 26912 - DNA, 22 bp, Homo sapiens
cagaaaccaaatgggatgggga

SEQ ID NO: 26913 - DNA, 22 bp, Homo sapiens
acttttcttatcagaaaggcca

SEQ ID NO: 26914 - DNA, 22 bp, Homo sapiens
tgacagaggagctggaatgatt

SEQ ID NO: 26915 - DNA, 22 bp, Homo sapiens
tttgcttgttcaagatttctgt

SEQ ID NO: 26916 - DNA, 22 bp, Homo sapiens
gtcctggggattatagagtgtt

SEQ ID NO: 26917 - DNA, 22 bp, Homo sapiens
tcacagcctggacagttgcctg

SEQ ID NO: 26918 - DNA, 22 bp, Homo sapiens
tgccttcgtacatgcaacatgc

SEQ ID NO: 26919 - DNA, 22 bp, Homo sapiens
ctgagatggagttttgctcttg

SEQ ID NO: 26920 - DNA, 22 bp, Homo sapiens
tgacttcctgcactcaggtgat

SEQ ID NO: 26921 - DNA, 22 bp, Homo sapiens
cgtcatcacggcaagcatctcc

SEQ ID NO: 26922 - DNA, 20 bp, Homo sapiens
aagacaccagtggcagcccc

SEQ ID NO: 26923 - DNA, 22 bp, Homo sapiens
tgttgattagtgtttagactta

SEQ ID NO: 26924 - DNA, 22 bp, Homo sapiens
gccaggaaagggaattccctga

SEQ ID NO: 26925 - DNA, 22 bp, Homo sapiens
taacatttaaatttttcacata

SEQ ID NO: 26926 - DNA, 22 bp, Homo sapiens
gaatgcagatggctggtgtatg

SEQ ID NO: 26927 - DNA, 22 bp, Homo sapiens
tgccttgtccttcgtcagggct

SEQ ID NO: 26928 - DNA, 22 bp, Homo sapiens
agaccaccaaaactttctccat

SEQ ID NO: 26929 - DNA, 22 bp, Homo sapiens
cttgtcagccaattgtggattt

SEQ ID NO: 26930 - DNA, 23 bp, Homo sapiens
ggcactcggccgtgaactcgtgc

SEQ ID NO: 26931 - DNA, 22 bp, Homo sapiens
caatagtaaattacggaggaga

SEQ ID NO: 26932 - DNA, 22 bp, Homo sapiens
agtggcctggagccccgcctgg

SEQ ID NO: 26933 - DNA, 22 bp, Homo sapiens
gtgcgtcctgggggctgggtcg

SEQ ID NO: 26934 - DNA, 22 bp, Homo sapiens
cccggacagaggggcagagtgt

SEQ ID NO: 26935 - DNA, 22 bp, Homo sapiens
caatcactctgcaacattcctg

SEQ ID NO: 26936 - DNA, 20 bp, Homo sapiens
tatgtgattttctcatcaat

SEQ ID NO: 26937 - DNA, 22 bp, Homo sapiens
ttgtgggatctccctgttgctc

SEQ ID NO: 26938 - DNA, 22 bp, Homo sapiens
cagcaagtcatccaggatgatg

SEQ ID NO: 26939 - DNA, 22 bp, Homo sapiens
tcacattttcaaaagctggtgc

SEQ ID NO: 26940 - DNA, 22 bp, Homo sapiens
ctgtgcgtaagtagccaaaata

SEQ ID NO: 26941 - DNA, 18 bp, Homo sapiens
ccctcttgcacaaagcaa

SEQ ID NO: 26942 - DNA, 22 bp, Homo sapiens
tatgttgcaccaacctaataat

SEQ ID NO: 26943 - DNA, 22 bp, Homo sapiens
catcatactgtttacactcaaa

SEQ ID NO: 26944 - DNA, 22 bp, Homo sapiens
ccaaggccttgaaggcgcgggg

SEQ ID NO: 26945 - DNA, 22 bp, Homo sapiens
atgaggtgggagaatcacttga

SEQ ID NO: 26946 - DNA, 22 bp, Homo sapiens
gttgtgaatagtgccgcaataa

SEQ ID NO: 26947 - DNA, 22 bp, Homo sapiens
gtctttatttgagattgtcatt

SEQ ID NO: 26948 - DNA, 22 bp, Homo sapiens
acattaaacttgcttggctgta

SEQ ID NO: 26949 - DNA, 22 bp, Homo sapiens
gactacaggtgtgtgccaccat

SEQ ID NO: 26950 - DNA, 22 bp, Homo sapiens
gagccaagattgtgtccctgca

SEQ ID NO: 26951 - DNA, 22 bp, Homo sapiens
acaagaagggtgattaggggca

SEQ ID NO: 26952 - DNA, 23 bp, Homo sapiens
cagagctggctcagagctgcctg

SEQ ID NO: 26953 - DNA, 22 bp, Homo sapiens
aaggatgattggtaatgacact

SEQ ID NO: 26954 - DNA, 22 bp, Homo sapiens
gtaatctcagctacttgggagg

SEQ ID NO: 26955 - DNA, 22 bp, Homo sapiens
ccggcgggcagcggcagtgagc

SEQ ID NO: 26956 - DNA, 22 bp, Homo sapiens
ttgatgagaccattgccgcgtc

SEQ ID NO: 26957 - DNA, 22 bp, Homo sapiens
cctcatcgtttccagaatgtgg

SEQ ID NO: 26958 - DNA, 18 bp, Homo sapiens
ggcgggtgttttattcac

SEQ ID NO: 26959 - DNA, 22 bp, Homo sapiens
tgagagcctgtgttcaaatgcc

SEQ ID NO: 26960 - DNA, 22 bp, Homo sapiens
gggattacagatgtgagccatt

SEQ ID NO: 26961 - DNA, 22 bp, Homo sapiens
ttggggctcaggccgccgatgc

SEQ ID NO: 26962 - DNA, 22 bp, Homo sapiens
cactgcacttcagcctgggtga

SEQ ID NO: 26963 - DNA, 22 bp, Homo sapiens
tcagaacctcctagcagtgttc

SEQ ID NO: 26964 - DNA, 22 bp, Homo sapiens
gggagaagaatgtgtcaattgt

SEQ ID NO: 26965 - DNA, 22 bp, Homo sapiens
cagcctgccgtcagccaggtag

SEQ ID NO: 26966 - DNA, 22 bp, Homo sapiens
acaggggacctaggaccctcgg

SEQ ID NO: 26967 - DNA, 22 bp, Homo sapiens
tcctggcttgtcacatctacgt

SEQ ID NO: 26968 - DNA, 22 bp, Homo sapiens
aaaaatcacttttataggcagc

SEQ ID NO: 26969 - DNA, 22 bp, Homo sapiens
cagcctgtcggctccttcattc

SEQ ID NO: 26970 - DNA, 22 bp, Homo sapiens
tgtggctctcatgcactcccag

SEQ ID NO: 26971 - DNA, 22 bp, Homo sapiens
tgtcctgtaggaggcagaacaa

SEQ ID NO: 26972 - DNA, 22 bp, Homo sapiens
ttattgcttatgattaggtgtt

SEQ ID NO: 26973 - DNA, 19 bp, Homo sapiens
gcagacaggtccagagagg

SEQ ID NO: 26974 - DNA, 22 bp, Homo sapiens
caccaaagtcgcttctgtcgtc

SEQ ID NO: 26975 - DNA, 22 bp, Homo sapiens
aatgcaatgcagcacctccttg

SEQ ID NO: 26976 - DNA, 22 bp, Homo sapiens
ttgagcagatcgggctgtgggg

SEQ ID NO: 26977 - DNA, 22 bp, Homo sapiens
attcgacaaccttgttttgtac

SEQ ID NO: 26978 - DNA, 22 bp, Homo sapiens
ccccaggacgtggccctcatag

SEQ ID NO: 26979 - DNA, 22 bp, Homo sapiens
ttgtctgcatgattctaggcag

SEQ ID NO: 26980 - DNA, 22 bp, Homo sapiens
gtggcccaggctggagtgcagt

SEQ ID NO: 26981 - DNA, 22 bp, Homo sapiens
tctcttggagagtccatcatca

SEQ ID NO: 26982 - DNA, 22 bp, Homo sapiens
tattttgtgccatgcactgcct

SEQ ID NO: 26983 - DNA, 22 bp, Homo sapiens
ttcttctaaatgtgcttattaa

SEQ ID NO: 26984 - DNA, 22 bp, Homo sapiens
tagatacctgctggacctcatt

SEQ ID NO: 26985 - DNA, 22 bp, Homo sapiens
cagagctgtccaaaccctgaca

SEQ ID NO: 26986 - DNA, 22 bp, Homo sapiens
agctggtgctcggggagctggc

SEQ ID NO: 26987 - DNA, 22 bp, Homo sapiens
aaggtgggtggatcacgaggtc

SEQ ID NO: 26988 - DNA, 22 bp, Homo sapiens
atattgcttgaggccaggaggt

SEQ ID NO: 26989 - DNA, 22 bp, Homo sapiens
atggcagcggagctggaaatga

SEQ ID NO: 26990 - DNA, 18 bp, Homo sapiens
tcttcatctcctgagctg

SEQ ID NO: 26991 - DNA, 22 bp, Homo sapiens
tgagatgaataactcctgctaa

SEQ ID NO: 26992 - DNA, 22 bp, Homo sapiens
ctaccgggttctcagccaggca

SEQ ID NO: 26993 - DNA, 22 bp, Homo sapiens
aagaggagaaaggctggctttg

SEQ ID NO: 26994 - DNA, 22 bp, Homo sapiens
ggatgttctggggttctcttgt

SEQ ID NO: 26995 - DNA, 22 bp, Homo sapiens
cacgaatggaagggtcttggct

SEQ ID NO: 26996 - DNA, 22 bp, Homo sapiens
tgcctaggctggagtgcaatgg

SEQ ID NO: 26997 - DNA, 22 bp, Homo sapiens
agatgaatccacacatggcaaa

SEQ ID NO: 26998 - DNA, 22 bp, Homo sapiens
atacaaagtattgatcctgagt

SEQ ID NO: 26999 - DNA, 22 bp, Homo sapiens
gacagacacaattgatccatga

SEQ ID NO: 27000 - DNA, 22 bp, Homo sapiens
ctgggaggtggaggttgcattg

SEQ ID NO: 27001 - DNA, 22 bp, Homo sapiens
gtggtgtttgagctgccaggga

SEQ ID NO: 27002 - DNA, 22 bp, Homo sapiens
acgcccggtctccatagttttt

SEQ ID NO: 27003 - DNA, 18 bp, Homo sapiens
cttttcccctttggactc

SEQ ID NO: 27004 - DNA, 22 bp, Homo sapiens
tgttattctagtggatcacgtc

SEQ ID NO: 27005 - DNA, 22 bp, Homo sapiens
cttcatcagctggcttactgtt

SEQ ID NO: 27006 - DNA, 22 bp, Homo sapiens
gactttctgatgtaaacattta

SEQ ID NO: 27007 - DNA, 22 bp, Homo sapiens
ttctcacagaagcacgaagcct

SEQ ID NO: 27008 - DNA, 22 bp, Homo sapiens
aagtgctgagactacaggcatg

SEQ ID NO: 27009 - DNA, 22 bp, Homo sapiens
tgggttcgatgtatatgtagcc

SEQ ID NO: 27010 - DNA, 22 bp, Homo sapiens
aggatcagggtggtggaagtca

SEQ ID NO: 27011 - DNA, 22 bp, Homo sapiens
atcctagaatcagcccttgctg

SEQ ID NO: 27012 - DNA, 22 bp, Homo sapiens
gggctagcctcttccctgctcc

SEQ ID NO: 27013 - DNA, 22 bp, Homo sapiens
cgccccggacgtctgaccaaac

SEQ ID NO: 27014 - DNA, 22 bp, Homo sapiens
cactcagctgagccctcagccc

SEQ ID NO: 27015 - DNA, 22 bp, Homo sapiens
ttccttacattcatatggcttc

SEQ ID NO: 27016 - DNA, 22 bp, Homo sapiens
tgttaaaccagttttgcatcat

SEQ ID NO: 27017 - DNA, 22 bp, Homo sapiens
ccttttgctctcccatccagaa

SEQ ID NO: 27018 - DNA, 22 bp, Homo sapiens
cccaggccccagggcttgtcag

SEQ ID NO: 27019 - DNA, 22 bp, Homo sapiens
tggtggcgggcagggccgtcac

SEQ ID NO: 27020 - DNA, 22 bp, Homo sapiens
gggccctgggattcagagcaag

SEQ ID NO: 27021 - DNA, 22 bp, Homo sapiens
gaagatgttatggagagctcag

SEQ ID NO: 27022 - DNA, 22 bp, Homo sapiens
tgaggcaggagttcaggctgcg

SEQ ID NO: 27023 - DNA, 22 bp, Homo sapiens
gcgagcctctggagtcctctgg

SEQ ID NO: 27024 - DNA, 22 bp, Homo sapiens
aatgtcaaaggctatacattca

SEQ ID NO: 27025 - DNA, 22 bp, Homo sapiens
tgctcgaggtccccaccggctc

SEQ ID NO: 27026 - DNA, 22 bp, Homo sapiens
gtctccccagggccctcttcat

SEQ ID NO: 27027 - DNA, 19 bp, Homo sapiens
tggttgtgcacgggttggt

SEQ ID NO: 27028 - DNA, 22 bp, Homo sapiens
tgacaggcaggacagaggtgtg

SEQ ID NO: 27029 - DNA, 22 bp, Homo sapiens
cacccaggttggagtgcagtgg

SEQ ID NO: 27030 - DNA, 22 bp, Homo sapiens
aaggctcggcaatgtgcggctc

SEQ ID NO: 27031 - DNA, 22 bp, Homo sapiens
gggcggggggagctggaatgaa

SEQ ID NO: 27032 - DNA, 22 bp, Homo sapiens
gtggcagagccaaggctggagc

SEQ ID NO: 27033 - DNA, 22 bp, Homo sapiens
tgtgagttattttcaggagttt

SEQ ID NO: 27034 - DNA, 22 bp, Homo sapiens
actgcactccagcctcggggtc

SEQ ID NO: 27035 - DNA, 22 bp, Homo sapiens
cagtgatatttatcctactcac

SEQ ID NO: 27036 - DNA, 22 bp, Homo sapiens
atgccactgcacttcagcctgg

SEQ ID NO: 27037 - DNA, 22 bp, Homo sapiens
ctttggctggcaccccagcggg

SEQ ID NO: 27038 - DNA, 22 bp, Homo sapiens
gtcacccgtttgactatccacc

SEQ ID NO: 27039 - DNA, 22 bp, Homo sapiens
cgccaggcttggtagctcatgc

SEQ ID NO: 27040 - DNA, 16 bp, Homo sapiens
ccacctgcagctctca

SEQ ID NO: 27041 - DNA, 22 bp, Homo sapiens
aagaataagaggatttagaaca

SEQ ID NO: 27042 - DNA, 22 bp, Homo sapiens
taagaaatttagttatagaatg

SEQ ID NO: 27043 - DNA, 22 bp, Homo sapiens
gggcaacagagcgagggcctgt

SEQ ID NO: 27044 - DNA, 22 bp, Homo sapiens
tccacatggctgggaggcctca

SEQ ID NO: 27045 - DNA, 22 bp, Homo sapiens
ccattgtaaattctgtggaagt

SEQ ID NO: 27046 - DNA, 22 bp, Homo sapiens
ttgtatgtggcaaatgggggag

SEQ ID NO: 27047 - DNA, 22 bp, Homo sapiens
ggaactcctgctccaagcagct

SEQ ID NO: 27048 - DNA, 22 bp, Homo sapiens
tgccgcactcggccaccagctg

SEQ ID NO: 27049 - DNA, 22 bp, Homo sapiens
tagagctctccttcctctgtgg

SEQ ID NO: 27050 - DNA, 22 bp, Homo sapiens
gaaggtggcgagcggattgctg

SEQ ID NO: 27051 - DNA, 22 bp, Homo sapiens
cagaggctggcggccgccccga

SEQ ID NO: 27052 - DNA, 22 bp, Homo sapiens
tccacaaggcagctcctccagg

SEQ ID NO: 27053 - DNA, 18 bp, Homo sapiens
gaattgtgctaaggtgat

SEQ ID NO: 27054 - DNA, 22 bp, Homo sapiens
gcaagatgttaccattagggaa

SEQ ID NO: 27055 - DNA, 22 bp, Homo sapiens
ggccttggagtcagccttgagc

SEQ ID NO: 27056 - DNA, 22 bp, Homo sapiens
ttgcagatatttccgatgctat

SEQ ID NO: 27057 - DNA, 22 bp, Homo sapiens
gctcactgcaagctctgcctcc

SEQ ID NO: 27058 - DNA, 18 bp, Homo sapiens
gatatggaaggccatgcc

SEQ ID NO: 27059 - DNA, 22 bp, Homo sapiens
tcccgcttcttccgaatcgcga

SEQ ID NO: 27060 - DNA, 22 bp, Homo sapiens
ctcttagtaatgccatgaagca

SEQ ID NO: 27061 - DNA, 22 bp, Homo sapiens
acccaggctggagtgcagtgat

SEQ ID NO: 27062 - DNA, 22 bp, Homo sapiens
cttgtagacccctggactcacg

SEQ ID NO: 27063 - DNA, 22 bp, Homo sapiens
gctgccttgccctcttcccata

SEQ ID NO: 27064 - DNA, 22 bp, Homo sapiens
ggggtgcgggccccatctggct

SEQ ID NO: 27065 - DNA, 22 bp, Homo sapiens
gcgttggggaccccgaagctgg

SEQ ID NO: 27066 - DNA, 22 bp, Homo sapiens
gctcaagacccctctgtgactg

SEQ ID NO: 27067 - DNA, 22 bp, Homo sapiens
agttttcattaccatgctgcaa

SEQ ID NO: 27068 - DNA, 22 bp, Homo sapiens
tgtgcattaactccacaagcag

SEQ ID NO: 27069 - DNA, 22 bp, Homo sapiens
ctctgctgtgccgccagggcct

SEQ ID NO: 27070 - DNA, 22 bp, Homo sapiens
gccatcatatcccctgtgacct

SEQ ID NO: 27071 - DNA, 22 bp, Homo sapiens
cctgggcctctcaaagtgctgg

SEQ ID NO: 27072 - DNA, 22 bp, Homo sapiens
ttgttgccggaaagatctcgac

SEQ ID NO: 27073 - DNA, 22 bp, Homo sapiens
atctgagtcaaatatttcattt

SEQ ID NO: 27074 - DNA, 18 bp, Homo sapiens
gcctggcttcggagccgc

SEQ ID NO: 27075 - DNA, 22 bp, Homo sapiens
aggcaatcccctgaggatactt

SEQ ID NO: 27076 - DNA, 22 bp, Homo sapiens
gaatcccttgcattatcccttt

SEQ ID NO: 27077 - DNA, 22 bp, Homo sapiens
tcaggaggtccgcccgggaggg

SEQ ID NO: 27078 - DNA, 22 bp, Homo sapiens
cctagagccgcacctcctccac

SEQ ID NO: 27079 - DNA, 22 bp, Homo sapiens
ttatttttaaaagttcacacag

SEQ ID NO: 27080 - DNA, 22 bp, Homo sapiens
actccacaccacgggggccgcc

SEQ ID NO: 27081 - DNA, 22 bp, Homo sapiens
aatggctctgatgttgttgtga

SEQ ID NO: 27082 - DNA, 22 bp, Homo sapiens
aaagagccgctgatgtcagccc

SEQ ID NO: 27083 - DNA, 22 bp, Homo sapiens
acaatgctccctgtagtcagga

SEQ ID NO: 27084 - DNA, 22 bp, Homo sapiens
tgggttttgtcctgatccatca

SEQ ID NO: 27085 - DNA, 22 bp, Homo sapiens
actgcactccagcctgggacac

SEQ ID NO: 27086 - DNA, 17 bp, Homo sapiens
gctccagaattctagtc

SEQ ID NO: 27087 - DNA, 22 bp, Homo sapiens
tgaggcaggacttgcataaagt

SEQ ID NO: 27088 - DNA, 22 bp, Homo sapiens
tgtgactaggcctgagctcttg

SEQ ID NO: 27089 - DNA, 22 bp, Homo sapiens
attaaagctatccagtcatgaa

SEQ ID NO: 27090 - DNA, 22 bp, Homo sapiens
acattacctggcatttgatctt

SEQ ID NO: 27091 - DNA, 22 bp, Homo sapiens
gaggcaggcagattgcttgagg

SEQ ID NO: 27092 - DNA, 21 bp, Homo sapiens
cccagaagttccatggggggc

SEQ ID NO: 27093 - DNA, 22 bp, Homo sapiens
acatcccatgcgcatctggcaa

SEQ ID NO: 27094 - DNA, 22 bp, Homo sapiens
acgtggcggccgccgtgagcgg

SEQ ID NO: 27095 - DNA, 22 bp, Homo sapiens
caccttactccctctggatgcc

SEQ ID NO: 27096 - DNA, 22 bp, Homo sapiens
tatcagtccagggttttgtgac

SEQ ID NO: 27097 - DNA, 22 bp, Homo sapiens
atgcctgtaatcccagcacttt

SEQ ID NO: 27098 - DNA, 22 bp, Homo sapiens
agtatgtcagagtgaaaatggt

SEQ ID NO: 27099 - DNA, 22 bp, Homo sapiens
tggaaaaccagaccgcgttggg

SEQ ID NO: 27100 - DNA, 22 bp, Homo sapiens
agagtactgctgctgggtactg

SEQ ID NO: 27101 - DNA, 23 bp, Homo sapiens
actgcagtcttgatctcctgggc

SEQ ID NO: 27102 - DNA, 22 bp, Homo sapiens
tcaccggtgaccctcggctcgc

SEQ ID NO: 27103 - DNA, 22 bp, Homo sapiens
tccaggctttggggcaggagcg

SEQ ID NO: 27104 - DNA, 22 bp, Homo sapiens
actgcactccagcctgggtgac

SEQ ID NO: 27105 - DNA, 22 bp, Homo sapiens
gggccaccccactgcccacgct

SEQ ID NO: 27106 - DNA, 22 bp, Homo sapiens
ccaaagtgctaggattacaggc

SEQ ID NO: 27107 - DNA, 22 bp, Homo sapiens
aaggctccagtgaatgctggca

SEQ ID NO: 27108 - DNA, 22 bp, Homo sapiens
caggagctcaagaccaccctgg

SEQ ID NO: 27109 - DNA, 22 bp, Homo sapiens
acttaccagagaggatccgccc

SEQ ID NO: 27110 - DNA, 22 bp, Homo sapiens
gagcccgagcgcgtacccggcg

SEQ ID NO: 27111 - DNA, 22 bp, Homo sapiens
ctgaggcaggagagttgcttga

SEQ ID NO: 27112 - DNA, 22 bp, Homo sapiens
tccctagtcgcatctgtggaga

SEQ ID NO: 27113 - DNA, 22 bp, Homo sapiens
ctgggatgcggaggttgcggtg

SEQ ID NO: 27114 - DNA, 22 bp, Homo sapiens
tccaagatctacagcagtttag

SEQ ID NO: 27115 - DNA, 22 bp, Homo sapiens
gaaaggatttggtgccaagcgt

SEQ ID NO: 27116 - DNA, 20 bp, Homo sapiens
tgcctataaagggccaggta

SEQ ID NO: 27117 - DNA, 22 bp, Homo sapiens
gtggagacctcctaggatgtgt

SEQ ID NO: 27118 - DNA, 22 bp, Homo sapiens
tcactgtagcctcaactcttgg

SEQ ID NO: 27119 - DNA, 22 bp, Homo sapiens
agatgtttataactcatgagtg

SEQ ID NO: 27120 - DNA, 22 bp, Homo sapiens
ttgctgctctgccggtacagct

SEQ ID NO: 27121 - DNA, 22 bp, Homo sapiens
agcctggcggtcgtcggtcagg

SEQ ID NO: 27122 - DNA, 22 bp, Homo sapiens
aaggaggttatcccagtggact

SEQ ID NO: 27123 - DNA, 22 bp, Homo sapiens
ctgccctggggggcctccttgc

SEQ ID NO: 27124 - DNA, 22 bp, Homo sapiens
tgagtggacacctgcttcttta

SEQ ID NO: 27125 - DNA, 22 bp, Homo sapiens
cccaaagcagttgatgtaccag

SEQ ID NO: 27126 - DNA, 18 bp, Homo sapiens
tccagttttcccagcatc

SEQ ID NO: 27127 - DNA, 22 bp, Homo sapiens
tatttgtctggtctaaggaggg

SEQ ID NO: 27128 - DNA, 22 bp, Homo sapiens
gagcctcatggtcatcttgagt

SEQ ID NO: 27129 - DNA, 22 bp, Homo sapiens
gctgcgagctcttgttctgaga

SEQ ID NO: 27130 - DNA, 22 bp, Homo sapiens
ctcccctagcccgttgggaggt

SEQ ID NO: 27131 - DNA, 22 bp, Homo sapiens
aatcggttgaacccaggaagtg

SEQ ID NO: 27132 - DNA, 22 bp, Homo sapiens
ggcgcagttgagcgtgctgttc

SEQ ID NO: 27133 - DNA, 22 bp, Homo sapiens
ctaggaccactgtaacaaagta

SEQ ID NO: 27134 - DNA, 20 bp, Homo sapiens
gccgactgccttgtgagcct

SEQ ID NO: 27135 - DNA, 22 bp, Homo sapiens
cagcttggaggaggatctaaga

SEQ ID NO: 27136 - DNA, 22 bp, Homo sapiens
ggcctttgcgtccacgccgctt

SEQ ID NO: 27137 - DNA, 22 bp, Homo sapiens
aggtaggcctgacgctggggtg

SEQ ID NO: 27138 - DNA, 22 bp, Homo sapiens
gaactcattagcctgctttcag

SEQ ID NO: 27139 - DNA, 22 bp, Homo sapiens
cgattgtcatattctgttggat

SEQ ID NO: 27140 - DNA, 22 bp, Homo sapiens
agtgcactggcaccatctcagc

SEQ ID NO: 27141 - DNA, 22 bp, Homo sapiens
acctgtgctttcaaggagctca

SEQ ID NO: 27142 - DNA, 22 bp, Homo sapiens
cccacgtcgaacttgctccaga

SEQ ID NO: 27143 - DNA, 22 bp, Homo sapiens
taaagggtaggttttactgtaa

SEQ ID NO: 27144 - DNA, 22 bp, Homo sapiens
tggggcagttaataaacattct

SEQ ID NO: 27145 - DNA, 22 bp, Homo sapiens
tccttaggaaaatgatgagggg

SEQ ID NO: 27146 - DNA, 22 bp, Homo sapiens
tgcgggttggtggcatatgcag

SEQ ID NO: 27147 - DNA, 22 bp, Homo sapiens
aagatacagacagagccaaaat

SEQ ID NO: 27148 - DNA, 22 bp, Homo sapiens
cgttcagcgggctggccgtgga

SEQ ID NO: 27149 - DNA, 22 bp, Homo sapiens
tcagcctccgaaagtgctggga

SEQ ID NO: 27150 - DNA, 22 bp, Homo sapiens
tcattgccatggcatttgcaga

SEQ ID NO: 27151 - DNA, 22 bp, Homo sapiens
tgtgcctactgatagagccaag

SEQ ID NO: 27152 - DNA, 22 bp, Homo sapiens
ttggttttgaaatagcttattg

SEQ ID NO: 27153 - DNA, 22 bp, Homo sapiens
tgtctcatctcttaaccccact

SEQ ID NO: 27154 - DNA, 22 bp, Homo sapiens
cccacacacatttatgatagga

SEQ ID NO: 27155 - DNA, 22 bp, Homo sapiens
caggctggagtgcagtggcgct

SEQ ID NO: 27156 - DNA, 22 bp, Homo sapiens
ggctcaatgcaacttctgcctc

SEQ ID NO: 27157 - DNA, 22 bp, Homo sapiens
ggtttgttggggtccaggccca

SEQ ID NO: 27158 - DNA, 22 bp, Homo sapiens
ctcactgcaacctctgccccca

SEQ ID NO: 27159 - DNA, 22 bp, Homo sapiens
tgtctccaccatcatcttacca

SEQ ID NO: 27160 - DNA, 22 bp, Homo sapiens
aaggcggggggatcacgaggtc

SEQ ID NO: 27161 - DNA, 22 bp, Homo sapiens
tggaatggaaacaaactgagga

SEQ ID NO: 27162 - DNA, 22 bp, Homo sapiens
accattgccccctagtgtctgt

SEQ ID NO: 27163 - DNA, 22 bp, Homo sapiens
ggctgtgtggccgtgggctcta

SEQ ID NO: 27164 - DNA, 22 bp, Homo sapiens
ccaagcagagcagcctctctgg

SEQ ID NO: 27165 - DNA, 22 bp, Homo sapiens
cctgccctgctcactgtcggta

SEQ ID NO: 27166 - DNA, 22 bp, Homo sapiens
ggtcaggagcccttggccccct

SEQ ID NO: 27167 - DNA, 22 bp, Homo sapiens
ccctaaaagtctcattttccag

SEQ ID NO: 27168 - DNA, 22 bp, Homo sapiens
acatgagatttgggtggtgata

SEQ ID NO: 27169 - DNA, 22 bp, Homo sapiens
tggcaaattccaaagttaattc

SEQ ID NO: 27170 - DNA, 22 bp, Homo sapiens
aagaagagaactggcatcctaa

SEQ ID NO: 27171 - DNA, 22 bp, Homo sapiens
cccattcatcctcgcttccttc

SEQ ID NO: 27172 - DNA, 20 bp, Homo sapiens
gctctgtggtttgagtctcc

SEQ ID NO: 27173 - DNA, 22 bp, Homo sapiens
gtatgtgctgagctttccccgc

SEQ ID NO: 27174 - DNA, 22 bp, Homo sapiens
tggtggggccagacttcagctc

SEQ ID NO: 27175 - DNA, 22 bp, Homo sapiens
tgattttctccattgtaaattc

SEQ ID NO: 27176 - DNA, 22 bp, Homo sapiens
aagacactcattatcactggtt

SEQ ID NO: 27177 - DNA, 22 bp, Homo sapiens
acacttggctctgagtcactac

SEQ ID NO: 27178 - DNA, 22 bp, Homo sapiens
cagctacaaatacttttgtatg

SEQ ID NO: 27179 - DNA, 22 bp, Homo sapiens
agcagcttgaggctggattcca

SEQ ID NO: 27180 - DNA, 22 bp, Homo sapiens
ctggcagatagtaagtgatcaa

SEQ ID NO: 27181 - DNA, 22 bp, Homo sapiens
tacaccattcccaggtggattt

SEQ ID NO: 27182 - DNA, 22 bp, Homo sapiens
ccaggctgctgttggtgtccgc

SEQ ID NO: 27183 - DNA, 22 bp, Homo sapiens
agtactgtcagcagggtgttga

SEQ ID NO: 27184 - DNA, 22 bp, Homo sapiens
tgaagttgttaaggttgccatt

SEQ ID NO: 27185 - DNA, 22 bp, Homo sapiens
tagactagaggatcagcaaggg

SEQ ID NO: 27186 - DNA, 22 bp, Homo sapiens
tagtaagttctcgcattgttat

SEQ ID NO: 27187 - DNA, 22 bp, Homo sapiens
ttagtctctttgcattgccata

SEQ ID NO: 27188 - DNA, 16 bp, Homo sapiens
aggcgaaggttcattt

SEQ ID NO: 27189 - DNA, 22 bp, Homo sapiens
tgagctgcttcttataatgtgt

SEQ ID NO: 27190 - DNA, 22 bp, Homo sapiens
cattcattacactcataaggtt

SEQ ID NO: 27191 - DNA, 22 bp, Homo sapiens
ctgtgctgggtccttcttttga

SEQ ID NO: 27192 - DNA, 17 bp, Homo sapiens
gagacccccactacacc

SEQ ID NO: 27193 - DNA, 22 bp, Homo sapiens
aggggatggagctggaaggcag

SEQ ID NO: 27194 - DNA, 22 bp, Homo sapiens
aagcctggactatcgcgtgtgc

SEQ ID NO: 27195 - DNA, 22 bp, Homo sapiens
agcctagggttctgatgtcact

SEQ ID NO: 27196 - DNA, 22 bp, Homo sapiens
cccaggctggagtgcagtggcg

SEQ ID NO: 27197 - DNA, 22 bp, Homo sapiens
actgagctccaagcctggaatc

SEQ ID NO: 27198 - DNA, 22 bp, Homo sapiens
ggtgttgcagttgaagactggt

SEQ ID NO: 27199 - DNA, 22 bp, Homo sapiens
aaaatcctgctgactcgagatg

SEQ ID NO: 27200 - DNA, 22 bp, Homo sapiens
taacctctctgtgcctcagttt

SEQ ID NO: 27201 - DNA, 22 bp, Homo sapiens
tgcctcagctgaggccgctcca

SEQ ID NO: 27202 - DNA, 22 bp, Homo sapiens
cgctgctccgccttgtccatat

SEQ ID NO: 27203 - DNA, 22 bp, Homo sapiens
ccagatatcactgccgtgttgt

SEQ ID NO: 27204 - DNA, 22 bp, Homo sapiens
aggaggcagtctgtcccttagc

SEQ ID NO: 27205 - DNA, 22 bp, Homo sapiens
gattgcgtctgtgtcaccttca

SEQ ID NO: 27206 - DNA, 22 bp, Homo sapiens
caggaggagggcagccgcctcc

SEQ ID NO: 27207 - DNA, 22 bp, Homo sapiens
aacccgggaggtggaggttatg

SEQ ID NO: 27208 - DNA, 18 bp, Homo sapiens
gtcaggcatgaatctggg

SEQ ID NO: 27209 - DNA, 18 bp, Homo sapiens
gcactgaggaaaacctct

SEQ ID NO: 27210 - DNA, 22 bp, Homo sapiens
tgcttgaacccaggaagtggag

SEQ ID NO: 27211 - DNA, 22 bp, Homo sapiens
tttggaggggaagaccttggag

SEQ ID NO: 27212 - DNA, 22 bp, Homo sapiens
atcacagggtgaggattagacc

SEQ ID NO: 27213 - DNA, 22 bp, Homo sapiens
tcctggatggcctgcaggcggt

SEQ ID NO: 27214 - DNA, 22 bp, Homo sapiens
acttcccttgctttacgatgtt

SEQ ID NO: 27215 - DNA, 22 bp, Homo sapiens
tggctgagttacgaacagagca

SEQ ID NO: 27216 - DNA, 22 bp, Homo sapiens
gggctccgcccttggctgagct

SEQ ID NO: 27217 - DNA, 22 bp, Homo sapiens
tcacagagttaaaagtttcttt

SEQ ID NO: 27218 - DNA, 22 bp, Homo sapiens
taatgtaaacacagagacagaa

SEQ ID NO: 27219 - DNA, 22 bp, Homo sapiens
gaagttctttatagcagtgtga

SEQ ID NO: 27220 - DNA, 22 bp, Homo sapiens
gtgtgtcccttggaacctcagc

SEQ ID NO: 27221 - DNA, 22 bp, Homo sapiens
cccccagctctgctgggtcccg

SEQ ID NO: 27222 - DNA, 20 bp, Homo sapiens
ttctccagtgcggtagccat

SEQ ID NO: 27223 - DNA, 22 bp, Homo sapiens
tttctggcagcgggacaggggt

SEQ ID NO: 27224 - DNA, 19 bp, Homo sapiens
tgctaccgtgggatgctta

SEQ ID NO: 27225 - DNA, 22 bp, Homo sapiens
tgttccagatttagccaaccga

SEQ ID NO: 27226 - DNA, 22 bp, Homo sapiens
agagggcattaactctgtcttg

SEQ ID NO: 27227 - DNA, 19 bp, Homo sapiens
tctgaagaattagagagca

SEQ ID NO: 27228 - DNA, 22 bp, Homo sapiens
taggctgggggtaggaattgag

SEQ ID NO: 27229 - DNA, 22 bp, Homo sapiens
gccataggcagcgtggccagca

SEQ ID NO: 27230 - DNA, 22 bp, Homo sapiens
agaggccgggtgcctgctcaga

SEQ ID NO: 27231 - DNA, 22 bp, Homo sapiens
tttaatcaggcaaagcataata

SEQ ID NO: 27232 - DNA, 22 bp, Homo sapiens
tcctgccgtcctccggggcctc

SEQ ID NO: 27233 - DNA, 22 bp, Homo sapiens
atggcatttgaatctgtctttt

SEQ ID NO: 27234 - DNA, 22 bp, Homo sapiens
ttcagagaattggataattcgt

SEQ ID NO: 27235 - DNA, 22 bp, Homo sapiens
gtatgtgaggttggtttccagg

SEQ ID NO: 27236 - DNA, 22 bp, Homo sapiens
aactcagatgtttggctacctt

SEQ ID NO: 27237 - DNA, 19 bp, Homo sapiens
ctctggagtcattgctccc

SEQ ID NO: 27238 - DNA, 22 bp, Homo sapiens
ctccccattatgcagtcattat

SEQ ID NO: 27239 - DNA, 21 bp, Homo sapiens
tgtaagtttcatctgaattgg

SEQ ID NO: 27240 - DNA, 22 bp, Homo sapiens
acccaggctggagtgcagtggg

SEQ ID NO: 27241 - DNA, 22 bp, Homo sapiens
ctaggtgatccactgctctctt

SEQ ID NO: 27242 - DNA, 22 bp, Homo sapiens
ggctctgtgtctccacccaaat

SEQ ID NO: 27243 - DNA, 22 bp, Homo sapiens
gcgtctgagttgcgggggctca

SEQ ID NO: 27244 - DNA, 21 bp, Homo sapiens
tgttttccaccttgaggcaag

SEQ ID NO: 27245 - DNA, 22 bp, Homo sapiens
ttgaggtccccagtacccactg

SEQ ID NO: 27246 - DNA, 22 bp, Homo sapiens
cggtcaggtgcagcgttggcac

SEQ ID NO: 27247 - DNA, 22 bp, Homo sapiens
gactacaggccggcatcagaga

SEQ ID NO: 27248 - DNA, 22 bp, Homo sapiens
tgggccacacacagaagaatca

SEQ ID NO: 27249 - DNA, 22 bp, Homo sapiens
cccaactactctcaggcagctt

SEQ ID NO: 27250 - DNA, 22 bp, Homo sapiens
cgtgggtcgggactccgcctcg

SEQ ID NO: 27251 - DNA, 22 bp, Homo sapiens
actgtctgtagacatttttggt

SEQ ID NO: 27252 - DNA, 22 bp, Homo sapiens
aggtggaaatggctttcctagg

SEQ ID NO: 27253 - DNA, 22 bp, Homo sapiens
ctagggtcaggggcctgcgtcg

SEQ ID NO: 27254 - DNA, 22 bp, Homo sapiens
agggcactgcaagggttgaagg

SEQ ID NO: 27255 - DNA, 22 bp, Homo sapiens
tagcagcaaagcaggatctgct

SEQ ID NO: 27256 - DNA, 22 bp, Homo sapiens
ctgatctcaagtgatccaccca

SEQ ID NO: 27257 - DNA, 22 bp, Homo sapiens
tcagtgtgaattcaggagccta

SEQ ID NO: 27258 - DNA, 22 bp, Homo sapiens
tggttacccagtcgctggagtt

SEQ ID NO: 27259 - DNA, 22 bp, Homo sapiens
aggtgggcgctgctcccgctgg

SEQ ID NO: 27260 - DNA, 22 bp, Homo sapiens
agcattccacactgaagtctgc

SEQ ID NO: 27261 - DNA, 22 bp, Homo sapiens
gtccctgagcctggcatttccc

SEQ ID NO: 27262 - DNA, 22 bp, Homo sapiens
atgaccagccgagataaacaga

SEQ ID NO: 27263 - DNA, 22 bp, Homo sapiens
ttgttccaacctaatagatgat

SEQ ID NO: 27264 - DNA, 22 bp, Homo sapiens
actgcactccagcctgggcggc

SEQ ID NO: 27265 - DNA, 22 bp, Homo sapiens
aggagggagcttaagccaggca

SEQ ID NO: 27266 - DNA, 20 bp, Homo sapiens
ttcgctgggagtggccaggc

SEQ ID NO: 27267 - DNA, 22 bp, Homo sapiens
gttactcttgagaggctgaggt

SEQ ID NO: 27268 - DNA, 22 bp, Homo sapiens
cagaggaacgtttggattgatt

SEQ ID NO: 27269 - DNA, 22 bp, Homo sapiens
tcctgaagaaggcagatatttg

SEQ ID NO: 27270 - DNA, 22 bp, Homo sapiens
tgcttttagctagtaactagta

SEQ ID NO: 27271 - DNA, 22 bp, Homo sapiens
ggtgtagctctgtgtcccactg

SEQ ID NO: 27272 - DNA, 22 bp, Homo sapiens
atgtgagtgctatgatagacag

SEQ ID NO: 27273 - DNA, 22 bp, Homo sapiens
agctcaccacaacctccgcctc

SEQ ID NO: 27274 - DNA, 22 bp, Homo sapiens
tggcacgacaattggcaccaat

SEQ ID NO: 27275 - DNA, 22 bp, Homo sapiens
gctgtggcctggcgcagagctg

SEQ ID NO: 27276 - DNA, 22 bp, Homo sapiens
gggcagagagctggaactcctt

SEQ ID NO: 27277 - DNA, 22 bp, Homo sapiens
ctcattgcccagatccccacag

SEQ ID NO: 27278 - DNA, 22 bp, Homo sapiens
tctgacattagattaattggaa

SEQ ID NO: 27279 - DNA, 22 bp, Homo sapiens
gcacagagagggaaggtaactt

SEQ ID NO: 27280 - DNA, 22 bp, Homo sapiens
tgtctgttattggtgtataaga

SEQ ID NO: 27281 - DNA, 22 bp, Homo sapiens
aggctggagtgcagtggtgtga

SEQ ID NO: 27282 - DNA, 22 bp, Homo sapiens
ggcatgcatgttgttttaggtg

SEQ ID NO: 27283 - DNA, 22 bp, Homo sapiens
cggctcactgcagctccgcctc

SEQ ID NO: 27284 - DNA, 22 bp, Homo sapiens
aatggcactttataaatgttaa

SEQ ID NO: 27285 - DNA, 22 bp, Homo sapiens
cgttaataggtgcaaggtaagg

SEQ ID NO: 27286 - DNA, 22 bp, Homo sapiens
gggaggcacgaggcgcgcagtg

SEQ ID NO: 27287 - DNA, 22 bp, Homo sapiens
gcaagtgaatgaggttgagatt

SEQ ID NO: 27288 - DNA, 22 bp, Homo sapiens
ttatcacttatgagctttttgc

SEQ ID NO: 27289 - DNA, 22 bp, Homo sapiens
aaaatcttgtgacttaggaagg

SEQ ID NO: 27290 - DNA, 22 bp, Homo sapiens
catgcctgcctggtgggcgtgg

SEQ ID NO: 27291 - DNA, 20 bp, Homo sapiens
tgtggtttttgccagttgaa

SEQ ID NO: 27292 - DNA, 22 bp, Homo sapiens
tgcctgatgcaggagtatcaga

SEQ ID NO: 27293 - DNA, 22 bp, Homo sapiens
taagtcgtggatgattcttcgg

SEQ ID NO: 27294 - DNA, 22 bp, Homo sapiens
atgccactgcgctctagcctgg

SEQ ID NO: 27295 - DNA, 22 bp, Homo sapiens
acatcctcccgatctactggct

SEQ ID NO: 27296 - DNA, 22 bp, Homo sapiens
aagacttgaccaggttgaaggc

SEQ ID NO: 27297 - DNA, 18 bp, Homo sapiens
tgagttcattagacttcc

SEQ ID NO: 27298 - DNA, 22 bp, Homo sapiens
gatggaggagatggcagggtgc

SEQ ID NO: 27299 - DNA, 22 bp, Homo sapiens
tgcagcaccgtcccactggcta

SEQ ID NO: 27300 - DNA, 22 bp, Homo sapiens
agaggaagtaatcaggacctgc

SEQ ID NO: 27301 - DNA, 22 bp, Homo sapiens
gggccccaagaacctcctcctg

SEQ ID NO: 27302 - DNA, 22 bp, Homo sapiens
gctggaaatgattaaatggtga

SEQ ID NO: 27303 - DNA, 22 bp, Homo sapiens
ttcaggcccagcacagcgcgtg

SEQ ID NO: 27304 - DNA, 22 bp, Homo sapiens
ttgagagttctgaatgagtaac

SEQ ID NO: 27305 - DNA, 22 bp, Homo sapiens
agtacccttttcactgtcacaa

SEQ ID NO: 27306 - DNA, 22 bp, Homo sapiens
taacaatacccattctaattac

SEQ ID NO: 27307 - DNA, 22 bp, Homo sapiens
aggctgtagtgcatgtgctatg

SEQ ID NO: 27308 - DNA, 22 bp, Homo sapiens
tggagggcatgctgtccatggg

SEQ ID NO: 27309 - DNA, 22 bp, Homo sapiens
cttcccgcagccctagcgctct

SEQ ID NO: 27310 - DNA, 22 bp, Homo sapiens
aagagactgtaaaggcgtgagt

SEQ ID NO: 27311 - DNA, 22 bp, Homo sapiens
gggttgttggaggtgagtgtta

SEQ ID NO: 27312 - DNA, 22 bp, Homo sapiens
aggggcgtgctcttccccgacg

SEQ ID NO: 27313 - DNA, 22 bp, Homo sapiens
cagcaggaggtgagtagcaggt

SEQ ID NO: 27314 - DNA, 22 bp, Homo sapiens
atctagattaggtataagagct

SEQ ID NO: 27315 - DNA, 22 bp, Homo sapiens
tcccagcgcggggggaggatcc

SEQ ID NO: 27316 - DNA, 22 bp, Homo sapiens
tcagacattattttcaagataa

SEQ ID NO: 27317 - DNA, 22 bp, Homo sapiens
cctcaagtcattccggagacct

SEQ ID NO: 27318 - DNA, 22 bp, Homo sapiens
tctcaatttgattacattcata

SEQ ID NO: 27319 - DNA, 22 bp, Homo sapiens
ctggcaggtggaggttgcagtg

SEQ ID NO: 27320 - DNA, 22 bp, Homo sapiens
tggtagtcggcctcggtggctc

SEQ ID NO: 27321 - DNA, 20 bp, Homo sapiens
tgtccccacccaaatctcat

SEQ ID NO: 27322 - DNA, 20 bp, Homo sapiens
caagggtttgcattggcttt

SEQ ID NO: 27323 - DNA, 22 bp, Homo sapiens
gggccatgagaggttcatcaac

SEQ ID NO: 27324 - DNA, 22 bp, Homo sapiens
gacactctttcctcttctggaa

SEQ ID NO: 27325 - DNA, 22 bp, Homo sapiens
gcactttgcccctcctttggca

SEQ ID NO: 27326 - DNA, 22 bp, Homo sapiens
ttgcaaatcagaagtatagatt

SEQ ID NO: 27327 - DNA, 22 bp, Homo sapiens
tgctggacagggcacggcccat

SEQ ID NO: 27328 - DNA, 22 bp, Homo sapiens
gcggccttgtggcggagcaggc

SEQ ID NO: 27329 - DNA, 22 bp, Homo sapiens
cagagatgtgatccagctgtct

SEQ ID NO: 27330 - DNA, 22 bp, Homo sapiens
aaaagagcttggttgattttgc

SEQ ID NO: 27331 - DNA, 22 bp, Homo sapiens
gaatgaacaaatgtggtggaga

SEQ ID NO: 27332 - DNA, 21 bp, Homo sapiens
tttcttaggctctaaaatgac

SEQ ID NO: 27333 - DNA, 22 bp, Homo sapiens
attttctctttgtatatgctag

SEQ ID NO: 27334 - DNA, 22 bp, Homo sapiens
gtgcgccagctcaaggggaggc

SEQ ID NO: 27335 - DNA, 22 bp, Homo sapiens
gggcttggcacatgggctcagc

SEQ ID NO: 27336 - DNA, 22 bp, Homo sapiens
gacttctgaattcctatcaggt

SEQ ID NO: 27337 - DNA, 22 bp, Homo sapiens
attgtactctagcctctgggca

SEQ ID NO: 27338 - DNA, 22 bp, Homo sapiens
tgtttgagttctagcgcattta

SEQ ID NO: 27339 - DNA, 22 bp, Homo sapiens
cctggaaagagaatgaatgagc

SEQ ID NO: 27340 - DNA, 22 bp, Homo sapiens
gaaagcatccgcctggaggtgg

SEQ ID NO: 27341 - DNA, 23 bp, Homo sapiens
acagcaagaggaccagatgtgag

SEQ ID NO: 27342 - DNA, 22 bp, Homo sapiens
gtgggggctggaaatcttgcca

SEQ ID NO: 27343 - DNA, 22 bp, Homo sapiens
gttaaggctgagcaggacactg

SEQ ID NO: 27344 - DNA, 22 bp, Homo sapiens
ccagttgttccctgtcagagat

SEQ ID NO: 27345 - DNA, 22 bp, Homo sapiens
ggcctcacccatcggtgccttt

SEQ ID NO: 27346 - DNA, 22 bp, Homo sapiens
cctgtggcgggggccagtgcct

SEQ ID NO: 27347 - DNA, 22 bp, Homo sapiens
cctagagctctgctttatctaa

SEQ ID NO: 27348 - DNA, 22 bp, Homo sapiens
cctctgtgtgatgcgcaaagta

SEQ ID NO: 27349 - DNA, 22 bp, Homo sapiens
ccttcccatgcagcctgtctga

SEQ ID NO: 27350 - DNA, 22 bp, Homo sapiens
ggccactggccaggatctaaga

SEQ ID NO: 27351 - DNA, 22 bp, Homo sapiens
gcagagctgggatatgaaccca

SEQ ID NO: 27352 - DNA, 22 bp, Homo sapiens
tgagggctgtctgaagcttggg

SEQ ID NO: 27353 - DNA, 22 bp, Homo sapiens
taggcccctagtgccacgtggc

SEQ ID NO: 27354 - DNA, 21 bp, Homo sapiens
gcagcagtgttctagaatact

SEQ ID NO: 27355 - DNA, 22 bp, Homo sapiens
accactgcactccagtctgggc

SEQ ID NO: 27356 - DNA, 19 bp, Homo sapiens
cgcctggcaggccctgcgc

SEQ ID NO: 27357 - DNA, 22 bp, Homo sapiens
agagggatcaccctgtttctgg

SEQ ID NO: 27358 - DNA, 22 bp, Homo sapiens
tatctattatgttctatgtgtc

SEQ ID NO: 27359 - DNA, 22 bp, Homo sapiens
caagcttgtttctcctgggggt

SEQ ID NO: 27360 - DNA, 22 bp, Homo sapiens
gagccaagctcttctccatgag

SEQ ID NO: 27361 - DNA, 23 bp, Homo sapiens
tgagctgggcctgcaggggtctc

SEQ ID NO: 27362 - DNA, 22 bp, Homo sapiens
ctgcaccctcaaactcctgggc

SEQ ID NO: 27363 - DNA, 22 bp, Homo sapiens
tgcgcctggggccctggctgtc

SEQ ID NO: 27364 - DNA, 22 bp, Homo sapiens
atgaattgaggaaaacagtcgt

SEQ ID NO: 27365 - DNA, 18 bp, Homo sapiens
tttctcagactctctttc

SEQ ID NO: 27366 - DNA, 22 bp, Homo sapiens
tgacaatgaggccctccacaaa

SEQ ID NO: 27367 - DNA, 15 bp, Homo sapiens
catatcactgggaat

SEQ ID NO: 27368 - DNA, 21 bp, Homo sapiens
ttgctgttttcccaatgcagt

SEQ ID NO: 27369 - DNA, 22 bp, Homo sapiens
gctggggaggcagcagagaaca

SEQ ID NO: 27370 - DNA, 22 bp, Homo sapiens
ccaggagttggaggttgcagtg

SEQ ID NO: 27371 - DNA, 22 bp, Homo sapiens
ctggcctcggcagcaggaacag

SEQ ID NO: 27372 - DNA, 22 bp, Homo sapiens
atgttgtgtttgactgttaccc

SEQ ID NO: 27373 - DNA, 22 bp, Homo sapiens
actgcacttcaccctgggtgac

SEQ ID NO: 27374 - DNA, 22 bp, Homo sapiens
ccctcaggtgaaaggaaaaatt

SEQ ID NO: 27375 - DNA, 22 bp, Homo sapiens
aggtgggcggattcatgaggtc

SEQ ID NO: 27376 - DNA, 22 bp, Homo sapiens
ctcagcttttcccggataggtg

SEQ ID NO: 27377 - DNA, 22 bp, Homo sapiens
tactgtactgcagttctgcaaa

SEQ ID NO: 27378 - DNA, 20 bp, Homo sapiens
tgacctcctgggctcaagcc

SEQ ID NO: 27379 - DNA, 22 bp, Homo sapiens
ggcgtggggccttctgcccgct

SEQ ID NO: 27380 - DNA, 22 bp, Homo sapiens
tgcccaggctggagtacagtgg

SEQ ID NO: 27381 - DNA, 22 bp, Homo sapiens
agtggccctggagtgactcgta

SEQ ID NO: 27382 - DNA, 22 bp, Homo sapiens
aactcaggagtttaaggctgca

SEQ ID NO: 27383 - DNA, 22 bp, Homo sapiens
agccaagcactcaactcctgga

SEQ ID NO: 27384 - DNA, 22 bp, Homo sapiens
catcagaacgtgagctccttgt

SEQ ID NO: 27385 - DNA, 22 bp, Homo sapiens
caacggctctggcttccaggcg

SEQ ID NO: 27386 - DNA, 22 bp, Homo sapiens
tgaatgtgatgctaaacatatg

SEQ ID NO: 27387 - DNA, 22 bp, Homo sapiens
tccagtcggataactagacggt

SEQ ID NO: 27388 - DNA, 22 bp, Homo sapiens
gaggagctgcccgtgtgtctgc

SEQ ID NO: 27389 - DNA, 22 bp, Homo sapiens
acatcttttactctggttcggg

SEQ ID NO: 27390 - DNA, 22 bp, Homo sapiens
gtgagccgagtatagttcatag

SEQ ID NO: 27391 - DNA, 22 bp, Homo sapiens
tctgtcttagccatctcaggct

SEQ ID NO: 27392 - DNA, 22 bp, Homo sapiens
accgggctaatttttgtatctt

SEQ ID NO: 27393 - DNA, 22 bp, Homo sapiens
ggcagcttgtcctggaggatgg

SEQ ID NO: 27394 - DNA, 22 bp, Homo sapiens
gatgatcatctgtaaagttaga

SEQ ID NO: 27395 - DNA, 22 bp, Homo sapiens
tcctcctgtctaccagttcctg

SEQ ID NO: 27396 - DNA, 22 bp, Homo sapiens
agccttacataaacagccttat

SEQ ID NO: 27397 - DNA, 22 bp, Homo sapiens
ggcccagacccaagagtggtgg

SEQ ID NO: 27398 - DNA, 21 bp, Homo sapiens
gaacccagcagcagtgctctg

SEQ ID NO: 27399 - DNA, 22 bp, Homo sapiens
cacttcattgggaccagggctg

SEQ ID NO: 27400 - DNA, 22 bp, Homo sapiens
tcactgcaacctccgcctcccg

SEQ ID NO: 27401 - DNA, 22 bp, Homo sapiens
tgtatgaggcatacatcaggca

SEQ ID NO: 27402 - DNA, 22 bp, Homo sapiens
ggctgtggcagctggaagtggt

SEQ ID NO: 27403 - DNA, 22 bp, Homo sapiens
tgagccagaggaggctgtgtgg

SEQ ID NO: 27404 - DNA, 22 bp, Homo sapiens
ggagttccagaccagactggcc

SEQ ID NO: 27405 - DNA, 22 bp, Homo sapiens
gtggggtagatctttctcagga

SEQ ID NO: 27406 - DNA, 22 bp, Homo sapiens
gaaatctttgccttagctgtgt

SEQ ID NO: 27407 - DNA, 22 bp, Homo sapiens
tacatgctccttatgagaatct

SEQ ID NO: 27408 - DNA, 22 bp, Homo sapiens
tccttcactccctctgcatcca

SEQ ID NO: 27409 - DNA, 22 bp, Homo sapiens
taggtaggtggaaaagtaattg

SEQ ID NO: 27410 - DNA, 22 bp, Homo sapiens
aggcaggaggatcatggatgca

SEQ ID NO: 27411 - DNA, 22 bp, Homo sapiens
aggtattattagcatctctatt

SEQ ID NO: 27412 - DNA, 18 bp, Homo sapiens
gatcgggggcgccccaag

SEQ ID NO: 27413 - DNA, 22 bp, Homo sapiens
tcaagcaaagtttagctggtta

SEQ ID NO: 27414 - DNA, 22 bp, Homo sapiens
cactgcccaccaagtggctggt

SEQ ID NO: 27415 - DNA, 22 bp, Homo sapiens
ctgtgatttctaaagagtagca

SEQ ID NO: 27416 - DNA, 22 bp, Homo sapiens
gtggtccagaagagcgcatatg

SEQ ID NO: 27417 - DNA, 22 bp, Homo sapiens
aaagtgctgggattacaagcgt

SEQ ID NO: 27418 - DNA, 22 bp, Homo sapiens
tgttggagcccgagtcagggag

SEQ ID NO: 27419 - DNA, 22 bp, Homo sapiens
tgaaggacagcagtggctccaa

SEQ ID NO: 27420 - DNA, 22 bp, Homo sapiens
gagggagggactagcattctct

SEQ ID NO: 27421 - DNA, 22 bp, Homo sapiens
gctcagaggcacgacctcttgg

SEQ ID NO: 27422 - DNA, 22 bp, Homo sapiens
ggctctgcagcttggggtcctg

SEQ ID NO: 27423 - DNA, 22 bp, Homo sapiens
ggacagccgagtggccttctcc

SEQ ID NO: 27424 - DNA, 22 bp, Homo sapiens
ttacaaagtttaaggtggcact

SEQ ID NO: 27425 - DNA, 22 bp, Homo sapiens
tgacccctatatcctgtttctt

SEQ ID NO: 27426 - DNA, 22 bp, Homo sapiens
tctttgctattgtgagtagtgc

SEQ ID NO: 27427 - DNA, 22 bp, Homo sapiens
acatagtgttttgagagacagc

SEQ ID NO: 27428 - DNA, 22 bp, Homo sapiens
cgtcccgggttcacgccattct

SEQ ID NO: 27429 - DNA, 22 bp, Homo sapiens
ccggaggaggacgagcccgcgg

SEQ ID NO: 27430 - DNA, 22 bp, Homo sapiens
aggtttctttatgctgctagaa

SEQ ID NO: 27431 - DNA, 22 bp, Homo sapiens
tggaagacaatttgaaaacatt

SEQ ID NO: 27432 - DNA, 22 bp, Homo sapiens
taatggattaacgtccctgtcg

SEQ ID NO: 27433 - DNA, 19 bp, Homo sapiens
caccaagatggctctagtc

SEQ ID NO: 27434 - DNA, 22 bp, Homo sapiens
atggatggaactctgctgtggt

SEQ ID NO: 27435 - DNA, 22 bp, Homo sapiens
ttactttaagggtgtcttatta

SEQ ID NO: 27436 - DNA, 22 bp, Homo sapiens
aggaaaatggaccagagttgtt

SEQ ID NO: 27437 - DNA, 22 bp, Homo sapiens
ggcaatagttgtgggttcttta

SEQ ID NO: 27438 - DNA, 22 bp, Homo sapiens
atccccctcttggatggcggca

SEQ ID NO: 27439 - DNA, 22 bp, Homo sapiens
gccacctggtggcatcttctgg

SEQ ID NO: 27440 - DNA, 22 bp, Homo sapiens
tccttaggcaatttgggagagt

SEQ ID NO: 27441 - DNA, 22 bp, Homo sapiens
ggcttcgcagctcggcagccgc

SEQ ID NO: 27442 - DNA, 22 bp, Homo sapiens
ttaggatttgaaaaggggcaga

SEQ ID NO: 27443 - DNA, 22 bp, Homo sapiens
aggaattcaagaccagctgggc

SEQ ID NO: 27444 - DNA, 22 bp, Homo sapiens
agaggaggctctgggatcgtcc

SEQ ID NO: 27445 - DNA, 22 bp, Homo sapiens
ataaaaactgacccatcctttg

SEQ ID NO: 27446 - DNA, 21 bp, Homo sapiens
cagagctgtccaaaccctgac

SEQ ID NO: 27447 - DNA, 22 bp, Homo sapiens
taggtttaggagtgaaggtgaa

SEQ ID NO: 27448 - DNA, 22 bp, Homo sapiens
acctgcaggcacaggtgtgcgc

SEQ ID NO: 27449 - DNA, 22 bp, Homo sapiens
tagcacagagcttttaaacttc

SEQ ID NO: 27450 - DNA, 22 bp, Homo sapiens
tctgtcacccagagtgcagtgg

SEQ ID NO: 27451 - DNA, 22 bp, Homo sapiens
gcctcagtctcccgagtagctg

SEQ ID NO: 27452 - DNA, 22 bp, Homo sapiens
tttttccacataccctaggcca

SEQ ID NO: 27453 - DNA, 22 bp, Homo sapiens
tcctccactttgtctagcaaca

SEQ ID NO: 27454 - DNA, 22 bp, Homo sapiens
ggcgggaagttcttgcccactt

SEQ ID NO: 27455 - DNA, 22 bp, Homo sapiens
tggaggcgagagcgcgcgggct

SEQ ID NO: 27456 - DNA, 23 bp, Homo sapiens
cgcccagcctcagtgacctgggc

SEQ ID NO: 27457 - DNA, 23 bp, Homo sapiens
atgggccaagcaagacccatgac

SEQ ID NO: 27458 - DNA, 21 bp, Homo sapiens
ctctgaatcctgcttctcagt

SEQ ID NO: 27459 - DNA, 22 bp, Homo sapiens
gagtttgtgggaatggagtatt

SEQ ID NO: 27460 - DNA, 22 bp, Homo sapiens
ctgtccagcgactaggggatgg

SEQ ID NO: 27461 - DNA, 17 bp, Homo sapiens
acctattgatctgtcac

SEQ ID NO: 27462 - DNA, 22 bp, Homo sapiens
tccgaggccaaagctgtgaata

SEQ ID NO: 27463 - DNA, 22 bp, Homo sapiens
gtattgcttgagcccaggagtt

SEQ ID NO: 27464 - DNA, 22 bp, Homo sapiens
acaactccttcttgggtcctgg

SEQ ID NO: 27465 - DNA, 22 bp, Homo sapiens
tcttcccccgtgctccagtgca

SEQ ID NO: 27466 - DNA, 22 bp, Homo sapiens
gggtcgctgccgctgctggacc

SEQ ID NO: 27467 - DNA, 22 bp, Homo sapiens
gagagtctagtgcacctagttt

SEQ ID NO: 27468 - DNA, 22 bp, Homo sapiens
agaaactctggaagaactttta

SEQ ID NO: 27469 - DNA, 22 bp, Homo sapiens
tgtctcttttcaagctaccctt

SEQ ID NO: 27470 - DNA, 22 bp, Homo sapiens
tgagggaatattgatagatccg

SEQ ID NO: 27471 - DNA, 22 bp, Homo sapiens
ccctgcctacagggttttcttt

SEQ ID NO: 27472 - DNA, 22 bp, Homo sapiens
agaacctcaattatttttgcac

SEQ ID NO: 27473 - DNA, 22 bp, Homo sapiens
ttccggacgcccgtcttccagc

SEQ ID NO: 27474 - DNA, 22 bp, Homo sapiens
cccactgtttccctgaggctct

SEQ ID NO: 27475 - DNA, 22 bp, Homo sapiens
ctggcagagttgggtctcaaat

SEQ ID NO: 27476 - DNA, 22 bp, Homo sapiens
tgagtcagccttggcagcccct

SEQ ID NO: 27477 - DNA, 22 bp, Homo sapiens
tattctcatcatcactggagct

SEQ ID NO: 27478 - DNA, 22 bp, Homo sapiens
agtcaaagatgaccgagttcct

SEQ ID NO: 27479 - DNA, 22 bp, Homo sapiens
tttccagaaataccatttggtg

SEQ ID NO: 27480 - DNA, 22 bp, Homo sapiens
actgccaatggtagtttgatgg

SEQ ID NO: 27481 - DNA, 22 bp, Homo sapiens
tacaagatgacaggtgcatgat

SEQ ID NO: 27482 - DNA, 22 bp, Homo sapiens
taatatctacttcatagagttt

SEQ ID NO: 27483 - DNA, 22 bp, Homo sapiens
tcacccctccattctctcatgt

SEQ ID NO: 27484 - DNA, 22 bp, Homo sapiens
ataaaagatcccttctgagctc

SEQ ID NO: 27485 - DNA, 22 bp, Homo sapiens
taaattgagattattagggtaa

SEQ ID NO: 27486 - DNA, 22 bp, Homo sapiens
ggattgtgataattgttgcaaa

SEQ ID NO: 27487 - DNA, 22 bp, Homo sapiens
tggcaatgttagcaaagcattt

SEQ ID NO: 27488 - DNA, 22 bp, Homo sapiens
ggagacagggttgaaccacgca

SEQ ID NO: 27489 - DNA, 21 bp, Homo sapiens
tcgacctgctgggctcgggct

SEQ ID NO: 27490 - DNA, 22 bp, Homo sapiens
caccagtgtttacctgtgacaa

SEQ ID NO: 27491 - DNA, 22 bp, Homo sapiens
cccgactagctgggattacagg

SEQ ID NO: 27492 - DNA, 22 bp, Homo sapiens
ggcaatatggtgaaaccccatc

SEQ ID NO: 27493 - DNA, 22 bp, Homo sapiens
tgtctctgtgactccttccgcc

SEQ ID NO: 27494 - DNA, 22 bp, Homo sapiens
gcgagaaactaagtgccctttg

SEQ ID NO: 27495 - DNA, 22 bp, Homo sapiens
cccagctcttcaagtcaccccc

SEQ ID NO: 27496 - DNA, 22 bp, Homo sapiens
gccacctcggctttctctgctc

SEQ ID NO: 27497 - DNA, 22 bp, Homo sapiens
tgataggtcctcgggcactgga

SEQ ID NO: 27498 - DNA, 19 bp, Homo sapiens
gccgaccgttggggtgccc

SEQ ID NO: 27499 - DNA, 22 bp, Homo sapiens
agaggcagtatacaatccgagc

SEQ ID NO: 27500 - DNA, 22 bp, Homo sapiens
cataatttctaccagggccata

SEQ ID NO: 27501 - DNA, 22 bp, Homo sapiens
tcttcacgccaagtgcccctca

SEQ ID NO: 27502 - DNA, 19 bp, Homo sapiens
gcataaatacactattgtc

SEQ ID NO: 27503 - DNA, 22 bp, Homo sapiens
ctgtctgaatcctaagcttcct

SEQ ID NO: 27504 - DNA, 22 bp, Homo sapiens
gtatccatgggggattggttcc

SEQ ID NO: 27505 - DNA, 22 bp, Homo sapiens
aagctgcagcacagagaggtgg

SEQ ID NO: 27506 - DNA, 22 bp, Homo sapiens
attgaggtcccagaaaggactg

SEQ ID NO: 27507 - DNA, 20 bp, Homo sapiens
tttcttgtcggctgttgctg

SEQ ID NO: 27508 - DNA, 22 bp, Homo sapiens
gccagggttgccaatgggggca

SEQ ID NO: 27509 - DNA, 22 bp, Homo sapiens
aagaaatgtgaatattgaatag

SEQ ID NO: 27510 - DNA, 22 bp, Homo sapiens
tgacttgtctctttgggagaca

SEQ ID NO: 27511 - DNA, 22 bp, Homo sapiens
tgtgagcagagacatgaaaagc

SEQ ID NO: 27512 - DNA, 22 bp, Homo sapiens
ttgctggaaggtggctggaatc

SEQ ID NO: 27513 - DNA, 22 bp, Homo sapiens
atggaaggctttatgactcaaa

SEQ ID NO: 27514 - DNA, 22 bp, Homo sapiens
agttcaacaccagcctgaccaa

SEQ ID NO: 27515 - DNA, 22 bp, Homo sapiens
aagagggctcgatttggcaaaa

SEQ ID NO: 27516 - DNA, 22 bp, Homo sapiens
gctgcacagacttgctcattta

SEQ ID NO: 27517 - DNA, 22 bp, Homo sapiens
gtacacaaagtgagacttgata

SEQ ID NO: 27518 - DNA, 22 bp, Homo sapiens
gagcccaggagtttgatgctgc

SEQ ID NO: 27519 - DNA, 22 bp, Homo sapiens
aagtcacactagacaactgagg

SEQ ID NO: 27520 - DNA, 21 bp, Homo sapiens
ccaccaggtcttctgctcggg

SEQ ID NO: 27521 - DNA, 22 bp, Homo sapiens
gcccaggctggagttcagtggt

SEQ ID NO: 27522 - DNA, 22 bp, Homo sapiens
gggacgtgagtgaagaaggtct

SEQ ID NO: 27523 - DNA, 22 bp, Homo sapiens
cagggagtgtacaccatgtgta

SEQ ID NO: 27524 - DNA, 22 bp, Homo sapiens
agctttgtttgctcacccgccg

SEQ ID NO: 27525 - DNA, 22 bp, Homo sapiens
agtcttcccagaggaggtgcca

SEQ ID NO: 27526 - DNA, 23 bp, Homo sapiens
ttaaacactagttcgagtagcat

SEQ ID NO: 27527 - DNA, 22 bp, Homo sapiens
ttattttaccttcctctgagct

SEQ ID NO: 27528 - DNA, 22 bp, Homo sapiens
gctgctgcttgaaggctcggag

SEQ ID NO: 27529 - DNA, 22 bp, Homo sapiens
catgcacttacctgaaattcaa

SEQ ID NO: 27530 - DNA, 22 bp, Homo sapiens
aagagggctgcaatcttattgc

SEQ ID NO: 27531 - DNA, 22 bp, Homo sapiens
tcaagcaattctcctgcctcag

SEQ ID NO: 27532 - DNA, 21 bp, Homo sapiens
gccatttcacacagacatttg

SEQ ID NO: 27533 - DNA, 22 bp, Homo sapiens
atgtttttaaatagacttacag

SEQ ID NO: 27534 - DNA, 22 bp, Homo sapiens
tcctgggccctccggatcaggt

SEQ ID NO: 27535 - DNA, 22 bp, Homo sapiens
tggcacagactgggccaaggaa

SEQ ID NO: 27536 - DNA, 22 bp, Homo sapiens
gtctgctcatgctaccgcgggc

SEQ ID NO: 27537 - DNA, 22 bp, Homo sapiens
atgagaaagttaatcatcatga

SEQ ID NO: 27538 - DNA, 22 bp, Homo sapiens
tcagggattgcaaaattcatcc

SEQ ID NO: 27539 - DNA, 22 bp, Homo sapiens
ccggtgttcaaagtctggtatg

SEQ ID NO: 27540 - DNA, 22 bp, Homo sapiens
gagctgagaagcagcgcttgat

SEQ ID NO: 27541 - DNA, 22 bp, Homo sapiens
tacaggcatgtagcatggtgat

SEQ ID NO: 27542 - DNA, 22 bp, Homo sapiens
ctgtatttcttggacagttgct

SEQ ID NO: 27543 - DNA, 22 bp, Homo sapiens
gcccccgtagtagatgaggcgc

SEQ ID NO: 27544 - DNA, 22 bp, Homo sapiens
cggtctcccgtgtgtgtgcgct

SEQ ID NO: 27545 - DNA, 22 bp, Homo sapiens
aaacccagggttttgtcttccc

SEQ ID NO: 27546 - DNA, 22 bp, Homo sapiens
tagggcaatatttcccagaaaa

SEQ ID NO: 27547 - DNA, 22 bp, Homo sapiens
atatacacatctttttaaatat

SEQ ID NO: 27548 - DNA, 22 bp, Homo sapiens
agaccactaaaactttctctat

SEQ ID NO: 27549 - DNA, 22 bp, Homo sapiens
aagaggttgtacctaaagtgtt

SEQ ID NO: 27550 - DNA, 22 bp, Homo sapiens
aaagcagaactgagagagctgg

SEQ ID NO: 27551 - DNA, 22 bp, Homo sapiens
cactgcaacctccgcctcctgg

SEQ ID NO: 27552 - DNA, 22 bp, Homo sapiens
gtgcggatcggtgtcctccaaa

SEQ ID NO: 27553 - DNA, 22 bp, Homo sapiens
tccaactttctcctccggcttg

SEQ ID NO: 27554 - DNA, 22 bp, Homo sapiens
gaaaggagagggttaaggagct

SEQ ID NO: 27555 - DNA, 21 bp, Homo sapiens
ttgaccaagggtgcgtgctcc

SEQ ID NO: 27556 - DNA, 22 bp, Homo sapiens
aaggagaaatggtagatgtgca

SEQ ID NO: 27557 - DNA, 22 bp, Homo sapiens
accatgtcatttattggccaaa

SEQ ID NO: 27558 - DNA, 22 bp, Homo sapiens
gtcgtgcagacctcacagcatt

SEQ ID NO: 27559 - DNA, 22 bp, Homo sapiens
tcgtggatgcgcagggcggcct

SEQ ID NO: 27560 - DNA, 22 bp, Homo sapiens
ttctcccctttagggcctacgg

SEQ ID NO: 27561 - DNA, 22 bp, Homo sapiens
tcacccaggctggagtgtagtg

SEQ ID NO: 27562 - DNA, 22 bp, Homo sapiens
cttgccttctctggggtggcag

SEQ ID NO: 27563 - DNA, 22 bp, Homo sapiens
aacatagccagaatgtctcctg

SEQ ID NO: 27564 - DNA, 22 bp, Homo sapiens
ttcaatatgatattagctgtgg

SEQ ID NO: 27565 - DNA, 22 bp, Homo sapiens
agatttggtgtctggttgatat

SEQ ID NO: 27566 - DNA, 22 bp, Homo sapiens
gagtcgagcagaaagccgtcgg

SEQ ID NO: 27567 - DNA, 22 bp, Homo sapiens
tgactacaacctccacctcccg

SEQ ID NO: 27568 - DNA, 22 bp, Homo sapiens
ctctagtagctgagattacagg

SEQ ID NO: 27569 - DNA, 22 bp, Homo sapiens
tgtgtctttgttccaggtacga

SEQ ID NO: 27570 - DNA, 22 bp, Homo sapiens
gtacactccccctgtgaagttg

SEQ ID NO: 27571 - DNA, 22 bp, Homo sapiens
ttctgggcacacaggccctggt

SEQ ID NO: 27572 - DNA, 22 bp, Homo sapiens
accaggttggtgtccttctggc

SEQ ID NO: 27573 - DNA, 22 bp, Homo sapiens
ttctcttttcaccagttgctaa

SEQ ID NO: 27574 - DNA, 22 bp, Homo sapiens
aatgttgcagagtgattgtcca

SEQ ID NO: 27575 - DNA, 22 bp, Homo sapiens
gttggctatgagagctttagtg

SEQ ID NO: 27576 - DNA, 19 bp, Homo sapiens
ttaccgtgaaatggttcag

SEQ ID NO: 27577 - DNA, 22 bp, Homo sapiens
gtctgctttgtctttcatgata

SEQ ID NO: 27578 - DNA, 22 bp, Homo sapiens
caaaatgcatctgagaccaggc

SEQ ID NO: 27579 - DNA, 22 bp, Homo sapiens
aggcactgtgcagtcccaagca

SEQ ID NO: 27580 - DNA, 22 bp, Homo sapiens
acactgtgtgacttctgagact

SEQ ID NO: 27581 - DNA, 22 bp, Homo sapiens
gggctgggattgcttgctgtga

SEQ ID NO: 27582 - DNA, 22 bp, Homo sapiens
ccactgcacttcagcctgggtg

SEQ ID NO: 27583 - DNA, 22 bp, Homo sapiens
ttctgccttggcagggtggtcc

SEQ ID NO: 27584 - DNA, 22 bp, Homo sapiens
aggggagagttaatgtgaatgt

SEQ ID NO: 27585 - DNA, 22 bp, Homo sapiens
gtggagagagataagcctggtc

SEQ ID NO: 27586 - DNA, 22 bp, Homo sapiens
caggcagggagctggaaaggat

SEQ ID NO: 27587 - DNA, 22 bp, Homo sapiens
tttctgtgataggctgcgacgc

SEQ ID NO: 27588 - DNA, 22 bp, Homo sapiens
ggccgcggattttcccgctggc

SEQ ID NO: 27589 - DNA, 22 bp, Homo sapiens
ccatgtggtgggaaggagaatg

SEQ ID NO: 27590 - DNA, 22 bp, Homo sapiens
ctggagggtggagagaagtctc

SEQ ID NO: 27591 - DNA, 22 bp, Homo sapiens
gagcctggagctggaacgaagc

SEQ ID NO: 27592 - DNA, 22 bp, Homo sapiens
ccctcaatgtctacagcagtcc

SEQ ID NO: 27593 - DNA, 21 bp, Homo sapiens
gtgacctgcgcggggcgcagc

SEQ ID NO: 27594 - DNA, 22 bp, Homo sapiens
agagcggggatagttaatattc

SEQ ID NO: 27595 - DNA, 22 bp, Homo sapiens
tctttgctattgtgaatagtgc

SEQ ID NO: 27596 - DNA, 22 bp, Homo sapiens
ggtggcagtagcactgggcctg

SEQ ID NO: 27597 - DNA, 22 bp, Homo sapiens
atctcagttcaggctccactgt

SEQ ID NO: 27598 - DNA, 22 bp, Homo sapiens
gcacttcaccactgtcctggtt

SEQ ID NO: 27599 - DNA, 22 bp, Homo sapiens
ggtttgacagcttggggctgtc

SEQ ID NO: 27600 - DNA, 18 bp, Homo sapiens
tccctcagaattatagaa

SEQ ID NO: 27601 - DNA, 23 bp, Homo sapiens
cactgcaatctctgcctcctggg

SEQ ID NO: 27602 - DNA, 22 bp, Homo sapiens
ggagaggggaacttgttgcttg

SEQ ID NO: 27603 - DNA, 22 bp, Homo sapiens
gggatttcaccatgttggttgg

SEQ ID NO: 27604 - DNA, 22 bp, Homo sapiens
ccaggctagaaactgaggcaca

SEQ ID NO: 27605 - DNA, 22 bp, Homo sapiens
ccaaccagctatggaatcttgt

SEQ ID NO: 27606 - DNA, 22 bp, Homo sapiens
gttgctcaggcaggagtacagt

SEQ ID NO: 27607 - DNA, 22 bp, Homo sapiens
tattattgacatttacttggtg

SEQ ID NO: 27608 - DNA, 22 bp, Homo sapiens
tcctcagcttttatttcacttg

SEQ ID NO: 27609 - DNA, 22 bp, Homo sapiens
tcgtctgtgaaattgggataag

SEQ ID NO: 27610 - DNA, 22 bp, Homo sapiens
aatctcagctcatgcaattcca

SEQ ID NO: 27611 - DNA, 22 bp, Homo sapiens
attcatcagctaatggacattt

SEQ ID NO: 27612 - DNA, 22 bp, Homo sapiens
cctttcccgctttgagggcaag

SEQ ID NO: 27613 - DNA, 17 bp, Homo sapiens
gggcagggactcctggg

SEQ ID NO: 27614 - DNA, 22 bp, Homo sapiens
tgccacctgtacatgctatctg

SEQ ID NO: 27615 - DNA, 22 bp, Homo sapiens
aaagcactgcacatatatttgc

SEQ ID NO: 27616 - DNA, 22 bp, Homo sapiens
gggggaagaaagaacatggcat

SEQ ID NO: 27617 - DNA, 22 bp, Homo sapiens
gagcctcagggttttgttgaca

SEQ ID NO: 27618 - DNA, 22 bp, Homo sapiens
agcatggccatctgggccgtcc

SEQ ID NO: 27619 - DNA, 22 bp, Homo sapiens
acactgaaagaagccagcttgt

SEQ ID NO: 27620 - DNA, 22 bp, Homo sapiens
aggggaccaaaatgtcctgcct

SEQ ID NO: 27621 - DNA, 22 bp, Homo sapiens
atgtcttctctgtaggtaaatt

SEQ ID NO: 27622 - DNA, 22 bp, Homo sapiens
atggcaccttccccagagctca

SEQ ID NO: 27623 - DNA, 22 bp, Homo sapiens
tggaacgtcgtaatgttggtta

SEQ ID NO: 27624 - DNA, 22 bp, Homo sapiens
ccttcccacattccttacatgc

SEQ ID NO: 27625 - DNA, 22 bp, Homo sapiens
gcttccgcgatgtcctaggtgg

SEQ ID NO: 27626 - DNA, 22 bp, Homo sapiens
ggtgtgattatgacatgtgact

SEQ ID NO: 27627 - DNA, 22 bp, Homo sapiens
acaaagtgaattgcatcgagtt

SEQ ID NO: 27628 - DNA, 22 bp, Homo sapiens
cactgcaagctctgccacctgg

SEQ ID NO: 27629 - DNA, 22 bp, Homo sapiens
gttgacagtgaccctgaaagca

SEQ ID NO: 27630 - DNA, 22 bp, Homo sapiens
tctgttttgcataatgttcttt

SEQ ID NO: 27631 - DNA, 20 bp, Homo sapiens
ggggcccaagccctcttgcc

SEQ ID NO: 27632 - DNA, 21 bp, Homo sapiens
gttcttgcaggatttccttcc

SEQ ID NO: 27633 - DNA, 22 bp, Homo sapiens
agggggctccttggtgtgcaga

SEQ ID NO: 27634 - DNA, 22 bp, Homo sapiens
tgggaggccgaggcaggtggat

SEQ ID NO: 27635 - DNA, 22 bp, Homo sapiens
tttctcggcagagatgatgggc

SEQ ID NO: 27636 - DNA, 22 bp, Homo sapiens
ctcaggacggccgggggagcct

SEQ ID NO: 27637 - DNA, 22 bp, Homo sapiens
catacccatttgtttcaggagc

SEQ ID NO: 27638 - DNA, 22 bp, Homo sapiens
ctctctgggcccagttggcacc

SEQ ID NO: 27639 - DNA, 22 bp, Homo sapiens
ttctatattcgcttcccaaggc

SEQ ID NO: 27640 - DNA, 22 bp, Homo sapiens
acatgggcatctatgaggctct

SEQ ID NO: 27641 - DNA, 22 bp, Homo sapiens
agagattcctttggggaaagca

SEQ ID NO: 27642 - DNA, 22 bp, Homo sapiens
ggcaatcattggcattctctgg

SEQ ID NO: 27643 - DNA, 22 bp, Homo sapiens
ttcatatttctttaaggacttt

SEQ ID NO: 27644 - DNA, 22 bp, Homo sapiens
ttgctttgcagtgcctatagga

SEQ ID NO: 27645 - DNA, 22 bp, Homo sapiens
ctgcttaagcaagaaagcagca

SEQ ID NO: 27646 - DNA, 19 bp, Homo sapiens
gcctatgtcttcaaatcat

SEQ ID NO: 27647 - DNA, 22 bp, Homo sapiens
aagaactgagtacgttaataaa

SEQ ID NO: 27648 - DNA, 22 bp, Homo sapiens
agctggaattacaggcacgcac

SEQ ID NO: 27649 - DNA, 22 bp, Homo sapiens
gcagaggacacaggagggcaag

SEQ ID NO: 27650 - DNA, 22 bp, Homo sapiens
gagaacagaagcattcctaatt

SEQ ID NO: 27651 - DNA, 22 bp, Homo sapiens
attctcaaaacataacttcact

SEQ ID NO: 27652 - DNA, 22 bp, Homo sapiens
gtccccgacgtttggcttgatg

SEQ ID NO: 27653 - DNA, 22 bp, Homo sapiens
gggacttcatagctaggcactt

SEQ ID NO: 27654 - DNA, 22 bp, Homo sapiens
ccaaagaaacccaagctcaggg

SEQ ID NO: 27655 - DNA, 22 bp, Homo sapiens
tcaccttgtgatccgcccacct

SEQ ID NO: 27656 - DNA, 22 bp, Homo sapiens
atggccaggcacctctggctga

SEQ ID NO: 27657 - DNA, 22 bp, Homo sapiens
gggcgccgtgggaaacagccgg

SEQ ID NO: 27658 - DNA, 22 bp, Homo sapiens
aaagtgcttcctttttgagggt

SEQ ID NO: 27659 - DNA, 22 bp, Homo sapiens
tgcttctgactaagctgcatga

SEQ ID NO: 27660 - DNA, 20 bp, Homo sapiens
tgttatggtgttctgatggg

SEQ ID NO: 27661 - DNA, 22 bp, Homo sapiens
agagagcccgggccagggcaca

SEQ ID NO: 27662 - DNA, 22 bp, Homo sapiens
actcatgtcctaggagtaaagc

SEQ ID NO: 27663 - DNA, 22 bp, Homo sapiens
actgatcaagggtttaatttta

SEQ ID NO: 27664 - DNA, 22 bp, Homo sapiens
aggccccctccacccattctgg

SEQ ID NO: 27665 - DNA, 22 bp, Homo sapiens
tggctagcactctacctttctc

SEQ ID NO: 27666 - DNA, 22 bp, Homo sapiens
tcgagctctggagccaaggatg

SEQ ID NO: 27667 - DNA, 22 bp, Homo sapiens
gcttcaggctgaattcctccta

SEQ ID NO: 27668 - DNA, 22 bp, Homo sapiens
aaggcaggatgggaaaagattt

SEQ ID NO: 27669 - DNA, 20 bp, Homo sapiens
tgcagcacgggccctttcca

SEQ ID NO: 27670 - DNA, 22 bp, Homo sapiens
cagctgttcattgttgccaccc

SEQ ID NO: 27671 - DNA, 22 bp, Homo sapiens
tgttttaagctctagaagggga

SEQ ID NO: 27672 - DNA, 22 bp, Homo sapiens
tagtttaggatccaatctaaga

SEQ ID NO: 27673 - DNA, 20 bp, Homo sapiens
tcacatcctctcccaacatg

SEQ ID NO: 27674 - DNA, 22 bp, Homo sapiens
tctgccttttactagctggatg

SEQ ID NO: 27675 - DNA, 21 bp, Homo sapiens
acacaggcagtgtcccgaggt

SEQ ID NO: 27676 - DNA, 22 bp, Homo sapiens
gggcactcagctgtagagcagg

SEQ ID NO: 27677 - DNA, 22 bp, Homo sapiens
caaagggaaaagccatgtgggc

SEQ ID NO: 27678 - DNA, 22 bp, Homo sapiens
gctgctctcagagctcatgctg

SEQ ID NO: 27679 - DNA, 22 bp, Homo sapiens
atcaagggcgcgtggttcggcg

SEQ ID NO: 27680 - DNA, 22 bp, Homo sapiens
ctgtggctctttagttgagcac

SEQ ID NO: 27681 - DNA, 22 bp, Homo sapiens
tgagatcattgacttgttcctg

SEQ ID NO: 27682 - DNA, 22 bp, Homo sapiens
ggaggtaaagtaactcgcccag

SEQ ID NO: 27683 - DNA, 22 bp, Homo sapiens
tcagtgccatgggcagacaggc

SEQ ID NO: 27684 - DNA, 22 bp, Homo sapiens
tgggaggccaaggcaggcggat

SEQ ID NO: 27685 - DNA, 22 bp, Homo sapiens
gaacactgctgttgggttctga

SEQ ID NO: 27686 - DNA, 21 bp, Homo sapiens
accctgctttatgccgtcctc

SEQ ID NO: 27687 - DNA, 19 bp, Homo sapiens
aggcttcaggccacatgct

SEQ ID NO: 27688 - DNA, 22 bp, Homo sapiens
gaggcacagagtaggtgcacac

SEQ ID NO: 27689 - DNA, 23 bp, Homo sapiens
gttttacaggtgagaaaatggag

SEQ ID NO: 27690 - DNA, 23 bp, Homo sapiens
gcctgggagttgcgatctgcccg

SEQ ID NO: 27691 - DNA, 22 bp, Homo sapiens
tgggcgacagagcaagactccg

SEQ ID NO: 27692 - DNA, 22 bp, Homo sapiens
tgggtgacagagcaagactctg

SEQ ID NO: 27693 - DNA, 22 bp, Homo sapiens
gtgctgacaggagcctggcggt

SEQ ID NO: 27694 - DNA, 22 bp, Homo sapiens
tggcccgaagatccgagggtca

SEQ ID NO: 27695 - DNA, 22 bp, Homo sapiens
tgacatttcctagtgctttgtg

SEQ ID NO: 27696 - DNA, 22 bp, Homo sapiens
tacagaggaggggattttaata

SEQ ID NO: 27697 - DNA, 22 bp, Homo sapiens
tcactgcagcctctgcctcccg

SEQ ID NO: 27698 - DNA, 22 bp, Homo sapiens
atgttcatatccccattctgat

SEQ ID NO: 27699 - DNA, 19 bp, Homo sapiens
gctgaggtggaggaaggag

SEQ ID NO: 27700 - DNA, 22 bp, Homo sapiens
ggatgttgattgaatggccatt

SEQ ID NO: 27701 - DNA, 22 bp, Homo sapiens
gtccccgccgtcgctcaggctg

SEQ ID NO: 27702 - DNA, 22 bp, Homo sapiens
tatctcattttattgcaaatgt

SEQ ID NO: 27703 - DNA, 22 bp, Homo sapiens
gcagtgagttatgatcatgcca

SEQ ID NO: 27704 - DNA, 22 bp, Homo sapiens
acccaggctggagtgcagtggc

SEQ ID NO: 27705 - DNA, 22 bp, Homo sapiens
tcactgcaatctcagcctcctg

SEQ ID NO: 27706 - DNA, 22 bp, Homo sapiens
aagaggcgccgggtacgtggcg

SEQ ID NO: 27707 - DNA, 22 bp, Homo sapiens
gcttagtcaattataaataggc

SEQ ID NO: 27708 - DNA, 22 bp, Homo sapiens
tacagaagcttttgaaaagatg

SEQ ID NO: 27709 - DNA, 22 bp, Homo sapiens
tggaggtaggacgaagaactct

SEQ ID NO: 27710 - DNA, 22 bp, Homo sapiens
acaggatcgccctgttgcccag

SEQ ID NO: 27711 - DNA, 22 bp, Homo sapiens
cggcccgctgcgagtgcaccgt

SEQ ID NO: 27712 - DNA, 22 bp, Homo sapiens
tcaaatgaagacagttgacttg

SEQ ID NO: 27713 - DNA, 22 bp, Homo sapiens
gaccttgtgatccgcccgcctt

SEQ ID NO: 27714 - DNA, 22 bp, Homo sapiens
atggggctgttctctgccctgc

SEQ ID NO: 27715 - DNA, 22 bp, Homo sapiens
gaactttgcgcagttcccgggg

SEQ ID NO: 27716 - DNA, 22 bp, Homo sapiens
gctgctttgtctgtaaaatgga

SEQ ID NO: 27717 - DNA, 22 bp, Homo sapiens
tggtggctcacgtctgtaatct

SEQ ID NO: 27718 - DNA, 22 bp, Homo sapiens
caagccattctcctgcctcagc

SEQ ID NO: 27719 - DNA, 23 bp, Homo sapiens
ctcaaccctagtaagggagtagg

SEQ ID NO: 27720 - DNA, 22 bp, Homo sapiens
ggacaagcctgtgagtgggttt

SEQ ID NO: 27721 - DNA, 22 bp, Homo sapiens
ctcgcggcgcccgaagcccttg

SEQ ID NO: 27722 - DNA, 22 bp, Homo sapiens
agttattgagtgcagagcaggg

SEQ ID NO: 27723 - DNA, 22 bp, Homo sapiens
tcaggcagtagaattgcttgaa

SEQ ID NO: 27724 - DNA, 22 bp, Homo sapiens
ctgaggcctctcccactccagc

SEQ ID NO: 27725 - DNA, 22 bp, Homo sapiens
tgatttacagtagtgtctaaac

SEQ ID NO: 27726 - DNA, 22 bp, Homo sapiens
agctttggttgccatgatctga

SEQ ID NO: 27727 - DNA, 22 bp, Homo sapiens
aagattttcagtgcctaaaaca

SEQ ID NO: 27728 - DNA, 22 bp, Homo sapiens
catataaatacaacatgtgtta

SEQ ID NO: 27729 - DNA, 22 bp, Homo sapiens
ttgaggtcttcaggatcaggct

SEQ ID NO: 27730 - DNA, 22 bp, Homo sapiens
aaaagtaattgcggtttttgct

SEQ ID NO: 27731 - DNA, 22 bp, Homo sapiens
tagcagaagttgcaaactaggg

SEQ ID NO: 27732 - DNA, 22 bp, Homo sapiens
tgcagtggcgccatctcagctc

SEQ ID NO: 27733 - DNA, 22 bp, Homo sapiens
aaggtggcggctgccaggtcct

SEQ ID NO: 27734 - DNA, 22 bp, Homo sapiens
cgaggaggaaacgcggagaact

SEQ ID NO: 27735 - DNA, 22 bp, Homo sapiens
ttggatccatctcaggcatagg

SEQ ID NO: 27736 - DNA, 22 bp, Homo sapiens
cttgaagtggagcttttgaaat

SEQ ID NO: 27737 - DNA, 19 bp, Homo sapiens
aggattccagaacagtgtt

SEQ ID NO: 27738 - DNA, 22 bp, Homo sapiens
agtgggccggacagcccaggcc

SEQ ID NO: 27739 - DNA, 15 bp, Homo sapiens
ccttcccacccaccc

SEQ ID NO: 27740 - DNA, 22 bp, Homo sapiens
agattcaggcatgtcttcattt

SEQ ID NO: 27741 - DNA, 22 bp, Homo sapiens
agggtcctgggtgcagttgctt

SEQ ID NO: 27742 - DNA, 21 bp, Homo sapiens
caaaagagactgattcttgga

SEQ ID NO: 27743 - DNA, 22 bp, Homo sapiens
catcttggatgacataactgtg

SEQ ID NO: 27744 - DNA, 22 bp, Homo sapiens
aaagtgctgtgattacaggcat

SEQ ID NO: 27745 - DNA, 22 bp, Homo sapiens
atataatttttggttagctcaa

SEQ ID NO: 27746 - DNA, 22 bp, Homo sapiens
tgtagatattaattattccttt

SEQ ID NO: 27747 - DNA, 22 bp, Homo sapiens
caggcactgtgctgagctctgc

SEQ ID NO: 27748 - DNA, 22 bp, Homo sapiens
agaaggcatagaccggattatg

SEQ ID NO: 27749 - DNA, 22 bp, Homo sapiens
tataccatgtgtgcacactccc

SEQ ID NO: 27750 - DNA, 23 bp, Homo sapiens
tcatgcccaggctccagatgtca

SEQ ID NO: 27751 - DNA, 22 bp, Homo sapiens
ggttgcaaactcctgggatcaa

SEQ ID NO: 27752 - DNA, 22 bp, Homo sapiens
cctgtcataatgtccgatgtca

SEQ ID NO: 27753 - DNA, 22 bp, Homo sapiens
gcctcaaatgtggagcactatt

SEQ ID NO: 27754 - DNA, 22 bp, Homo sapiens
tgacagtgcgggtacatcatag

SEQ ID NO: 27755 - DNA, 22 bp, Homo sapiens
tcctgggaggcggaggttgcag

SEQ ID NO: 27756 - DNA, 22 bp, Homo sapiens
ggatgtcgaggatggggtagca

SEQ ID NO: 27757 - DNA, 22 bp, Homo sapiens
gactgtggggaagcagatgcca

SEQ ID NO: 27758 - DNA, 22 bp, Homo sapiens
aaaagtaattgtggtttttgct

SEQ ID NO: 27759 - DNA, 16 bp, Homo sapiens
tgcggcaacttgcggc

SEQ ID NO: 27760 - DNA, 22 bp, Homo sapiens
tgtgactggttgtcccgctttc

SEQ ID NO: 27761 - DNA, 22 bp, Homo sapiens
attgataaattgcaatggggct

SEQ ID NO: 27762 - DNA, 22 bp, Homo sapiens
gccccaagtccctatgtttcca

SEQ ID NO: 27763 - DNA, 22 bp, Homo sapiens
agtgtttgagtttgcggcattg

SEQ ID NO: 27764 - DNA, 19 bp, Homo sapiens
tttgatagggcataatata

SEQ ID NO: 27765 - DNA, 16 bp, Homo sapiens
tgggtgggaggagcgg

SEQ ID NO: 27766 - DNA, 22 bp, Homo sapiens
acgaggaagcgacccttgcccg

SEQ ID NO: 27767 - DNA, 22 bp, Homo sapiens
ttccacattccttacattcata

SEQ ID NO: 27768 - DNA, 22 bp, Homo sapiens
tgacagtaccactgaaagtctg

SEQ ID NO: 27769 - DNA, 15 bp, Homo sapiens
tggcccacccgttga

SEQ ID NO: 27770 - DNA, 22 bp, Homo sapiens
tcaccggcagacgtggcctgat

SEQ ID NO: 27771 - DNA, 22 bp, Homo sapiens
tccggactcacctgacaatggc

SEQ ID NO: 27772 - DNA, 22 bp, Homo sapiens
gctgaggtggaggaaggagacc

SEQ ID NO: 27773 - DNA, 21 bp, Homo sapiens
tgaaggtgttcatgatgcggt

SEQ ID NO: 27774 - DNA, 21 bp, Homo sapiens
acagcctccatctcctgggct

SEQ ID NO: 27775 - DNA, 22 bp, Homo sapiens
tcaggctcaggttaggggccaa

SEQ ID NO: 27776 - DNA, 22 bp, Homo sapiens
actccacatttgaacacagttc

SEQ ID NO: 27777 - DNA, 22 bp, Homo sapiens
aatatcatctctcttttctgca

SEQ ID NO: 27778 - DNA, 22 bp, Homo sapiens
ttcaccctggaccagaaattgg

SEQ ID NO: 27779 - DNA, 22 bp, Homo sapiens
ccgccgtgcaggccgcgacgtg

SEQ ID NO: 27780 - DNA, 18 bp, Homo sapiens
cttgttcttctcttggcg

SEQ ID NO: 27781 - DNA, 22 bp, Homo sapiens
gtgagcagagatcgcgtgattg

SEQ ID NO: 27782 - DNA, 22 bp, Homo sapiens
tgttcttaggtatttgacagtc

SEQ ID NO: 27783 - DNA, 22 bp, Homo sapiens
cagtggctggttagggacagga

SEQ ID NO: 27784 - DNA, 22 bp, Homo sapiens
agcacctgtcaagtccaggctg

SEQ ID NO: 27785 - DNA, 18 bp, Homo sapiens
aggtttggtggaaacata

SEQ ID NO: 27786 - DNA, 19 bp, Homo sapiens
gagaaagcaggcacagcac

SEQ ID NO: 27787 - DNA, 22 bp, Homo sapiens
ccagtgtatttttgggacctgc

SEQ ID NO: 27788 - DNA, 22 bp, Homo sapiens
aaaccgcaattacttttgcgtc

SEQ ID NO: 27789 - DNA, 23 bp, Homo sapiens
cttcacaggttcaggggattaag

SEQ ID NO: 27790 - DNA, 22 bp, Homo sapiens
cctgggacttggtctggggttt

SEQ ID NO: 27791 - DNA, 22 bp, Homo sapiens
agcaagatttttcaggttagta

SEQ ID NO: 27792 - DNA, 22 bp, Homo sapiens
gagcgattgcgggggtcagagg

SEQ ID NO: 27793 - DNA, 22 bp, Homo sapiens
ccagagctgattcctgggactt

SEQ ID NO: 27794 - DNA, 22 bp, Homo sapiens
cccaccagtacagatggtagat

SEQ ID NO: 27795 - DNA, 22 bp, Homo sapiens
tttagcgtagctgacagctaat

SEQ ID NO: 27796 - DNA, 22 bp, Homo sapiens
ctttggcaatgtcattttcaat

SEQ ID NO: 27797 - DNA, 22 bp, Homo sapiens
ataataacaatgccagatgcct

SEQ ID NO: 27798 - DNA, 22 bp, Homo sapiens
tagcataacaggtaagagtgag

SEQ ID NO: 27799 - DNA, 22 bp, Homo sapiens
ctccaccccgtgccggtgctgg

SEQ ID NO: 27800 - DNA, 22 bp, Homo sapiens
tctggcaatctgattctgcatc

SEQ ID NO: 27801 - DNA, 22 bp, Homo sapiens
tggaggccagaggtactgggac

SEQ ID NO: 27802 - DNA, 22 bp, Homo sapiens
ctgggagtggtgacagctctcg

SEQ ID NO: 27803 - DNA, 22 bp, Homo sapiens
tggaaatgtttcttgagctcag

SEQ ID NO: 27804 - DNA, 22 bp, Homo sapiens
ggggctgaacctggaggtggtc

SEQ ID NO: 27805 - DNA, 22 bp, Homo sapiens
atttttggctgttgtcagaggt

SEQ ID NO: 27806 - DNA, 22 bp, Homo sapiens
aaggtgggcagatcacaaggtc

SEQ ID NO: 27807 - DNA, 22 bp, Homo sapiens
tccagggagagccgctgctcca

SEQ ID NO: 27808 - DNA, 22 bp, Homo sapiens
aagtggactaatacaaggacta

SEQ ID NO: 27809 - DNA, 22 bp, Homo sapiens
ggcctacgccagtatccccagg

SEQ ID NO: 27810 - DNA, 22 bp, Homo sapiens
cttgaatgtcctgtggcaaagt

SEQ ID NO: 27811 - DNA, 19 bp, Homo sapiens
agagtattgaatttgccct

SEQ ID NO: 27812 - DNA, 22 bp, Homo sapiens
ttctgcaggctgtacaagaagc

SEQ ID NO: 27813 - DNA, 22 bp, Homo sapiens
gaacgggtgcagccatgggccc

SEQ ID NO: 27814 - DNA, 22 bp, Homo sapiens
acccgggaggcaggagtcatag

SEQ ID NO: 27815 - DNA, 22 bp, Homo sapiens
ccttcattcattaatttagccc

SEQ ID NO: 27816 - DNA, 22 bp, Homo sapiens
agagtgcaaccgaaacaagcag

SEQ ID NO: 27817 - DNA, 18 bp, Homo sapiens
acctgattggcgcagccc

SEQ ID NO: 27818 - DNA, 22 bp, Homo sapiens
ttcaacagacccttctttcttt

SEQ ID NO: 27819 - DNA, 23 bp, Homo sapiens
gtgggcgcccaggagcgggacgg

SEQ ID NO: 27820 - DNA, 22 bp, Homo sapiens
tggcctcggcatccagcaagag

SEQ ID NO: 27821 - DNA, 22 bp, Homo sapiens
tgactcctggtatggatgacag

SEQ ID NO: 27822 - DNA, 22 bp, Homo sapiens
gcctcctgagtagctgggattg

SEQ ID NO: 27823 - DNA, 22 bp, Homo sapiens
tttctcttcactgtgtgcctca

SEQ ID NO: 27824 - DNA, 22 bp, Homo sapiens
aagaggcgctcctcacttccta

SEQ ID NO: 27825 - DNA, 22 bp, Homo sapiens
gccatgcttggtatgctgtgag

SEQ ID NO: 27826 - DNA, 22 bp, Homo sapiens
acctggaacttggtcatttttc

SEQ ID NO: 27827 - DNA, 22 bp, Homo sapiens
ctgggcacagcgttgggctctt

SEQ ID NO: 27828 - DNA, 22 bp, Homo sapiens
ttctggaaggatgtttctatct

SEQ ID NO: 27829 - DNA, 22 bp, Homo sapiens
tttcatctgagtagcgtcggat

SEQ ID NO: 27830 - DNA, 22 bp, Homo sapiens
gggcggggtggctcatgcctgt

SEQ ID NO: 27831 - DNA, 22 bp, Homo sapiens
tcgtggatcaccgcgtctgtgt

SEQ ID NO: 27832 - DNA, 22 bp, Homo sapiens
tgttttggtggtctataggaaa

SEQ ID NO: 27833 - DNA, 22 bp, Homo sapiens
tttagattgtgacctcccccca

SEQ ID NO: 27834 - DNA, 22 bp, Homo sapiens
ctgaggagaggtggcctgtgtt

SEQ ID NO: 27835 - DNA, 22 bp, Homo sapiens
atgccactgcgctccagcctgg

SEQ ID NO: 27836 - DNA, 22 bp, Homo sapiens
aaaagggacgacaacaggccac

SEQ ID NO: 27837 - DNA, 22 bp, Homo sapiens
gtggcccaggttggagtgcagt

SEQ ID NO: 27838 - DNA, 22 bp, Homo sapiens
ataatacatggttgatcttttc

SEQ ID NO: 27839 - DNA, 22 bp, Homo sapiens
tatacactgttgttgggagtct

SEQ ID NO: 27840 - DNA, 22 bp, Homo sapiens
ctgattgagaaggaaggggatc

SEQ ID NO: 27841 - DNA, 22 bp, Homo sapiens
cccgggaggtggaggttgcagt

SEQ ID NO: 27842 - DNA, 22 bp, Homo sapiens
tgagatgtaaggtatgcttact

SEQ ID NO: 27843 - DNA, 22 bp, Homo sapiens
tatagcagcatgatttatagtc

SEQ ID NO: 27844 - DNA, 22 bp, Homo sapiens
taagatgtttacagtatggaga

SEQ ID NO: 27845 - DNA, 22 bp, Homo sapiens
gcacatccaatgattgttttga

SEQ ID NO: 27846 - DNA, 22 bp, Homo sapiens
tgcgaccctagccccctcactt

SEQ ID NO: 27847 - DNA, 22 bp, Homo sapiens
aacagaatattttgcctttctc

SEQ ID NO: 27848 - DNA, 22 bp, Homo sapiens
gtttctctgtctgttacattgg

SEQ ID NO: 27849 - DNA, 22 bp, Homo sapiens
aataaaatggtcagttttctca

SEQ ID NO: 27850 - DNA, 22 bp, Homo sapiens
tttatgtagttacggactatca

SEQ ID NO: 27851 - DNA, 22 bp, Homo sapiens
tgagatgtcatagttcagttca

SEQ ID NO: 27852 - DNA, 22 bp, Homo sapiens
acgcctctgcagctgccgggcc

SEQ ID NO: 27853 - DNA, 22 bp, Homo sapiens
gttatataagacaaatcagagt

SEQ ID NO: 27854 - DNA, 22 bp, Homo sapiens
gagacctcttggtatcgctagg

SEQ ID NO: 27855 - DNA, 22 bp, Homo sapiens
gtatcacttttgagagtgagaa

SEQ ID NO: 27856 - DNA, 22 bp, Homo sapiens
gtggcttggaccagtcacagtg

SEQ ID NO: 27857 - DNA, 22 bp, Homo sapiens
ttgctcttgaaaattgatgctg

SEQ ID NO: 27858 - DNA, 22 bp, Homo sapiens
ggctgcaggttggttggcagct

SEQ ID NO: 27859 - DNA, 22 bp, Homo sapiens
ccccagtggaggtgagggtcct

SEQ ID NO: 27860 - DNA, 22 bp, Homo sapiens
ttttaagttggattgctaagta

SEQ ID NO: 27861 - DNA, 22 bp, Homo sapiens
agccctggtttgcagcatttgc

SEQ ID NO: 27862 - DNA, 22 bp, Homo sapiens
aacccgtgatcctgactcccct

SEQ ID NO: 27863 - DNA, 22 bp, Homo sapiens
cctgcttaacattgccatgaca

SEQ ID NO: 27864 - DNA, 22 bp, Homo sapiens
gtcgtggtcagacaccagaaaa

SEQ ID NO: 27865 - DNA, 22 bp, Homo sapiens
tgtccaggttagcttcaaacac

SEQ ID NO: 27866 - DNA, 20 bp, Homo sapiens
tggtccccatccttgcgatt

SEQ ID NO: 27867 - DNA, 22 bp, Homo sapiens
ccgtggtcacctgagctccttg

SEQ ID NO: 27868 - DNA, 22 bp, Homo sapiens
caccaggaggacaggcccctac

SEQ ID NO: 27869 - DNA, 22 bp, Homo sapiens
acaactttgacccttgttctta

SEQ ID NO: 27870 - DNA, 22 bp, Homo sapiens
agccacacttgccaggggaagg

SEQ ID NO: 27871 - DNA, 22 bp, Homo sapiens
atgccactgcacttcagcttgg

SEQ ID NO: 27872 - DNA, 22 bp, Homo sapiens
tgatccattaaaatccaagagt

SEQ ID NO: 27873 - DNA, 22 bp, Homo sapiens
tatcacagccttttggtgaggg

SEQ ID NO: 27874 - DNA, 19 bp, Homo sapiens
ttctggtctggaatcaagg

SEQ ID NO: 27875 - DNA, 22 bp, Homo sapiens
tcccttgggagtggtgaccaca

SEQ ID NO: 27876 - DNA, 21 bp, Homo sapiens
ttgatggtgggtgatgctctg

SEQ ID NO: 27877 - DNA, 22 bp, Homo sapiens
aggagcagaccgtagtcctgca

SEQ ID NO: 27878 - DNA, 22 bp, Homo sapiens
gacaggcttccactatgttgcc

SEQ ID NO: 27879 - DNA, 22 bp, Homo sapiens
gcccagccacagtcactttcat

SEQ ID NO: 27880 - DNA, 22 bp, Homo sapiens
gtgccccagacacgcatgtggg

SEQ ID NO: 27881 - DNA, 22 bp, Homo sapiens
aacccaggaggtggaggttgtg

SEQ ID NO: 27882 - DNA, 22 bp, Homo sapiens
ggggccgaccgcggttcaggcc

SEQ ID NO: 27883 - DNA, 22 bp, Homo sapiens
tataaagagtctcaaagaagtt

SEQ ID NO: 27884 - DNA, 22 bp, Homo sapiens
aaagtgctgaaattacaggtgt

SEQ ID NO: 27885 - DNA, 22 bp, Homo sapiens
gtggtgagattgctggatcaaa

SEQ ID NO: 27886 - DNA, 22 bp, Homo sapiens
aggctgaggcaagaggatcact

SEQ ID NO: 27887 - DNA, 22 bp, Homo sapiens
catccaggctggagtacagtgg

SEQ ID NO: 27888 - DNA, 22 bp, Homo sapiens
tattcatagtaaacaaaagtgg

SEQ ID NO: 27889 - DNA, 22 bp, Homo sapiens
ggggccttttctgaatgtggaa

SEQ ID NO: 27890 - DNA, 22 bp, Homo sapiens
accaggcccgctgctatggtgg

SEQ ID NO: 27891 - DNA, 22 bp, Homo sapiens
aataaacaaatccttccttccc

SEQ ID NO: 27892 - DNA, 22 bp, Homo sapiens
acccagccatgttcagttctct

SEQ ID NO: 27893 - DNA, 22 bp, Homo sapiens
gaggcaggaggattgcttgagc

SEQ ID NO: 27894 - DNA, 22 bp, Homo sapiens
tttatagcagcatgatttatag

SEQ ID NO: 27895 - DNA, 23 bp, Homo sapiens
aggaaagcattcatttttaccat

SEQ ID NO: 27896 - DNA, 22 bp, Homo sapiens
agctctgaaagttatgtcgccg

SEQ ID NO: 27897 - DNA, 22 bp, Homo sapiens
aggccaggaatccttgtcccag

SEQ ID NO: 27898 - DNA, 22 bp, Homo sapiens
ctgggctcaagtgatccaccca

SEQ ID NO: 27899 - DNA, 22 bp, Homo sapiens
tgggcaaggctggagcctgcag

SEQ ID NO: 27900 - DNA, 22 bp, Homo sapiens
gccaggctgaggctctggaaga

SEQ ID NO: 27901 - DNA, 22 bp, Homo sapiens
tctgacattttgagaatgacat

SEQ ID NO: 27902 - DNA, 22 bp, Homo sapiens
catggggcccatgtgctccaag

SEQ ID NO: 27903 - DNA, 22 bp, Homo sapiens
aacagtgctgttataaatgtac

SEQ ID NO: 27904 - DNA, 22 bp, Homo sapiens
agtcaggggatctagacttgaa

SEQ ID NO: 27905 - DNA, 22 bp, Homo sapiens
cctgaggatgccagcatgggtg

SEQ ID NO: 27906 - DNA, 22 bp, Homo sapiens
cacagtggtccccgaagcccct

SEQ ID NO: 27907 - DNA, 22 bp, Homo sapiens
taggctaggctgaaggttttgg

SEQ ID NO: 27908 - DNA, 22 bp, Homo sapiens
attttctatgttgtaattgtta

SEQ ID NO: 27909 - DNA, 22 bp, Homo sapiens
taagagaccgatattcttaagt

SEQ ID NO: 27910 - DNA, 22 bp, Homo sapiens
tgggggtgtcctggtgcacaca

SEQ ID NO: 27911 - DNA, 22 bp, Homo sapiens
cacagagctggaaaggctgggc

SEQ ID NO: 27912 - DNA, 22 bp, Homo sapiens
ccagtgtgcaatctctggctta

SEQ ID NO: 27913 - DNA, 22 bp, Homo sapiens
tgctcgccccacatgccctcat

SEQ ID NO: 27914 - DNA, 22 bp, Homo sapiens
ttatttaaaagtggtaagattc

SEQ ID NO: 27915 - DNA, 22 bp, Homo sapiens
ttccatacgactgaggtctcgg

SEQ ID NO: 27916 - DNA, 22 bp, Homo sapiens
ggggcccctcggacacgtgcgg

SEQ ID NO: 27917 - DNA, 22 bp, Homo sapiens
atatgggtcatgtgatgttcaa

SEQ ID NO: 27918 - DNA, 22 bp, Homo sapiens
ctggtaggggtgactgttatcg

SEQ ID NO: 27919 - DNA, 22 bp, Homo sapiens
gggcccggaccttcctctctga

SEQ ID NO: 27920 - DNA, 22 bp, Homo sapiens
tgattgcacacctgcactcaag

SEQ ID NO: 27921 - DNA, 22 bp, Homo sapiens
cctgggccctcaccgccggtgg

SEQ ID NO: 27922 - DNA, 22 bp, Homo sapiens
atgtttttggaaatgggaacat

SEQ ID NO: 27923 - DNA, 22 bp, Homo sapiens
gcctccagcccacgcaggcctg

SEQ ID NO: 27924 - DNA, 22 bp, Homo sapiens
ccggcgaccgctgtcggaggcg

SEQ ID NO: 27925 - DNA, 22 bp, Homo sapiens
aatctgagggaacttgaactcc

SEQ ID NO: 27926 - DNA, 22 bp, Homo sapiens
agtgggtgacagtgaacacgta

SEQ ID NO: 27927 - DNA, 19 bp, Homo sapiens
catggtgaaaccccgtctc

SEQ ID NO: 27928 - DNA, 19 bp, Homo sapiens
ggtatatgggcctcacttg

SEQ ID NO: 27929 - DNA, 17 bp, Homo sapiens
aatgtccttggaccaca

SEQ ID NO: 27930 - DNA, 22 bp, Homo sapiens
tcacaactgggtgtcttcatca

SEQ ID NO: 27931 - DNA, 22 bp, Homo sapiens
aaagtgctgggattacaagtgt

SEQ ID NO: 27932 - DNA, 22 bp, Homo sapiens
tggggtgagattcagatattca

SEQ ID NO: 27933 - DNA, 22 bp, Homo sapiens
aggacgctctcgctgaacttct

SEQ ID NO: 27934 - DNA, 22 bp, Homo sapiens
acttcttcttcagctgggggat

SEQ ID NO: 27935 - DNA, 22 bp, Homo sapiens
actgcaaagggaagccctttct

SEQ ID NO: 27936 - DNA, 22 bp, Homo sapiens
tacgggcacgcaccacgatgcc

SEQ ID NO: 27937 - DNA, 22 bp, Homo sapiens
gtcactgtatccaggttccagc

SEQ ID NO: 27938 - DNA, 22 bp, Homo sapiens
tgctgctgaggctaaagtatag

SEQ ID NO: 27939 - DNA, 22 bp, Homo sapiens
ccagatgtccctctcaggtttg

SEQ ID NO: 27940 - DNA, 23 bp, Homo sapiens
tctcccaagcctggcaggggcac

SEQ ID NO: 27941 - DNA, 22 bp, Homo sapiens
tggagaagattggtcaccattc

SEQ ID NO: 27942 - DNA, 22 bp, Homo sapiens
aaagatcacgtcccaggactcg

SEQ ID NO: 27943 - DNA, 22 bp, Homo sapiens
atgcacctgaactccatcagct

SEQ ID NO: 27944 - DNA, 22 bp, Homo sapiens
cccaggaggtggaggctgcagt

SEQ ID NO: 27945 - DNA, 22 bp, Homo sapiens
tcctcggctgggccccaggctt

SEQ ID NO: 27946 - DNA, 22 bp, Homo sapiens
aagccggctgggccgaggctgc

SEQ ID NO: 27947 - DNA, 22 bp, Homo sapiens
tatttaataaaactatggcatg

SEQ ID NO: 27948 - DNA, 22 bp, Homo sapiens
ctgggggcagcaagaagccatg

SEQ ID NO: 27949 - DNA, 22 bp, Homo sapiens
gttgggttaaccaggatgtcaa

SEQ ID NO: 27950 - DNA, 22 bp, Homo sapiens
agcagtgtgggctgcacgctgg

SEQ ID NO: 27951 - DNA, 22 bp, Homo sapiens
cagggtgctgcaccatccctca

SEQ ID NO: 27952 - DNA, 22 bp, Homo sapiens
agggaattcactggaacgccct

SEQ ID NO: 27953 - DNA, 21 bp, Homo sapiens
gcccacagtgaggaggatccc

SEQ ID NO: 27954 - DNA, 22 bp, Homo sapiens
tggggaaaatgcttgtagtcag

SEQ ID NO: 27955 - DNA, 22 bp, Homo sapiens
ttgtcttttgtgggaaatatgg

SEQ ID NO: 27956 - DNA, 22 bp, Homo sapiens
gctcactgcaacctctgcctcc

SEQ ID NO: 27957 - DNA, 22 bp, Homo sapiens
gacaattagatcattcctttga

SEQ ID NO: 27958 - DNA, 22 bp, Homo sapiens
gcttggaagtaggattgggaga

SEQ ID NO: 27959 - DNA, 22 bp, Homo sapiens
agcctggtttaagcattttata

SEQ ID NO: 27960 - DNA, 22 bp, Homo sapiens
ccaggggggcgtagatgctggg

SEQ ID NO: 27961 - DNA, 22 bp, Homo sapiens
aaagtgcttctctttggtgggt

SEQ ID NO: 27962 - DNA, 22 bp, Homo sapiens
ccaattctgtagagttgattaa

SEQ ID NO: 27963 - DNA, 22 bp, Homo sapiens
aggcgcctgcgggatccttgcc

SEQ ID NO: 27964 - DNA, 22 bp, Homo sapiens
gattcactcatattttacgttt

SEQ ID NO: 27965 - DNA, 22 bp, Homo sapiens
attttttgttaactcaggatag

SEQ ID NO: 27966 - DNA, 22 bp, Homo sapiens
gccgccgctgtgcaatttagca

SEQ ID NO: 27967 - DNA, 22 bp, Homo sapiens
tccttgccctaaatgtctgtgt

SEQ ID NO: 27968 - DNA, 22 bp, Homo sapiens
tgctgaataagacgtggcttgt

SEQ ID NO: 27969 - DNA, 22 bp, Homo sapiens
cccagcgagtttgccggtgaac

SEQ ID NO: 27970 - DNA, 22 bp, Homo sapiens
tggcccagtatgtataatctta

SEQ ID NO: 27971 - DNA, 22 bp, Homo sapiens
ggtcagccttggatttggtagc

SEQ ID NO: 27972 - DNA, 22 bp, Homo sapiens
aggcaggaaaatcgcttgaacc

SEQ ID NO: 27973 - DNA, 22 bp, Homo sapiens
gatgtagacacttggaggctta

SEQ ID NO: 27974 - DNA, 22 bp, Homo sapiens
aggcaagggggcgccaccttcc

SEQ ID NO: 27975 - DNA, 22 bp, Homo sapiens
agcctctcagagtgctgggatt

SEQ ID NO: 27976 - DNA, 22 bp, Homo sapiens
cagagggttgatgtgaggctta

SEQ ID NO: 27977 - DNA, 22 bp, Homo sapiens
caggtgttggaagggcagtggg

SEQ ID NO: 27978 - DNA, 22 bp, Homo sapiens
tatgaagtctctgatgttgagt

SEQ ID NO: 27979 - DNA, 22 bp, Homo sapiens
agtccgtggccagactcaagag

SEQ ID NO: 27980 - DNA, 22 bp, Homo sapiens
aatgactaaatctgaagatagg

SEQ ID NO: 27981 - DNA, 22 bp, Homo sapiens
ttgactgtgatgggctcagctg

SEQ ID NO: 27982 - DNA, 22 bp, Homo sapiens
cactaggctggagtgcagtggc

SEQ ID NO: 27983 - DNA, 22 bp, Homo sapiens
agcataagttggtacagccact

SEQ ID NO: 27984 - DNA, 22 bp, Homo sapiens
tgtgcccaacgtgcaggtttgt

SEQ ID NO: 27985 - DNA, 22 bp, Homo sapiens
gccgtccacctcgatggccact

SEQ ID NO: 27986 - DNA, 22 bp, Homo sapiens
attctacatgatagaagggaga

SEQ ID NO: 27987 - DNA, 17 bp, Homo sapiens
acttcccacccctccag

SEQ ID NO: 27988 - DNA, 22 bp, Homo sapiens
ctgaatccacacaaggtgatgg

SEQ ID NO: 27989 - DNA, 22 bp, Homo sapiens
gctcactgcaacctccgccttc

SEQ ID NO: 27990 - DNA, 22 bp, Homo sapiens
agacagctggtagcacttcctg

SEQ ID NO: 27991 - DNA, 22 bp, Homo sapiens
ccacgggcagatgtggttggtt

SEQ ID NO: 27992 - DNA, 22 bp, Homo sapiens
cagcatgaatgtgttcgtaggg

SEQ ID NO: 27993 - DNA, 22 bp, Homo sapiens
gaacccaggaggcagaggttgc

SEQ ID NO: 27994 - DNA, 17 bp, Homo sapiens
tcggtttgccaggcttc

SEQ ID NO: 27995 - DNA, 22 bp, Homo sapiens
tactagttcccagctaaaagta

SEQ ID NO: 27996 - DNA, 22 bp, Homo sapiens
gcatctaaataaacgtgggagt

SEQ ID NO: 27997 - DNA, 22 bp, Homo sapiens
tgagataatcatgtgatttcat

SEQ ID NO: 27998 - DNA, 22 bp, Homo sapiens
cggccgcagcagtgtcggccca

SEQ ID NO: 27999 - DNA, 22 bp, Homo sapiens
ggcaaagccctgcctggttcaa

SEQ ID NO: 28000 - DNA, 22 bp, Homo sapiens
gctcaagccttctgcccacctc

SEQ ID NO: 28001 - DNA, 22 bp, Homo sapiens
tggtggctaccaggtcctgggg

SEQ ID NO: 28002 - DNA, 22 bp, Homo sapiens
atgtgtattacctcgattgtga

SEQ ID NO: 28003 - DNA, 22 bp, Homo sapiens
agtccaggcattccagccattc

SEQ ID NO: 28004 - DNA, 22 bp, Homo sapiens
actgttttctgtaaagggccag

SEQ ID NO: 28005 - DNA, 22 bp, Homo sapiens
ccctcccggcgtgctgggctcg

SEQ ID NO: 28006 - DNA, 22 bp, Homo sapiens
attgcactccagcctgggcgac

SEQ ID NO: 28007 - DNA, 22 bp, Homo sapiens
cacttcaacctctgagtcctgg

SEQ ID NO: 28008 - DNA, 22 bp, Homo sapiens
ataatctttcttttccagatag

SEQ ID NO: 28009 - DNA, 19 bp, Homo sapiens
tctcacagctctactatgt

SEQ ID NO: 28010 - DNA, 22 bp, Homo sapiens
cctgtatggctattccttggac

SEQ ID NO: 28011 - DNA, 23 bp, Homo sapiens
tgcatggggctatactgctgttc

SEQ ID NO: 28012 - DNA, 22 bp, Homo sapiens
tatccgtgatgtttataaacca

SEQ ID NO: 28013 - DNA, 22 bp, Homo sapiens
acaaggcactttatgaagagga

SEQ ID NO: 28014 - DNA, 22 bp, Homo sapiens
atgcccaatgtcacaatttttg

SEQ ID NO: 28015 - DNA, 22 bp, Homo sapiens
gagcacagtaaagcagtgtcac

SEQ ID NO: 28016 - DNA, 22 bp, Homo sapiens
actcggggtggagagagcggtg

SEQ ID NO: 28017 - DNA, 22 bp, Homo sapiens
ggcaaaaagttcccatcagtgt

SEQ ID NO: 28018 - DNA, 22 bp, Homo sapiens
tcttcatgtcatggtatattga

SEQ ID NO: 28019 - DNA, 22 bp, Homo sapiens
cagaatcaagtccaattagcac

SEQ ID NO: 28020 - DNA, 22 bp, Homo sapiens
tggccagctttgactgtaaacc

SEQ ID NO: 28021 - DNA, 22 bp, Homo sapiens
agcttgacagacagatggtagc

SEQ ID NO: 28022 - DNA, 20 bp, Homo sapiens
tagcatgggtgagggtagag

SEQ ID NO: 28023 - DNA, 23 bp, Homo sapiens
ctcctcgtaactctgtggtgggt

SEQ ID NO: 28024 - DNA, 22 bp, Homo sapiens
ctaaagtgccaggaatacaggt

SEQ ID NO: 28025 - DNA, 22 bp, Homo sapiens
attgtggtgtcagttataggca

SEQ ID NO: 28026 - DNA, 22 bp, Homo sapiens
cctgtcatatacatacctcctc

SEQ ID NO: 28027 - DNA, 22 bp, Homo sapiens
tgcactccaggctgggtgacag

SEQ ID NO: 28028 - DNA, 22 bp, Homo sapiens
tgtggggatcttctagcttttc

SEQ ID NO: 28029 - DNA, 22 bp, Homo sapiens
tctggtgtcagtattctttgaa

SEQ ID NO: 28030 - DNA, 22 bp, Homo sapiens
ttgtacttgccatagaacaaca

SEQ ID NO: 28031 - DNA, 20 bp, Homo sapiens
agagatggggtatcaccgta

SEQ ID NO: 28032 - DNA, 22 bp, Homo sapiens
tctgctctgtggcttcagctaa

SEQ ID NO: 28033 - DNA, 22 bp, Homo sapiens
agatggagtctcactcttgttg

SEQ ID NO: 28034 - DNA, 22 bp, Homo sapiens
ccttctagcaaatcaacataaa

SEQ ID NO: 28035 - DNA, 22 bp, Homo sapiens
agagggcgcccaggcccacgcc

SEQ ID NO: 28036 - DNA, 22 bp, Homo sapiens
aaagcctcccaggttatgagta

SEQ ID NO: 28037 - DNA, 22 bp, Homo sapiens
cgccggcttgaggcaggcggca

SEQ ID NO: 28038 - DNA, 22 bp, Homo sapiens
cattgcactcctgcctgggcaa

SEQ ID NO: 28039 - DNA, 22 bp, Homo sapiens
gggaggttgaggctgcagtgag

SEQ ID NO: 28040 - DNA, 22 bp, Homo sapiens
aaagcgcttccctttggagcgt

SEQ ID NO: 28041 - DNA, 22 bp, Homo sapiens
agagagcagtggatcacctagc

SEQ ID NO: 28042 - DNA, 21 bp, Homo sapiens
ggcaagaaacacaatcaagta

SEQ ID NO: 28043 - DNA, 22 bp, Homo sapiens
gaccactggggtgagggccatc

SEQ ID NO: 28044 - DNA, 22 bp, Homo sapiens
ttagtttataattcatttctgt

SEQ ID NO: 28045 - DNA, 22 bp, Homo sapiens
tttgctattgtgaatagtgcca

SEQ ID NO: 28046 - DNA, 22 bp, Homo sapiens
tgaagactcagaagctaagata

SEQ ID NO: 28047 - DNA, 22 bp, Homo sapiens
aggctcagatccttgtgtcctg

SEQ ID NO: 28048 - DNA, 22 bp, Homo sapiens
ctgaggaaggctgggggcatcc

SEQ ID NO: 28049 - DNA, 22 bp, Homo sapiens
tcaacaccacaatttcttaact

SEQ ID NO: 28050 - DNA, 22 bp, Homo sapiens
gggtctcctaatggaggatgac

SEQ ID NO: 28051 - DNA, 22 bp, Homo sapiens
agctggagatgagtgacgtgcc

SEQ ID NO: 28052 - DNA, 22 bp, Homo sapiens
ttgtgctctgtgttatttaagg

SEQ ID NO: 28053 - DNA, 22 bp, Homo sapiens
tcctacacagataacagagacg

SEQ ID NO: 28054 - DNA, 22 bp, Homo sapiens
gctccgtgggcattgctaggtg

SEQ ID NO: 28055 - DNA, 22 bp, Homo sapiens
cactgcactccatcctgggaaa

SEQ ID NO: 28056 - DNA, 19 bp, Homo sapiens
gccgggcccgggttggccg

SEQ ID NO: 28057 - DNA, 22 bp, Homo sapiens
gcaactgaacatgtgtgtggcc

SEQ ID NO: 28058 - DNA, 22 bp, Homo sapiens
agtccgcctgctgccgtggcag

SEQ ID NO: 28059 - DNA, 19 bp, Homo sapiens
tgccgctcgaggctctggg

SEQ ID NO: 28060 - DNA, 22 bp, Homo sapiens
aacattgaacttggcacaccca

SEQ ID NO: 28061 - DNA, 22 bp, Homo sapiens
agaggggcccggttctccgtct

SEQ ID NO: 28062 - DNA, 22 bp, Homo sapiens
cttcctttgctgttcggaggtt

SEQ ID NO: 28063 - DNA, 22 bp, Homo sapiens
actcccttggtggagaatgcaa

SEQ ID NO: 28064 - DNA, 22 bp, Homo sapiens
tcgtgaggctctgcatcgcaca

SEQ ID NO: 28065 - DNA, 22 bp, Homo sapiens
gaaggaccctctggggtctcag

SEQ ID NO: 28066 - DNA, 22 bp, Homo sapiens
gtggggtctgtcctcttctggg

SEQ ID NO: 28067 - DNA, 22 bp, Homo sapiens
actgcgtggggagctgtgacta

SEQ ID NO: 28068 - DNA, 22 bp, Homo sapiens
cacccaggcaaggattctgcaa

SEQ ID NO: 28069 - DNA, 22 bp, Homo sapiens
acacatggtctacttcttctca

SEQ ID NO: 28070 - DNA, 22 bp, Homo sapiens
tctgttgactcctagcagccat

SEQ ID NO: 28071 - DNA, 22 bp, Homo sapiens
gtgcgcaccctcccggcatccc

SEQ ID NO: 28072 - DNA, 22 bp, Homo sapiens
gagggtggtggcttaaggtgct

SEQ ID NO: 28073 - DNA, 22 bp, Homo sapiens
ggtgtgtctgccaggaactgca

SEQ ID NO: 28074 - DNA, 22 bp, Homo sapiens
ttgtaacaggtactaaataact

SEQ ID NO: 28075 - DNA, 22 bp, Homo sapiens
gagccgaggcgcacagctcggg

SEQ ID NO: 28076 - DNA, 22 bp, Homo sapiens
gctaatcaatgttaaggctgtg

SEQ ID NO: 28077 - DNA, 22 bp, Homo sapiens
gaaacactcaatttagtaattc

SEQ ID NO: 28078 - DNA, 22 bp, Homo sapiens
tcacctctactcagcctagttc

SEQ ID NO: 28079 - DNA, 22 bp, Homo sapiens
cactgcaatctccatctcctgg

SEQ ID NO: 28080 - DNA, 22 bp, Homo sapiens
gtggctcacgcctgtaatccca

SEQ ID NO: 28081 - DNA, 22 bp, Homo sapiens
gaggcagaggttgcagtgagct

SEQ ID NO: 28082 - DNA, 22 bp, Homo sapiens
caccaagaatcttcacttttta

SEQ ID NO: 28083 - DNA, 23 bp, Homo sapiens
attttttgtctttgtaactagat

SEQ ID NO: 28084 - DNA, 22 bp, Homo sapiens
tggaaccatcaaagagatcctg

SEQ ID NO: 28085 - DNA, 22 bp, Homo sapiens
gcactgcaggtgggtggagagg

SEQ ID NO: 28086 - DNA, 22 bp, Homo sapiens
gcagcaacgcggccctactgct

SEQ ID NO: 28087 - DNA, 22 bp, Homo sapiens
agtgaatgtccccgcgggtcag

SEQ ID NO: 28088 - DNA, 22 bp, Homo sapiens
tagaggattttgcatttcatat

SEQ ID NO: 28089 - DNA, 22 bp, Homo sapiens
atgccactgcactccagcctgg

SEQ ID NO: 28090 - DNA, 23 bp, Homo sapiens
aattatctatttcaaatttagca

SEQ ID NO: 28091 - DNA, 22 bp, Homo sapiens
actgtactccagcctgggaaac

SEQ ID NO: 28092 - DNA, 22 bp, Homo sapiens
ctccccccacagtgttcttgcc

SEQ ID NO: 28093 - DNA, 22 bp, Homo sapiens
ttgcttcttagatattcctctc

SEQ ID NO: 28094 - DNA, 23 bp, Homo sapiens
caggagatggctgctgtgtcagc

SEQ ID NO: 28095 - DNA, 22 bp, Homo sapiens
atgaggcaggtggaggctgcca

SEQ ID NO: 28096 - DNA, 22 bp, Homo sapiens
acattaaaattgggtggggtaa

SEQ ID NO: 28097 - DNA, 22 bp, Homo sapiens
tggtccgctcctattcgccgca

SEQ ID NO: 28098 - DNA, 22 bp, Homo sapiens
cttggtgccacagcagcttgcg

SEQ ID NO: 28099 - DNA, 22 bp, Homo sapiens
gagtctctgaccagggtgccaa

SEQ ID NO: 28100 - DNA, 22 bp, Homo sapiens
agtttccatcccacacttgctt

SEQ ID NO: 28101 - DNA, 22 bp, Homo sapiens
agacggctggcagtgagcggct

SEQ ID NO: 28102 - DNA, 22 bp, Homo sapiens
tgggaagctgcattttaacaag

SEQ ID NO: 28103 - DNA, 22 bp, Homo sapiens
aagtctctcacatatctggtcc

SEQ ID NO: 28104 - DNA, 22 bp, Homo sapiens
atgcagccccctggtgcccggg

SEQ ID NO: 28105 - DNA, 22 bp, Homo sapiens
atggtcacaccactgtactcca

SEQ ID NO: 28106 - DNA, 22 bp, Homo sapiens
accagctagggtagcacatctc

SEQ ID NO: 28107 - DNA, 21 bp, Homo sapiens
cctcaagtgcctcctgctgct

SEQ ID NO: 28108 - DNA, 19 bp, Homo sapiens
gagcagtgaggaccaccag

SEQ ID NO: 28109 - DNA, 22 bp, Homo sapiens
ccttgtttctctcccagataag

SEQ ID NO: 28110 - DNA, 22 bp, Homo sapiens
gagtcggaggcaggagacctgg

SEQ ID NO: 28111 - DNA, 22 bp, Homo sapiens
taatcctgtcttgaccatcagg

SEQ ID NO: 28112 - DNA, 22 bp, Homo sapiens
attgtggactgatcagggctag

SEQ ID NO: 28113 - DNA, 22 bp, Homo sapiens
gggacgacaggctctgtggtag

SEQ ID NO: 28114 - DNA, 22 bp, Homo sapiens
ttgcagttttgacagaccaaat

SEQ ID NO: 28115 - DNA, 22 bp, Homo sapiens
tcaggaggcggaggttgcagtg

SEQ ID NO: 28116 - DNA, 22 bp, Homo sapiens
agattgtcattgacgatgagca

SEQ ID NO: 28117 - DNA, 22 bp, Homo sapiens
ccaggctggagtgcaatggcat

SEQ ID NO: 28118 - DNA, 22 bp, Homo sapiens
tggctccgttgtacaggctgga

SEQ ID NO: 28119 - DNA, 22 bp, Homo sapiens
gccatgggcaaatgcagagctg

SEQ ID NO: 28120 - DNA, 22 bp, Homo sapiens
acagtatagggcttatattgta

SEQ ID NO: 28121 - DNA, 22 bp, Homo sapiens
atgccaataaatgttaatatct

SEQ ID NO: 28122 - DNA, 22 bp, Homo sapiens
caggaggacatactggctcaca

SEQ ID NO: 28123 - DNA, 22 bp, Homo sapiens
actgcaagaatggtaatatttg

SEQ ID NO: 28124 - DNA, 22 bp, Homo sapiens
ttcaaatgatggcagtcctggc

SEQ ID NO: 28125 - DNA, 22 bp, Homo sapiens
cttgaggctgcactccagggcc

SEQ ID NO: 28126 - DNA, 22 bp, Homo sapiens
catccgcatgcaagtgctgtcc

SEQ ID NO: 28127 - DNA, 22 bp, Homo sapiens
acaggcttacaggctgcaagta

SEQ ID NO: 28128 - DNA, 22 bp, Homo sapiens
tgcacgtgtgagcattcacatg

SEQ ID NO: 28129 - DNA, 22 bp, Homo sapiens
gtgggccactgggaggcaaggg

SEQ ID NO: 28130 - DNA, 22 bp, Homo sapiens
tgaaatgtgttctagtgttttg

SEQ ID NO: 28131 - DNA, 22 bp, Homo sapiens
cctcccggatcatgtcccgcac

SEQ ID NO: 28132 - DNA, 22 bp, Homo sapiens
gccatgactctccataccaaag

SEQ ID NO: 28133 - DNA, 22 bp, Homo sapiens
ttactgtttgggtctgaggtca

SEQ ID NO: 28134 - DNA, 22 bp, Homo sapiens
tctgctggaaaaccagggaatt

SEQ ID NO: 28135 - DNA, 22 bp, Homo sapiens
ttccgctgtttagttgaagttt

SEQ ID NO: 28136 - DNA, 23 bp, Homo sapiens
tagatgtattaagtgcattttca

SEQ ID NO: 28137 - DNA, 22 bp, Homo sapiens
ggagggcagagtcccctgctga

SEQ ID NO: 28138 - DNA, 20 bp, Homo sapiens
gagattaactgagaatctag

SEQ ID NO: 28139 - DNA, 22 bp, Homo sapiens
ggctcactgcaacttccgcctc

SEQ ID NO: 28140 - DNA, 22 bp, Homo sapiens
ctccccagccctggtattctga

SEQ ID NO: 28141 - DNA, 22 bp, Homo sapiens
cagcccaggactgcaggtgttt

SEQ ID NO: 28142 - DNA, 22 bp, Homo sapiens
atttctctgcagtgttcggaat

SEQ ID NO: 28143 - DNA, 22 bp, Homo sapiens
tgaggcaggaggattgcaggat

SEQ ID NO: 28144 - DNA, 22 bp, Homo sapiens
tatctatgtgctctgacctctc

SEQ ID NO: 28145 - DNA, 22 bp, Homo sapiens
gagcccaggaagtggaggctga

SEQ ID NO: 28146 - DNA, 22 bp, Homo sapiens
gatagtcacctcccttaacttt

SEQ ID NO: 28147 - DNA, 22 bp, Homo sapiens
ggctgggctccgggagcatgcg

SEQ ID NO: 28148 - DNA, 22 bp, Homo sapiens
gggcaaaacctgggcatcatga

SEQ ID NO: 28149 - DNA, 20 bp, Homo sapiens
tcccccactgtttctgctac

SEQ ID NO: 28150 - DNA, 22 bp, Homo sapiens
gcgggccaccttggagagcgct

SEQ ID NO: 28151 - DNA, 22 bp, Homo sapiens
tttgagatggagtcttgctctg

SEQ ID NO: 28152 - DNA, 22 bp, Homo sapiens
gcttctcgggcctgatgtcgtc

SEQ ID NO: 28153 - DNA, 22 bp, Homo sapiens
gttgaggagcaagcatgtgtct

SEQ ID NO: 28154 - DNA, 22 bp, Homo sapiens
tggagagttctgtagatatcta

SEQ ID NO: 28155 - DNA, 22 bp, Homo sapiens
ccactgtggaaagcagttcaga

SEQ ID NO: 28156 - DNA, 17 bp, Homo sapiens
tctgagaatgctggagg

SEQ ID NO: 28157 - DNA, 22 bp, Homo sapiens
agaaaacataggagacaggaaa

SEQ ID NO: 28158 - DNA, 22 bp, Homo sapiens
tgagcctgagttcaaggctgca

SEQ ID NO: 28159 - DNA, 22 bp, Homo sapiens
tttccagagggtgctcagggcg

SEQ ID NO: 28160 - DNA, 22 bp, Homo sapiens
cagaggtagcatgctgtggctt

SEQ ID NO: 28161 - DNA, 22 bp, Homo sapiens
ccgggttgaggttcccatagat

SEQ ID NO: 28162 - DNA, 22 bp, Homo sapiens
gggactggagtagaggccggtg

SEQ ID NO: 28163 - DNA, 22 bp, Homo sapiens
cctggctcctacgggtattttg

SEQ ID NO: 28164 - DNA, 22 bp, Homo sapiens
gcaaaaagtagtgctggttagg

SEQ ID NO: 28165 - DNA, 22 bp, Homo sapiens
aaaatatgtataactcttctgc

SEQ ID NO: 28166 - DNA, 22 bp, Homo sapiens
aggtggtgtttggttacatgag

SEQ ID NO: 28167 - DNA, 22 bp, Homo sapiens
ggctttgggggtgtccaagaaa

SEQ ID NO: 28168 - DNA, 22 bp, Homo sapiens
gactcgctcccttttgtcttat

SEQ ID NO: 28169 - DNA, 22 bp, Homo sapiens
gttactcttccccggggtctgg

SEQ ID NO: 28170 - DNA, 22 bp, Homo sapiens
ttcactggtcctttataggaac

SEQ ID NO: 28171 - DNA, 22 bp, Homo sapiens
tgcactactgtgatacacagcc

SEQ ID NO: 28172 - DNA, 22 bp, Homo sapiens
gcgccccatctacagtactttt

SEQ ID NO: 28173 - DNA, 22 bp, Homo sapiens
cactgcaacaacctctacctcc

SEQ ID NO: 28174 - DNA, 22 bp, Homo sapiens
gaaagacatagttgcaagatgg

SEQ ID NO: 28175 - DNA, 22 bp, Homo sapiens
tggtacacatgtccaaggtcag

SEQ ID NO: 28176 - DNA, 22 bp, Homo sapiens
atattacacacggtatcacggg

SEQ ID NO: 28177 - DNA, 22 bp, Homo sapiens
cacctgtaatcccagcacttca

SEQ ID NO: 28178 - DNA, 22 bp, Homo sapiens
attctggacaaggcaagctcct

SEQ ID NO: 28179 - DNA, 22 bp, Homo sapiens
tccaggtgacagagacaggata

SEQ ID NO: 28180 - DNA, 22 bp, Homo sapiens
ggttttcacctccagaatgtgc

SEQ ID NO: 28181 - DNA, 22 bp, Homo sapiens
ctttaattgtagctcccataat

SEQ ID NO: 28182 - DNA, 22 bp, Homo sapiens
gtgaagttggccagtttagttt

SEQ ID NO: 28183 - DNA, 22 bp, Homo sapiens
cagtcacaagcgtacctaattt

SEQ ID NO: 28184 - DNA, 22 bp, Homo sapiens
ccctgctgtcaggtgctgggag

SEQ ID NO: 28185 - DNA, 22 bp, Homo sapiens
agcgggtctgcaagccttccct

SEQ ID NO: 28186 - DNA, 22 bp, Homo sapiens
gcagtggcatgatgtgggctca

SEQ ID NO: 28187 - DNA, 20 bp, Homo sapiens
cagcctgcatcatctgcagc

SEQ ID NO: 28188 - DNA, 21 bp, Homo sapiens
tccctgagcccaaggggctcc

SEQ ID NO: 28189 - DNA, 22 bp, Homo sapiens
gacctcgtgatccgccctcctt

SEQ ID NO: 28190 - DNA, 22 bp, Homo sapiens
aaggagtctgggccattcagag

SEQ ID NO: 28191 - DNA, 22 bp, Homo sapiens
aagcccttggcgcacaccgggc

SEQ ID NO: 28192 - DNA, 22 bp, Homo sapiens
ggtcccaggttgacagggagac

SEQ ID NO: 28193 - DNA, 22 bp, Homo sapiens
ctcagatctttcccattttccc

SEQ ID NO: 28194 - DNA, 22 bp, Homo sapiens
aacttggctaccagcgttaaat

SEQ ID NO: 28195 - DNA, 22 bp, Homo sapiens
cagcctggtccccggctcaccc

SEQ ID NO: 28196 - DNA, 22 bp, Homo sapiens
aagtcacttcttaggaaaggag

SEQ ID NO: 28197 - DNA, 22 bp, Homo sapiens
tggttttagggaatcaatctat

SEQ ID NO: 28198 - DNA, 22 bp, Homo sapiens
cccaagaggtggaggttgcagt

SEQ ID NO: 28199 - DNA, 22 bp, Homo sapiens
tcccgtaggttgctgtagtcgg

SEQ ID NO: 28200 - DNA, 22 bp, Homo sapiens
catcccttcccccgagcatggc

SEQ ID NO: 28201 - DNA, 20 bp, Homo sapiens
tttgaatgtaaagcatgtca

SEQ ID NO: 28202 - DNA, 20 bp, Homo sapiens
gacatgtctttctcacacaa

SEQ ID NO: 28203 - DNA, 22 bp, Homo sapiens
tggctacctgatttcttttcag

SEQ ID NO: 28204 - DNA, 22 bp, Homo sapiens
gccgggtgcagcgggcccgcca

SEQ ID NO: 28205 - DNA, 22 bp, Homo sapiens
tcttttgtgattcttcagttac

SEQ ID NO: 28206 - DNA, 22 bp, Homo sapiens
ttagattttaagaagggaggta

SEQ ID NO: 28207 - DNA, 22 bp, Homo sapiens
ttgtgaatagtgctgcagtaaa

SEQ ID NO: 28208 - DNA, 22 bp, Homo sapiens
ccaaagtgctgggattacaggc

SEQ ID NO: 28209 - DNA, 22 bp, Homo sapiens
agttggagtgaacatgagattg

SEQ ID NO: 28210 - DNA, 22 bp, Homo sapiens
atacagggacatccagtttttc

SEQ ID NO: 28211 - DNA, 22 bp, Homo sapiens
ttaggcctttgattggggtgct

SEQ ID NO: 28212 - DNA, 22 bp, Homo sapiens
attgcccttgtcaggcacgggt

SEQ ID NO: 28213 - DNA, 22 bp, Homo sapiens
ggcaaaaaccataattactttt

SEQ ID NO: 28214 - DNA, 22 bp, Homo sapiens
tgcccaggctggagtgcagtgg

SEQ ID NO: 28215 - DNA, 22 bp, Homo sapiens
tgtgacctcatcttaactggaa

SEQ ID NO: 28216 - DNA, 22 bp, Homo sapiens
aagtgattgttccgttgagtgt

SEQ ID NO: 28217 - DNA, 22 bp, Homo sapiens
agagctaagaaacagaattgct

SEQ ID NO: 28218 - DNA, 22 bp, Homo sapiens
cgcgctctccttctggcaccca

SEQ ID NO: 28219 - DNA, 22 bp, Homo sapiens
tgcaataactactttaatgttg

SEQ ID NO: 28220 - DNA, 22 bp, Homo sapiens
ttttaggattcacatggattca

SEQ ID NO: 28221 - DNA, 22 bp, Homo sapiens
gctgcagacttctcatctcatt

SEQ ID NO: 28222 - DNA, 22 bp, Homo sapiens
cttcactttaagccaatcatga

SEQ ID NO: 28223 - DNA, 22 bp, Homo sapiens
actcaaatagcaacggtgagaa

SEQ ID NO: 28224 - DNA, 22 bp, Homo sapiens
agaggtgagtcattacctagtg

SEQ ID NO: 28225 - DNA, 22 bp, Homo sapiens
acctcctggcctcaagcaatcc

SEQ ID NO: 28226 - DNA, 22 bp, Homo sapiens
cacccaggctggattgcagtgg

SEQ ID NO: 28227 - DNA, 22 bp, Homo sapiens
ttgtgttaaggtgcatctagtg

SEQ ID NO: 28228 - DNA, 22 bp, Homo sapiens
ggccttggttccaaagcaggca

SEQ ID NO: 28229 - DNA, 22 bp, Homo sapiens
tcagacaactctggaggctggc

SEQ ID NO: 28230 - DNA, 22 bp, Homo sapiens
tctggcttcgcagctcccagcc

SEQ ID NO: 28231 - DNA, 20 bp, Homo sapiens
gccaacgcgctggggctgcc

SEQ ID NO: 28232 - DNA, 19 bp, Homo sapiens
agaaccactgctctcttca

SEQ ID NO: 28233 - DNA, 22 bp, Homo sapiens
ctgatcccaggcactgtcgcaa

SEQ ID NO: 28234 - DNA, 22 bp, Homo sapiens
ctgggcctggggctgttgagag

SEQ ID NO: 28235 - DNA, 22 bp, Homo sapiens
attgcaggctctgacaccaggc

SEQ ID NO: 28236 - DNA, 22 bp, Homo sapiens
tagaggccgaatgctgagctgg

SEQ ID NO: 28237 - DNA, 22 bp, Homo sapiens
agttcgagatctgctgatgaga

SEQ ID NO: 28238 - DNA, 22 bp, Homo sapiens
agaacactgatagctgagggga

SEQ ID NO: 28239 - DNA, 22 bp, Homo sapiens
tagattcagatatttaggacaa

SEQ ID NO: 28240 - DNA, 22 bp, Homo sapiens
acatatgcgatcataggatgca

SEQ ID NO: 28241 - DNA, 22 bp, Homo sapiens
acagcagagcctggtacttact

SEQ ID NO: 28242 - DNA, 22 bp, Homo sapiens
cttgatctacatagtgaaaccc

SEQ ID NO: 28243 - DNA, 22 bp, Homo sapiens
acagcacttgggttttcctgtt

SEQ ID NO: 28244 - DNA, 22 bp, Homo sapiens
gagatatgttggcagctggtat

SEQ ID NO: 28245 - DNA, 20 bp, Homo sapiens
agacagtgtggagattcctt

SEQ ID NO: 28246 - DNA, 22 bp, Homo sapiens
taatgcacatagaagtacttag

SEQ ID NO: 28247 - DNA, 22 bp, Homo sapiens
tgccctctttctgtacagctcc

SEQ ID NO: 28248 - DNA, 22 bp, Homo sapiens
tcttaattctgtgtcttcacta

SEQ ID NO: 28249 - DNA, 22 bp, Homo sapiens
ttaggtattttgttatgtcagc

SEQ ID NO: 28250 - DNA, 22 bp, Homo sapiens
gagtggctattgatccgtgatg

SEQ ID NO: 28251 - DNA, 22 bp, Homo sapiens
ctgagctcaagcgatcctccca

SEQ ID NO: 28252 - DNA, 22 bp, Homo sapiens
tcccccaggctggagtgcagtg

SEQ ID NO: 28253 - DNA, 22 bp, Homo sapiens
gaggggagcccccatcctccag

SEQ ID NO: 28254 - DNA, 22 bp, Homo sapiens
ttggaatgcacactgagcctgc

SEQ ID NO: 28255 - DNA, 22 bp, Homo sapiens
tgacagaactcattctcaccaa

SEQ ID NO: 28256 - DNA, 22 bp, Homo sapiens
aagccgggcctgagaaatgaca

SEQ ID NO: 28257 - DNA, 22 bp, Homo sapiens
gctgggacaacaggtgagcacc

SEQ ID NO: 28258 - DNA, 22 bp, Homo sapiens
ttcaccagacctgtgagcttcc

SEQ ID NO: 28259 - DNA, 22 bp, Homo sapiens
gttgagtgggttaggatgctga

SEQ ID NO: 28260 - DNA, 18 bp, Homo sapiens
ggagactaaactgttgac

SEQ ID NO: 28261 - DNA, 22 bp, Homo sapiens
aggaatgacaggcctcccgcag

SEQ ID NO: 28262 - DNA, 22 bp, Homo sapiens
ggttcagggctaccagtgggtg

SEQ ID NO: 28263 - DNA, 22 bp, Homo sapiens
ccagcatccatgctccctcggg

SEQ ID NO: 28264 - DNA, 22 bp, Homo sapiens
tgatcaggtctgaacagggagg

SEQ ID NO: 28265 - DNA, 23 bp, Homo sapiens
agctataaaatctgtgacagcag

SEQ ID NO: 28266 - DNA, 22 bp, Homo sapiens
atctgggaatggaagccttctg

SEQ ID NO: 28267 - DNA, 22 bp, Homo sapiens
ggtttgtggagctggaaacact

SEQ ID NO: 28268 - DNA, 22 bp, Homo sapiens
caattgtcagtgctgtttaaat

SEQ ID NO: 28269 - DNA, 22 bp, Homo sapiens
ccctgtgggaactcctgagttg

SEQ ID NO: 28270 - DNA, 22 bp, Homo sapiens
tctgaaaactccatgagctcgt

SEQ ID NO: 28271 - DNA, 22 bp, Homo sapiens
cttggggcagcccaggctgagc

SEQ ID NO: 28272 - DNA, 22 bp, Homo sapiens
cccattcttcatacaagtctaa

SEQ ID NO: 28273 - DNA, 22 bp, Homo sapiens
tttcaacagatctgtcttcagg

SEQ ID NO: 28274 - DNA, 22 bp, Homo sapiens
tcagtgcagggtgggagagaga

SEQ ID NO: 28275 - DNA, 22 bp, Homo sapiens
ctgcatgtttacatttttgaga

SEQ ID NO: 28276 - DNA, 22 bp, Homo sapiens
cgtaggtggctcagcacctggg

SEQ ID NO: 28277 - DNA, 22 bp, Homo sapiens
tccacagtggttgaactagttt

SEQ ID NO: 28278 - DNA, 22 bp, Homo sapiens
ctccaacgaggctggggtacaa

SEQ ID NO: 28279 - DNA, 22 bp, Homo sapiens
aagcccggttgggaacgtggtg

SEQ ID NO: 28280 - DNA, 22 bp, Homo sapiens
tcctgggatcaagtgatcctcc

SEQ ID NO: 28281 - DNA, 22 bp, Homo sapiens
tcactttaagcgggaggcagag

SEQ ID NO: 28282 - DNA, 23 bp, Homo sapiens
gacattggctgtctgatgcaggg

SEQ ID NO: 28283 - DNA, 22 bp, Homo sapiens
ggctcagatggtttgttctaga

SEQ ID NO: 28284 - DNA, 22 bp, Homo sapiens
aaggaaagctgtggttctgaga

SEQ ID NO: 28285 - DNA, 22 bp, Homo sapiens
tggcgcgacgtgccccctgctt

SEQ ID NO: 28286 - DNA, 22 bp, Homo sapiens
gccctagcgccagctcagcacc

SEQ ID NO: 28287 - DNA, 22 bp, Homo sapiens
gccagtggtcactgaggaagaa

SEQ ID NO: 28288 - DNA, 22 bp, Homo sapiens
ccgcaaggcagaggttgcagtg

SEQ ID NO: 28289 - DNA, 22 bp, Homo sapiens
gaaagagaacctgggcctagat

SEQ ID NO: 28290 - DNA, 22 bp, Homo sapiens
cagtggcgtgatctctgctcac

SEQ ID NO: 28291 - DNA, 22 bp, Homo sapiens
aaaacgatgtttaaaagctctg

SEQ ID NO: 28292 - DNA, 21 bp, Homo sapiens
ccagagcctgagaggattatg

SEQ ID NO: 28293 - DNA, 22 bp, Homo sapiens
tcacttgaacctgggaggcaga

SEQ ID NO: 28294 - DNA, 22 bp, Homo sapiens
gcgagtgccgagagggcagggc

SEQ ID NO: 28295 - DNA, 22 bp, Homo sapiens
ggcagccccatcagagacgctg

SEQ ID NO: 28296 - DNA, 22 bp, Homo sapiens
tttcagaacataatgtgagcat

SEQ ID NO: 28297 - DNA, 22 bp, Homo sapiens
tttgaaatgtatcagtataggt

SEQ ID NO: 28298 - DNA, 22 bp, Homo sapiens
agtgctgtctccttcccccggg

SEQ ID NO: 28299 - DNA, 22 bp, Homo sapiens
gaggggtccaggaggcacttac

SEQ ID NO: 28300 - DNA, 22 bp, Homo sapiens
ttgtgaatagtgccgcaataaa

SEQ ID NO: 28301 - DNA, 22 bp, Homo sapiens
gttgcctaggctggtcttgaac

SEQ ID NO: 28302 - DNA, 22 bp, Homo sapiens
ccagggatgcagaggttgcagt

SEQ ID NO: 28303 - DNA, 22 bp, Homo sapiens
tgaaatgattatatggtgtttg

SEQ ID NO: 28304 - DNA, 22 bp, Homo sapiens
gtgttaaccagctaaactttgc

SEQ ID NO: 28305 - DNA, 22 bp, Homo sapiens
tcaaattgtcatcttgataatg

SEQ ID NO: 28306 - DNA, 22 bp, Homo sapiens
aagaagcattctttcattggtt

SEQ ID NO: 28307 - DNA, 22 bp, Homo sapiens
tggggcatgtgaacctggatgt

SEQ ID NO: 28308 - DNA, 19 bp, Homo sapiens
ggggcctgtgatggtcaca

SEQ ID NO: 28309 - DNA, 22 bp, Homo sapiens
atgtacataaaatgtataatga

SEQ ID NO: 28310 - DNA, 20 bp, Homo sapiens
agatacagtggtttctttag

SEQ ID NO: 28311 - DNA, 22 bp, Homo sapiens
gctcttgtcaaaaattagttga

SEQ ID NO: 28312 - DNA, 22 bp, Homo sapiens
atggcctgcagtgctgccacag

SEQ ID NO: 28313 - DNA, 22 bp, Homo sapiens
cgctgcgaggcgcccttgttgc

SEQ ID NO: 28314 - DNA, 22 bp, Homo sapiens
ggctcttccgccaccagccaca

SEQ ID NO: 28315 - DNA, 22 bp, Homo sapiens
tgcaatctcggcactttgggag

SEQ ID NO: 28316 - DNA, 22 bp, Homo sapiens
agcgaggtgagtcctccagctc

SEQ ID NO: 28317 - DNA, 22 bp, Homo sapiens
tttctataaaaagtgctaggat

SEQ ID NO: 28318 - DNA, 19 bp, Homo sapiens
taccatccaagctggtttg

SEQ ID NO: 28319 - DNA, 22 bp, Homo sapiens
agacggattacctgaggtcagg

SEQ ID NO: 28320 - DNA, 22 bp, Homo sapiens
ctggggaacgcagcgagcagcg

SEQ ID NO: 28321 - DNA, 22 bp, Homo sapiens
catgtaaagaatttcacacaag

SEQ ID NO: 28322 - DNA, 22 bp, Homo sapiens
aggaggggttctcgggtgctga

SEQ ID NO: 28323 - DNA, 22 bp, Homo sapiens
cctggcaggtggcgccctcggc

SEQ ID NO: 28324 - DNA, 22 bp, Homo sapiens
aaggtcatggcaaattactttt

SEQ ID NO: 28325 - DNA, 22 bp, Homo sapiens
gcggcccgagcaggacgggtgg

SEQ ID NO: 28326 - DNA, 22 bp, Homo sapiens
ctgcttctccctgagatagtgt

SEQ ID NO: 28327 - DNA, 19 bp, Homo sapiens
gggtcccaaaagatgtgct

SEQ ID NO: 28328 - DNA, 22 bp, Homo sapiens
cagtcaccttgaggactcagac

SEQ ID NO: 28329 - DNA, 22 bp, Homo sapiens
aacagtgtttttcttcagcact

SEQ ID NO: 28330 - DNA, 22 bp, Homo sapiens
ccttgctcaagctagtgacggg

SEQ ID NO: 28331 - DNA, 22 bp, Homo sapiens
aggacttagaacattatgtact

SEQ ID NO: 28332 - DNA, 22 bp, Homo sapiens
tcacgtgagggacctgtgtctg

SEQ ID NO: 28333 - DNA, 22 bp, Homo sapiens
ccctctctgctgcatagaggaa

SEQ ID NO: 28334 - DNA, 22 bp, Homo sapiens
gaagtattactctgaatgtatt

SEQ ID NO: 28335 - DNA, 22 bp, Homo sapiens
gccctgggcaaggttctggcca

SEQ ID NO: 28336 - DNA, 20 bp, Homo sapiens
tgctggaaattgttctagga

SEQ ID NO: 28337 - DNA, 22 bp, Homo sapiens
atggggggatgaaggagtccaa

SEQ ID NO: 28338 - DNA, 22 bp, Homo sapiens
ggctggtgttgagtgcctgtag

SEQ ID NO: 28339 - DNA, 22 bp, Homo sapiens
tgaatatgtgactttgatttca

SEQ ID NO: 28340 - DNA, 22 bp, Homo sapiens
tagctcaaaggttaagtgtgga

SEQ ID NO: 28341 - DNA, 22 bp, Homo sapiens
tggcaccagggaacaagcattt

SEQ ID NO: 28342 - DNA, 22 bp, Homo sapiens
gccagagttgaggcagtttatt

SEQ ID NO: 28343 - DNA, 22 bp, Homo sapiens
gtgtgacctcatcttaactgga

SEQ ID NO: 28344 - DNA, 22 bp, Homo sapiens
aaagcagaggttgcagtgagct

SEQ ID NO: 28345 - DNA, 22 bp, Homo sapiens
aggaaataagggacaagacaaa

SEQ ID NO: 28346 - DNA, 22 bp, Homo sapiens
ggcgggcagcgtcttgctggcc

SEQ ID NO: 28347 - DNA, 22 bp, Homo sapiens
gtgagtaaaggttcattgaatt

SEQ ID NO: 28348 - DNA, 22 bp, Homo sapiens
ctgcactgagcatctaacctta

SEQ ID NO: 28349 - DNA, 22 bp, Homo sapiens
tattgtgaataatgccgcaata

SEQ ID NO: 28350 - DNA, 22 bp, Homo sapiens
taggcaagtggaccagaggttt

SEQ ID NO: 28351 - DNA, 22 bp, Homo sapiens
accctcaacaaattcactctat

SEQ ID NO: 28352 - DNA, 17 bp, Homo sapiens
tgggatccgtctctgtg

SEQ ID NO: 28353 - DNA, 20 bp, Homo sapiens
agtaggtgtccttcaggata

SEQ ID NO: 28354 - DNA, 22 bp, Homo sapiens
tcttgggcatgtgtttgatttc

SEQ ID NO: 28355 - DNA, 22 bp, Homo sapiens
tccacagtggttgaactagtaa

SEQ ID NO: 28356 - DNA, 22 bp, Homo sapiens
ataagattgtcatagtatggac

SEQ ID NO: 28357 - DNA, 22 bp, Homo sapiens
gtgacacccgcatgccactgtg

SEQ ID NO: 28358 - DNA, 22 bp, Homo sapiens
gaggcctcatgaggtgagcatt

SEQ ID NO: 28359 - DNA, 22 bp, Homo sapiens
ctcgtgatccgcccacctcagc

SEQ ID NO: 28360 - DNA, 22 bp, Homo sapiens
ttgggctgcagcaattattagt

SEQ ID NO: 28361 - DNA, 22 bp, Homo sapiens
ttttatctgtgacatctggcag

SEQ ID NO: 28362 - DNA, 22 bp, Homo sapiens
tgcctgtggaaaggctggtgct

SEQ ID NO: 28363 - DNA, 22 bp, Homo sapiens
tcccagaaccctgccaggtcct

SEQ ID NO: 28364 - DNA, 22 bp, Homo sapiens
gagcactgatttatttttgtct

SEQ ID NO: 28365 - DNA, 22 bp, Homo sapiens
tccagtatcaaagtcctagtcc

SEQ ID NO: 28366 - DNA, 22 bp, Homo sapiens
gtgacaatattagctcaggggc

SEQ ID NO: 28367 - DNA, 22 bp, Homo sapiens
tccttgcagggtttgataaaga

SEQ ID NO: 28368 - DNA, 22 bp, Homo sapiens
tgcaccactgcactccagcctg

SEQ ID NO: 28369 - DNA, 22 bp, Homo sapiens
tcactacctgacaatacagtat

SEQ ID NO: 28370 - DNA, 22 bp, Homo sapiens
gcagctattgtctcctgggccc

SEQ ID NO: 28371 - DNA, 22 bp, Homo sapiens
tgaccacattgatttctcatcc

SEQ ID NO: 28372 - DNA, 22 bp, Homo sapiens
agagctccagggttttgtagtg

SEQ ID NO: 28373 - DNA, 22 bp, Homo sapiens
ctgtccctgagcaactcctgtt

SEQ ID NO: 28374 - DNA, 22 bp, Homo sapiens
ctgtgaagggacggatgctgct

SEQ ID NO: 28375 - DNA, 22 bp, Homo sapiens
cactgcaatatctgcatcctgg

SEQ ID NO: 28376 - DNA, 22 bp, Homo sapiens
tttcctcttctggcaggcaggg

SEQ ID NO: 28377 - DNA, 22 bp, Homo sapiens
cgcccaggctggagagcagtgg

SEQ ID NO: 28378 - DNA, 22 bp, Homo sapiens
gagatttccatattttgtaaca

SEQ ID NO: 28379 - DNA, 22 bp, Homo sapiens
gctccccaaaagctccaggaaa

SEQ ID NO: 28380 - DNA, 21 bp, Homo sapiens
acgggaatgaacatggtggag

SEQ ID NO: 28381 - DNA, 18 bp, Homo sapiens
agctccatctgtcagcat

SEQ ID NO: 28382 - DNA, 22 bp, Homo sapiens
atgctaaggcccaggagaaaat

SEQ ID NO: 28383 - DNA, 22 bp, Homo sapiens
gcaaaagtacagccggatttct

SEQ ID NO: 28384 - DNA, 22 bp, Homo sapiens
attgcactccggcctgggtgac

SEQ ID NO: 28385 - DNA, 23 bp, Homo sapiens
tcgttgaatagcaatagcacaac

SEQ ID NO: 28386 - DNA, 17 bp, Homo sapiens
gaggccaaggcaggcgg

SEQ ID NO: 28387 - DNA, 22 bp, Homo sapiens
aaaagcaattgcagttcttgcc

SEQ ID NO: 28388 - DNA, 22 bp, Homo sapiens
tttgtggcaggagcggagaccg

SEQ ID NO: 28389 - DNA, 22 bp, Homo sapiens
atgtatatgcatgcattcaaag

SEQ ID NO: 28390 - DNA, 22 bp, Homo sapiens
tcctttaaacaaccagctctca

SEQ ID NO: 28391 - DNA, 22 bp, Homo sapiens
gcatctaaataaacgtgggagt

SEQ ID NO: 28392 - DNA, 22 bp, Homo sapiens
ctcttagtaatgccatgaagca

SEQ ID NO: 28393 - DNA, 22 bp, Homo sapiens
ttatttaaaagtggtaagattc

SEQ ID NO: 28394 - DNA, 22 bp, Homo sapiens
cccatgaggtggaggttgcagt

SEQ ID NO: 28395 - DNA, 22 bp, Homo sapiens
atatatttgagaatattcatga

SEQ ID NO: 28396 - DNA, 22 bp, Homo sapiens
tccatgaggaccaaattcgtag

SEQ ID NO: 28397 - DNA, 22 bp, Homo sapiens
tcgagctctggagccaaggatg

SEQ ID NO: 28398 - DNA, 18 bp, Homo sapiens
tcttccaacactgacacc

SEQ ID NO: 28399 - DNA, 20 bp, Homo sapiens
tttctgtgagaaacactgtt

SEQ ID NO: 28400 - DNA, 22 bp, Homo sapiens
ttctcttttcaccagttgctaa

SEQ ID NO: 28401 - DNA, 22 bp, Homo sapiens
agttattactctttaacatatt

SEQ ID NO: 28402 - DNA, 22 bp, Homo sapiens
caaatgtataaatgtactttct

SEQ ID NO: 28403 - DNA, 22 bp, Homo sapiens
ggcttggaccagtcacagtggt

SEQ ID NO: 28404 - DNA, 22 bp, Homo sapiens
ctagcctgggatttgaacttat

SEQ ID NO: 28405 - DNA, 22 bp, Homo sapiens
ttctgtgaatcttttttcccac

SEQ ID NO: 28406 - DNA, 20 bp, Homo sapiens
ctgtggaattttaccatgcg

SEQ ID NO: 28407 - DNA, 22 bp, Homo sapiens
cttctcaaagttgtgaatcagg

SEQ ID NO: 28408 - DNA, 22 bp, Homo sapiens
gtcccataagtagtgcaacttg

SEQ ID NO: 28409 - DNA, 22 bp, Homo sapiens
gtctatatattgcttgaataat

SEQ ID NO: 28410 - DNA, 23 bp, Homo sapiens
ccactagcacctgttcaacttct

SEQ ID NO: 28411 - DNA, 22 bp, Homo sapiens
ttatgatttgccacagattggt

SEQ ID NO: 28412 - DNA, 22 bp, Homo sapiens
gtcactgtatccaggttccagc

SEQ ID NO: 28413 - DNA, 22 bp, Homo sapiens
ggatgttgattgaatggccatt

SEQ ID NO: 28414 - DNA, 22 bp, Homo sapiens
ttatttaatgtgatctgaagag

SEQ ID NO: 28415 - DNA, 22 bp, Homo sapiens
ctggctgggagcgagctgctca

SEQ ID NO: 28416 - DNA, 22 bp, Homo sapiens
catataaatacaacatgtgtta

SEQ ID NO: 28417 - DNA, 22 bp, Homo sapiens
acaagcatgggctttgacatca

SEQ ID NO: 28418 - DNA, 22 bp, Homo sapiens
ttaaatattatgttgtctgcaa

SEQ ID NO: 28419 - DNA, 22 bp, Homo sapiens
ttcttcagcctaccttgacctc

SEQ ID NO: 28420 - DNA, 22 bp, Homo sapiens
tgagatgtaaggtatgcttact

SEQ ID NO: 28421 - DNA, 20 bp, Homo sapiens
ataaaataactgccacaaga

SEQ ID NO: 28422 - DNA, 22 bp, Homo sapiens
acttcttcttcagctgggggat

SEQ ID NO: 28423 - DNA, 20 bp, Homo sapiens
ttgagcttttagtacagaca

SEQ ID NO: 28424 - DNA, 22 bp, Homo sapiens
taatatctacttcatagagttt

SEQ ID NO: 28425 - DNA, 22 bp, Homo sapiens
agggcgacaatggagagcgttt

SEQ ID NO: 28426 - DNA, 22 bp, Homo sapiens
tcagggctgcagaagaggcagg

SEQ ID NO: 28427 - DNA, 23 bp, Homo sapiens
ggctgggagctccgggtgcacgt

SEQ ID NO: 28428 - DNA, 22 bp, Homo sapiens
aaccaccattctctcctcttcc

SEQ ID NO: 28429 - DNA, 22 bp, Homo sapiens
aggagcagaccgtagtcctgca

SEQ ID NO: 28430 - DNA, 22 bp, Homo sapiens
ggggcattgtgtctgggttcct

SEQ ID NO: 28431 - DNA, 22 bp, Homo sapiens
ctgaggcctctcccactccagc

SEQ ID NO: 28432 - DNA, 22 bp, Homo sapiens
ctcttagtaatgccatgaagca

SEQ ID NO: 28433 - DNA, 22 bp, Homo sapiens
ggccaggcgatgacccctccac

SEQ ID NO: 28434 - DNA, 22 bp, Homo sapiens
ccctctctgctgcatagaggaa

SEQ ID NO: 28435 - DNA, 20 bp, Homo sapiens
ctcttccggaggggcgctcc

SEQ ID NO: 28436 - DNA, 19 bp, Homo sapiens
ctgctgccggagactcgtc

SEQ ID NO: 28437 - DNA, 22 bp, Homo sapiens
cttgtcagccaattgtggattt

SEQ ID NO: 28438 - DNA, 22 bp, Homo sapiens
cagcctggtccccggctcaccc

SEQ ID NO: 28439 - DNA, 22 bp, Homo sapiens
cggctggtgtcgggcacagcaa

SEQ ID NO: 28440 - DNA, 22 bp, Homo sapiens
tcctgggaggcggaggttgcag

SEQ ID NO: 28441 - DNA, 22 bp, Homo sapiens
aaggccttgccgaaggatgcca

SEQ ID NO: 28442 - DNA, 22 bp, Homo sapiens
gggctgggattgcttgctgtga

SEQ ID NO: 28443 - DNA, 22 bp, Homo sapiens
tgcccagggtggagtgcagtgg

SEQ ID NO: 28444 - DNA, 22 bp, Homo sapiens
aacccaggagttggaggctgtg

SEQ ID NO: 28445 - DNA, 22 bp, Homo sapiens
ccagagctgattcctgggactt

SEQ ID NO: 28446 - DNA, 22 bp, Homo sapiens
ggctgggcctctccctcagctg

SEQ ID NO: 28447 - DNA, 22 bp, Homo sapiens
ggcctggcagagcgcgcggctg

SEQ ID NO: 28448 - DNA, 22 bp, Homo sapiens
cagccctcctaccctgccaggc

SEQ ID NO: 28449 - DNA, 22 bp, Homo sapiens
gccgtgtcatctgcgggtggca

SEQ ID NO: 28450 - DNA, 22 bp, Homo sapiens
ctcctctttagccccagctgga

SEQ ID NO: 28451 - DNA, 22 bp, Homo sapiens
aagaggttgtctgtgatgagtt

SEQ ID NO: 28452 - DNA, 22 bp, Homo sapiens
accacccagccagcttctccct

SEQ ID NO: 28453 - DNA, 22 bp, Homo sapiens
ggcagagcttgcagtgagccga

SEQ ID NO: 28454 - DNA, 22 bp, Homo sapiens
gcctggccaacgtggtgaaacc

SEQ ID NO: 28455 - DNA, 22 bp, Homo sapiens
agcctctcagagtgctgggatt

SEQ ID NO: 28456 - DNA, 22 bp, Homo sapiens
tgaggcaggagttcaggctgcg

SEQ ID NO: 28457 - DNA, 22 bp, Homo sapiens
cgtgattggcttctgcattgga

SEQ ID NO: 28458 - DNA, 22 bp, Homo sapiens
cacccaggcaaggattctgcaa

SEQ ID NO: 28459 - DNA, 22 bp, Homo sapiens
ggtgacagtggttaaaatttgt

SEQ ID NO: 28460 - DNA, 20 bp, Homo sapiens
ccagagctgatggctgcccg

SEQ ID NO: 28461 - DNA, 23 bp, Homo sapiens
tgaggcaggcggatcacgaggtc

SEQ ID NO: 28462 - DNA, 22 bp, Homo sapiens
gggcctgtgtgttcaggagcct

SEQ ID NO: 28463 - DNA, 21 bp, Homo sapiens
ggcctcccggaccgcagcgcc

SEQ ID NO: 28464 - DNA, 22 bp, Homo sapiens
cttgaggctgcactccagggcc

SEQ ID NO: 28465 - DNA, 22 bp, Homo sapiens
gagccaggtcgggccgcggcga

SEQ ID NO: 28466 - DNA, 22 bp, Homo sapiens
aggaaggcttctttggtcttct

SEQ ID NO: 28467 - DNA, 22 bp, Homo sapiens
tgcctccctggcaagtctctcc

SEQ ID NO: 28468 - DNA, 22 bp, Homo sapiens
gagccaggttggaggctgcagt

SEQ ID NO: 28469 - DNA, 22 bp, Homo sapiens
tgagagcctgtgttcaaatgcc

SEQ ID NO: 28470 - DNA, 22 bp, Homo sapiens
cgccaggcttggtagctcatgc

SEQ ID NO: 28471 - DNA, 22 bp, Homo sapiens
tactgtgtgcccagccgagctg

SEQ ID NO: 28472 - DNA, 22 bp, Homo sapiens
ctcccggctgctccggctcccg

SEQ ID NO: 28473 - DNA, 23 bp, Homo sapiens
gcctgggagttgcgatctgcccg

SEQ ID NO: 28474 - DNA, 22 bp, Homo sapiens
gggtacagttcttccagtgtca

SEQ ID NO: 28475 - DNA, 22 bp, Homo sapiens
tgcccaggctggagtgcagtgg

SEQ ID NO: 28476 - DNA, 22 bp, Homo sapiens
aggattgtgcctccagtcagaa

SEQ ID NO: 28477 - DNA, 22 bp, Homo sapiens
gccagggtcctgaagaccaagt

SEQ ID NO: 28478 - DNA, 19 bp, Homo sapiens
caggcctcttaccctctct

SEQ ID NO: 28479 - DNA, 22 bp, Homo sapiens
cccaggaggtcgaagctgcagt

SEQ ID NO: 28480 - DNA, 22 bp, Homo sapiens
cctgtctctgcagggccctgcc

SEQ ID NO: 28481 - DNA, 22 bp, Homo sapiens
agggccagcactcctggcagga

SEQ ID NO: 28482 - DNA, 22 bp, Homo sapiens
ggagaagaggagctggaagcct

SEQ ID NO: 28483 - DNA, 22 bp, Homo sapiens
tgggaacagaggacttgactgt

SEQ ID NO: 28484 - DNA, 22 bp, Homo sapiens
cccagagcatgtgctgcctttg

SEQ ID NO: 28485 - DNA, 22 bp, Homo sapiens
gagccaggggtcagctccgagg

SEQ ID NO: 28486 - DNA, 22 bp, Homo sapiens
cccaggaggcagaagttgcagt

SEQ ID NO: 28487 - DNA, 22 bp, Homo sapiens
tcagtgtgaattcaggagccta

SEQ ID NO: 28488 - DNA, 22 bp, Homo sapiens
ctgtcctggggaaagccagccc

SEQ ID NO: 28489 - DNA, 22 bp, Homo sapiens
tgaggcaggaggattgcaggat

SEQ ID NO: 28490 - DNA, 18 bp, Homo sapiens
taggttacagccagccag

SEQ ID NO: 28491 - DNA, 22 bp, Homo sapiens
tctctcttttttgaacccgctc

SEQ ID NO: 28492 - DNA, 22 bp, Homo sapiens
aggagccagtggagttcctgcc

SEQ ID NO: 28493 - DNA, 22 bp, Homo sapiens
gcctccagcccacgcaggcctg

SEQ ID NO: 28494 - DNA, 22 bp, Homo sapiens
ccagaccctccattcaagctcc

SEQ ID NO: 28495 - DNA, 22 bp, Homo sapiens
ctgggcagctgtatcagggagt

SEQ ID NO: 28496 - DNA, 22 bp, Homo sapiens
tctgaggctgaatggactccgt

SEQ ID NO: 28497 - DNA, 22 bp, Homo sapiens
gagcccaggaagtggaggctga

SEQ ID NO: 28498 - DNA, 22 bp, Homo sapiens
cgggagcctctgggtcacactg

SEQ ID NO: 28499 - DNA, 22 bp, Homo sapiens
gggagctggagctggaagactc

SEQ ID NO: 28500 - DNA, 22 bp, Homo sapiens
gcccagtggtaaaagcaggcct

SEQ ID NO: 28501 - DNA, 22 bp, Homo sapiens
cctgaccaacgtggtgaaaccc

SEQ ID NO: 28502 - DNA, 22 bp, Homo sapiens
tgcctccaacagcccatcctag

SEQ ID NO: 28503 - DNA, 22 bp, Homo sapiens
gaagccttgaactgcaaacccc

SEQ ID NO: 28504 - DNA, 22 bp, Homo sapiens
gcctgtcccgcaccggagcccg

SEQ ID NO: 28505 - DNA, 18 bp, Homo sapiens
atggtctcatactgggag

SEQ ID NO: 28506 - DNA, 23 bp, Homo sapiens
agcagccagagatcctcggccct

SEQ ID NO: 28507 - DNA, 22 bp, Homo sapiens
tgtgtcagaaggcaatggggat

SEQ ID NO: 28508 - DNA, 22 bp, Homo sapiens
agatttatgtggtcacactcag

SEQ ID NO: 28509 - DNA, 22 bp, Homo sapiens
ggcctgggctccgggagttact

SEQ ID NO: 28510 - DNA, 22 bp, Homo sapiens
agggctggagccacagctggga

SEQ ID NO: 28511 - DNA, 23 bp, Homo sapiens
cagagctggctcagagctgcctg

SEQ ID NO: 28512 - DNA, 22 bp, Homo sapiens
aatggctctgatgttgttgtga

SEQ ID NO: 28513 - DNA, 22 bp, Homo sapiens
tggagccagagcgcagcctggg

SEQ ID NO: 28514 - DNA, 22 bp, Homo sapiens
tgcctaggctggagtgtagtgg

SEQ ID NO: 28515 - DNA, 22 bp, Homo sapiens
ccctgggattcaatttcactct

SEQ ID NO: 28516 - DNA, 22 bp, Homo sapiens
ctctgcctgtctcatcctgcaa

SEQ ID NO: 28517 - DNA, 22 bp, Homo sapiens
ggggaccctcaggactgcgtct

SEQ ID NO: 28518 - DNA, 22 bp, Homo sapiens
gcatggcttcggggtgctgcct

SEQ ID NO: 28519 - DNA, 22 bp, Homo sapiens
tggattcacaccattctcctgc

SEQ ID NO: 28520 - DNA, 21 bp, Homo sapiens
cagggccaatcctgacctcta

SEQ ID NO: 28521 - DNA, 22 bp, Homo sapiens
gcctgtgtggatgcgccggtgc

SEQ ID NO: 28522 - DNA, 22 bp, Homo sapiens
cctgaccagcaggacgggggca

SEQ ID NO: 28523 - DNA, 22 bp, Homo sapiens
ccaggagctggagggtgcagtg

SEQ ID NO: 28524 - DNA, 22 bp, Homo sapiens
ctgagggtcaacttgattgtat

SEQ ID NO: 28525 - DNA, 22 bp, Homo sapiens
cctgggccctcaccgccggtgg

SEQ ID NO: 28526 - DNA, 22 bp, Homo sapiens
ccctcccagatgggcttgaggt

SEQ ID NO: 28527 - DNA, 22 bp, Homo sapiens
tcctgggatcaagtgatcctcc

SEQ ID NO: 28528 - DNA, 22 bp, Homo sapiens
gtgacaatattagctcaggggc

SEQ ID NO: 28529 - DNA, 22 bp, Homo sapiens
tgctgggattacagtcatgagc

SEQ ID NO: 28530 - DNA, 22 bp, Homo sapiens
agcctgggccctgcctcttctc

SEQ ID NO: 28531 - DNA, 22 bp, Homo sapiens
cagaccagaaggaagccgacaa

SEQ ID NO: 28532 - DNA, 22 bp, Homo sapiens
gttccaggtggtcacagagctc

SEQ ID NO: 28533 - DNA, 22 bp, Homo sapiens
tccaggctttggggcaggagcg

SEQ ID NO: 28534 - DNA, 19 bp, Homo sapiens
tcctgcctggggccgcctg

SEQ ID NO: 28535 - DNA, 22 bp, Homo sapiens
cttctggcgttggaggtctgag

SEQ ID NO: 28536 - DNA, 22 bp, Homo sapiens
tcctgggacaagccgtggaagt

SEQ ID NO: 28537 - DNA, 22 bp, Homo sapiens
agaggccggccgagcccatggg

SEQ ID NO: 28538 - DNA, 22 bp, Homo sapiens
tccttaggcaatttgggagagt

SEQ ID NO: 28539 - DNA, 22 bp, Homo sapiens
gaccacacttttcccctgctag

SEQ ID NO: 28540 - DNA, 21 bp, Homo sapiens
ccagagcctgagaggattatg

SEQ ID NO: 28541 - DNA, 22 bp, Homo sapiens
agcctgggcaacagagcaaaac

SEQ ID NO: 28542 - DNA, 22 bp, Homo sapiens
acccgggcaaggattctgagag

SEQ ID NO: 28543 - DNA, 23 bp, Homo sapiens
aaataggagtatctggatcatga

SEQ ID NO: 28544 - DNA, 22 bp, Homo sapiens
gggctagcctcttccctgctcc

SEQ ID NO: 28545 - DNA, 22 bp, Homo sapiens
cggctgggttcggctgcaggcc

SEQ ID NO: 28546 - DNA, 22 bp, Homo sapiens
ccacccttgggttcggaggccg

SEQ ID NO: 28547 - DNA, 22 bp, Homo sapiens
gagccaggaggcagagactgca

SEQ ID NO: 28548 - DNA, 22 bp, Homo sapiens
caagacttcaccgctctgtgct

SEQ ID NO: 28549 - DNA, 22 bp, Homo sapiens
gcaggtctgttgattacagtca

SEQ ID NO: 28550 - DNA, 22 bp, Homo sapiens
tcggagctgtagatgaaaccct

SEQ ID NO: 28551 - DNA, 22 bp, Homo sapiens
atggagttctgccagcgctgct

SEQ ID NO: 28552 - DNA, 22 bp, Homo sapiens
tctgttgcaatgtgcatggtga

SEQ ID NO: 28553 - DNA, 22 bp, Homo sapiens
ctccagttggccccagttggtt

SEQ ID NO: 28554 - DNA, 22 bp, Homo sapiens
cctggggccccgagccagaagc

SEQ ID NO: 28555 - DNA, 22 bp, Homo sapiens
ttgcttcctctagtttcttgaa

SEQ ID NO: 28556 - DNA, 22 bp, Homo sapiens
aaccaggtgactcatggtgagc

SEQ ID NO: 28557 - DNA, 22 bp, Homo sapiens
ggttctctaactttgactggag

SEQ ID NO: 28558 - DNA, 21 bp, Homo sapiens
tgactgaggcttcttcacaca

SEQ ID NO: 28559 - DNA, 22 bp, Homo sapiens
gagagcaggaggcagcgggacg

SEQ ID NO: 28560 - DNA, 22 bp, Homo sapiens
tggcacaggatctcagcggcca

SEQ ID NO: 28561 - DNA, 22 bp, Homo sapiens
aaggctgaggcagtgaggcaga

SEQ ID NO: 28562 - DNA, 22 bp, Homo sapiens
aaagtgcaaggattacaggcat

SEQ ID NO: 28563 - DNA, 22 bp, Homo sapiens
agtgaatgtccccgcgggtcag

SEQ ID NO: 28564 - DNA, 22 bp, Homo sapiens
caggctgatcagggctgggatg

SEQ ID NO: 28565 - DNA, 18 bp, Homo sapiens
cccggctaatttttggta

SEQ ID NO: 28566 - DNA, 22 bp, Homo sapiens
aaattacagccttgggtagctt

SEQ ID NO: 28567 - DNA, 22 bp, Homo sapiens
tgggggagctcagtccagccca

SEQ ID NO: 28568 - DNA, 22 bp, Homo sapiens
ctccagattccgtttattcagg

SEQ ID NO: 28569 - DNA, 22 bp, Homo sapiens
tccacgtgagcttcgtgtgcag

SEQ ID NO: 28570 - DNA, 22 bp, Homo sapiens
cacagtcctgccagagggcctt

SEQ ID NO: 28571 - DNA, 22 bp, Homo sapiens
cgctccttgagcgtgtcggcct

SEQ ID NO: 28572 - DNA, 22 bp, Homo sapiens
gggaaagaccttcctggggtgt

SEQ ID NO: 28573 - DNA, 21 bp, Homo sapiens
aaactgaccttgcctgagaca

SEQ ID NO: 28574 - DNA, 22 bp, Homo sapiens
aaagtgctgggattacaggcct

SEQ ID NO: 28575 - DNA, 22 bp, Homo sapiens
ctttgcttgacactgtgattgt

SEQ ID NO: 28576 - DNA, 22 bp, Homo sapiens
aggccttaccatagctgtagca

SEQ ID NO: 28577 - DNA, 22 bp, Homo sapiens
gaggctgaggcggatggatcac

SEQ ID NO: 28578 - DNA, 22 bp, Homo sapiens
gagagtctagtgcacctagttt

SEQ ID NO: 28579 - DNA, 20 bp, Homo sapiens
acgtggccaccagtggctta

SEQ ID NO: 28580 - DNA, 22 bp, Homo sapiens
gcctcagtctcccgagtagctg

SEQ ID NO: 28581 - DNA, 22 bp, Homo sapiens
gcagctattgtctcctgggccc

SEQ ID NO: 28582 - DNA, 22 bp, Homo sapiens
tctggtgtcagtattctttgaa

SEQ ID NO: 28583 - DNA, 22 bp, Homo sapiens
atttcagcagcccatgtttgga

SEQ ID NO: 28584 - DNA, 22 bp, Homo sapiens
agaggctgcacttgctcatgat

SEQ ID NO: 28585 - DNA, 22 bp, Homo sapiens
tggttacccagtcgctggagtt

SEQ ID NO: 28586 - DNA, 17 bp, Homo sapiens
cgggcatggagggcagg

SEQ ID NO: 28587 - DNA, 22 bp, Homo sapiens
ggcatagatttctttaggttta

SEQ ID NO: 28588 - DNA, 22 bp, Homo sapiens
ctcagctgcagcctggctggca

SEQ ID NO: 28589 - DNA, 22 bp, Homo sapiens
cccaggctggagtgcagtggcg

SEQ ID NO: 28590 - DNA, 22 bp, Homo sapiens
ggcaaagccctgcctggttcaa

SEQ ID NO: 28591 - DNA, 22 bp, Homo sapiens
gcgagcctctggagtcctctgg

SEQ ID NO: 28592 - DNA, 18 bp, Homo sapiens
cagggctgtggggtcact

SEQ ID NO: 28593 - DNA, 22 bp, Homo sapiens
gtgggggcaggcagtgctagga

SEQ ID NO: 28594 - DNA, 22 bp, Homo sapiens
gaggggagcccccatcctccag

SEQ ID NO: 28595 - DNA, 22 bp, Homo sapiens
ggaggggatttagtagatgcta

SEQ ID NO: 28596 - DNA, 22 bp, Homo sapiens
gtgctggggagataggaagaga

SEQ ID NO: 28597 - DNA, 22 bp, Homo sapiens
ggatgttctggggttctcttgt

SEQ ID NO: 28598 - DNA, 22 bp, Homo sapiens
ggaggagacagtaaaaagcacg

SEQ ID NO: 28599 - DNA, 22 bp, Homo sapiens
cactgcactccatcctgggaaa

SEQ ID NO: 28600 - DNA, 22 bp, Homo sapiens
cctgggctctgtcagaattggg

SEQ ID NO: 28601 - DNA, 22 bp, Homo sapiens
actgcacttcagcctgggtgac

SEQ ID NO: 28602 - DNA, 22 bp, Homo sapiens
aaagtgctgtgattacaggcat

SEQ ID NO: 28603 - DNA, 22 bp, Homo sapiens
attataggcttgagccaccgtg

SEQ ID NO: 28604 - DNA, 22 bp, Homo sapiens
ccacagaattctgtctccagga

SEQ ID NO: 28605 - DNA, 22 bp, Homo sapiens
catgagatttgggaggggccag

SEQ ID NO: 28606 - DNA, 22 bp, Homo sapiens
gggcggggggagctggaatgaa

SEQ ID NO: 28607 - DNA, 22 bp, Homo sapiens
tcagggctgcagaagaggcagg

SEQ ID NO: 28608 - DNA, 22 bp, Homo sapiens
ccaggctggagtgcagtggcac

SEQ ID NO: 28609 - DNA, 22 bp, Homo sapiens
gtggctgcagcggctgtggaga

SEQ ID NO: 28610 - DNA, 19 bp, Homo sapiens
cggcccctcctctcgcgcc

SEQ ID NO: 28611 - DNA, 22 bp, Homo sapiens
aagaggtagcagtcacaaaaga

SEQ ID NO: 28612 - DNA, 22 bp, Homo sapiens
ctggtctggctacccagcgaat

SEQ ID NO: 28613 - DNA, 22 bp, Homo sapiens
ctccagtgcttctagaaaatac

SEQ ID NO: 28614 - DNA, 22 bp, Homo sapiens
aaaaaattatcatagttcctga

SEQ ID NO: 28615 - DNA, 22 bp, Homo sapiens
cactgcactccagcctgggtca

SEQ ID NO: 28616 - DNA, 22 bp, Homo sapiens
cggggttcatccatgctgtggc

SEQ ID NO: 28617 - DNA, 22 bp, Homo sapiens
tgcctccctggcaagtctctcc

SEQ ID NO: 28618 - DNA, 22 bp, Homo sapiens
aaaagcaattgcagttcttgcc

SEQ ID NO: 28619 - DNA, 22 bp, Homo sapiens
actgcacttcagcctgggtgtc

SEQ ID NO: 28620 - DNA, 22 bp, Homo sapiens
aggctagaggcttctggcttca

SEQ ID NO: 28621 - DNA, 18 bp, Homo sapiens
tcttcatctcctgagctg

SEQ ID NO: 28622 - DNA, 22 bp, Homo sapiens
tgagatgaataactcctgctaa

SEQ ID NO: 28623 - DNA, 22 bp, Homo sapiens
tgggaaggggagctggaaagga

SEQ ID NO: 28624 - DNA, 22 bp, Homo sapiens
gagctgggcctgcgagtgctgc

SEQ ID NO: 28625 - DNA, 22 bp, Homo sapiens
tgtcttcaggagtaaatatcat

SEQ ID NO: 28626 - DNA, 22 bp, Homo sapiens
ggggccttggatctgtgccccg

SEQ ID NO: 28627 - DNA, 20 bp, Homo sapiens
ttcgctgggagtggccaggc

SEQ ID NO: 28628 - DNA, 22 bp, Homo sapiens
gaggcagaagttgcagtgagca

SEQ ID NO: 28629 - DNA, 23 bp, Homo sapiens
cagagctggcttcatgggtgtgc

SEQ ID NO: 28630 - DNA, 22 bp, Homo sapiens
aggagctgtcagagtgccagag

SEQ ID NO: 28631 - DNA, 22 bp, Homo sapiens
tggccaccaccaatacttgcct

SEQ ID NO: 28632 - DNA, 22 bp, Homo sapiens
tgaggcaggagaatcacatgaa

SEQ ID NO: 28633 - DNA, 22 bp, Homo sapiens
ttgtaacaggtactaaataact

SEQ ID NO: 28634 - DNA, 21 bp, Homo sapiens
cactccacttagaacagggtt

SEQ ID NO: 28635 - DNA, 22 bp, Homo sapiens
tgcagtggcgccatctcagctc

SEQ ID NO: 28636 - DNA, 19 bp, Homo sapiens
ctctgggcaagtcacttaa

SEQ ID NO: 28637 - DNA, 22 bp, Homo sapiens
tccaggattgcaggtgcacaac

SEQ ID NO: 28638 - DNA, 22 bp, Homo sapiens
ggactgggaatcagggagatgc

SEQ ID NO: 28639 - DNA, 22 bp, Homo sapiens
atcttctcatgtgtaatgaggt

SEQ ID NO: 28640 - DNA, 22 bp, Homo sapiens
gctgaggctcctcgggaggaca

SEQ ID NO: 28641 - DNA, 22 bp, Homo sapiens
ttctcatgaaactcgcttcctc

SEQ ID NO: 28642 - DNA, 22 bp, Homo sapiens
aaaagcaattgcgggttttgcc

SEQ ID NO: 28643 - DNA, 22 bp, Homo sapiens
ccaggctgctgttggtgtccgc

SEQ ID NO: 28644 - DNA, 22 bp, Homo sapiens
tggctccacaggccagggtgtg

SEQ ID NO: 28645 - DNA, 22 bp, Homo sapiens
ccctctctgctgcatagaggaa

SEQ ID NO: 28646 - DNA, 23 bp, Homo sapiens
tgttccagatacgccttttcctc

SEQ ID NO: 28647 - DNA, 22 bp, Homo sapiens
ccctcccaggagtggccagaga

SEQ ID NO: 28648 - DNA, 22 bp, Homo sapiens
gagtggggggtccgtctcagtg

SEQ ID NO: 28649 - DNA, 22 bp, Homo sapiens
cgtctggcttctccacggtaaa

SEQ ID NO: 28650 - DNA, 22 bp, Homo sapiens
agtgactggtgtgaagttaaat

SEQ ID NO: 28651 - DNA, 22 bp, Homo sapiens
cttctcttcctttgtcaactga

SEQ ID NO: 28652 - DNA, 22 bp, Homo sapiens
accacccagccagcttctccct

SEQ ID NO: 28653 - DNA, 22 bp, Homo sapiens
agttatgtcctcagcaaatcaa

SEQ ID NO: 28654 - DNA, 22 bp, Homo sapiens
gcttctcaattctcaccctcca

SEQ ID NO: 28655 - DNA, 22 bp, Homo sapiens
gggttcttatagtatcagagct

SEQ ID NO: 28656 - DNA, 22 bp, Homo sapiens
cagtcctgaatactggacggtg

SEQ ID NO: 28657 - DNA, 22 bp, Homo sapiens
ggtgggagagcttgctttgatg

SEQ ID NO: 28658 - DNA, 22 bp, Homo sapiens
gctcaagccttctgcccacctc

SEQ ID NO: 28659 - DNA, 22 bp, Homo sapiens
atacagggacatccagtttttc

SEQ ID NO: 28660 - DNA, 22 bp, Homo sapiens
cagcagcattgctctggattcc

SEQ ID NO: 28661 - DNA, 22 bp, Homo sapiens
agcgtgaattagttggtacaca

SEQ ID NO: 28662 - DNA, 22 bp, Homo sapiens
gggcccctgggaattctgtgat

SEQ ID NO: 28663 - DNA, 22 bp, Homo sapiens
gggccggagctgggtcccgcgc

SEQ ID NO: 28664 - DNA, 22 bp, Homo sapiens
ggaggtgggctaaggactctct

SEQ ID NO: 28665 - DNA, 22 bp, Homo sapiens
ggagaggcttccagagtcgtgc

SEQ ID NO: 28666 - DNA, 19 bp, Homo sapiens
gcctatgtcttcaaatcat

SEQ ID NO: 28667 - DNA, 22 bp, Homo sapiens
ggaggcggaagttgcagtgagc

SEQ ID NO: 28668 - DNA, 22 bp, Homo sapiens
ggaggtggaggttgcagtgagc

SEQ ID NO: 28669 - DNA, 22 bp, Homo sapiens
aagcagatctgatagggccctg

SEQ ID NO: 28670 - DNA, 22 bp, Homo sapiens
tcgcaccattgcactccagcca

SEQ ID NO: 28671 - DNA, 22 bp, Homo sapiens
gacaattgcttttgccgaataa

SEQ ID NO: 28672 - DNA, 22 bp, Homo sapiens
gaggcaggcagattgcttgagg

SEQ ID NO: 28673 - DNA, 22 bp, Homo sapiens
gtggccccagggccctgtctgg

SEQ ID NO: 28674 - DNA, 22 bp, Homo sapiens
ctgggcaaattgtgccagctat

SEQ ID NO: 28675 - DNA, 22 bp, Homo sapiens
tggatatccttgttaactttct

SEQ ID NO: 28676 - DNA, 20 bp, Homo sapiens
ggcagagggcctgggagaag

SEQ ID NO: 28677 - DNA, 22 bp, Homo sapiens
gaggcaggaggattgcttgagc

SEQ ID NO: 28678 - DNA, 22 bp, Homo sapiens
cgcggtggcggcctccagcgcc

SEQ ID NO: 28679 - DNA, 22 bp, Homo sapiens
actgcaacctccacctcctggg

SEQ ID NO: 28680 - DNA, 22 bp, Homo sapiens
tagtaagttctcgcattgttat

SEQ ID NO: 28681 - DNA, 22 bp, Homo sapiens
ttgtgagtagtgccgcaataaa

SEQ ID NO: 28682 - DNA, 22 bp, Homo sapiens
ggtgggagagctctgtctccag

SEQ ID NO: 28683 - DNA, 20 bp, Homo sapiens
agagatggggtatcaccgta

SEQ ID NO: 28684 - DNA, 22 bp, Homo sapiens
aggggtgaaagagggccctcaa

SEQ ID NO: 28685 - DNA, 22 bp, Homo sapiens
gagccagactgcctgaagctca

SEQ ID NO: 28686 - DNA, 22 bp, Homo sapiens
ggcagggagtggagactcccta

SEQ ID NO: 28687 - DNA, 22 bp, Homo sapiens
actgcactccaacctgggtgac

SEQ ID NO: 28688 - DNA, 22 bp, Homo sapiens
actgcactccagcctgggtaac

SEQ ID NO: 28689 - DNA, 22 bp, Homo sapiens
ctatacagcagcttactagtta

SEQ ID NO: 28690 - DNA, 22 bp, Homo sapiens
gcaggtctatcaggctgcaggt

SEQ ID NO: 28691 - DNA, 22 bp, Homo sapiens
tctcctggtacccttcctagca

SEQ ID NO: 28692 - DNA, 22 bp, Homo sapiens
acaaagtgctgacattacaggc

SEQ ID NO: 28693 - DNA, 23 bp, Homo sapiens
tctctgcatgtcctgagcacatc

SEQ ID NO: 28694 - DNA, 22 bp, Homo sapiens
ccatcacagtccccatcgtgat

SEQ ID NO: 28695 - DNA, 22 bp, Homo sapiens
gccatcatatcccctgtgacct

SEQ ID NO: 28696 - DNA, 17 bp, Homo sapiens
tgtagcttctccttctc

SEQ ID NO: 28697 - DNA, 22 bp, Homo sapiens
acgcctgtaatcccagcacttt

SEQ ID NO: 28698 - DNA, 22 bp, Homo sapiens
gggctgggattgcttgctgtga

SEQ ID NO: 28699 - DNA, 22 bp, Homo sapiens
agggccagcactcctggcagga

SEQ ID NO: 28700 - DNA, 22 bp, Homo sapiens
aatgtcaaaggctatacattca

SEQ ID NO: 28701 - DNA, 22 bp, Homo sapiens
actgcgctccagcctgggtgac

SEQ ID NO: 28702 - DNA, 22 bp, Homo sapiens
ttgtcagccagctcgcactctt

SEQ ID NO: 28703 - DNA, 22 bp, Homo sapiens
ctgagccaaggggacagtgaca

SEQ ID NO: 28704 - DNA, 22 bp, Homo sapiens
gctggaggatggactggaagaa

SEQ ID NO: 28705 - DNA, 22 bp, Homo sapiens
aaagtgctgggattacaggtgt

SEQ ID NO: 28706 - DNA, 22 bp, Homo sapiens
agagaagagtcttgtcaaatta

SEQ ID NO: 28707 - DNA, 22 bp, Homo sapiens
agcttgggcaacacagcaagac

SEQ ID NO: 28708 - DNA, 22 bp, Homo sapiens
gaaggaccctctggggtctcag

SEQ ID NO: 28709 - DNA, 22 bp, Homo sapiens
ttaaatattatgttgtctgcaa

SEQ ID NO: 28710 - DNA, 22 bp, Homo sapiens
tttgaaatgtatcagtataggt

SEQ ID NO: 28711 - DNA, 23 bp, Homo sapiens
ttctgggctgtggaagcctcggg

SEQ ID NO: 28712 - DNA, 22 bp, Homo sapiens
actcatgtcctaggagtaaagc

SEQ ID NO: 28713 - DNA, 22 bp, Homo sapiens
ggtggctgcaatggctaacttc

SEQ ID NO: 28714 - DNA, 22 bp, Homo sapiens
tgaaatgttaaacaagtggctc

SEQ ID NO: 28715 - DNA, 22 bp, Homo sapiens
gaggttcattcagctctgtcac

SEQ ID NO: 28716 - DNA, 22 bp, Homo sapiens
gcgccccatctacagtactttt

SEQ ID NO: 28717 - DNA, 22 bp, Homo sapiens
gcaagacctatctagttgctgt

SEQ ID NO: 28718 - DNA, 22 bp, Homo sapiens
actgcacttcaccctgggtgac

SEQ ID NO: 28719 - DNA, 22 bp, Homo sapiens
tcactgcaacctccacctcctg

SEQ ID NO: 28720 - DNA, 22 bp, Homo sapiens
tgcctactagtactattttgtg

SEQ ID NO: 28721 - DNA, 22 bp, Homo sapiens
tgcctgttgcccacctgataaa

SEQ ID NO: 28722 - DNA, 22 bp, Homo sapiens
ggcaggaggtgagtggcgggtg

SEQ ID NO: 28723 - DNA, 22 bp, Homo sapiens
caaagtgctaggattataggtg

SEQ ID NO: 28724 - DNA, 22 bp, Homo sapiens
acggcttcttgactgtgggttg

SEQ ID NO: 28725 - DNA, 22 bp, Homo sapiens
ctgggggcagcaagaagccatg

SEQ ID NO: 28726 - DNA, 22 bp, Homo sapiens
ttcaaagcagagggtcaataca

SEQ ID NO: 28727 - DNA, 22 bp, Homo sapiens
gaggcacagagtaggtgcacac

SEQ ID NO: 28728 - DNA, 23 bp, Homo sapiens
ggaagctcacgtagtcctgcact

SEQ ID NO: 28729 - DNA, 22 bp, Homo sapiens
gtaatctcagctacttgggagg

SEQ ID NO: 28730 - DNA, 22 bp, Homo sapiens
tgtgcctgttcccactttgcct

SEQ ID NO: 28731 - DNA, 22 bp, Homo sapiens
agggtcctgggtgcagttgctt

SEQ ID NO: 28732 - DNA, 22 bp, Homo sapiens
ggagtagctgcattccgagcac

SEQ ID NO: 28733 - DNA, 22 bp, Homo sapiens
ctgtggctctttagttgagcac

SEQ ID NO: 28734 - DNA, 22 bp, Homo sapiens
tctaatcctatggtggggaggg

SEQ ID NO: 28735 - DNA, 22 bp, Homo sapiens
attgtgaatagtgccgcagtaa

SEQ ID NO: 28736 - DNA, 22 bp, Homo sapiens
ccagttccagtgctcacatcca

SEQ ID NO: 28737 - DNA, 22 bp, Homo sapiens
aatggctctgatgttgttgtga

SEQ ID NO: 28738 - DNA, 22 bp, Homo sapiens
gcaggagaacaaagcaagctgc

SEQ ID NO: 28739 - DNA, 21 bp, Homo sapiens
ttgctgttttcccaatgcagt

SEQ ID NO: 28740 - DNA, 23 bp, Homo sapiens
atgggccaagcaagacccatgac

SEQ ID NO: 28741 - DNA, 22 bp, Homo sapiens
actgggctcaagtgattgtcct

SEQ ID NO: 28742 - DNA, 22 bp, Homo sapiens
tgggccactgctgcggaaggcg

SEQ ID NO: 28743 - DNA, 22 bp, Homo sapiens
gagagtctaggaacctcatata

SEQ ID NO: 28744 - DNA, 22 bp, Homo sapiens
tgactggattgtcattacgacg

SEQ ID NO: 28745 - DNA, 22 bp, Homo sapiens
aaagtgctgggattacaagcgt

SEQ ID NO: 28746 - DNA, 22 bp, Homo sapiens
cactgcacttcagcctgggtga

SEQ ID NO: 28747 - DNA, 22 bp, Homo sapiens
caggctggagtgcagtggtgcc

SEQ ID NO: 28748 - DNA, 22 bp, Homo sapiens
cctgggggccaggaaggtgtga

SEQ ID NO: 28749 - DNA, 22 bp, Homo sapiens
aaggcaggatgggaaaagattt

SEQ ID NO: 28750 - DNA, 22 bp, Homo sapiens
aaggagtctgggccattcagag

SEQ ID NO: 28751 - DNA, 22 bp, Homo sapiens
aggggaggtgtccccaaatctc

SEQ ID NO: 28752 - DNA, 22 bp, Homo sapiens
tttggactgcatgatgatctgg

SEQ ID NO: 28753 - DNA, 22 bp, Homo sapiens
ttgcaattgctatggagagcgt

SEQ ID NO: 28754 - DNA, 22 bp, Homo sapiens
gggaggcagtgctggaggctgg

SEQ ID NO: 28755 - DNA, 22 bp, Homo sapiens
aggagcagaccgtagtcctgca

SEQ ID NO: 28756 - DNA, 22 bp, Homo sapiens
gtgggccagcttttctcctggg

SEQ ID NO: 28757 - DNA, 22 bp, Homo sapiens
aaaaagtattggccatggttga

SEQ ID NO: 28758 - DNA, 22 bp, Homo sapiens
ttccggaaggttctctagaatt

SEQ ID NO: 28759 - DNA, 22 bp, Homo sapiens
aagagagtcagtctgagcacca

SEQ ID NO: 28760 - DNA, 22 bp, Homo sapiens
tgagcttccctcctgcactaca

SEQ ID NO: 28761 - DNA, 22 bp, Homo sapiens
ctgtccctgagcaactcctgtt

SEQ ID NO: 28762 - DNA, 22 bp, Homo sapiens
agatgtgagaatcaagtgacca

SEQ ID NO: 28763 - DNA, 22 bp, Homo sapiens
ctcctgggaaaggctggacaca

SEQ ID NO: 28764 - DNA, 22 bp, Homo sapiens
ttagggttacaccagcctcctg

SEQ ID NO: 28765 - DNA, 22 bp, Homo sapiens
cggtctcccgtgtgtgtgcgct

SEQ ID NO: 28766 - DNA, 22 bp, Homo sapiens
ggccagaagttggaaaagagcc

SEQ ID NO: 28767 - DNA, 22 bp, Homo sapiens
ttctagtgtccttggacttgct

SEQ ID NO: 28768 - DNA, 22 bp, Homo sapiens
tgggtgctctgcgaccgtaggg

SEQ ID NO: 28769 - DNA, 20 bp, Homo sapiens
ccagagctgatggctgcccg

SEQ ID NO: 28770 - DNA, 22 bp, Homo sapiens
gccacctggtggcatcttctgg

SEQ ID NO: 28771 - DNA, 22 bp, Homo sapiens
tgggccacacacagaagaatca

SEQ ID NO: 28772 - DNA, 22 bp, Homo sapiens
gaagtattactctgaatgtatt

SEQ ID NO: 28773 - DNA, 22 bp, Homo sapiens
actctttgtctgttgccgctta

SEQ ID NO: 28774 - DNA, 22 bp, Homo sapiens
ctcagcagtatactctgaagat

SEQ ID NO: 28775 - DNA, 22 bp, Homo sapiens
aagagggaaattgttggctgct

SEQ ID NO: 28776 - DNA, 22 bp, Homo sapiens
ctgcatccatgttgctgcaaag

SEQ ID NO: 28777 - DNA, 22 bp, Homo sapiens
cactgcactccagcctgggtga

SEQ ID NO: 28778 - DNA, 22 bp, Homo sapiens
tataaagagtctcaaagaagtt

SEQ ID NO: 28779 - DNA, 23 bp, Homo sapiens
aaaacagcttcctccagtggctc

SEQ ID NO: 28780 - DNA, 22 bp, Homo sapiens
tggattcacaccattctcctgc

SEQ ID NO: 28781 - DNA, 22 bp, Homo sapiens
cagcacatgctcatcagggaag

SEQ ID NO: 28782 - DNA, 22 bp, Homo sapiens
ctctcagtcctgcgcgcctctg

SEQ ID NO: 28783 - DNA, 22 bp, Homo sapiens
agccggccatgtggtcttgtgc

SEQ ID NO: 28784 - DNA, 22 bp, Homo sapiens
agtgagagtattaatgtgaact

SEQ ID NO: 28785 - DNA, 22 bp, Homo sapiens
aaagtgctgagattacaagcgt

SEQ ID NO: 28786 - DNA, 22 bp, Homo sapiens
aaagtgctgggattacaggcgt

SEQ ID NO: 28787 - DNA, 22 bp, Homo sapiens
ctcattgcaacctccgcctccc

SEQ ID NO: 28788 - DNA, 22 bp, Homo sapiens
tgggagaaagaaccctgagtga

SEQ ID NO: 28789 - DNA, 22 bp, Homo sapiens
ggaggcggaggttgcagtgagc

SEQ ID NO: 28790 - DNA, 22 bp, Homo sapiens
aaagtgctgggattacaggcat

SEQ ID NO: 28791 - DNA, 18 bp, Homo sapiens
gaggtagataagattttc

SEQ ID NO: 28792 - DNA, 22 bp, Homo sapiens
cagagctggtgtgtcctggcat

SEQ ID NO: 28793 - DNA, 22 bp, Homo sapiens
ggcttagcaactcctgaggctc

SEQ ID NO: 28794 - DNA, 22 bp, Homo sapiens
tgagacgaagtcttgctctgtt

SEQ ID NO: 28795 - DNA, 22 bp, Homo sapiens
accatgttggccaagctggtct

SEQ ID NO: 28796 - DNA, 22 bp, Homo sapiens
aaagcagaggttgcagtgagct

SEQ ID NO: 28797 - DNA, 22 bp, Homo sapiens
gggacaatggaggcctctctcc

SEQ ID NO: 28798 - DNA, 22 bp, Homo sapiens
actgcactccagcctgggtgat

SEQ ID NO: 28799 - DNA, 22 bp, Homo sapiens
ttttctaacatctagtaatttg

SEQ ID NO: 28800 - DNA, 22 bp, Homo sapiens
gactgtgacttctgaagcaata

SEQ ID NO: 28801 - DNA, 22 bp, Homo sapiens
tcatggggccacagctgccagc

SEQ ID NO: 28802 - DNA, 22 bp, Homo sapiens
aaagtgctgaaattacaggtgt

SEQ ID NO: 28803 - DNA, 22 bp, Homo sapiens
ctgggggtcttgaaagggagag

SEQ ID NO: 28804 - DNA, 22 bp, Homo sapiens
gataccagacagggagggagaa

SEQ ID NO: 28805 - DNA, 22 bp, Homo sapiens
aacagcttgctgcaccttaata

SEQ ID NO: 28806 - DNA, 19 bp, Homo sapiens
gccatcccaagcattttgg

SEQ ID NO: 28807 - DNA, 22 bp, Homo sapiens
cgcaccactgaattccagcctg

SEQ ID NO: 28808 - DNA, 22 bp, Homo sapiens
tggagaattctatgttgagggg

SEQ ID NO: 28809 - DNA, 22 bp, Homo sapiens
tctctttgcctgctgccatcca

SEQ ID NO: 28810 - DNA, 22 bp, Homo sapiens
tgctgctgaggctaaagtatag

SEQ ID NO: 28811 - DNA, 22 bp, Homo sapiens
tgacttcctgcactcaggtgat

SEQ ID NO: 28812 - DNA, 22 bp, Homo sapiens
agatacattgttctaagcattg

SEQ ID NO: 28813 - DNA, 22 bp, Homo sapiens
aagaggagaaaggctggctttg

SEQ ID NO: 28814 - DNA, 22 bp, Homo sapiens
aggagggagcttaagccaggca

SEQ ID NO: 28815 - DNA, 19 bp, Homo sapiens
agccccttggtactgtcct

SEQ ID NO: 28816 - DNA, 22 bp, Homo sapiens
ccttttgctctcccatccagaa

SEQ ID NO: 28817 - DNA, 22 bp, Homo sapiens
tccaggatggtgacggtggcca

SEQ ID NO: 28818 - DNA, 22 bp, Homo sapiens
gccctgggcaaggttctggcca

SEQ ID NO: 28819 - DNA, 22 bp, Homo sapiens
ttgtgttaaggtgcatctagtg

SEQ ID NO: 28820 - DNA, 21 bp, Homo sapiens
ctggccactgcacctcttcct

SEQ ID NO: 28821 - DNA, 19 bp, Homo sapiens
tcctggggaggggcatggc

SEQ ID NO: 28822 - DNA, 22 bp, Homo sapiens
ttaataaagtatgaattggaaa

SEQ ID NO: 28823 - DNA, 20 bp, Homo sapiens
gtgtggccaggagctgcgct

SEQ ID NO: 28824 - DNA, 19 bp, Homo sapiens
atcccaaggagctgggact

SEQ ID NO: 28825 - DNA, 22 bp, Homo sapiens
ggaggcggaggttgcagtgagt

SEQ ID NO: 28826 - DNA, 22 bp, Homo sapiens
ccctttagcccctgcagagact

SEQ ID NO: 28827 - DNA, 22 bp, Homo sapiens
aatgttacgatcaacaacacat

SEQ ID NO: 28828 - DNA, 22 bp, Homo sapiens
tcagccagccagctacaggctt

SEQ ID NO: 28829 - DNA, 22 bp, Homo sapiens
ggaggcggaggctgcagtgagc

SEQ ID NO: 28830 - DNA, 22 bp, Homo sapiens
aaggagaaatggtagatgtgca

SEQ ID NO: 28831 - DNA, 22 bp, Homo sapiens
ctggcctggcgcagtggctcac

SEQ ID NO: 28832 - DNA, 21 bp, Homo sapiens
tgcaatccagcctgggcgaca

SEQ ID NO: 28833 - DNA, 22 bp, Homo sapiens
gctgtctgtcttcacatctcgc

SEQ ID NO: 28834 - DNA, 22 bp, Homo sapiens
aagaggtaaccatagcaaccac

SEQ ID NO: 28835 - DNA, 18 bp, Homo sapiens
ggtgagggagctggaagc

SEQ ID NO: 28836 - DNA, 22 bp, Homo sapiens
ggagagtggattccagctgtat

SEQ ID NO: 28837 - DNA, 22 bp, Homo sapiens
gagggagggactagcattctct

SEQ ID NO: 28838 - DNA, 22 bp, Homo sapiens
ataaaatttgctactgttaaat

SEQ ID NO: 28839 - DNA, 22 bp, Homo sapiens
ggggtgggcgtgcagggacacc

SEQ ID NO: 28840 - DNA, 22 bp, Homo sapiens
ctgtaatcccagctacctggga

SEQ ID NO: 28841 - DNA, 22 bp, Homo sapiens
cggtcaggtgcagcgttggcac

SEQ ID NO: 28842 - DNA, 22 bp, Homo sapiens
gcgttggggaccccgaagctgg

SEQ ID NO: 28843 - DNA, 22 bp, Homo sapiens
gcttccacctactaaatgccac

SEQ ID NO: 28844 - DNA, 22 bp, Homo sapiens
tggctgagttacgaacagagca

SEQ ID NO: 28845 - DNA, 23 bp, Homo sapiens
actcgtggaattctctgcgatcg

SEQ ID NO: 28846 - DNA, 22 bp, Homo sapiens
tttaaaaaactagtctgagtct

SEQ ID NO: 28847 - DNA, 22 bp, Homo sapiens
ccgggcctcgggacaccgggta

SEQ ID NO: 28848 - DNA, 22 bp, Homo sapiens
gaaaattattgaaaatggctct

SEQ ID NO: 28849 - DNA, 22 bp, Homo sapiens
gaggttggggctgcagtgagct

SEQ ID NO: 28850 - DNA, 22 bp, Homo sapiens
gaaagtgctctctctatacaca

SEQ ID NO: 28851 - DNA, 22 bp, Homo sapiens
aaagtgctgggattacaggctt

SEQ ID NO: 28852 - DNA, 22 bp, Homo sapiens
ggcagggcaggaaagtcaggaa

SEQ ID NO: 28853 - DNA, 22 bp, Homo sapiens
tgccgtggggctgaggctggag

SEQ ID NO: 28854 - DNA, 22 bp, Homo sapiens
atggctgcctgggcgctggccg

SEQ ID NO: 28855 - DNA, 22 bp, Homo sapiens
ggagacagggttgaaccacgca

SEQ ID NO: 28856 - DNA, 22 bp, Homo sapiens
ctgtggctctcagaggctgctg

SEQ ID NO: 28857 - DNA, 22 bp, Homo sapiens
gaggcagaggttgcagtgagct

SEQ ID NO: 28858 - DNA, 22 bp, Homo sapiens
ccttgctcaagctagtgacggg

SEQ ID NO: 28859 - DNA, 22 bp, Homo sapiens
gcccagctgcaccctggtgggt

SEQ ID NO: 28860 - DNA, 22 bp, Homo sapiens
gggagctgagctggaagagaat

SEQ ID NO: 28861 - DNA, 22 bp, Homo sapiens
atgttggagtcgtaaggcatgg

SEQ ID NO: 28862 - DNA, 22 bp, Homo sapiens
tctgggtccgggactgtggatg

SEQ ID NO: 28863 - DNA, 22 bp, Homo sapiens
cactgcactccagcctgggaga

SEQ ID NO: 28864 - DNA, 22 bp, Homo sapiens
aggtttctttatgctgctagaa

SEQ ID NO: 28865 - DNA, 22 bp, Homo sapiens
ggcatagcggctcagcgtccag

SEQ ID NO: 28866 - DNA, 22 bp, Homo sapiens
aaggtccttttgcagtgtgatc

SEQ ID NO: 28867 - DNA, 22 bp, Homo sapiens
ctctctgggcccagttggcacc

SEQ ID NO: 28868 - DNA, 21 bp, Homo sapiens
agtagtttagcacagggtttg

SEQ ID NO: 28869 - DNA, 22 bp, Homo sapiens
aaagtgctcggattacaggtat

SEQ ID NO: 28870 - DNA, 22 bp, Homo sapiens
atgtgggccgtgcgggtgtcct

SEQ ID NO: 28871 - DNA, 22 bp, Homo sapiens
gatgtagacacttggaggctta

SEQ ID NO: 28872 - DNA, 22 bp, Homo sapiens
caaagtgctgggattataggca

SEQ ID NO: 28873 - DNA, 22 bp, Homo sapiens
agggtgaatctcacaactctta

SEQ ID NO: 28874 - DNA, 22 bp, Homo sapiens
ggccactgctctccagcctggg

SEQ ID NO: 28875 - DNA, 22 bp, Homo sapiens
cagcttggaggaggatctaaga

SEQ ID NO: 28876 - DNA, 22 bp, Homo sapiens
ggcctcttatctggctcctgca

SEQ ID NO: 28877 - DNA, 19 bp, Homo sapiens
catggtgaaaccccgtctc

SEQ ID NO: 28878 - DNA, 22 bp, Homo sapiens
aggtctcttgctgtctctgggc

SEQ ID NO: 28879 - DNA, 22 bp, Homo sapiens
gtgaggtggtacaatattaact

SEQ ID NO: 28880 - DNA, 22 bp, Homo sapiens
taaaggtagtgtgacatattgt

SEQ ID NO: 28881 - DNA, 22 bp, Homo sapiens
ccaggaggttgaggctgcagtg

SEQ ID NO: 28882 - DNA, 22 bp, Homo sapiens
gacaggaggcagagctcaggtg

SEQ ID NO: 28883 - DNA, 22 bp, Homo sapiens
gacttctgaattcctatcaggt

SEQ ID NO: 28884 - DNA, 22 bp, Homo sapiens
ttgggctcaggagtttgagacc

SEQ ID NO: 28885 - DNA, 22 bp, Homo sapiens
catgcctgcctggtgggcgtgg

SEQ ID NO: 28886 - DNA, 22 bp, Homo sapiens
gaggctgaggttgcagtgagct

SEQ ID NO: 28887 - DNA, 22 bp, Homo sapiens
caggctggagttcagtggtgtg

SEQ ID NO: 28888 - DNA, 22 bp, Homo sapiens
gggatctgggacaacaggtggt

SEQ ID NO: 28889 - DNA, 22 bp, Homo sapiens
tcagtgcagggtgggagagaga

SEQ ID NO: 28890 - DNA, 22 bp, Homo sapiens
gggaaggaaagttattagcaga

SEQ ID NO: 28891 - DNA, 22 bp, Homo sapiens
aaggcaaaagaggtgtcatcac

SEQ ID NO: 28892 - DNA, 22 bp, Homo sapiens
ctctggaggtggaggttgcagt

SEQ ID NO: 28893 - DNA, 22 bp, Homo sapiens
ctgggctcaagtgatccaccca

SEQ ID NO: 28894 - DNA, 22 bp, Homo sapiens
agtgaggggcagctgagtgggc

SEQ ID NO: 28895 - DNA, 22 bp, Homo sapiens
actgcactcctgcctgggtaac

SEQ ID NO: 28896 - DNA, 22 bp, Homo sapiens
gctggccacagatccccaggga

SEQ ID NO: 28897 - DNA, 22 bp, Homo sapiens
caaagtgctgggattacaggct

SEQ ID NO: 28898 - DNA, 22 bp, Homo sapiens
caggaaggggctcactctggcc

SEQ ID NO: 28899 - DNA, 22 bp, Homo sapiens
cttctggcgttggaggtctgag

SEQ ID NO: 28900 - DNA, 22 bp, Homo sapiens
cccctcttggcattgagtgcca

SEQ ID NO: 28901 - DNA, 22 bp, Homo sapiens
gtcagatctttggggatgctgt

SEQ ID NO: 28902 - DNA, 22 bp, Homo sapiens
cagcagcagtggctgcagaaca

SEQ ID NO: 28903 - DNA, 22 bp, Homo sapiens
tcctcagtcacggtagcacatt

SEQ ID NO: 28904 - DNA, 22 bp, Homo sapiens
gcacagccacgtaatgtggtca

SEQ ID NO: 28905 - DNA, 22 bp, Homo sapiens
caaagtgctaggattacaggcc

SEQ ID NO: 28906 - DNA, 22 bp, Homo sapiens
ttgtgaatagtgctgcaataaa

SEQ ID NO: 28907 - DNA, 22 bp, Homo sapiens
aggtgactggtttatctggcag

SEQ ID NO: 28908 - DNA, 22 bp, Homo sapiens
tctgtcttagccatctcaggct

SEQ ID NO: 28909 - DNA, 22 bp, Homo sapiens
atctagattaggtataagagct

SEQ ID NO: 28910 - DNA, 22 bp, Homo sapiens
gtgggggctggaaatcttgcca

SEQ ID NO: 28911 - DNA, 22 bp, Homo sapiens
tgcactccaggctgggtgacag

SEQ ID NO: 28912 - DNA, 22 bp, Homo sapiens
gaggctgaggcaggaggatcac

SEQ ID NO: 28913 - DNA, 22 bp, Homo sapiens
atgtgctgagtgtgtatataca

SEQ ID NO: 28914 - DNA, 22 bp, Homo sapiens
cctgcctatgagacgttttgcc

SEQ ID NO: 28915 - DNA, 22 bp, Homo sapiens
tcagtgcacccaattctctcca

SEQ ID NO: 28916 - DNA, 22 bp, Homo sapiens
agtggctgagtgactgtgactc

SEQ ID NO: 28917 - DNA, 22 bp, Homo sapiens
gagcccaggaagtggaggctga

SEQ ID NO: 28918 - DNA, 22 bp, Homo sapiens
ccccatgaagtagggtctctga

SEQ ID NO: 28919 - DNA, 22 bp, Homo sapiens
caggaggacatactggctcaca

SEQ ID NO: 28920 - DNA, 22 bp, Homo sapiens
gagaggaagccttctgtacttg

SEQ ID NO: 28921 - DNA, 22 bp, Homo sapiens
acatctagactcttgccctctt

SEQ ID NO: 28922 - DNA, 22 bp, Homo sapiens
cagaggtagcatgctgtggctt

SEQ ID NO: 28923 - DNA, 22 bp, Homo sapiens
tgattaatatcaccaccattgg

SEQ ID NO: 28924 - DNA, 22 bp, Homo sapiens
gggagaggttacccgagcaact

SEQ ID NO: 28925 - DNA, 22 bp, Homo sapiens
gcctggattccttgtttctcag

SEQ ID NO: 28926 - DNA, 22 bp, Homo sapiens
cactgcaacctccacctcctgg

SEQ ID NO: 28927 - DNA, 22 bp, Homo sapiens
tggcccttgttcaaatatgtca

SEQ ID NO: 28928 - DNA, 22 bp, Homo sapiens
agaggcaggaggttgacttgag

SEQ ID NO: 28929 - DNA, 22 bp, Homo sapiens
gaagccttgaactgcaaacccc

SEQ ID NO: 28930 - DNA, 22 bp, Homo sapiens
atgaaatatcttgaagaaattc

SEQ ID NO: 28931 - DNA, 22 bp, Homo sapiens
caggccagggttgagaagagaa

SEQ ID NO: 28932 - DNA, 22 bp, Homo sapiens
aaggaggcctggcagatgaaga

SEQ ID NO: 28933 - DNA, 22 bp, Homo sapiens
aacagctttgtatacagtaact

SEQ ID NO: 28934 - DNA, 22 bp, Homo sapiens
tgaggaaacttacaaggcagaa

SEQ ID NO: 28935 - DNA, 22 bp, Homo sapiens
aggggaatgggtagactgttga

SEQ ID NO: 28936 - DNA, 22 bp, Homo sapiens
gctgggctgcgtcggggaagcc

SEQ ID NO: 28937 - DNA, 16 bp, Homo sapiens
tgggtgggaggagcgg

SEQ ID NO: 28938 - DNA, 19 bp, Homo sapiens
agtcctggcctgggggacc

SEQ ID NO: 28939 - DNA, 22 bp, Homo sapiens
tccaggattgtcagccagaagg

SEQ ID NO: 28940 - DNA, 22 bp, Homo sapiens
cccagttgttgccggctctgga

SEQ ID NO: 28941 - DNA, 22 bp, Homo sapiens
tgccctctttctgtacagctcc

SEQ ID NO: 28942 - DNA, 22 bp, Homo sapiens
aaagtgctgggattacaagtgt

SEQ ID NO: 28943 - DNA, 22 bp, Homo sapiens
tctcaagcttgttggtatgttt

SEQ ID NO: 28944 - DNA, 22 bp, Homo sapiens
cgccggcttgaggcaggcggca

SEQ ID NO: 28945 - DNA, 22 bp, Homo sapiens
tctcatggagtcaggagcagaa

SEQ ID NO: 28946 - DNA, 22 bp, Homo sapiens
gggggctaccgtctctggagct

SEQ ID NO: 28947 - DNA, 18 bp, Homo sapiens
tgagagcattcgaggcaa

SEQ ID NO: 28948 - DNA, 21 bp, Homo sapiens
acctgagctccacctcctgcc

SEQ ID NO: 28949 - DNA, 22 bp, Homo sapiens
ctgggatccacgggctcccaag

SEQ ID NO: 28950 - DNA, 22 bp, Homo sapiens
actgcaacacctcctgggttca

SEQ ID NO: 28951 - DNA, 22 bp, Homo sapiens
tcactgcaacctccacctcccg

SEQ ID NO: 28952 - DNA, 22 bp, Homo sapiens
accactgcccatggtgaaaact

SEQ ID NO: 28953 - DNA, 22 bp, Homo sapiens
gcctccccaagcagcagggatt

SEQ ID NO: 28954 - DNA, 22 bp, Homo sapiens
tgggctttgagctcggtcacct

SEQ ID NO: 28955 - DNA, 22 bp, Homo sapiens
gaaggaagtcattagtgcagac

SEQ ID NO: 28956 - DNA, 22 bp, Homo sapiens
tagatttgtttccttctctcca

SEQ ID NO: 28957 - DNA, 22 bp, Homo sapiens
agcattccacactgaagtctgc

SEQ ID NO: 28958 - DNA, 22 bp, Homo sapiens
tcccagagctctggaggttgga

SEQ ID NO: 28959 - DNA, 22 bp, Homo sapiens
gctgggttttcttccgggccta

SEQ ID NO: 28960 - DNA, 22 bp, Homo sapiens
cagtcaccttgaggactcagac

SEQ ID NO: 28961 - DNA, 22 bp, Homo sapiens
atgttctacagatggaaagggg

SEQ ID NO: 28962 - DNA, 22 bp, Homo sapiens
attaagtgactaaagtaatgct

SEQ ID NO: 28963 - DNA, 22 bp, Homo sapiens
aggccagcctcaggcagggacc

SEQ ID NO: 28964 - DNA, 22 bp, Homo sapiens
ctgaagagaaagggagctcttc

SEQ ID NO: 28965 - DNA, 22 bp, Homo sapiens
tgcctgcctaggaagctgtgaa

SEQ ID NO: 28966 - DNA, 22 bp, Homo sapiens
tgacagtgcgggtacatcatag

SEQ ID NO: 28967 - DNA, 22 bp, Homo sapiens
aggccagcagcatgacggcatc

SEQ ID NO: 28968 - DNA, 21 bp, Homo sapiens
atctcgggcttctcgcccagc

SEQ ID NO: 28969 - DNA, 22 bp, Homo sapiens
taagaaatttagttatagaatg

SEQ ID NO: 28970 - DNA, 22 bp, Homo sapiens
ggaggcagaatagagtgtgggt

SEQ ID NO: 28971 - DNA, 22 bp, Homo sapiens
gtcctgtgagattcatgctcaa

SEQ ID NO: 28972 - DNA, 22 bp, Homo sapiens
ttgaaattttaggccttgcaat

SEQ ID NO: 28973 - DNA, 22 bp, Homo sapiens
ttcaggaagtgctgcctggtgt

SEQ ID NO: 28974 - DNA, 22 bp, Homo sapiens
tgagctgtagcagatgctgttg

SEQ ID NO: 28975 - DNA, 22 bp, Homo sapiens
ctgtctgaatcctaagcttcct

SEQ ID NO: 28976 - DNA, 22 bp, Homo sapiens
aggtggggaggagtgtctcttt

SEQ ID NO: 28977 - DNA, 22 bp, Homo sapiens
tgagctgtctgaatggtgagga

SEQ ID NO: 28978 - DNA, 19 bp, Homo sapiens
tctgaagaattagagagca

SEQ ID NO: 28979 - DNA, 17 bp, Homo sapiens
cccgttctcttcgctgg

SEQ ID NO: 28980 - DNA, 22 bp, Homo sapiens
aactaatacattaatacatgtg

SEQ ID NO: 28981 - DNA, 22 bp, Homo sapiens
ctgtaatcccagctactcggga

SEQ ID NO: 28982 - DNA, 22 bp, Homo sapiens
atggggggatgaaggagtccaa

SEQ ID NO: 28983 - DNA, 22 bp, Homo sapiens
cacagagctggaaaggctgggc

SEQ ID NO: 28984 - DNA, 22 bp, Homo sapiens
aactatgttaataagtttcatt

SEQ ID NO: 28985 - DNA, 22 bp, Homo sapiens
agctgctgagccaggctgatgt

SEQ ID NO: 28986 - DNA, 22 bp, Homo sapiens
tctgtgctaggcagcctggccc

SEQ ID NO: 28987 - DNA, 22 bp, Homo sapiens
tccaggctttggggcaggagcg

SEQ ID NO: 28988 - DNA, 22 bp, Homo sapiens
ctgcactgacttccccggctgc

SEQ ID NO: 28989 - DNA, 22 bp, Homo sapiens
cccaggcttttctcttgcccca

SEQ ID NO: 28990 - DNA, 22 bp, Homo sapiens
caaatgaatatttccatgggtt

SEQ ID NO: 28991 - DNA, 22 bp, Homo sapiens
agatgctgctccacaggccagg

SEQ ID NO: 28992 - DNA, 22 bp, Homo sapiens
ggagagcagggaggctgctctg

SEQ ID NO: 28993 - DNA, 22 bp, Homo sapiens
cagccctcctaccctgccaggc

SEQ ID NO: 28994 - DNA, 22 bp, Homo sapiens
atcaaatacaaagggcataagg

SEQ ID NO: 28995 - DNA, 22 bp, Homo sapiens
tccctctacagggaagcgcttt

SEQ ID NO: 28996 - DNA, 22 bp, Homo sapiens
ctgggctagaaggaccaggatg

SEQ ID NO: 28997 - DNA, 19 bp, Homo sapiens
aggaatggaattaattctg

SEQ ID NO: 28998 - DNA, 22 bp, Homo sapiens
actctggccatcttggaccttg

SEQ ID NO: 28999 - DNA, 22 bp, Homo sapiens
aaggggaagagaccgcagagtc

SEQ ID NO: 29000 - DNA, 22 bp, Homo sapiens
aaagtgctgaaattacaggggt

SEQ ID NO: 29001 - DNA, 22 bp, Homo sapiens
ggaaggcagaggtgtcgtgggg

SEQ ID NO: 29002 - DNA, 22 bp, Homo sapiens
ccggtcccaggtgccccggtga

SEQ ID NO: 29003 - DNA, 22 bp, Homo sapiens
gccaccccataggtgttaggtg

SEQ ID NO: 29004 - DNA, 22 bp, Homo sapiens
tctcgctctgtcgcccaggctg

SEQ ID NO: 29005 - DNA, 22 bp, Homo sapiens
tgaggcaggacttgcataaagt

SEQ ID NO: 29006 - DNA, 22 bp, Homo sapiens
cccaggatggggctgcagttat

SEQ ID NO: 29007 - DNA, 22 bp, Homo sapiens
tgatgtggccccacttagctgt

SEQ ID NO: 29008 - DNA, 22 bp, Homo sapiens
tcaagcggactgagatactctg

SEQ ID NO: 29009 - DNA, 22 bp, Homo sapiens
ccaggttggagttcagtggcgc

SEQ ID NO: 29010 - DNA, 22 bp, Homo sapiens
tcctggcttgtcacatctacgt

SEQ ID NO: 29011 - DNA, 22 bp, Homo sapiens
gtggaatttttacctatgaatg

SEQ ID NO: 29012 - DNA, 22 bp, Homo sapiens
aagcatttcaggtagagatatt

SEQ ID NO: 29013 - DNA, 22 bp, Homo sapiens
agttggagtgaacatgagattg

SEQ ID NO: 29014 - DNA, 22 bp, Homo sapiens
ctgggaggcagaggttgcagtg

SEQ ID NO: 29015 - DNA, 22 bp, Homo sapiens
caaagtgctgggattacaggtg

SEQ ID NO: 29016 - DNA, 22 bp, Homo sapiens
tgctgagcgcatccggcggccg

SEQ ID NO: 29017 - DNA, 22 bp, Homo sapiens
cctgtggcgggggccagtgcct

SEQ ID NO: 29018 - DNA, 22 bp, Homo sapiens
aggaaggactccatggtccgtc

SEQ ID NO: 29019 - DNA, 22 bp, Homo sapiens
ttctcaagaacatatgtagggt

SEQ ID NO: 29020 - DNA, 22 bp, Homo sapiens
aggggctcctttgtgctgcgtc

SEQ ID NO: 29021 - DNA, 22 bp, Homo sapiens
agatgtgtttctagttcctgca

SEQ ID NO: 29022 - DNA, 22 bp, Homo sapiens
aattttctggtgtgtaatgaag

SEQ ID NO: 29023 - DNA, 23 bp, Homo sapiens
cagagctggctcagagctgcctg

SEQ ID NO: 29024 - DNA, 21 bp, Homo sapiens
gggcctggctgcgcaggacgg

SEQ ID NO: 29025 - DNA, 22 bp, Homo sapiens
cctagagccgcacctcctccac

SEQ ID NO: 29026 - DNA, 22 bp, Homo sapiens
tttctggcagcgggacaggggt

SEQ ID NO: 29027 - DNA, 22 bp, Homo sapiens
aataaaatggtcagttttctca

SEQ ID NO: 29028 - DNA, 22 bp, Homo sapiens
caggaacagggtgtcctggcag

SEQ ID NO: 29029 - DNA, 22 bp, Homo sapiens
cactgcactccagcccgggcaa

SEQ ID NO: 29030 - DNA, 22 bp, Homo sapiens
agttcagaggcaggagaaggct

SEQ ID NO: 29031 - DNA, 23 bp, Homo sapiens
gcagccatgttcccgtctcagct

SEQ ID NO: 29032 - DNA, 19 bp, Homo sapiens
tcctgcccaccagccaggg

SEQ ID NO: 29033 - DNA, 22 bp, Homo sapiens
gtagaggggtgattctgtgaga

SEQ ID NO: 29034 - DNA, 22 bp, Homo sapiens
ggggaaagccagccctgcttcc

SEQ ID NO: 29035 - DNA, 22 bp, Homo sapiens
gcaggctgtctaaagttagagt

SEQ ID NO: 29036 - DNA, 22 bp, Homo sapiens
tgggcgacagagcaagactccg

SEQ ID NO: 29037 - DNA, 22 bp, Homo sapiens
gctgctgcttgaaggctcggag

SEQ ID NO: 29038 - DNA, 22 bp, Homo sapiens
gaggctgaggttgcagtgagcc

SEQ ID NO: 29039 - DNA, 22 bp, Homo sapiens
ttgaataatatgcttcgttctc

SEQ ID NO: 29040 - DNA, 22 bp, Homo sapiens
tgctgtgaggttgagaaggaag

SEQ ID NO: 29041 - DNA, 22 bp, Homo sapiens
cccagctcttcaagtcaccccc

SEQ ID NO: 29042 - DNA, 22 bp, Homo sapiens
agatggggtttcatcatgttgg

SEQ ID NO: 29043 - DNA, 22 bp, Homo sapiens
tcctgggccctccggatcaggt

SEQ ID NO: 29044 - DNA, 22 bp, Homo sapiens
aggggatggagctggaaggcag

SEQ ID NO: 29045 - DNA, 22 bp, Homo sapiens
aaggctgagacagcacaggtcc

SEQ ID NO: 29046 - DNA, 22 bp, Homo sapiens
cttgcctttgtcttcaaaggct

SEQ ID NO: 29047 - DNA, 22 bp, Homo sapiens
gaccttcttgctgtgtcctaac

SEQ ID NO: 29048 - DNA, 22 bp, Homo sapiens
gggctgtgaggtgagaacttac

SEQ ID NO: 29049 - DNA, 22 bp, Homo sapiens
ttctgggcacacaggccctggt

SEQ ID NO: 29050 - DNA, 22 bp, Homo sapiens
cattgcaacttcaaactcctgg

SEQ ID NO: 29051 - DNA, 22 bp, Homo sapiens
caggagctcaagaccaccctgg

SEQ ID NO: 29052 - DNA, 22 bp, Homo sapiens
ggtgttgcagttgaagactggt

SEQ ID NO: 29053 - DNA, 22 bp, Homo sapiens
tagatctgatacaattcatctg

SEQ ID NO: 29054 - DNA, 23 bp, Homo sapiens
aagttagtttcaataaagcaatt

SEQ ID NO: 29055 - DNA, 22 bp, Homo sapiens
agaggaagtaatcaggacctgc

SEQ ID NO: 29056 - DNA, 22 bp, Homo sapiens
aaagtgctaggattacaagcgt

SEQ ID NO: 29057 - DNA, 22 bp, Homo sapiens
tcctggtgctgacacccatagc

SEQ ID NO: 29058 - DNA, 22 bp, Homo sapiens
ctgtatctgtgttggatgagtt

SEQ ID NO: 29059 - DNA, 22 bp, Homo sapiens
agcccggcttccccggttgcta

SEQ ID NO: 29060 - DNA, 22 bp, Homo sapiens
tcccagctactctagaggctga

SEQ ID NO: 29061 - DNA, 22 bp, Homo sapiens
tgtcctgtaggaggcagaacaa

SEQ ID NO: 29062 - DNA, 22 bp, Homo sapiens
agcataagttggtacagccact

SEQ ID NO: 29063 - DNA, 22 bp, Homo sapiens
tgaagactcagaagctaagata

SEQ ID NO: 29064 - DNA, 22 bp, Homo sapiens
aggaattcaagaccagctgggc

SEQ ID NO: 29065 - DNA, 22 bp, Homo sapiens
attggccatttgcatgtattat

SEQ ID NO: 29066 - DNA, 22 bp, Homo sapiens
ccttctagcaaatcaacataaa

SEQ ID NO: 29067 - DNA, 22 bp, Homo sapiens
agtggcctggagccccgcctgg

SEQ ID NO: 29068 - DNA, 22 bp, Homo sapiens
gagatggagtctttttctgtca

SEQ ID NO: 29069 - DNA, 20 bp, Homo sapiens
aactcctagcctcaagtgat

SEQ ID NO: 29070 - DNA, 22 bp, Homo sapiens
ccctggaggttgaggctgcagt

SEQ ID NO: 29071 - DNA, 22 bp, Homo sapiens
ctgggaggcggaggttgcagtg

SEQ ID NO: 29072 - DNA, 23 bp, Homo sapiens
gcagaggagcaagctggacacca

SEQ ID NO: 29073 - DNA, 22 bp, Homo sapiens
ccgtggtcacctgagctccttg

SEQ ID NO: 29074 - DNA, 22 bp, Homo sapiens
aaaatcttgtgacttaggaagg

SEQ ID NO: 29075 - DNA, 22 bp, Homo sapiens
ttgagcccaggaggcctgggtg

SEQ ID NO: 29076 - DNA, 22 bp, Homo sapiens
tcttgggcaatttctctagagg

SEQ ID NO: 29077 - DNA, 22 bp, Homo sapiens
ggcgtttcaccatgttgaccag

SEQ ID NO: 29078 - DNA, 22 bp, Homo sapiens
ttatacagggagtttccctgca

SEQ ID NO: 29079 - DNA, 23 bp, Homo sapiens
ggatggacgtgatgccttagcca

SEQ ID NO: 29080 - DNA, 22 bp, Homo sapiens
actgcactccagcctgggtgac

SEQ ID NO: 29081 - DNA, 22 bp, Homo sapiens
tcacttcccagacggggtggca

SEQ ID NO: 29082 - DNA, 22 bp, Homo sapiens
catgctgggtaaaggtggtgaa

SEQ ID NO: 29083 - DNA, 22 bp, Homo sapiens
attctggacaaggcaagctcct

SEQ ID NO: 29084 - DNA, 22 bp, Homo sapiens
gcagaggacacaggagggcaag

SEQ ID NO: 29085 - DNA, 22 bp, Homo sapiens
gccagggttcgaatccgtatgg

SEQ ID NO: 29086 - DNA, 22 bp, Homo sapiens
aggggagagttaatgtgaatgt

SEQ ID NO: 29087 - DNA, 22 bp, Homo sapiens
gcacggctaatttttgtatttt

SEQ ID NO: 29088 - DNA, 22 bp, Homo sapiens
caggctgaagtgcagtggtgtg

SEQ ID NO: 29089 - DNA, 22 bp, Homo sapiens
caaagtgctggaattacaggtg

SEQ ID NO: 29090 - DNA, 18 bp, Homo sapiens
ttcacaagggcttggttt

SEQ ID NO: 29091 - DNA, 22 bp, Homo sapiens
caaagtgctaggattacaggcg

SEQ ID NO: 29092 - DNA, 22 bp, Homo sapiens
ctctggagtgtctggccagggt

SEQ ID NO: 29093 - DNA, 22 bp, Homo sapiens
tgatctggtcctactgtgggca

SEQ ID NO: 29094 - DNA, 21 bp, Homo sapiens
agcgtcaatatcgtcaacagg

SEQ ID NO: 29095 - DNA, 22 bp, Homo sapiens
agccccttgtgggcgcacagca

SEQ ID NO: 29096 - DNA, 22 bp, Homo sapiens
ataaagtggaggtagtattcat

SEQ ID NO: 29097 - DNA, 22 bp, Homo sapiens
tttcataatactgtacatgaaa

SEQ ID NO: 29098 - DNA, 21 bp, Homo sapiens
cgtgactgggtccgtctggct

SEQ ID NO: 29099 - DNA, 22 bp, Homo sapiens
ccggctactcgggaggctgacg

SEQ ID NO: 29100 - DNA, 22 bp, Homo sapiens
gttcaagaccagcctggccaac

SEQ ID NO: 29101 - DNA, 22 bp, Homo sapiens
ttcccacattctttacattcat

SEQ ID NO: 29102 - DNA, 22 bp, Homo sapiens
agaggaggctctgggatcgtcc

SEQ ID NO: 29103 - DNA, 22 bp, Homo sapiens
gaagttctttatagcagtgtga

SEQ ID NO: 29104 - DNA, 22 bp, Homo sapiens
aaagtgctggtattacaggtgt

SEQ ID NO: 29105 - DNA, 20 bp, Homo sapiens
ttggatgtgcatggccgtgc

SEQ ID NO: 29106 - DNA, 22 bp, Homo sapiens
aaggatgattggtaatgacact

SEQ ID NO: 29107 - DNA, 22 bp, Homo sapiens
ccagcatccatgctccctcggg

SEQ ID NO: 29108 - DNA, 22 bp, Homo sapiens
tgtcctgtgattccagctcttc

SEQ ID NO: 29109 - DNA, 21 bp, Homo sapiens
tcgtgcagcagctgaggcttg

SEQ ID NO: 29110 - DNA, 22 bp, Homo sapiens
caggaaggcgcggctgtgcctg

SEQ ID NO: 29111 - DNA, 22 bp, Homo sapiens
tcacagcctggacagttgcctg

SEQ ID NO: 29112 - DNA, 20 bp, Homo sapiens
cgcccagtgcggttctgacc

SEQ ID NO: 29113 - DNA, 22 bp, Homo sapiens
gtcagtaggaacctagggtcaa

SEQ ID NO: 29114 - DNA, 22 bp, Homo sapiens
cagagcttcctgctgggcttct

SEQ ID NO: 29115 - DNA, 21 bp, Homo sapiens
cgcagagcgaacttgcggcgc

SEQ ID NO: 29116 - DNA, 22 bp, Homo sapiens
agcttgtgtttttctaagtatc

SEQ ID NO: 29117 - DNA, 18 bp, Homo sapiens
gcctgagggtcaagtgtg

SEQ ID NO: 29118 - DNA, 22 bp, Homo sapiens
ctgggaggcagaggttgcagtg

SEQ ID NO: 29119 - DNA, 23 bp, Homo sapiens
ctcaccaagcgccgccgctgtgt

SEQ ID NO: 29120 - DNA, 22 bp, Homo sapiens
cacagctgtgagaagggagcct

SEQ ID NO: 29121 - DNA, 20 bp, Homo sapiens
ttcgctgggagtggccaggc

SEQ ID NO: 29122 - DNA, 22 bp, Homo sapiens
gtggactgcgcttgagggggcc

SEQ ID NO: 29123 - DNA, 22 bp, Homo sapiens
gctcccagtctgatggaggaga

SEQ ID NO: 29124 - DNA, 22 bp, Homo sapiens
actaggggctcaggcccaggga

SEQ ID NO: 29125 - DNA, 18 bp, Homo sapiens
tttctcagactctctttc

SEQ ID NO: 29126 - DNA, 22 bp, Homo sapiens
tctatgtctcgacccaagacaa

SEQ ID NO: 29127 - DNA, 22 bp, Homo sapiens
tgagtcatgtaataatgctgct

SEQ ID NO: 29128 - DNA, 22 bp, Homo sapiens
tgttccgaccgtggggtttgat

SEQ ID NO: 29129 - DNA, 22 bp, Homo sapiens
gcagggaggtttgctgacctgg

SEQ ID NO: 29130 - DNA, 22 bp, Homo sapiens
tgtgacagcacggttcaactgc

SEQ ID NO: 29131 - DNA, 22 bp, Homo sapiens
gtcgtggagctcacagtgtgcc

SEQ ID NO: 29132 - DNA, 20 bp, Homo sapiens
tgttgattggtgtcatctca

SEQ ID NO: 29133 - DNA, 22 bp, Homo sapiens
gtgggctgcccttgaggtcagc

SEQ ID NO: 29134 - DNA, 22 bp, Homo sapiens
tgagcctgggtggtcgaggctg

SEQ ID NO: 29135 - DNA, 22 bp, Homo sapiens
gtcctggggattatagagtgtt

SEQ ID NO: 29136 - DNA, 22 bp, Homo sapiens
ggggccgaccgcggttcaggcc

SEQ ID NO: 29137 - DNA, 22 bp, Homo sapiens
gcggtcggcagaggggctctgc

SEQ ID NO: 29138 - DNA, 22 bp, Homo sapiens
ctgggaggcggaggttgcagtg

SEQ ID NO: 29139 - DNA, 22 bp, Homo sapiens
gctgggttttcttccgggccta

SEQ ID NO: 29140 - DNA, 22 bp, Homo sapiens
agggctggagccacagctggga

SEQ ID NO: 29141 - DNA, 22 bp, Homo sapiens
taggtttcagaggtgccgggaa

SEQ ID NO: 29142 - DNA, 22 bp, Homo sapiens
ttgtgaatagtgccgcaataaa

SEQ ID NO: 29143 - DNA, 22 bp, Homo sapiens
tgacttcctgcactcaggtgat

SEQ ID NO: 29144 - DNA, 21 bp, Homo sapiens
gggcctggctgcgcaggacgg

SEQ ID NO: 29145 - DNA, 17 bp, Homo sapiens
cgggcatggagggcagg

SEQ ID NO: 29146 - DNA, 20 bp, Homo sapiens
ggcagagggcctgggagaag

SEQ ID NO: 29147 - DNA, 22 bp, Homo sapiens
gggttggatcctggtggctgcc

SEQ ID NO: 29148 - DNA, 22 bp, Homo sapiens
ttcctagggcagagccgctggg

SEQ ID NO: 29149 - DNA, 22 bp, Homo sapiens
gggacaatggaggcctctctcc

SEQ ID NO: 29150 - DNA, 22 bp, Homo sapiens
gggctgagacgatggggtcttc

SEQ ID NO: 29151 - DNA, 22 bp, Homo sapiens
tccgaggccaaagctgtgaata

SEQ ID NO: 29152 - DNA, 22 bp, Homo sapiens
gccaaataagtgtccggccctc

SEQ ID NO: 29153 - DNA, 22 bp, Homo sapiens
ggagttccagaccagactggcc

SEQ ID NO: 29154 - DNA, 22 bp, Homo sapiens
tcccggcgctgggaggtgggtc

SEQ ID NO: 29155 - DNA, 22 bp, Homo sapiens
tgaacatgctgttgatggcctg

SEQ ID NO: 29156 - DNA, 22 bp, Homo sapiens
ggaccggtggcttcctcgggtc

SEQ ID NO: 29157 - DNA, 22 bp, Homo sapiens
caagcgtggctgctctgatgga

SEQ ID NO: 29158 - DNA, 22 bp, Homo sapiens
gaactttgcgcagttcccgggg

SEQ ID NO: 29159 - DNA, 22 bp, Homo sapiens
tggtctttgtccctccttgatc

SEQ ID NO: 29160 - DNA, 22 bp, Homo sapiens
aatgttacgatcaacaacacat

SEQ ID NO: 29161 - DNA, 22 bp, Homo sapiens
ataaaatttgctactgttaaat

SEQ ID NO: 29162 - DNA, 22 bp, Homo sapiens
ctgggggcagcaagaagccatg

SEQ ID NO: 29163 - DNA, 22 bp, Homo sapiens
tcctgggccctccggatcaggt

SEQ ID NO: 29164 - DNA, 22 bp, Homo sapiens
tacagctgctggtgctccatgc

SEQ ID NO: 29165 - DNA, 22 bp, Homo sapiens
acccagtctggagtgcagtgac

SEQ ID NO: 29166 - DNA, 22 bp, Homo sapiens
gagctgtgtatgcatcattctg

SEQ ID NO: 29167 - DNA, 21 bp, Homo sapiens
gggcagaggggcctcctgggt

SEQ ID NO: 29168 - DNA, 22 bp, Homo sapiens
agatttccagaccaatttctca

SEQ ID NO: 29169 - DNA, 22 bp, Homo sapiens
tctcttgagctcagttctgatg

SEQ ID NO: 29170 - DNA, 22 bp, Homo sapiens
tacagctgcaagggtttctggg

SEQ ID NO: 29171 - DNA, 22 bp, Homo sapiens
ttccaactttgtcatatattat

SEQ ID NO: 29172 - DNA, 22 bp, Homo sapiens
tcaggaggtccgcccgggaggg

SEQ ID NO: 29173 - DNA, 22 bp, Homo sapiens
ggtcccaggttgacagggagac

SEQ ID NO: 29174 - DNA, 22 bp, Homo sapiens
ctgaggggtcgtgggagcccag

SEQ ID NO: 29175 - DNA, 22 bp, Homo sapiens
tttgtggcaggagcggagaccg

SEQ ID NO: 29176 - DNA, 22 bp, Homo sapiens
ctcctgggaaaggctggacaca

SEQ ID NO: 29177 - DNA, 22 bp, Homo sapiens
agatttggtgtctggttgatat

SEQ ID NO: 29178 - DNA, 22 bp, Homo sapiens
tagatatttctactgtggatta

SEQ ID NO: 29179 - DNA, 22 bp, Homo sapiens
ttgctctgactggagtgcagtg

SEQ ID NO: 29180 - DNA, 22 bp, Homo sapiens
ggctcctgggggtgctcctgcc

SEQ ID NO: 29181 - DNA, 22 bp, Homo sapiens
gcttggaagtaggattgggaga

SEQ ID NO: 29182 - DNA, 22 bp, Homo sapiens
ctgcgggctgtcaggcgtgcca

SEQ ID NO: 29183 - DNA, 22 bp, Homo sapiens
cggaagagggacagcgccagcc

SEQ ID NO: 29184 - DNA, 22 bp, Homo sapiens
atgggctgtccattgctggctg

SEQ ID NO: 29185 - DNA, 22 bp, Homo sapiens
ttccatttggcacttcactgag

SEQ ID NO: 29186 - DNA, 22 bp, Homo sapiens
aggctgaggcaagaggatcact

SEQ ID NO: 29187 - DNA, 22 bp, Homo sapiens
tgttatatctaaatagccacat

SEQ ID NO: 29188 - DNA, 22 bp, Homo sapiens
gctgggacaacaggtgagcacc

SEQ ID NO: 29189 - DNA, 22 bp, Homo sapiens
ggggctgaacctggaggtggtc

SEQ ID NO: 29190 - DNA, 22 bp, Homo sapiens
tttgaagactactgggagtgaa

SEQ ID NO: 29191 - DNA, 22 bp, Homo sapiens
taactaggattacaagcgtgcg

SEQ ID NO: 29192 - DNA, 22 bp, Homo sapiens
ccagatatcactgccgtgttgt

SEQ ID NO: 29193 - DNA, 22 bp, Homo sapiens
ggcttggaaactagagtgtgca

SEQ ID NO: 29194 - DNA, 22 bp, Homo sapiens
ttttgacaatgctaatctcaat

SEQ ID NO: 29195 - DNA, 22 bp, Homo sapiens
acaagcgggccacagtgctggt

SEQ ID NO: 29196 - DNA, 22 bp, Homo sapiens
tgggcagggagctggaaccaca

SEQ ID NO: 29197 - DNA, 22 bp, Homo sapiens
tgtgggacctcagagggtcccc

SEQ ID NO: 29198 - DNA, 22 bp, Homo sapiens
tccttaggcaatttgggagagt

SEQ ID NO: 29199 - DNA, 22 bp, Homo sapiens
aaaaagtattggccatggttga

SEQ ID NO: 29200 - DNA, 22 bp, Homo sapiens
gaggagggagctggaagctctt

SEQ ID NO: 29201 - DNA, 22 bp, Homo sapiens
ctgaggagaggtggcctgtgtt

SEQ ID NO: 29202 - DNA, 22 bp, Homo sapiens
gcgggccaccttggagagcgct

SEQ ID NO: 29203 - DNA, 22 bp, Homo sapiens
atctgtcttttaatgttaatgc

SEQ ID NO: 29204 - DNA, 22 bp, Homo sapiens
tgagcctgggagatggaggctg

SEQ ID NO: 29205 - DNA, 22 bp, Homo sapiens
gaggggctgccctggtgtcagg

SEQ ID NO: 29206 - DNA, 22 bp, Homo sapiens
cttggggcagcccaggctgagc

SEQ ID NO: 29207 - DNA, 22 bp, Homo sapiens
ctcctaggtaacagggtggttt

SEQ ID NO: 29208 - DNA, 21 bp, Homo sapiens
gctcctggtgctgcgtggcgc

SEQ ID NO: 29209 - DNA, 22 bp, Homo sapiens
gggaagagggagctggaatgat

SEQ ID NO: 29210 - DNA, 22 bp, Homo sapiens
gggggactggaccgtcctgggt

SEQ ID NO: 29211 - DNA, 22 bp, Homo sapiens
actgtactccagcctgggaaac

SEQ ID NO: 29212 - DNA, 22 bp, Homo sapiens
tgagccatgggactccaaggga

SEQ ID NO: 29213 - DNA, 22 bp, Homo sapiens
gcccagtagttcaaggttgcag

SEQ ID NO: 29214 - DNA, 22 bp, Homo sapiens
ggagagcttggagtgcgatttt

SEQ ID NO: 29215 - DNA, 20 bp, Homo sapiens
aactcctagcctcaagtgat

SEQ ID NO: 29216 - DNA, 22 bp, Homo sapiens
tccgggagctgaacgtcttgcg

SEQ ID NO: 29217 - DNA, 22 bp, Homo sapiens
gattcactcatattttacgttt

SEQ ID NO: 29218 - DNA, 23 bp, Homo sapiens
ctggggctttcaaatctgggcag

SEQ ID NO: 29219 - DNA, 22 bp, Homo sapiens
ttagggttacaccagcctcctg

SEQ ID NO: 29220 - DNA, 22 bp, Homo sapiens
tgctcattggcgatctgaggga

SEQ ID NO: 29221 - DNA, 22 bp, Homo sapiens
gccaaactacaagttaaatttt

SEQ ID NO: 29222 - DNA, 22 bp, Homo sapiens
cggaggttgaggctgcagtgag

SEQ ID NO: 29223 - DNA, 22 bp, Homo sapiens
ggaggcagaatagagtgtgggt

SEQ ID NO: 29224 - DNA, 22 bp, Homo sapiens
cttagagatgggttttacttag

SEQ ID NO: 29225 - DNA, 22 bp, Homo sapiens
tctgttttgcataatgttcttt

SEQ ID NO: 29226 - DNA, 22 bp, Homo sapiens
attgtgtcctcattgaccttca

SEQ ID NO: 29227 - DNA, 22 bp, Homo sapiens
tgggattcaccatgggcttcag

SEQ ID NO: 29228 - DNA, 22 bp, Homo sapiens
gggagctggagctggaagactc

SEQ ID NO: 29229 - DNA, 22 bp, Homo sapiens
cttggtctataggagagattgt

SEQ ID NO: 29230 - DNA, 23 bp, Homo sapiens
ggctgggagctccgggtgcacgt

SEQ ID NO: 29231 - DNA, 22 bp, Homo sapiens
tatttcttttcgtgacttattg

SEQ ID NO: 29232 - DNA, 22 bp, Homo sapiens
ctgggcgcgtcccctgaggcgg

SEQ ID NO: 29233 - DNA, 22 bp, Homo sapiens
tgggagaaagaaccctgagtga

SEQ ID NO: 29234 - DNA, 22 bp, Homo sapiens
gagctgagaagcagcgcttgat

SEQ ID NO: 29235 - DNA, 22 bp, Homo sapiens
ggctagggatctagaccaggac

SEQ ID NO: 29236 - DNA, 22 bp, Homo sapiens
caggaagaccagggctgtggct

SEQ ID NO: 29237 - DNA, 22 bp, Homo sapiens
agcgagtgggtcagcgttgcag

SEQ ID NO: 29238 - DNA, 22 bp, Homo sapiens
ggctgggctccgggagcatgcg

SEQ ID NO: 29239 - DNA, 22 bp, Homo sapiens
tcagggattaaggtcaaaggtg

SEQ ID NO: 29240 - DNA, 23 bp, Homo sapiens
tgctggagaagcaaagttctgag

SEQ ID NO: 29241 - DNA, 22 bp, Homo sapiens
taggcctggatctctgggagca

SEQ ID NO: 29242 - DNA, 22 bp, Homo sapiens
ttgtgaatggtgccgcaataaa

SEQ ID NO: 29243 - DNA, 22 bp, Homo sapiens
ttaccaaatgaaatagagattt

SEQ ID NO: 29244 - DNA, 22 bp, Homo sapiens
gtgtcaataaatagcggtgtgg

SEQ ID NO: 29245 - DNA, 22 bp, Homo sapiens
ggggacctgggcttcaagggtt

SEQ ID NO: 29246 - DNA, 19 bp, Homo sapiens
agcggttctcaaagtcagg

SEQ ID NO: 29247 - DNA, 22 bp, Homo sapiens
ttgtgctcctatgagaatctaa

SEQ ID NO: 29248 - DNA, 22 bp, Homo sapiens
ccagaaaaatcctcccttgtcc

SEQ ID NO: 29249 - DNA, 22 bp, Homo sapiens
gtgaccatcatctcagctagtt

SEQ ID NO: 29250 - DNA, 22 bp, Homo sapiens
gtctgctcatgctaccgcgggc

SEQ ID NO: 29251 - DNA, 22 bp, Homo sapiens
tagcacagcttcttgatgtcac

SEQ ID NO: 29252 - DNA, 22 bp, Homo sapiens
aatattatcaaaagctttttca

SEQ ID NO: 29253 - DNA, 22 bp, Homo sapiens
tgatctggtcctactgtgggca

SEQ ID NO: 29254 - DNA, 21 bp, Homo sapiens
ccgccgctgatagctctgggc

SEQ ID NO: 29255 - DNA, 22 bp, Homo sapiens
cctggggccccgagccagaagc

SEQ ID NO: 29256 - DNA, 22 bp, Homo sapiens
acagattcactgcactggccat

SEQ ID NO: 29257 - DNA, 22 bp, Homo sapiens
gggaggttgaggctgcagtgag

SEQ ID NO: 29258 - DNA, 22 bp, Homo sapiens
cacagctgaagtagccatgtgg

SEQ ID NO: 29259 - DNA, 22 bp, Homo sapiens
ttgtgctcctgtgagaatctag

SEQ ID NO: 29260 - DNA, 22 bp, Homo sapiens
tgatcagcatcttcccagctcg

SEQ ID NO: 29261 - DNA, 22 bp, Homo sapiens
caggaaagggatgggctgccac

SEQ ID NO: 29262 - DNA, 22 bp, Homo sapiens
ggaggggatttagtagatgcta

SEQ ID NO: 29263 - DNA, 21 bp, Homo sapiens
acataggcgaatgttcgggag

SEQ ID NO: 29264 - DNA, 22 bp, Homo sapiens
taaagattgctcaaaactgtga

SEQ ID NO: 29265 - DNA, 22 bp, Homo sapiens
ggggcaggagcccttcttcagc

SEQ ID NO: 29266 - DNA, 22 bp, Homo sapiens
gggaggttctgttcgcacttga

SEQ ID NO: 29267 - DNA, 22 bp, Homo sapiens
gaggcctgggcaagggggtctg

SEQ ID NO: 29268 - DNA, 22 bp, Homo sapiens
aaaaatcacttttataggcagc

SEQ ID NO: 29269 - DNA, 23 bp, Homo sapiens
gttttacaggtgagaaaatggag

SEQ ID NO: 29270 - DNA, 22 bp, Homo sapiens
ttccagttcactccatttctgg

SEQ ID NO: 29271 - DNA, 22 bp, Homo sapiens
tttgaagggcacgacaatagtt

SEQ ID NO: 29272 - DNA, 22 bp, Homo sapiens
ggcaaggggtcaggctgagaca

SEQ ID NO: 29273 - DNA, 22 bp, Homo sapiens
actgttttctgtaaagggccag

SEQ ID NO: 29274 - DNA, 22 bp, Homo sapiens
gggcctgtgtgttcaggagcct

SEQ ID NO: 29275 - DNA, 22 bp, Homo sapiens
tgggcaggggccctgcttccgt

SEQ ID NO: 29276 - DNA, 22 bp, Homo sapiens
tctgttgcaatgtgcatggtga

SEQ ID NO: 29277 - DNA, 22 bp, Homo sapiens
gacagctgcatcctcagacaca

SEQ ID NO: 29278 - DNA, 22 bp, Homo sapiens
agaggaagtaatcaggacctgc

SEQ ID NO: 29279 - DNA, 22 bp, Homo sapiens
gggctccgcccttggctgagct

SEQ ID NO: 29280 - DNA, 22 bp, Homo sapiens
agagggtgggcacgtgatggat

SEQ ID NO: 29281 - DNA, 22 bp, Homo sapiens
aagacacaatgtagcccagcac

SEQ ID NO: 29282 - DNA, 20 bp, Homo sapiens
gggcagagccagccagtccc

SEQ ID NO: 29283 - DNA, 22 bp, Homo sapiens
gagacctcttggtatcgctagg

SEQ ID NO: 29284 - DNA, 22 bp, Homo sapiens
tgtttcttacgtttttagaggc

SEQ ID NO: 29285 - DNA, 22 bp, Homo sapiens
caggctggagtgcagtggggcg

SEQ ID NO: 29286 - DNA, 22 bp, Homo sapiens
gggccggagctgggtcccgcgc

SEQ ID NO: 29287 - DNA, 22 bp, Homo sapiens
tttacaacccaagtccagagag

SEQ ID NO: 29288 - DNA, 22 bp, Homo sapiens
ggctgtggcagctggaagtggt

SEQ ID NO: 29289 - DNA, 22 bp, Homo sapiens
cattacagaatatgtaatgatc

SEQ ID NO: 29290 - DNA, 22 bp, Homo sapiens
caccaggaggacaggcccctac

SEQ ID NO: 29291 - DNA, 22 bp, Homo sapiens
caagccattctcctgcctcagc

SEQ ID NO: 29292 - DNA, 22 bp, Homo sapiens
aaagcctcccaggttatgagta

SEQ ID NO: 29293 - DNA, 22 bp, Homo sapiens
tgaggcactccaggatgctgtt

SEQ ID NO: 29294 - DNA, 22 bp, Homo sapiens
ggctgggcaggtctgcacaggg

SEQ ID NO: 29295 - DNA, 22 bp, Homo sapiens
taagggttcagaatgcagtggt

SEQ ID NO: 29296 - DNA, 22 bp, Homo sapiens
gggaggcacgaggcgcgcagtg

SEQ ID NO: 29297 - DNA, 22 bp, Homo sapiens
ccaggctggagtgcaatggcat

SEQ ID NO: 29298 - DNA, 22 bp, Homo sapiens
gagagcaggaggcagcgggacg

SEQ ID NO: 29299 - DNA, 22 bp, Homo sapiens
tggagaagattggtcaccattc

SEQ ID NO: 29300 - DNA, 22 bp, Homo sapiens
gggaaactttcacaatgtccag

SEQ ID NO: 29301 - DNA, 22 bp, Homo sapiens
ccctcccagatgggcttgaggt

SEQ ID NO: 29302 - DNA, 22 bp, Homo sapiens
ggtgcagaggagccagctgggg

SEQ ID NO: 29303 - DNA, 22 bp, Homo sapiens
tgttgatttgtgggctgcaaaa

SEQ ID NO: 29304 - DNA, 22 bp, Homo sapiens
aagttcctgacattgccatggc

SEQ ID NO: 29305 - DNA, 22 bp, Homo sapiens
actaggggctcaggcccaggga

SEQ ID NO: 29306 - DNA, 19 bp, Homo sapiens
gcctcatttccacctcccc

SEQ ID NO: 29307 - DNA, 22 bp, Homo sapiens
agacccaggattggggctgccg

SEQ ID NO: 29308 - DNA, 22 bp, Homo sapiens
acgggccttctcttcaggcgag

SEQ ID NO: 29309 - DNA, 22 bp, Homo sapiens
tggctccgttgtacaggctgga

SEQ ID NO: 29310 - DNA, 22 bp, Homo sapiens
tggtatgaccgtggtgcaagca

SEQ ID NO: 29311 - DNA, 22 bp, Homo sapiens
agaaaacataggagacaggaaa

SEQ ID NO: 29312 - DNA, 17 bp, Homo sapiens
cgggcatggagggcagg

SEQ ID NO: 29313 - DNA, 22 bp, Homo sapiens
cagcagcagtgttctagaatct

SEQ ID NO: 29314 - DNA, 20 bp, Homo sapiens
tgatatggtttggctgtgtt

SEQ ID NO: 29315 - DNA, 22 bp, Homo sapiens
agaggccggccgagcccatggg

SEQ ID NO: 29316 - DNA, 22 bp, Homo sapiens
gagacacaggcacagaagaggc

SEQ ID NO: 29317 - DNA, 22 bp, Homo sapiens
gagcgcacagaaggaagcagcc

SEQ ID NO: 29318 - DNA, 22 bp, Homo sapiens
cccacagtgatcgcattcgtac

SEQ ID NO: 29319 - DNA, 22 bp, Homo sapiens
gcagctgacatctggctgggcc

SEQ ID NO: 29320 - DNA, 18 bp, Homo sapiens
gatatggaaggccatgcc

SEQ ID NO: 29321 - DNA, 22 bp, Homo sapiens
ggcaaggggtcaggctgagaca

SEQ ID NO: 29322 - DNA, 19 bp, Homo sapiens
ggcttcgaggctggggaag

SEQ ID NO: 29323 - DNA, 22 bp, Homo sapiens
cctacagttatattcttgattg

SEQ ID NO: 29324 - DNA, 22 bp, Homo sapiens
tttattctgtgctacatgaaga

SEQ ID NO: 29325 - DNA, 22 bp, Homo sapiens
ggagagcagggaggctgctctg

SEQ ID NO: 29326 - DNA, 22 bp, Homo sapiens
ctaggaccactgtaacaaagta

SEQ ID NO: 29327 - DNA, 22 bp, Homo sapiens
ccccatgaagtagggtctctga

SEQ ID NO: 29328 - DNA, 22 bp, Homo sapiens
gggccatgagaggttcatcaac

SEQ ID NO: 29329 - DNA, 22 bp, Homo sapiens
ggcgcggtgactcagcctcgct

SEQ ID NO: 29330 - DNA, 22 bp, Homo sapiens
tgttttaagggtcaactgtcac

SEQ ID NO: 29331 - DNA, 22 bp, Homo sapiens
gcagaggacacaggagggcaag

SEQ ID NO: 29332 - DNA, 22 bp, Homo sapiens
ggatgttgattgaatggccatt

SEQ ID NO: 29333 - DNA, 22 bp, Homo sapiens
tggcccgaagatccgagggtca

SEQ ID NO: 29334 - DNA, 21 bp, Homo sapiens
ccgccgctgatagctctgggc

SEQ ID NO: 29335 - DNA, 22 bp, Homo sapiens
caggaaggcgcggctgtgcctg

SEQ ID NO: 29336 - DNA, 22 bp, Homo sapiens
tctcatttacttccacaggctg

SEQ ID NO: 29337 - DNA, 23 bp, Homo sapiens
cagagctggcttcatgggtgtgc

SEQ ID NO: 29338 - DNA, 22 bp, Homo sapiens
aggccttaccatagctgtagca

SEQ ID NO: 29339 - DNA, 22 bp, Homo sapiens
gtggagagagataagcctggtc

SEQ ID NO: 29340 - DNA, 22 bp, Homo sapiens
catgtaaagaatttcacacaag

SEQ ID NO: 29341 - DNA, 22 bp, Homo sapiens
ccctcccaggagtggccagaga

SEQ ID NO: 29342 - DNA, 22 bp, Homo sapiens
agagggcattaactctgtcttg

SEQ ID NO: 29343 - DNA, 22 bp, Homo sapiens
tgaggcaggagttcaggctgcg

SEQ ID NO: 29344 - DNA, 22 bp, Homo sapiens
tcaggctcaggttaggggccaa

SEQ ID NO: 29345 - DNA, 22 bp, Homo sapiens
gctgggacaacaggtgagcacc

SEQ ID NO: 29346 - DNA, 22 bp, Homo sapiens
ggaggctgagaggtcgcagtgg

SEQ ID NO: 29347 - DNA, 22 bp, Homo sapiens
caggctggagtgcaatgacgcc

SEQ ID NO: 29348 - DNA, 21 bp, Homo sapiens
tggtaggtactggcttcaggc

SEQ ID NO: 29349 - DNA, 22 bp, Homo sapiens
ccacagtcctggcttctgtctg

SEQ ID NO: 29350 - DNA, 21 bp, Homo sapiens
ggtgctcgctgatgaggagtg

SEQ ID NO: 29351 - DNA, 22 bp, Homo sapiens
acatgtaatacatccagcaata

SEQ ID NO: 29352 - DNA, 22 bp, Homo sapiens
ccaggctgctgttggtgtccgc

SEQ ID NO: 29353 - DNA, 22 bp, Homo sapiens
ctggagagaatgtggaatgatt

SEQ ID NO: 29354 - DNA, 22 bp, Homo sapiens
tgatattttatgagctttcata

SEQ ID NO: 29355 - DNA, 22 bp, Homo sapiens
gagccaggaggcagagactgca

SEQ ID NO: 29356 - DNA, 22 bp, Homo sapiens
gccagatttacagatttgccct

SEQ ID NO: 29357 - DNA, 20 bp, Homo sapiens
gttaggaggttggacatgga

SEQ ID NO: 29358 - DNA, 22 bp, Homo sapiens
tttgaagactactgggagtgaa

SEQ ID NO: 29359 - DNA, 18 bp, Homo sapiens
gctctgcaggtgctcggt

SEQ ID NO: 29360 - DNA, 22 bp, Homo sapiens
ctggggaacgcagcgagcagcg

SEQ ID NO: 29361 - DNA, 22 bp, Homo sapiens
tttccctttagcctgagaatcc

SEQ ID NO: 29362 - DNA, 22 bp, Homo sapiens
tagatacctgctggacctcatt

SEQ ID NO: 29363 - DNA, 22 bp, Homo sapiens
ccagaaaaatcctcccttgtcc

SEQ ID NO: 29364 - DNA, 22 bp, Homo sapiens
aatgcaatgcagcacctccttg

SEQ ID NO: 29365 - DNA, 22 bp, Homo sapiens
gctgtgtatcagatgccacggg

SEQ ID NO: 29366 - DNA, 22 bp, Homo sapiens
gccatgggcaaatgcagagctg

SEQ ID NO: 29367 - DNA, 22 bp, Homo sapiens
cccgtgtgtgcgaggctcccgc

SEQ ID NO: 29368 - DNA, 22 bp, Homo sapiens
ggaaacttggatgccagcactc

SEQ ID NO: 29369 - DNA, 22 bp, Homo sapiens
ggcgccaggcttcactttaaag

SEQ ID NO: 29370 - DNA, 22 bp, Homo sapiens
gtgacaatattagctcaggggc

SEQ ID NO: 29371 - DNA, 22 bp, Homo sapiens
aaggtccttttgcagtgtgatc

SEQ ID NO: 29372 - DNA, 18 bp, Homo sapiens
tccctcagaattatagaa

SEQ ID NO: 29373 - DNA, 22 bp, Homo sapiens
acaaacagagttgaaaaatagg

SEQ ID NO: 29374 - DNA, 22 bp, Homo sapiens
tcgcgggttgcacatggccatc

SEQ ID NO: 29375 - DNA, 22 bp, Homo sapiens
gaggttggggctgcagtgagct

SEQ ID NO: 29376 - DNA, 22 bp, Homo sapiens
ggaggaggggtgactgaatgct

SEQ ID NO: 29377 - DNA, 22 bp, Homo sapiens
ctgggcacagcgttgggctctt

SEQ ID NO: 29378 - DNA, 22 bp, Homo sapiens
gcaggaggttgagccaggactg

SEQ ID NO: 29379 - DNA, 22 bp, Homo sapiens
gaccttcttgctgtgtcctaac

SEQ ID NO: 29380 - DNA, 22 bp, Homo sapiens
ctgggcctggggctgttgagag

SEQ ID NO: 29381 - DNA, 22 bp, Homo sapiens
ctcattccatgtgtattttgag

SEQ ID NO: 29382 - DNA, 22 bp, Homo sapiens
atatatttgagaatattcatga

SEQ ID NO: 29383 - DNA, 22 bp, Homo sapiens
cctcattctcgcgtgtgtttct

SEQ ID NO: 29384 - DNA, 22 bp, Homo sapiens
gagatatgttggcagctggtat

SEQ ID NO: 29385 - DNA, 22 bp, Homo sapiens
tgtcttcaggagtaaatatcat

SEQ ID NO: 29386 - DNA, 22 bp, Homo sapiens
aagaataagaggatttagaaca

SEQ ID NO: 29387 - DNA, 22 bp, Homo sapiens
agcgccactgcactccagcctg

SEQ ID NO: 29388 - DNA, 22 bp, Homo sapiens
tgcacgtgtgagcattcacatg

SEQ ID NO: 29389 - DNA, 22 bp, Homo sapiens
ccaggctggagtatagtggcgc

SEQ ID NO: 29390 - DNA, 23 bp, Homo sapiens
agcttttaggtggaaatggcact

SEQ ID NO: 29391 - DNA, 22 bp, Homo sapiens
agggccagcactcctggcagga

SEQ ID NO: 29392 - DNA, 22 bp, Homo sapiens
ggagagggtaggggtcctgccc

SEQ ID NO: 29393 - DNA, 22 bp, Homo sapiens
gcctccagcccacgcaggcctg

SEQ ID NO: 29394 - DNA, 22 bp, Homo sapiens
aggagcagaccgtagtcctgca

SEQ ID NO: 29395 - DNA, 22 bp, Homo sapiens
cacccaggttggagtgcagtgg

SEQ ID NO: 29396 - DNA, 22 bp, Homo sapiens
atttaagggatttggagaccaa

SEQ ID NO: 29397 - DNA, 21 bp, Homo sapiens
ggagtttttctggaagggact

SEQ ID NO: 29398 - DNA, 22 bp, Homo sapiens
gggagctgagctggaagagaat

SEQ ID NO: 29399 - DNA, 22 bp, Homo sapiens
tgtccgcggtttgcgttgtggg

SEQ ID NO: 29400 - DNA, 22 bp, Homo sapiens
cccaggaattggaggctgcagt

SEQ ID NO: 29401 - DNA, 22 bp, Homo sapiens
tcagtttttctatactttgtag

SEQ ID NO: 29402 - DNA, 22 bp, Homo sapiens
ggcttcgcagctcggcagccgc

SEQ ID NO: 29403 - DNA, 22 bp, Homo sapiens
ctgaggagaggtggcctgtgtt

SEQ ID NO: 29404 - DNA, 22 bp, Homo sapiens
cagagctggtgtgtcctggcat

SEQ ID NO: 29405 - DNA, 22 bp, Homo sapiens
ggagtgaatcactagatgcaga

SEQ ID NO: 29406 - DNA, 22 bp, Homo sapiens
agagagcccgggccagggcaca

SEQ ID NO: 29407 - DNA, 22 bp, Homo sapiens
cacccaggctggaatgcagtgg

SEQ ID NO: 29408 - DNA, 22 bp, Homo sapiens
cacccaggctggagtgcagtga

SEQ ID NO: 29409 - DNA, 18 bp, Homo sapiens
ggtgagggagctggaagc

SEQ ID NO: 29410 - DNA, 22 bp, Homo sapiens
gaggaggcttccgggaggcacg

SEQ ID NO: 29411 - DNA, 22 bp, Homo sapiens
ccacagaattctgtctccagga

SEQ ID NO: 29412 - DNA, 22 bp, Homo sapiens
acccagggctcaagcgtaggca

SEQ ID NO: 29413 - DNA, 22 bp, Homo sapiens
taggtagctttggcgtttcttg

SEQ ID NO: 29414 - DNA, 22 bp, Homo sapiens
cactctcacatgccctgtcagt

SEQ ID NO: 29415 - DNA, 22 bp, Homo sapiens
tgaagaaacgcagagaggtagg

SEQ ID NO: 29416 - DNA, 22 bp, Homo sapiens
gagcaccgcctccacgatgccc

SEQ ID NO: 29417 - DNA, 22 bp, Homo sapiens
gagcctggagctggaacgaagc

SEQ ID NO: 29418 - DNA, 22 bp, Homo sapiens
gggcagagagctggaactcctt

SEQ ID NO: 29419 - DNA, 22 bp, Homo sapiens
tcactgcaacctccacctcccg

SEQ ID NO: 29420 - DNA, 22 bp, Homo sapiens
tgagcttccctcctgcactaca

SEQ ID NO: 29421 - DNA, 22 bp, Homo sapiens
tagctcaaaggttaagtgtgga

SEQ ID NO: 29422 - DNA, 17 bp, Homo sapiens
ggctgcagtccaggagg

SEQ ID NO: 29423 - DNA, 22 bp, Homo sapiens
cacatgaaggctggggtcgtga

SEQ ID NO: 29424 - DNA, 22 bp, Homo sapiens
tgcaaaggtttgtgcttggaaa

SEQ ID NO: 29425 - DNA, 22 bp, Homo sapiens
gctgtggcctggcgcagagctg

SEQ ID NO: 29426 - DNA, 22 bp, Homo sapiens
actagaaagaagttttttgaga

SEQ ID NO: 29427 - DNA, 22 bp, Homo sapiens
catggcactgagcaggtatgca

SEQ ID NO: 29428 - DNA, 22 bp, Homo sapiens
cctgagagcattccacactgaa

SEQ ID NO: 29429 - DNA, 22 bp, Homo sapiens
taacaaagtattgtttgtgtat

SEQ ID NO: 29430 - DNA, 18 bp, Homo sapiens
aggcttacagcagcaggc

SEQ ID NO: 29431 - DNA, 22 bp, Homo sapiens
ttcctcaggctgctttcacata

SEQ ID NO: 29432 - DNA, 22 bp, Homo sapiens
tcaggaggcggaggttgcagtg

SEQ ID NO: 29433 - DNA, 22 bp, Homo sapiens
atattacacacggtatcacggg

SEQ ID NO: 29434 - DNA, 22 bp, Homo sapiens
tccattatacttctgattcaaa

SEQ ID NO: 29435 - DNA, 22 bp, Homo sapiens
ggcctcgcggcttctggtggct

SEQ ID NO: 29436 - DNA, 22 bp, Homo sapiens
aggctgtgtggataatattggg

SEQ ID NO: 29437 - DNA, 22 bp, Homo sapiens
ctttaaggtgatgagagatgct

SEQ ID NO: 29438 - DNA, 22 bp, Homo sapiens
ccgcggggcgtgggctcttacc

SEQ ID NO: 29439 - DNA, 22 bp, Homo sapiens
gtagaccatttatctggggagt

SEQ ID NO: 29440 - DNA, 22 bp, Homo sapiens
agttttcattaccatgctgcaa

SEQ ID NO: 29441 - DNA, 22 bp, Homo sapiens
ggcggtctcagcaccctcttgg

SEQ ID NO: 29442 - DNA, 22 bp, Homo sapiens
ggaggctgaggcaggcggatca

SEQ ID NO: 29443 - DNA, 22 bp, Homo sapiens
ggcttagcaactcctgaggctc

SEQ ID NO: 29444 - DNA, 22 bp, Homo sapiens
agccagggacgctgcaggctac

SEQ ID NO: 29445 - DNA, 22 bp, Homo sapiens
tgttcctgcaaggaactggtgc

SEQ ID NO: 29446 - DNA, 22 bp, Homo sapiens
gaggcagaggttgcagtgagct

SEQ ID NO: 29447 - DNA, 20 bp, Homo sapiens
ggcagagggcctgggagaag

SEQ ID NO: 29448 - DNA, 22 bp, Homo sapiens
tcactgcaagctccacctcccg

SEQ ID NO: 29449 - DNA, 22 bp, Homo sapiens
ctcagcactttggaaggctgat

SEQ ID NO: 29450 - DNA, 20 bp, Homo sapiens
cattggacttggcttcatgg

SEQ ID NO: 29451 - DNA, 22 bp, Homo sapiens
aggcaatcccctgaggatactt

SEQ ID NO: 29452 - DNA, 22 bp, Homo sapiens
tgaggcaggaggttgagaactg

SEQ ID NO: 29453 - DNA, 22 bp, Homo sapiens
cgggcgcactccgggcagctgt

SEQ ID NO: 29454 - DNA, 22 bp, Homo sapiens
gcaccgagaaggaagcatgcct

SEQ ID NO: 29455 - DNA, 22 bp, Homo sapiens
agcaggaaggggatgatgggca

SEQ ID NO: 29456 - DNA, 22 bp, Homo sapiens
tggtattacttctagacacaag

SEQ ID NO: 29457 - DNA, 22 bp, Homo sapiens
aggatttctgtgcctggaaaat

SEQ ID NO: 29458 - DNA, 22 bp, Homo sapiens
caccgcggagtgatggagaaac

SEQ ID NO: 29459 - DNA, 22 bp, Homo sapiens
cagcgtctcgttgtgggcctcg

SEQ ID NO: 29460 - DNA, 20 bp, Homo sapiens
ctgcgggctcggccgacccc

SEQ ID NO: 29461 - DNA, 22 bp, Homo sapiens
aggagaagccaagttgtgagca

SEQ ID NO: 29462 - DNA, 22 bp, Homo sapiens
gaggagggagctggaagctctt

SEQ ID NO: 29463 - DNA, 22 bp, Homo sapiens
gtgcacatcgtgcaggtttgtt

SEQ ID NO: 29464 - DNA, 22 bp, Homo sapiens
caagtctgacctctgggtgaag

SEQ ID NO: 29465 - DNA, 22 bp, Homo sapiens
gaggcacagagtaggtgcacac

SEQ ID NO: 29466 - DNA, 22 bp, Homo sapiens
accctccccaagaggtcgtgcc

SEQ ID NO: 29467 - DNA, 22 bp, Homo sapiens
aggctctgtcaggcggagcagc

SEQ ID NO: 29468 - DNA, 22 bp, Homo sapiens
gagacgtggcctttgcctgagc

SEQ ID NO: 29469 - DNA, 22 bp, Homo sapiens
tcactgcaacctccacctcctg

SEQ ID NO: 29470 - DNA, 22 bp, Homo sapiens
gtatttggaaaccaccagtgcc

SEQ ID NO: 29471 - DNA, 22 bp, Homo sapiens
ctctccattccctacagttttc

SEQ ID NO: 29472 - DNA, 22 bp, Homo sapiens
cactgcaagctccgcctcctgg

SEQ ID NO: 29473 - DNA, 22 bp, Homo sapiens
ctgtggctctcagaggctgctg

SEQ ID NO: 29474 - DNA, 22 bp, Homo sapiens
ccactattactgtgtggcagtc

SEQ ID NO: 29475 - DNA, 22 bp, Homo sapiens
gcagttaaaaataaaccttcat

SEQ ID NO: 29476 - DNA, 22 bp, Homo sapiens
gaccagtcattactcatgccct

SEQ ID NO: 29477 - DNA, 22 bp, Homo sapiens
caccgaggctggagtgcagtgg

SEQ ID NO: 29478 - DNA, 22 bp, Homo sapiens
cactgcaacctctgcctcctgg

SEQ ID NO: 29479 - DNA, 22 bp, Homo sapiens
gggaggcagtgctggaggctgg

SEQ ID NO: 29480 - DNA, 22 bp, Homo sapiens
cagggtgacaagtggcaaggag

SEQ ID NO: 29481 - DNA, 22 bp, Homo sapiens
gagctgggcctgcgagtgctgc

SEQ ID NO: 29482 - DNA, 22 bp, Homo sapiens
gggggaagaaagaacatggcat

SEQ ID NO: 29483 - DNA, 22 bp, Homo sapiens
ttcctggcttgtcacatctacg

SEQ ID NO: 29484 - DNA, 22 bp, Homo sapiens
tttgaagggcacgacaatagtt

SEQ ID NO: 29485 - DNA, 22 bp, Homo sapiens
acccaggctggagtgcagtggc

SEQ ID NO: 29486 - DNA, 22 bp, Homo sapiens
gatggcacacagacatccccgc

SEQ ID NO: 29487 - DNA, 22 bp, Homo sapiens
gaggcagaggttgttgcagtga

SEQ ID NO: 29488 - DNA, 22 bp, Homo sapiens
gaggcaggaggattgcttgagc

SEQ ID NO: 29489 - DNA, 23 bp, Homo sapiens
ggcactcggccgtgaactcgtgc

SEQ ID NO: 29490 - DNA, 22 bp, Homo sapiens
ctgatattctattttgcttgct

SEQ ID NO: 29491 - DNA, 22 bp, Homo sapiens
tctctagtctcctttaacctga

SEQ ID NO: 29492 - DNA, 22 bp, Homo sapiens
caggctggagtgcagtggcgcc

SEQ ID NO: 29493 - DNA, 22 bp, Homo sapiens
actgcaaagggaagccctttct

SEQ ID NO: 29494 - DNA, 22 bp, Homo sapiens
ggcctgcctcacagtcagcacc

SEQ ID NO: 29495 - DNA, 22 bp, Homo sapiens
tcttgaattgtactcccataag

SEQ ID NO: 29496 - DNA, 23 bp, Homo sapiens
acagcaagaggaccagatgtgag

SEQ ID NO: 29497 - DNA, 22 bp, Homo sapiens
agggaattcactggaacgccct

SEQ ID NO: 29498 - DNA, 22 bp, Homo sapiens
cccagcaggaggaggttgcagt

SEQ ID NO: 29499 - DNA, 22 bp, Homo sapiens
acaggggacctaggaccctcgg

SEQ ID NO: 29500 - DNA, 22 bp, Homo sapiens
gggaagatagtgttgagggccc

SEQ ID NO: 29501 - DNA, 22 bp, Homo sapiens
tccctctacagggaagcgcttt

SEQ ID NO: 29502 - DNA, 22 bp, Homo sapiens
tagaagaaagtgaagctgggga

SEQ ID NO: 29503 - DNA, 22 bp, Homo sapiens
ggtgctggacacgtggcactcc

SEQ ID NO: 29504 - DNA, 22 bp, Homo sapiens
ctcagcactgacccaggagatg

SEQ ID NO: 29505 - DNA, 22 bp, Homo sapiens
ggcgccagcactgcagcgcctc

SEQ ID NO: 29506 - DNA, 22 bp, Homo sapiens
ggtggcagtagcactgggcctg

SEQ ID NO: 29507 - DNA, 22 bp, Homo sapiens
acccggagtcggaggttgcagt

SEQ ID NO: 29508 - DNA, 22 bp, Homo sapiens
tccacttccacgtgtgcagaat

SEQ ID NO: 29509 - DNA, 22 bp, Homo sapiens
gtggagaggaacccagctctgt

SEQ ID NO: 29510 - DNA, 22 bp, Homo sapiens
tttattggatatttacaagata

SEQ ID NO: 29511 - DNA, 22 bp, Homo sapiens
aatgccttggagagcctagagg

SEQ ID NO: 29512 - DNA, 22 bp, Homo sapiens
gcaggagaacaaagcaagctgc

SEQ ID NO: 29513 - DNA, 22 bp, Homo sapiens
accgggaagtcctgcactgggc

SEQ ID NO: 29514 - DNA, 22 bp, Homo sapiens
caggctggagtgcagtggcgct

SEQ ID NO: 29515 - DNA, 22 bp, Homo sapiens
atgcagaagactgaaaagctga

SEQ ID NO: 29516 - DNA, 22 bp, Homo sapiens
agtggcctggagccccgcctgg

SEQ ID NO: 29517 - DNA, 22 bp, Homo sapiens
ctggggtccttgccatgtgtca

SEQ ID NO: 29518 - DNA, 22 bp, Homo sapiens
ggatgtcgaggatggggtagca

SEQ ID NO: 29519 - DNA, 22 bp, Homo sapiens
aagtggcagttcaggaagcaga

SEQ ID NO: 29520 - DNA, 22 bp, Homo sapiens
ccgtgtgcacgcgccggtgctg

SEQ ID NO: 29521 - DNA, 22 bp, Homo sapiens
acttttaaatgagtttcagttg

SEQ ID NO: 29522 - DNA, 22 bp, Homo sapiens
tgcaatctcggcactttgggag

SEQ ID NO: 29523 - DNA, 22 bp, Homo sapiens
caaggtgccatgctgggcgggg

SEQ ID NO: 29524 - DNA, 22 bp, Homo sapiens
atctagattaggtataagagct

SEQ ID NO: 29525 - DNA, 22 bp, Homo sapiens
gggagctgaaggagccggcggg

SEQ ID NO: 29526 - DNA, 22 bp, Homo sapiens
gtgagcagagatcgcgtgattg

SEQ ID NO: 29527 - DNA, 22 bp, Homo sapiens
tgcgaccctagccccctcactt

SEQ ID NO: 29528 - DNA, 22 bp, Homo sapiens
aaggcggggggatcacgaggtc

SEQ ID NO: 29529 - DNA, 22 bp, Homo sapiens
cctttaggagtgaggaccgagc

SEQ ID NO: 29530 - DNA, 22 bp, Homo sapiens
aaaggcttcggatcagaaggta

SEQ ID NO: 29531 - DNA, 20 bp, Homo sapiens
gggcagagccagccagtccc

SEQ ID NO: 29532 - DNA, 22 bp, Homo sapiens
gccctgggcaaggttctggcca

SEQ ID NO: 29533 - DNA, 22 bp, Homo sapiens
tttaaaaaactagtctgagtct

SEQ ID NO: 29534 - DNA, 22 bp, Homo sapiens
tcattccctcattgttcactgg

SEQ ID NO: 29535 - DNA, 22 bp, Homo sapiens
gagaactttctgtgtttttatc

SEQ ID NO: 29536 - DNA, 21 bp, Homo sapiens
gtggttctagagaaacagaat

SEQ ID NO: 29537 - DNA, 20 bp, Homo sapiens
gccgactgccttgtgagcct

SEQ ID NO: 29538 - DNA, 22 bp, Homo sapiens
tgtgactggttgtcccgctttc

SEQ ID NO: 29539 - DNA, 16 bp, Homo sapiens
gtagccgtggccgctg

SEQ ID NO: 29540 - DNA, 22 bp, Homo sapiens
aggctgagataggtggatcatt

SEQ ID NO: 29541 - DNA, 22 bp, Homo sapiens
ctaggtgatccactgctctctt

SEQ ID NO: 29542 - DNA, 22 bp, Homo sapiens
cttcctcctccatctcgaaggc

SEQ ID NO: 29543 - DNA, 22 bp, Homo sapiens
ttctgatgaggaggtctctaag

SEQ ID NO: 29544 - DNA, 22 bp, Homo sapiens
tgtatgaggcatacatcaggca

SEQ ID NO: 29545 - DNA, 22 bp, Homo sapiens
gagccaggtcgggccgcggcga

SEQ ID NO: 29546 - DNA, 22 bp, Homo sapiens
ttttaatactgctattgtagga

SEQ ID NO: 29547 - DNA, 22 bp, Homo sapiens
cagtttcttcctcccccagaga

SEQ ID NO: 29548 - DNA, 22 bp, Homo sapiens
tacttttagcctatttgattct

SEQ ID NO: 29549 - DNA, 17 bp, Homo sapiens
gcccgtgggctacggta

SEQ ID NO: 29550 - DNA, 22 bp, Homo sapiens
ggtagaaggggaagaggtccat

SEQ ID NO: 29551 - DNA, 22 bp, Homo sapiens
caccctcaagcagtggcacgtg

SEQ ID NO: 29552 - DNA, 22 bp, Homo sapiens
gcccaggctggagtgcagtggc

SEQ ID NO: 29553 - DNA, 22 bp, Homo sapiens
gggctgcatcagcaggacccgg

SEQ ID NO: 29554 - DNA, 22 bp, Homo sapiens
agcccaggctggagtgcagtgg

SEQ ID NO: 29555 - DNA, 22 bp, Homo sapiens
aggtcacccgtttgactatcca

SEQ ID NO: 29556 - DNA, 23 bp, Homo sapiens
gcagaggagcaagctggacacca

SEQ ID NO: 29557 - DNA, 22 bp, Homo sapiens
taatggattaacgtccctgtcg

SEQ ID NO: 29558 - DNA, 22 bp, Homo sapiens
tcgtggatgcgcagggcggcct

SEQ ID NO: 29559 - DNA, 22 bp, Homo sapiens
aatgtgaggccttggtagttat

SEQ ID NO: 29560 - DNA, 22 bp, Homo sapiens
gagcacgttgaagcgcactgtc

SEQ ID NO: 29561 - DNA, 22 bp, Homo sapiens
cctgaggatgccagcatgggtg

SEQ ID NO: 29562 - DNA, 22 bp, Homo sapiens
gtggatggagctggaagccatt

SEQ ID NO: 29563 - DNA, 22 bp, Homo sapiens
tcattaatcccggggtccaggg

SEQ ID NO: 29564 - DNA, 22 bp, Homo sapiens
gacgccgtgtcccggcactctt

SEQ ID NO: 29565 - DNA, 22 bp, Homo sapiens
gcagggcacaaggacgcacagg

SEQ ID NO: 29566 - DNA, 22 bp, Homo sapiens
tgagaaattacttcagtgatgg

SEQ ID NO: 29567 - DNA, 22 bp, Homo sapiens
gaaaggagagggttaaggagct

SEQ ID NO: 29568 - DNA, 22 bp, Homo sapiens
gggagaggttacccgagcaact

SEQ ID NO: 29569 - DNA, 22 bp, Homo sapiens
tgagatgtaaggtatgcttact

SEQ ID NO: 29570 - DNA, 23 bp, Homo sapiens
cagagctggctcagagctgcctg

SEQ ID NO: 29571 - DNA, 22 bp, Homo sapiens
acccaggccattggcaagagtc

SEQ ID NO: 29572 - DNA, 21 bp, Homo sapiens
tcactagtgccttctgtcatt

SEQ ID NO: 29573 - DNA, 22 bp, Homo sapiens
tgggcagggagctggaaccaca

SEQ ID NO: 29574 - DNA, 22 bp, Homo sapiens
cgtgggtcgggactccgcctcg

SEQ ID NO: 29575 - DNA, 22 bp, Homo sapiens
aaaactacatttgacattttgt

SEQ ID NO: 29576 - DNA, 22 bp, Homo sapiens
cggaggttgaggctgcagtgag

SEQ ID NO: 29577 - DNA, 22 bp, Homo sapiens
ccaggaggttgaggctgcagtg

SEQ ID NO: 29578 - DNA, 23 bp, Homo sapiens
ggagtgcaatggcgccatctcgg

SEQ ID NO: 29579 - DNA, 22 bp, Homo sapiens
ggctgggctccgggagcatgcg

SEQ ID NO: 29580 - DNA, 22 bp, Homo sapiens
gagcactgatttatttttgtct

SEQ ID NO: 29581 - DNA, 22 bp, Homo sapiens
cactgcaacctccgcctcctgg

SEQ ID NO: 29582 - DNA, 17 bp, Homo sapiens
ccctcactcctgccggg

SEQ ID NO: 29583 - DNA, 22 bp, Homo sapiens
cccggacagaggggcagagtgt

SEQ ID NO: 29584 - DNA, 22 bp, Homo sapiens
acacagagccaaaccatatcac

SEQ ID NO: 29585 - DNA, 22 bp, Homo sapiens
aatgagatggaattcccgccta

SEQ ID NO: 29586 - DNA, 22 bp, Homo sapiens
actgcaacctccacctcctggg

SEQ ID NO: 29587 - DNA, 22 bp, Homo sapiens
gggctgagacgatggggtcttc

SEQ ID NO: 29588 - DNA, 22 bp, Homo sapiens
atgattgaaaatgacattgcca

SEQ ID NO: 29589 - DNA, 22 bp, Homo sapiens
gctggaggatggactggaagaa

SEQ ID NO: 29590 - DNA, 22 bp, Homo sapiens
agcctattccaggatgagctca

SEQ ID NO: 29591 - DNA, 22 bp, Homo sapiens
aagctgattccactttttccac

SEQ ID NO: 29592 - DNA, 22 bp, Homo sapiens
tcgctgaggctgcacggctgcc

SEQ ID NO: 29593 - DNA, 22 bp, Homo sapiens
acagcagagcctggtacttact

SEQ ID NO: 29594 - DNA, 20 bp, Homo sapiens
agagatggggtatcaccgta

SEQ ID NO: 29595 - DNA, 22 bp, Homo sapiens
cccaggggttctgagcagcagc

SEQ ID NO: 29596 - DNA, 22 bp, Homo sapiens
cccaggaagtggaggttgcagt

SEQ ID NO: 29597 - DNA, 22 bp, Homo sapiens
ctgggcagctgtatcagggagt

SEQ ID NO: 29598 - DNA, 22 bp, Homo sapiens
cactgcaagctccgcctcccgg

SEQ ID NO: 29599 - DNA, 22 bp, Homo sapiens
agatcggctttgcagacctcat

SEQ ID NO: 29600 - DNA, 22 bp, Homo sapiens
cttgtagacccctggactcacg

SEQ ID NO: 29601 - DNA, 22 bp, Homo sapiens
ggctttgacatgctgaattaaa

SEQ ID NO: 29602 - DNA, 17 bp, Homo sapiens
ggcctgcacctcctgct

SEQ ID NO: 29603 - DNA, 22 bp, Homo sapiens
gcgttggggaccccgaagctgg

SEQ ID NO: 29604 - DNA, 20 bp, Homo sapiens
agcagagtgcccatcccgga

SEQ ID NO: 29605 - DNA, 22 bp, Homo sapiens
gcctgcagggcctgggcctacc

SEQ ID NO: 29606 - DNA, 22 bp, Homo sapiens
cactgcaacctccacctcctgg

SEQ ID NO: 29607 - DNA, 23 bp, Homo sapiens
ccaagactgttaggagtggggag

SEQ ID NO: 29608 - DNA, 22 bp, Homo sapiens
aagatattcaaagatttattag

SEQ ID NO: 29609 - DNA, 22 bp, Homo sapiens
ttgagcccaggaggcctgggtg

SEQ ID NO: 29610 - DNA, 22 bp, Homo sapiens
aggggatggagctggaaggcag

SEQ ID NO: 29611 - DNA, 22 bp, Homo sapiens
aggctgaggcaagaggatcact

SEQ ID NO: 29612 - DNA, 22 bp, Homo sapiens
tttgaggttagctagcagatca

SEQ ID NO: 29613 - DNA, 22 bp, Homo sapiens
ctgggatgcggaggttgcggtg

SEQ ID NO: 29614 - DNA, 22 bp, Homo sapiens
cgcaccactgaattccagcctg

SEQ ID NO: 29615 - DNA, 22 bp, Homo sapiens
tttacacagaggacactgggct

SEQ ID NO: 29616 - DNA, 22 bp, Homo sapiens
gagaaatatggctcagttccac

SEQ ID NO: 29617 - DNA, 22 bp, Homo sapiens
ggtttattgttaataagtttga

SEQ ID NO: 29618 - DNA, 20 bp, Homo sapiens
aactcctagcctcaagtgat

SEQ ID NO: 29619 - DNA, 22 bp, Homo sapiens
aggagggagcttaagccaggca

SEQ ID NO: 29620 - DNA, 22 bp, Homo sapiens
ttgagggtctggatctgctgct

SEQ ID NO: 29621 - DNA, 22 bp, Homo sapiens
ctgaggctggagtgcagtggtg

SEQ ID NO: 29622 - DNA, 22 bp, Homo sapiens
atttacaggtagaattttaagt

SEQ ID NO: 29623 - DNA, 21 bp, Homo sapiens
aggcatgagccctgcatggac

SEQ ID NO: 29624 - DNA, 22 bp, Homo sapiens
gcccaggctggagtgcagtggt

SEQ ID NO: 29625 - DNA, 22 bp, Homo sapiens
aaaagcaattgcgggttttgcc

SEQ ID NO: 29626 - DNA, 22 bp, Homo sapiens
ctctctgggcccagttggcacc

SEQ ID NO: 29627 - DNA, 22 bp, Homo sapiens
ccaggctggagtgcagtggcac

SEQ ID NO: 29628 - DNA, 22 bp, Homo sapiens
ccaggctggagtgcaatggcgt

SEQ ID NO: 29629 - DNA, 22 bp, Homo sapiens
gaaggaagtcattagtgcagac

SEQ ID NO: 29630 - DNA, 22 bp, Homo sapiens
tgatatgggaaaagggctcgga

SEQ ID NO: 29631 - DNA, 22 bp, Homo sapiens
gggagctggagctggaagactc

SEQ ID NO: 29632 - DNA, 22 bp, Homo sapiens
tcaccgaggctggagtgcagtg

SEQ ID NO: 29633 - DNA, 22 bp, Homo sapiens
gaggcagaagttgcagtgagca

SEQ ID NO: 29634 - DNA, 22 bp, Homo sapiens
aggtaggcctgacgctggggtg

SEQ ID NO: 29635 - DNA, 22 bp, Homo sapiens
tggtgcaaaactaattgcggtt

SEQ ID NO: 29636 - DNA, 22 bp, Homo sapiens
aaggccctgtctccaaatacag

SEQ ID NO: 29637 - DNA, 22 bp, Homo sapiens
cacccaggctggagtgcagtgg

SEQ ID NO: 29638 - DNA, 22 bp, Homo sapiens
gccatgactctccataccaaag

SEQ ID NO: 29639 - DNA, 22 bp, Homo sapiens
ctgagggtcaacttgattgtat

SEQ ID NO: 29640 - DNA, 22 bp, Homo sapiens
acccaggctggagtgcagtggg

SEQ ID NO: 29641 - DNA, 22 bp, Homo sapiens
gcctgcaactggcacagcttgt

SEQ ID NO: 29642 - DNA, 22 bp, Homo sapiens
ctgaggtgtgaaatggtggcaa

SEQ ID NO: 29643 - DNA, 22 bp, Homo sapiens
gaaccctagcatgtcctttagg

SEQ ID NO: 29644 - DNA, 22 bp, Homo sapiens
caggaggattgcttgaggccag

SEQ ID NO: 29645 - DNA, 22 bp, Homo sapiens
ggctgtggcagctggaagtggt

SEQ ID NO: 29646 - DNA, 19 bp, Homo sapiens
agggaatccggctgaggga

SEQ ID NO: 29647 - DNA, 22 bp, Homo sapiens
gacagctgcatcctcagacaca

SEQ ID NO: 29648 - DNA, 22 bp, Homo sapiens
tttgttttcaatgtgtcattca

SEQ ID NO: 29649 - DNA, 22 bp, Homo sapiens
agggtagtacagagagtgtcct

SEQ ID NO: 29650 - DNA, 22 bp, Homo sapiens
aggcaaggtgctacagacagtg

SEQ ID NO: 29651 - DNA, 22 bp, Homo sapiens
cttccctctgctccttggtcca

SEQ ID NO: 29652 - DNA, 22 bp, Homo sapiens
ggctgtggagctgcagagttgg

SEQ ID NO: 29653 - DNA, 22 bp, Homo sapiens
ttatgatttgccacagattggt

SEQ ID NO: 29654 - DNA, 22 bp, Homo sapiens
tgggaaggggagctggaaagga

SEQ ID NO: 29655 - DNA, 18 bp, Homo sapiens
tgagaggctattttttgc

SEQ ID NO: 29656 - DNA, 22 bp, Homo sapiens
gaaatgctcaggggttttccag

SEQ ID NO: 29657 - DNA, 22 bp, Homo sapiens
agtgattctcctgcctcagcct

SEQ ID NO: 29658 - DNA, 22 bp, Homo sapiens
ggggagatgcttaggtccgggg

SEQ ID NO: 29659 - DNA, 22 bp, Homo sapiens
gaggcaggcagattgcttgagg

SEQ ID NO: 29660 - DNA, 22 bp, Homo sapiens
tctttcttgtgggtgccctttt

SEQ ID NO: 29661 - DNA, 22 bp, Homo sapiens
cttctggcgttggaggtctgag

SEQ ID NO: 29662 - DNA, 22 bp, Homo sapiens
tcacttcccagacggggtggca

SEQ ID NO: 29663 - DNA, 22 bp, Homo sapiens
ctacaccggagcctggaaggta

SEQ ID NO: 29664 - DNA, 22 bp, Homo sapiens
ggcatggacgtctctgaggcca

SEQ ID NO: 29665 - DNA, 22 bp, Homo sapiens
cctcggggcaccgcggcctgct

SEQ ID NO: 29666 - DNA, 22 bp, Homo sapiens
caggcaggtcagtgaagaagga

SEQ ID NO: 29667 - DNA, 22 bp, Homo sapiens
tgatctggtcctactgtgggca

SEQ ID NO: 29668 - DNA, 22 bp, Homo sapiens
tggagtgcaatagtaataaggt

SEQ ID NO: 29669 - DNA, 22 bp, Homo sapiens
gagccaggttggaggctgcagt

SEQ ID NO: 29670 - DNA, 22 bp, Homo sapiens
gccaggaaagggaattccctga

SEQ ID NO: 29671 - DNA, 22 bp, Homo sapiens
aggtcacatacaaatgctcctt

SEQ ID NO: 29672 - DNA, 22 bp, Homo sapiens
aatggcactttataaatgttaa

SEQ ID NO: 29673 - DNA, 22 bp, Homo sapiens
actcggggtggagagagcggtg

SEQ ID NO: 29674 - DNA, 21 bp, Homo sapiens
gggcagaggggcctcctgggt

SEQ ID NO: 29675 - DNA, 22 bp, Homo sapiens
ctaccgggttctcagccaggca

SEQ ID NO: 29676 - DNA, 22 bp, Homo sapiens
acccaggctggagtgcagtgat

SEQ ID NO: 29677 - DNA, 21 bp, Homo sapiens
aggcttggatctagacaggcc

SEQ ID NO: 29678 - DNA, 22 bp, Homo sapiens
catctgctgttccttggactca

SEQ ID NO: 29679 - DNA, 22 bp, Homo sapiens
gatctggaatctgaaggctgag

SEQ ID NO: 29680 - DNA, 22 bp, Homo sapiens
acccgtcagaatggctgttatt

SEQ ID NO: 29681 - DNA, 19 bp, Homo sapiens
ccacagcctgctgtcttcc

SEQ ID NO: 29682 - DNA, 22 bp, Homo sapiens
acccaggctggcgtgcagtggc

SEQ ID NO: 29683 - DNA, 22 bp, Homo sapiens
gcgcacgtcagaaaggctttta

SEQ ID NO: 29684 - DNA, 22 bp, Homo sapiens
ctggcaggttatagagctgccc

SEQ ID NO: 29685 - DNA, 22 bp, Homo sapiens
tgtgggtggcatcgtcctggcc

SEQ ID NO: 29686 - DNA, 22 bp, Homo sapiens
cagctgttcattgttgccaccc

SEQ ID NO: 29687 - DNA, 22 bp, Homo sapiens
gagtcacatactatgtaataga

SEQ ID NO: 29688 - DNA, 22 bp, Homo sapiens
acaagaagggtgattaggggca

SEQ ID NO: 29689 - DNA, 22 bp, Homo sapiens
ctgcagggagaggggacagcct

SEQ ID NO: 29690 - DNA, 22 bp, Homo sapiens
ggcgcccccttcaaacagagca

SEQ ID NO: 29691 - DNA, 22 bp, Homo sapiens
ccccacaactcatgttgaaact

SEQ ID NO: 29692 - DNA, 22 bp, Homo sapiens
cacagctgaagtagccatgtgg

SEQ ID NO: 29693 - DNA, 22 bp, Homo sapiens
aaagatgttgctgctccgccct

SEQ ID NO: 29694 - DNA, 22 bp, Homo sapiens
atgaattgaggaaaacagtcgt

SEQ ID NO: 29695 - DNA, 23 bp, Homo sapiens
tgaggcaggcggatcacgaggtc

SEQ ID NO: 29696 - DNA, 22 bp, Homo sapiens
tgcgggatgacagtggccaaca

SEQ ID NO: 29697 - DNA, 22 bp, Homo sapiens
tgaggcacaggcagtgcccccg

SEQ ID NO: 29698 - DNA, 22 bp, Homo sapiens
tcacccctccattctctcatgt

SEQ ID NO: 29699 - DNA, 22 bp, Homo sapiens
cgtaggtggctcagcacctggg

SEQ ID NO: 29700 - DNA, 22 bp, Homo sapiens
gcccgcgccagcctctccatct

SEQ ID NO: 29701 - DNA, 22 bp, Homo sapiens
ggcaggaggtgagtggcgggtg

SEQ ID NO: 29702 - DNA, 22 bp, Homo sapiens
tcctcattcttggtgcatcaaa

SEQ ID NO: 29703 - DNA, 22 bp, Homo sapiens
catgtgtgtctccaccagctgc

SEQ ID NO: 29704 - DNA, 22 bp, Homo sapiens
ccctcaggtgaaaggaaaaatt

SEQ ID NO: 29705 - DNA, 22 bp, Homo sapiens
aacttggctaccagcgttaaat

SEQ ID NO: 29706 - DNA, 22 bp, Homo sapiens
gggcggggggagctggaatgaa

SEQ ID NO: 29707 - DNA, 22 bp, Homo sapiens
cccgcagtcggaatttctcagt

SEQ ID NO: 29708 - DNA, 22 bp, Homo sapiens
tgccgtggggctgaggctggag

SEQ ID NO: 29709 - DNA, 19 bp, Homo sapiens
cccaggaagcggaggttgc

SEQ ID NO: 29710 - DNA, 22 bp, Homo sapiens
agtccgcgctccatgggagtcc

SEQ ID NO: 29711 - DNA, 22 bp, Homo sapiens
tttcttaggctctaaaatgact

SEQ ID NO: 29712 - DNA, 22 bp, Homo sapiens
tgggagaaagaaccctgagtga

SEQ ID NO: 29713 - DNA, 22 bp, Homo sapiens
caggcagggagctggaaaggat

SEQ ID NO: 29714 - DNA, 22 bp, Homo sapiens
atagggcctaaaaagtattgct

SEQ ID NO: 29715 - DNA, 22 bp, Homo sapiens
ggggctgaacctggaggtggtc

SEQ ID NO: 29716 - DNA, 22 bp, Homo sapiens
tgttttaagctctagaagggga

SEQ ID NO: 29717 - DNA, 22 bp, Homo sapiens
gcaggctgtctaaagttagagt

SEQ ID NO: 29718 - DNA, 23 bp, Homo sapiens
aggtaggttattgctgctacctg

SEQ ID NO: 29719 - DNA, 22 bp, Homo sapiens
tagcagcaaagcaggatctgct

SEQ ID NO: 29720 - DNA, 22 bp, Homo sapiens
ttgccgccgtctgctcgccccg

SEQ ID NO: 29721 - DNA, 22 bp, Homo sapiens
cctactctgagcgcctccgcat

SEQ ID NO: 29722 - DNA, 22 bp, Homo sapiens
ctcggggatccatccacgtggc

SEQ ID NO: 29723 - DNA, 22 bp, Homo sapiens
tgcatctgcctggagtagcgcc

SEQ ID NO: 29724 - DNA, 22 bp, Homo sapiens
agaaggacccggtgggagatga

SEQ ID NO: 29725 - DNA, 22 bp, Homo sapiens
aggctgtgtgctccttatgaga

SEQ ID NO: 29726 - DNA, 22 bp, Homo sapiens
tcccctttgtcttcctgtgggt

SEQ ID NO: 29727 - DNA, 22 bp, Homo sapiens
gaggactgaaacttacaggaaa

SEQ ID NO: 29728 - DNA, 22 bp, Homo sapiens
ttattagagtgctttgagaaag

SEQ ID NO: 29729 - DNA, 22 bp, Homo sapiens
tgcaccctcatcagtcaaatgg

SEQ ID NO: 29730 - DNA, 21 bp, Homo sapiens
gaccccagaccagcagacaca

SEQ ID NO: 29731 - DNA, 22 bp, Homo sapiens
ataccaccatctatgaaaggta

SEQ ID NO: 29732 - DNA, 22 bp, Homo sapiens
tgaagttgttaaggttgccatt

SEQ ID NO: 29733 - DNA, 22 bp, Homo sapiens
caggaacagggtgtcctggcag

SEQ ID NO: 29734 - DNA, 22 bp, Homo sapiens
caggaagctgtgaaggagacgg

SEQ ID NO: 29735 - DNA, 22 bp, Homo sapiens
accgtgtctgacactttgggcg

SEQ ID NO: 29736 - DNA, 22 bp, Homo sapiens
ggcgccgcactcggtgcagccg

SEQ ID NO: 29737 - DNA, 22 bp, Homo sapiens
acgtagcactgagagatgcagg

SEQ ID NO: 29738 - DNA, 22 bp, Homo sapiens
ttattttaccttcctctgagct

SEQ ID NO: 29739 - DNA, 22 bp, Homo sapiens
agtggagacaggacagtcgata

SEQ ID NO: 29740 - DNA, 22 bp, Homo sapiens
ggttgcaaactcctgggatcaa

SEQ ID NO: 29741 - DNA, 22 bp, Homo sapiens
aaggccctggcaggaagcagga

SEQ ID NO: 29742 - DNA, 22 bp, Homo sapiens
gggatgcagactacagggctta

SEQ ID NO: 29743 - DNA, 22 bp, Homo sapiens
gaggcctgggcaagggggtctg

SEQ ID NO: 29744 - DNA, 22 bp, Homo sapiens
agggctggagccacagctggga

SEQ ID NO: 29745 - DNA, 22 bp, Homo sapiens
atctttgattgaagggaccctg

SEQ ID NO: 29746 - DNA, 22 bp, Homo sapiens
ggcttcagtggccagagatgat

SEQ ID NO: 29747 - DNA, 22 bp, Homo sapiens
ttgaccactgaatggttctgaa

SEQ ID NO: 29748 - DNA, 22 bp, Homo sapiens
tgaacatgctgttgatggcctg

SEQ ID NO: 29749 - DNA, 22 bp, Homo sapiens
tcctccccaaagcccagcctgg

SEQ ID NO: 29750 - DNA, 22 bp, Homo sapiens
agcatagagtcctgagggcagg

SEQ ID NO: 29751 - DNA, 22 bp, Homo sapiens
tcggggatggtgtctgagggag

SEQ ID NO: 29752 - DNA, 23 bp, Homo sapiens
ttggacaaggccagagccagcac

SEQ ID NO: 29753 - DNA, 22 bp, Homo sapiens
ggaactgaatgtctcggtataa

SEQ ID NO: 29754 - DNA, 22 bp, Homo sapiens
actgttttctgtaaagggccag

SEQ ID NO: 29755 - DNA, 21 bp, Homo sapiens
tctctttctggaagcttccct

SEQ ID NO: 29756 - DNA, 22 bp, Homo sapiens
agaaatatgctgattagatgaa

SEQ ID NO: 29757 - DNA, 22 bp, Homo sapiens
agatttatgtggtcacactcag

SEQ ID NO: 29758 - DNA, 22 bp, Homo sapiens
cctggagagctcgggccaggca

SEQ ID NO: 29759 - DNA, 23 bp, Homo sapiens
actgagccagggcctgggtcagc

SEQ ID NO: 29760 - DNA, 22 bp, Homo sapiens
atgtgggccgtgcgggtgtcct

SEQ ID NO: 29761 - DNA, 22 bp, Homo sapiens
ctgcaccgtgtctcgggctgcc

SEQ ID NO: 29762 - DNA, 22 bp, Homo sapiens
tcacatcaaggactgtctggct

SEQ ID NO: 29763 - DNA, 22 bp, Homo sapiens
cgggcaaggcgagactaggccc

SEQ ID NO: 29764 - DNA, 22 bp, Homo sapiens
acccaggagacggaggtgcagt

SEQ ID NO: 29765 - DNA, 22 bp, Homo sapiens
tctcgctctgtcgcccaggctg

SEQ ID NO: 29766 - DNA, 22 bp, Homo sapiens
gaagaaggtggcccaggggtag

SEQ ID NO: 29767 - DNA, 22 bp, Homo sapiens
gcttctcaattctcaccctcca

SEQ ID NO: 29768 - DNA, 22 bp, Homo sapiens
aagattttcagtgcctaaaaca

SEQ ID NO: 29769 - DNA, 22 bp, Homo sapiens
gctggggaggcagcagagaaca

SEQ ID NO: 29770 - DNA, 22 bp, Homo sapiens
accctcaagatggaagcagttt

SEQ ID NO: 29771 - DNA, 22 bp, Homo sapiens
gaggctgaggcggatggatcac

SEQ ID NO: 29772 - DNA, 22 bp, Homo sapiens
gggtacagttcttccagtgtca

SEQ ID NO: 29773 - DNA, 20 bp, Homo sapiens
caagggtttgcattggcttt

SEQ ID NO: 29774 - DNA, 22 bp, Homo sapiens
tccgggcaactgaagggaggtt

SEQ ID NO: 29775 - DNA, 22 bp, Homo sapiens
gcggcggagacagcaggaagcc

SEQ ID NO: 29776 - DNA, 22 bp, Homo sapiens
aaggccttgccgaaggatgcca

SEQ ID NO: 29777 - DNA, 22 bp, Homo sapiens
tattagttgcaaaacattgact

SEQ ID NO: 29778 - DNA, 19 bp, Homo sapiens
tgagggtgagctttggaga

SEQ ID NO: 29779 - DNA, 22 bp, Homo sapiens
attcacagggggagaagggtat

SEQ ID NO: 29780 - DNA, 22 bp, Homo sapiens
cagggcctcctaaggcatctaa

SEQ ID NO: 29781 - DNA, 22 bp, Homo sapiens
ttcagcactgactgagtggtta

SEQ ID NO: 29782 - DNA, 22 bp, Homo sapiens
tgctgaataagacgtggcttgt

SEQ ID NO: 29783 - DNA, 22 bp, Homo sapiens
actcagtacatctggagttggc

SEQ ID NO: 29784 - DNA, 20 bp, Homo sapiens
agacaccccctgacagggaa

SEQ ID NO: 29785 - DNA, 19 bp, Homo sapiens
tccaggggctccacctcct

SEQ ID NO: 29786 - DNA, 22 bp, Homo sapiens
ggcgctcagtgttgccccagag

SEQ ID NO: 29787 - DNA, 22 bp, Homo sapiens
ggtccccgtggaggctggagcg

SEQ ID NO: 29788 - DNA, 22 bp, Homo sapiens
atctacaagaggttctcctctc

SEQ ID NO: 29789 - DNA, 22 bp, Homo sapiens
ctgaggcaggatggcctggctg

SEQ ID NO: 29790 - DNA, 18 bp, Homo sapiens
gctgtggaagtctttata

SEQ ID NO: 29791 - DNA, 22 bp, Homo sapiens
aatggaatacctaggtggccca

SEQ ID NO: 29792 - DNA, 22 bp, Homo sapiens
caggaagaccagggctgtggct

SEQ ID NO: 29793 - DNA, 22 bp, Homo sapiens
caggctgctgcctagaatgaca

SEQ ID NO: 29794 - DNA, 22 bp, Homo sapiens
ggtggttcacgcctataatccc

SEQ ID NO: 29795 - DNA, 22 bp, Homo sapiens
gcaggtctatcaggctgcaggt

SEQ ID NO: 29796 - DNA, 22 bp, Homo sapiens
tgagccgtggtctctgagggtg

SEQ ID NO: 29797 - DNA, 22 bp, Homo sapiens
ctggagggctgcagcgaggctg

SEQ ID NO: 29798 - DNA, 22 bp, Homo sapiens
cccaggggttcaaggctgcagt

SEQ ID NO: 29799 - DNA, 22 bp, Homo sapiens
ggtccccccatggtgagcactg

SEQ ID NO: 29800 - DNA, 18 bp, Homo sapiens
ggagactaaactgttgac

SEQ ID NO: 29801 - DNA, 22 bp, Homo sapiens
cctcttcaggcactcgaaggcc

SEQ ID NO: 29802 - DNA, 22 bp, Homo sapiens
acaggggattgattggaagtct

SEQ ID NO: 29803 - DNA, 22 bp, Homo sapiens
ggcagggcaggaaagtcaggaa

SEQ ID NO: 29804 - DNA, 22 bp, Homo sapiens
agacagggtgatcgcttgagcc

SEQ ID NO: 29805 - DNA, 22 bp, Homo sapiens
ctggtctggctacccagcgaat

SEQ ID NO: 29806 - DNA, 22 bp, Homo sapiens
tcaccttgtgatctccctgcct

SEQ ID NO: 29807 - DNA, 22 bp, Homo sapiens
aggtcaccatggcatgctccac

SEQ ID NO: 29808 - DNA, 22 bp, Homo sapiens
ccaggaggcggaaggtacagtg

SEQ ID NO: 29809 - DNA, 22 bp, Homo sapiens
aggaaaacagaccaaggagctc

SEQ ID NO: 29810 - DNA, 22 bp, Homo sapiens
tctgtcttagccatctcaggct

SEQ ID NO: 29811 - DNA, 22 bp, Homo sapiens
ggccctctttagacagagtagg

SEQ ID NO: 29812 - DNA, 22 bp, Homo sapiens
gcctccccaagcagcagggatt

SEQ ID NO: 29813 - DNA, 22 bp, Homo sapiens
cggctgggttcggctgcaggcc

SEQ ID NO: 29814 - DNA, 22 bp, Homo sapiens
ccttctcagccccagctcccgc

SEQ ID NO: 29815 - DNA, 22 bp, Homo sapiens
acaggggaatttactgtcatta

SEQ ID NO: 29816 - DNA, 22 bp, Homo sapiens
agagaagagtcttgtcaaatta

SEQ ID NO: 29817 - DNA, 22 bp, Homo sapiens
gagctcattcattcattgcctg

SEQ ID NO: 29818 - DNA, 22 bp, Homo sapiens
ggaggagacagtaaaaagcacg

SEQ ID NO: 29819 - DNA, 22 bp, Homo sapiens
tttaaaaaactagtctgagtct

SEQ ID NO: 29820 - DNA, 22 bp, Homo sapiens
tcctcagcttttatttcacttg

SEQ ID NO: 29821 - DNA, 22 bp, Homo sapiens
cctttgatttcccccgtctcag

SEQ ID NO: 29822 - DNA, 22 bp, Homo sapiens
ggaggtggaggttgcagtgagc

SEQ ID NO: 29823 - DNA, 22 bp, Homo sapiens
cctcttctaggacgtccttgtg

SEQ ID NO: 29824 - DNA, 22 bp, Homo sapiens
aggccagcagcatgacggcatc

SEQ ID NO: 29825 - DNA, 22 bp, Homo sapiens
cagtcctgaatactggacggtg

SEQ ID NO: 29826 - DNA, 22 bp, Homo sapiens
tgtctcatctcttaaccccact

SEQ ID NO: 29827 - DNA, 22 bp, Homo sapiens
accactgcccatggtgaaaact

SEQ ID NO: 29828 - DNA, 22 bp, Homo sapiens
ggaggggatttagtagatgcta

SEQ ID NO: 29829 - DNA, 22 bp, Homo sapiens
aagcagatctgatagggccctg

SEQ ID NO: 29830 - DNA, 22 bp, Homo sapiens
gcctcagtctcccgagtagctg

SEQ ID NO: 29831 - DNA, 22 bp, Homo sapiens
acaaacagagttgaaaaatagg

SEQ ID NO: 29832 - DNA, 22 bp, Homo sapiens
ttatttaaaagtggtaagattc

SEQ ID NO: 29833 - DNA, 22 bp, Homo sapiens
gggagaggttacccgagcaact

SEQ ID NO: 29834 - DNA, 22 bp, Homo sapiens
atgttggagtcgtaaggcatgg

SEQ ID NO: 29835 - DNA, 22 bp, Homo sapiens
agatgtgagaatcaagtgacca

SEQ ID NO: 29836 - DNA, 22 bp, Homo sapiens
gatgtagacacttggaggctta

SEQ ID NO: 29837 - DNA, 22 bp, Homo sapiens
aaccaccattctctcctcttcc

SEQ ID NO: 29838 - DNA, 22 bp, Homo sapiens
ctctgcaacttctagcagtgtc

SEQ ID NO: 29839 - DNA, 22 bp, Homo sapiens
gaagttctttatagcagtgtga

SEQ ID NO: 29840 - DNA, 22 bp, Homo sapiens
aggggatggagctggaaggcag

SEQ ID NO: 29841 - DNA, 21 bp, Homo sapiens
atctcgggcttctcgcccagc

SEQ ID NO: 29842 - DNA, 22 bp, Homo sapiens
accacccagccagcttctccct

SEQ ID NO: 29843 - DNA, 22 bp, Homo sapiens
ctgggggcagcaagaagccatg

SEQ ID NO: 29844 - DNA, 22 bp, Homo sapiens
agtgagagtattaatgtgaact

SEQ ID NO: 29845 - DNA, 22 bp, Homo sapiens
ctctcagtcctgcgcgcctctg

SEQ ID NO: 29846 - DNA, 22 bp, Homo sapiens
tgggggagctcagtccagccca

SEQ ID NO: 29847 - DNA, 22 bp, Homo sapiens
aggccagcctcaggcagggacc

SEQ ID NO: 29848 - DNA, 22 bp, Homo sapiens
cagccctcctaccctgccaggc

SEQ ID NO: 29849 - DNA, 22 bp, Homo sapiens
aataaaatggtcagttttctca

SEQ ID NO: 29850 - DNA, 22 bp, Homo sapiens
agagggatcaccctgtttctgg

SEQ ID NO: 29851 - DNA, 18 bp, Homo sapiens
tgagagcattcgaggcaa

SEQ ID NO: 29852 - DNA, 22 bp, Homo sapiens
ctgtatctgtgttggatgagtt

SEQ ID NO: 29853 - DNA, 22 bp, Homo sapiens
aaggatgattggtaatgacact

SEQ ID NO: 29854 - DNA, 22 bp, Homo sapiens
ctcagctgcagcctggctggca

SEQ ID NO: 29855 - DNA, 22 bp, Homo sapiens
taagaaatttagttatagaatg

SEQ ID NO: 29856 - DNA, 22 bp, Homo sapiens
agtactgtcagcagggtgttga

SEQ ID NO: 29857 - DNA, 19 bp, Homo sapiens
agccccttggtactgtcct

SEQ ID NO: 29858 - DNA, 22 bp, Homo sapiens
gccaccccataggtgttaggtg

SEQ ID NO: 29859 - DNA, 22 bp, Homo sapiens
agtgaggggcagctgagtgggc

SEQ ID NO: 29860 - DNA, 22 bp, Homo sapiens
gtggtgtaggtcacagttagga

SEQ ID NO: 29861 - DNA, 22 bp, Homo sapiens
tcagtgcagggtgggagagaga

SEQ ID NO: 29862 - DNA, 22 bp, Homo sapiens
cctgggggccaggaaggtgtga

SEQ ID NO: 29863 - DNA, 22 bp, Homo sapiens
gctgctgcttgaaggctcggag

SEQ ID NO: 29864 - DNA, 22 bp, Homo sapiens
aggggaggtgtccccaaatctc

SEQ ID NO: 29865 - DNA, 22 bp, Homo sapiens
gctggaggatggactggaagaa

SEQ ID NO: 29866 - DNA, 22 bp, Homo sapiens
ctgggggtcttgaaagggagag

SEQ ID NO: 29867 - DNA, 22 bp, Homo sapiens
tcgaactcatagtcgtagctgt

SEQ ID NO: 29868 - DNA, 22 bp, Homo sapiens
aacagtgtttttcttcagcact

SEQ ID NO: 29869 - DNA, 22 bp, Homo sapiens
gcccagctgcaccctggtgggt

SEQ ID NO: 29870 - DNA, 22 bp, Homo sapiens
agttggagtgaacatgagattg

SEQ ID NO: 29871 - DNA, 22 bp, Homo sapiens
ttccagctaactcacatccctt

SEQ ID NO: 29872 - DNA, 22 bp, Homo sapiens
aaggggaagagaccgcagagtc

SEQ ID NO: 29873 - DNA, 22 bp, Homo sapiens
tcagtgttaatcagtggtacct

SEQ ID NO: 29874 - DNA, 22 bp, Homo sapiens
ggcgcacaatgtgcaggtttgt

SEQ ID NO: 29875 - DNA, 22 bp, Homo sapiens
aaggaggcctggcagatgaaga

SEQ ID NO: 29876 - DNA, 22 bp, Homo sapiens
aggggagagttaatgtgaatgt

SEQ ID NO: 29877 - DNA, 22 bp, Homo sapiens
aaggagaaatggtagatgtgca

SEQ ID NO: 29878 - DNA, 22 bp, Homo sapiens
tgacctattagatttccttgcc

SEQ ID NO: 29879 - DNA, 19 bp, Homo sapiens
agtcctggcctgggggacc

SEQ ID NO: 29880 - DNA, 22 bp, Homo sapiens
tgagatgaataactcctgctaa

SEQ ID NO: 29881 - DNA, 22 bp, Homo sapiens
caaatgaatatttccatgggtt

SEQ ID NO: 29882 - DNA, 22 bp, Homo sapiens
tcctcagtcacggtagcacatt

SEQ ID NO: 29883 - DNA, 22 bp, Homo sapiens
ggcagggcaggaaagtcaggaa

SEQ ID NO: 29884 - DNA, 22 bp, Homo sapiens
gtgctggggagataggaagaga

SEQ ID NO: 29885 - DNA, 22 bp, Homo sapiens
gataccagacagggagggagaa

SEQ ID NO: 29886 - DNA, 22 bp, Homo sapiens
gggcggggggagctggaatgaa

SEQ ID NO: 29887 - DNA, 22 bp, Homo sapiens
ggagagcagggaggctgctctg

SEQ ID NO: 29888 - DNA, 18 bp, Homo sapiens
cagggctgtggggtcact

SEQ ID NO: 29889 - DNA, 22 bp, Homo sapiens
gagagcaggaggcagcgggacg

SEQ ID NO: 29890 - DNA, 22 bp, Homo sapiens
tttgggcaggcttttccctaga

SEQ ID NO: 29891 - DNA, 22 bp, Homo sapiens
tctggtgtcagtattctttgaa

SEQ ID NO: 29892 - DNA, 22 bp, Homo sapiens
tacctcaagttccaggaaagcg

SEQ ID NO: 29893 - DNA, 18 bp, Homo sapiens
ggtgagggagctggaagc

SEQ ID NO: 29894 - DNA, 22 bp, Homo sapiens
ctccttctgggcctggcagtgg

SEQ ID NO: 29895 - DNA, 22 bp, Homo sapiens
aagacttgaccaggttgaaggc

SEQ ID NO: 29896 - DNA, 18 bp, Homo sapiens
actctttctgcccacagg

SEQ ID NO: 29897 - DNA, 22 bp, Homo sapiens
ccaggaggttgaggctgcagtg

SEQ ID NO: 29898 - DNA, 17 bp, Homo sapiens
cccgttctcttcgctgg

SEQ ID NO: 29899 - DNA, 22 bp, Homo sapiens
ctccagtgcttctagaaaatac

SEQ ID NO: 29900 - DNA, 22 bp, Homo sapiens
cacagtcctgccagagggcctt

SEQ ID NO: 29901 - DNA, 22 bp, Homo sapiens
tttagattgtgacctcccccca

SEQ ID NO: 29902 - DNA, 22 bp, Homo sapiens
taactctgaatcctcacagcag

SEQ ID NO: 29903 - DNA, 19 bp, Homo sapiens
tcctgcccaccagccaggg

SEQ ID NO: 29904 - DNA, 22 bp, Homo sapiens
tcagggctgcagaagaggcagg

SEQ ID NO: 29905 - DNA, 22 bp, Homo sapiens
gggaaatctcgtcctctattta

SEQ ID NO: 29906 - DNA, 22 bp, Homo sapiens
tgttcagaacaaaggtaaatga

SEQ ID NO: 29907 - DNA, 22 bp, Homo sapiens
tgtctttgttattgtggacagg

SEQ ID NO: 29908 - DNA, 22 bp, Homo sapiens
gaaggaagtcattagtgcagac

SEQ ID NO: 29909 - DNA, 22 bp, Homo sapiens
tgacagagtgacactcttgtct

SEQ ID NO: 29910 - DNA, 22 bp, Homo sapiens
tgaagaaacgcagagaggtagg

SEQ ID NO: 29911 - DNA, 22 bp, Homo sapiens
tgagagttctctcttcaggtgg

SEQ ID NO: 29912 - DNA, 22 bp, Homo sapiens
tgacagaggagctggaatgatt

SEQ ID NO: 29913 - DNA, 22 bp, Homo sapiens
gctggtagacctcactgcactc

SEQ ID NO: 29914 - DNA, 22 bp, Homo sapiens
tgacttgtctctttgggagaca

SEQ ID NO: 29915 - DNA, 21 bp, Homo sapiens
agtagtttagcacagggtttg

SEQ ID NO: 29916 - DNA, 22 bp, Homo sapiens
tgctgtgaggttgagaaggaag

SEQ ID NO: 29917 - DNA, 22 bp, Homo sapiens
ttgtatagcccagagagtgaga

SEQ ID NO: 29918 - DNA, 22 bp, Homo sapiens
aggcaatcccctgaggatactt

SEQ ID NO: 29919 - DNA, 21 bp, Homo sapiens
agcgtcaatatcgtcaacagg

SEQ ID NO: 29920 - DNA, 22 bp, Homo sapiens
ggaagaaaggtggacaacaggt

SEQ ID NO: 29921 - DNA, 22 bp, Homo sapiens
cccccaaagtttgcacggataa

SEQ ID NO: 29922 - DNA, 22 bp, Homo sapiens
acagattcactgcactggccat

SEQ ID NO: 29923 - DNA, 22 bp, Homo sapiens
ctccaggccatggctgcggagg

SEQ ID NO: 29924 - DNA, 22 bp, Homo sapiens
gtcaggactctgacccgtcccg

SEQ ID NO: 29925 - DNA, 22 bp, Homo sapiens
tcccacacagcccgctcaccgg

SEQ ID NO: 29926 - DNA, 22 bp, Homo sapiens
cgccccggacgtctgaccaaac

SEQ ID NO: 29927 - DNA, 18 bp, Homo sapiens
tgtagagccaggtttgcc

SEQ ID NO: 29928 - DNA, 22 bp, Homo sapiens
tgactctgataagacatatggc

SEQ ID NO: 29929 - DNA, 21 bp, Homo sapiens
tcctgtaagcttgggtggctc

SEQ ID NO: 29930 - DNA, 22 bp, Homo sapiens
ggttcccggatctccgagtccc

SEQ ID NO: 29931 - DNA, 22 bp, Homo sapiens
actctggccatcttggaccttg

SEQ ID NO: 29932 - DNA, 22 bp, Homo sapiens
ggctgagttgagaggattactt

SEQ ID NO: 29933 - DNA, 22 bp, Homo sapiens
ttccacattccttacattcata

SEQ ID NO: 29934 - DNA, 22 bp, Homo sapiens
ccttgctcaagctagtgacggg

SEQ ID NO: 29935 - DNA, 21 bp, Homo sapiens
ttagaagctaatgcagctggt

SEQ ID NO: 29936 - DNA, 19 bp, Homo sapiens
catctggatgattctcctg

SEQ ID NO: 29937 - DNA, 22 bp, Homo sapiens
tcctggcaaagatgttggtgtt

SEQ ID NO: 29938 - DNA, 22 bp, Homo sapiens
agaggccggccgagcccatggg

SEQ ID NO: 29939 - DNA, 22 bp, Homo sapiens
catcagaacgtgagctccttgt

SEQ ID NO: 29940 - DNA, 22 bp, Homo sapiens
ggtcattatagtggggaggtgg

SEQ ID NO: 29941 - DNA, 22 bp, Homo sapiens
ttcccacattctttacattcat

SEQ ID NO: 29942 - DNA, 22 bp, Homo sapiens
gcagcctcaaactccccagctc

SEQ ID NO: 29943 - DNA, 22 bp, Homo sapiens
tctggcttccctctgttctggg

SEQ ID NO: 29944 - DNA, 22 bp, Homo sapiens
aaagatcacgtcccaggactcg

SEQ ID NO: 29945 - DNA, 22 bp, Homo sapiens
ctgagggtcaacttgattgtat

SEQ ID NO: 29946 - DNA, 22 bp, Homo sapiens
gccatcatatcccctgtgacct

SEQ ID NO: 29947 - DNA, 22 bp, Homo sapiens
cccgagtgtctactcactccca

SEQ ID NO: 29948 - DNA, 22 bp, Homo sapiens
catgagataatttttctccagt

SEQ ID NO: 29949 - DNA, 22 bp, Homo sapiens
atagggcctaaaaagtattgct

SEQ ID NO: 29950 - DNA, 22 bp, Homo sapiens
ttggaacatgccggggtccagg

SEQ ID NO: 29951 - DNA, 22 bp, Homo sapiens
taaagggtaggttttactgtaa

SEQ ID NO: 29952 - DNA, 17 bp, Homo sapiens
ttaaggtggatcagcac

SEQ ID NO: 29953 - DNA, 20 bp, Homo sapiens
ttcatgggagcaaagaggcc

SEQ ID NO: 29954 - DNA, 22 bp, Homo sapiens
tccaccctgcttttgtctttga

SEQ ID NO: 29955 - DNA, 22 bp, Homo sapiens
gggacaatggaggcctctctcc

SEQ ID NO: 29956 - DNA, 22 bp, Homo sapiens
tagcccctgcctttgaacctgg

SEQ ID NO: 29957 - DNA, 22 bp, Homo sapiens
gctggcagacttcctctggaac

SEQ ID NO: 29958 - DNA, 22 bp, Homo sapiens
tgttgagtatatacctacaagt

SEQ ID NO: 29959 - DNA, 22 bp, Homo sapiens
gttcccattggggatcttgggc

SEQ ID NO: 29960 - DNA, 22 bp, Homo sapiens
cgggcaaggcgagactaggccc

SEQ ID NO: 29961 - DNA, 22 bp, Homo sapiens
gagacctcttggtatcgctagg

SEQ ID NO: 29962 - DNA, 22 bp, Homo sapiens
acacagagccaaaccatatcac

SEQ ID NO: 29963 - DNA, 22 bp, Homo sapiens
gcctccggagtcacagtgtctt

SEQ ID NO: 29964 - DNA, 22 bp, Homo sapiens
ttatttaatgtgatctgaagag

SEQ ID NO: 29965 - DNA, 22 bp, Homo sapiens
cggctggtgtcgggcacagcaa

SEQ ID NO: 29966 - DNA, 22 bp, Homo sapiens
cttgtcttgcacacggttgcca

SEQ ID NO: 29967 - DNA, 22 bp, Homo sapiens
gctgcgccggatcccacgttcc

SEQ ID NO: 29968 - DNA, 22 bp, Homo sapiens
atgttggagtcgtaaggcatgg

SEQ ID NO: 29969 - DNA, 22 bp, Homo sapiens
cccacacacatttatgatagga

SEQ ID NO: 29970 - DNA, 22 bp, Homo sapiens
acaattctgatggtttcccagt

SEQ ID NO: 29971 - DNA, 22 bp, Homo sapiens
acaggtcctcaagtcagctggg

SEQ ID NO: 29972 - DNA, 22 bp, Homo sapiens
cgctgataaacgtcacgttccc

SEQ ID NO: 29973 - DNA, 18 bp, Homo sapiens
actctgcggaggccccag

SEQ ID NO: 29974 - DNA, 22 bp, Homo sapiens
caggctggagtgcaatgacgcc

SEQ ID NO: 29975 - DNA, 22 bp, Homo sapiens
ggtgccaggctgtagtcagggt

SEQ ID NO: 29976 - DNA, 22 bp, Homo sapiens
gccaggttgctgacgacgatct

SEQ ID NO: 29977 - DNA, 22 bp, Homo sapiens
tgcctaggctggagtgtagtgg

SEQ ID NO: 29978 - DNA, 22 bp, Homo sapiens
tgggactcactcttttggccag

SEQ ID NO: 29979 - DNA, 19 bp, Homo sapiens
tcctgcctggggccgcctg

SEQ ID NO: 29980 - DNA, 22 bp, Homo sapiens
ggcaagagggcagatggagtgc

SEQ ID NO: 29981 - DNA, 21 bp, Homo sapiens
gggcagaggggcctcctgggt

SEQ ID NO: 29982 - DNA, 22 bp, Homo sapiens
actgccaatggtagtttgatgg

SEQ ID NO: 29983 - DNA, 22 bp, Homo sapiens
ggcaaggggtcaggctgagaca

SEQ ID NO: 29984 - DNA, 20 bp, Homo sapiens
tggcctctgagatgccacgg

SEQ ID NO: 29985 - DNA, 22 bp, Homo sapiens
atctggctcccttggaatccgt

SEQ ID NO: 29986 - DNA, 22 bp, Homo sapiens
ggaggacaggggctgcagcaca

SEQ ID NO: 29987 - DNA, 22 bp, Homo sapiens
gccgggaccaaggccacggagc

SEQ ID NO: 29988 - DNA, 18 bp, Homo sapiens
aggcttacagcagcaggc

SEQ ID NO: 29989 - DNA, 22 bp, Homo sapiens
tgttgactcaacactgtgggca

SEQ ID NO: 29990 - DNA, 22 bp, Homo sapiens
gctgctaagcgtttctgttcca

SEQ ID NO: 29991 - DNA, 22 bp, Homo sapiens
ggagaagaggagctggaagcct

SEQ ID NO: 29992 - DNA, 22 bp, Homo sapiens
tgatctggtcctactgtgggca

SEQ ID NO: 29993 - DNA, 21 bp, Homo sapiens
tcacgtggtcacatgagcttt

SEQ ID NO: 29994 - DNA, 22 bp, Homo sapiens
gtttgtcttaattaggcatcga

SEQ ID NO: 29995 - DNA, 22 bp, Homo sapiens
ctctctgggcccagttggcacc

SEQ ID NO: 29996 - DNA, 22 bp, Homo sapiens
agccagggtctctcgctctgtt

SEQ ID NO: 29997 - DNA, 21 bp, Homo sapiens
tgactgaggcttcttcacaca

SEQ ID NO: 29998 - DNA, 22 bp, Homo sapiens
ttattttaccttcctctgagct

SEQ ID NO: 29999 - DNA, 17 bp, Homo sapiens
cttcccaccatctcctg

SEQ ID NO: 30000 - DNA, 22 bp, Homo sapiens
gcccagccacagtcactttcat

SEQ ID NO: 30001 - DNA, 22 bp, Homo sapiens
tattttgtgccatgcactgcct

SEQ ID NO: 30002 - DNA, 22 bp, Homo sapiens
gatctggaatctgaaggctgag

SEQ ID NO: 30003 - DNA, 22 bp, Homo sapiens
tgagtagagaattcagctaagg

SEQ ID NO: 30004 - DNA, 22 bp, Homo sapiens
caaatactacgattcttgcagt

SEQ ID NO: 30005 - DNA, 22 bp, Homo sapiens
ctccaggctcgtccaagatcga

SEQ ID NO: 30006 - DNA, 22 bp, Homo sapiens
gacccggctccaggcccagcag

SEQ ID NO: 30007 - DNA, 22 bp, Homo sapiens
gcctccggagttgcagtgtctt

SEQ ID NO: 30008 - DNA, 22 bp, Homo sapiens
ctggcaggagcattcacagagg

SEQ ID NO: 30009 - DNA, 22 bp, Homo sapiens
ccatcacagtccccatcgtgat

SEQ ID NO: 30010 - DNA, 22 bp, Homo sapiens
atggcctgcagtgctgccacag

SEQ ID NO: 30011 - DNA, 22 bp, Homo sapiens
cctggcaggtggcgccctcggc

SEQ ID NO: 30012 - DNA, 22 bp, Homo sapiens
gggtaattggggccttgcagtg

SEQ ID NO: 30013 - DNA, 22 bp, Homo sapiens
tatttaataaaactatggcatg

SEQ ID NO: 30014 - DNA, 22 bp, Homo sapiens
aagtcgtggcaggcttgcacga

SEQ ID NO: 30015 - DNA, 22 bp, Homo sapiens
gagaggtggaggttgcagtgag

SEQ ID NO: 30016 - DNA, 22 bp, Homo sapiens
gggtaaatctcttttcatggct

SEQ ID NO: 30017 - DNA, 22 bp, Homo sapiens
acagattcactgcactggccat

SEQ ID NO: 30018 - DNA, 21 bp, Homo sapiens
cactccacttagaacagggtt

SEQ ID NO: 30019 - DNA, 22 bp, Homo sapiens
atgttggagtcgtaaggcatgg

SEQ ID NO: 30020 - DNA, 22 bp, Homo sapiens
agaggccggccgagcccatggg

SEQ ID NO: 30021 - DNA, 22 bp, Homo sapiens
tttgaagggcacgacaatagtt

SEQ ID NO: 30022 - DNA, 22 bp, Homo sapiens
cgcgaggtggaggttgcagtga

SEQ ID NO: 30023 - DNA, 21 bp, Homo sapiens
tggctaaaccctagtaaatta

SEQ ID NO: 30024 - DNA, 22 bp, Homo sapiens
tcactgcaacctccacctcctg

SEQ ID NO: 30025 - DNA, 17 bp, Homo sapiens
cttcccaccatctcctg

SEQ ID NO: 30026 - DNA, 22 bp, Homo sapiens
cactgcactccatcctgggaaa

SEQ ID NO: 30027 - DNA, 22 bp, Homo sapiens
tcactgcaacctccacctcccg

SEQ ID NO: 30028 - DNA, 22 bp, Homo sapiens
ttcattttctttcacgctgctg

SEQ ID NO: 30029 - DNA, 22 bp, Homo sapiens
gaatgacgccctgtggtcactt

SEQ ID NO: 30030 - DNA, 22 bp, Homo sapiens
gctgctaagcgtttctgttcca

SEQ ID NO: 30031 - DNA, 22 bp, Homo sapiens
attcacctttccccaaaatgag

SEQ ID NO: 30032 - DNA, 22 bp, Homo sapiens
tcgcaccattgcactccagcca

SEQ ID NO: 30033 - DNA, 22 bp, Homo sapiens
atgtttaaagggttgagaaata

SEQ ID NO: 30034 - DNA, 22 bp, Homo sapiens
cccacacacatttatgatagga

SEQ ID NO: 30035 - DNA, 21 bp, Homo sapiens
gggcagaggggcctcctgggt

SEQ ID NO: 30036 - DNA, 22 bp, Homo sapiens
gacccggctccaggcccagcag

SEQ ID NO: 30037 - DNA, 22 bp, Homo sapiens
actgcactccagcctgggtaac

SEQ ID NO: 30038 - DNA, 22 bp, Homo sapiens
tggctaaaccctagtaaattaa

SEQ ID NO: 30039 - DNA, 22 bp, Homo sapiens
ctggcaagaaatatatatctta

SEQ ID NO: 30040 - DNA, 22 bp, Homo sapiens
gggacaatggaggcctctctcc

SEQ ID NO: 30041 - DNA, 22 bp, Homo sapiens
caaatactacgattcttgcagt

SEQ ID NO: 30042 - DNA, 22 bp, Homo sapiens
gcctgtgtggatgcgccggtgc

SEQ ID NO: 30043 - DNA, 22 bp, Homo sapiens
tgaacatgctgttgatggcctg

SEQ ID NO: 30044 - DNA, 22 bp, Homo sapiens
gctgcagtgagccaagatcgtg

SEQ ID NO: 30045 - DNA, 22 bp, Homo sapiens
gtaggtcagacataagaggaca

SEQ ID NO: 30046 - DNA, 22 bp, Homo sapiens
acaattctgatggtttcccagt

SEQ ID NO: 30047 - DNA, 22 bp, Homo sapiens
gtagttctgcagtgtcacctga

SEQ ID NO: 30048 - DNA, 22 bp, Homo sapiens
ttatttaatgtgatctgaagag

SEQ ID NO: 30049 - DNA, 22 bp, Homo sapiens
gcccagccacagtcactttcat

SEQ ID NO: 30050 - DNA, 22 bp, Homo sapiens
tgtaagtagtaatggaaggaca

SEQ ID NO: 30051 - DNA, 22 bp, Homo sapiens
tgttatctgagcaacgtcgacg

SEQ ID NO: 30052 - DNA, 22 bp, Homo sapiens
gagacctcttggtatcgctagg

SEQ ID NO: 30053 - DNA, 22 bp, Homo sapiens
cgctgataaacgtcacgttccc

SEQ ID NO: 30054 - DNA, 21 bp, Homo sapiens
tgactgaggcttcttcacaca

SEQ ID NO: 30055 - DNA, 21 bp, Homo sapiens
tcctgtaagcttgggtggctc

SEQ ID NO: 30056 - DNA, 22 bp, Homo sapiens
actgcactcctgcctgggtaac

SEQ ID NO: 30057 - DNA, 22 bp, Homo sapiens
tccaagatctacagcagtttag

SEQ ID NO: 30058 - DNA, 22 bp, Homo sapiens
atagggcctaaaaagtattgct

SEQ ID NO: 30059 - DNA, 22 bp, Homo sapiens
attaatgaaactttggttaagc

SEQ ID NO: 30060 - DNA, 22 bp, Homo sapiens
ccttgctcaagctagtgacggg

SEQ ID NO: 30061 - DNA, 22 bp, Homo sapiens
tcaaatgaagacagttgacttg

SEQ ID NO: 30062 - DNA, 22 bp, Homo sapiens
cgcaccactgaattccagcctg

SEQ ID NO: 30063 - DNA, 22 bp, Homo sapiens
ttccacattccttacattcata

SEQ ID NO: 30064 - DNA, 20 bp, Homo sapiens
ttcatgggagcaaagaggcc

SEQ ID NO: 30065 - DNA, 22 bp, Homo sapiens
gtccccgacgtttggcttgatg

SEQ ID NO: 30066 - DNA, 19 bp, Homo sapiens
ttgacgttgtggaattaac

SEQ ID NO: 30067 - DNA, 22 bp, Homo sapiens
cccccaaagtttgcacggataa

SEQ ID NO: 30068 - DNA, 22 bp, Homo sapiens
acacagagccaaaccatatcac

SEQ ID NO: 30069 - DNA, 17 bp, Homo sapiens
gtaaggcttgcagatgc

SEQ ID NO: 30070 - DNA, 22 bp, Homo sapiens
acaggtcctcaagtcagctggg

SEQ ID NO: 30071 - DNA, 18 bp, Homo sapiens
cttgttcttctcttggcg

SEQ ID NO: 30072 - DNA, 22 bp, Homo sapiens
ctgcatccatgttgctgcaaag

SEQ ID NO: 30073 - DNA, 22 bp, Homo sapiens
gattcactcatattttacgttt

SEQ ID NO: 30074 - DNA, 22 bp, Homo sapiens
cactgcactccagcctgggtca

SEQ ID NO: 30075 - DNA, 22 bp, Homo sapiens
cggaggttgaggctgcagtgag

SEQ ID NO: 30076 - DNA, 22 bp, Homo sapiens
ttaatgaaaggcagtttggaac

SEQ ID NO: 30077 - DNA, 22 bp, Homo sapiens
tgtggacgtcattaaagcagtg

SEQ ID NO: 30078 - DNA, 22 bp, Homo sapiens
gtatggcactatcctctctgat

SEQ ID NO: 30079 - DNA, 22 bp, Homo sapiens
tttgtgaataggttggcttcca

SEQ ID NO: 30080 - DNA, 22 bp, Homo sapiens
cactgcactccagcctgggtga

SEQ ID NO: 30081 - DNA, 22 bp, Homo sapiens
tgagtagagaattcagctaagg

SEQ ID NO: 30082 - DNA, 22 bp, Homo sapiens
ctgagggtcaacttgattgtat

SEQ ID NO: 30083 - DNA, 22 bp, Homo sapiens
taaagggtaggttttactgtaa

SEQ ID NO: 30084 - DNA, 22 bp, Homo sapiens
tcccacacagcccgctcaccgg

SEQ ID NO: 30085 - DNA, 22 bp, Homo sapiens
ccatcacagtccccatcgtgat

SEQ ID NO: 30086 - DNA, 22 bp, Homo sapiens
ttcccacattctttacattcat

SEQ ID NO: 30087 - DNA, 22 bp, Homo sapiens
cactgcactccagcccgggcaa

SEQ ID NO: 30088 - DNA, 22 bp, Homo sapiens
cattcattacactcataaggtt

SEQ ID NO: 30089 - DNA, 22 bp, Homo sapiens
actcatgtcctaggagtaaagc

SEQ ID NO: 30090 - DNA, 18 bp, Homo sapiens
tgtagagccaggtttgcc

SEQ ID NO: 30091 - DNA, 22 bp, Homo sapiens
ggtccccgtggaggctggagcg

SEQ ID NO: 30092 - DNA, 22 bp, Homo sapiens
cactgcactccagcctgggaga

SEQ ID NO: 30093 - DNA, 22 bp, Homo sapiens
ttaataaagtatgaattggaaa

SEQ ID NO: 30094 - DNA, 22 bp, Homo sapiens
cactgcacttcagcctgggtga

SEQ ID NO: 30095 - DNA, 22 bp, Homo sapiens
actgccaatggtagtttgatgg

SEQ ID NO: 30096 - DNA, 22 bp, Homo sapiens
tatactctgagaaacgtgtcac

SEQ ID NO: 30097 - DNA, 23 bp, Homo sapiens
ctatttctcatagttcaggtctt

SEQ ID NO: 30098 - DNA, 22 bp, Homo sapiens
gctcccaccgccgctatgggta

SEQ ID NO: 30099 - DNA, 21 bp, Homo sapiens
ctacttaagtaggggattagg

SEQ ID NO: 30100 - DNA, 22 bp, Homo sapiens
aggtggtgtttggttacatgag

SEQ ID NO: 30101 - DNA, 22 bp, Homo sapiens
gcatgcaatctatccttaggaa

SEQ ID NO: 30102 - DNA, 22 bp, Homo sapiens
ctcagactagcctgtaccgaca

SEQ ID NO: 30103 - DNA, 22 bp, Homo sapiens
catgttggtgtgctgcacccgt

SEQ ID NO: 30104 - DNA, 22 bp, Homo sapiens
gctgggctgcgtcggggaagcc

SEQ ID NO: 30105 - DNA, 22 bp, Homo sapiens
atccccctcttggatggcggca

SEQ ID NO: 30106 - DNA, 22 bp, Homo sapiens
ggaccaggactggtggtatctc

SEQ ID NO: 30107 - DNA, 22 bp, Homo sapiens
gcctcctggggtgccatcatct

SEQ ID NO: 30108 - DNA, 22 bp, Homo sapiens
gacagacacaattgatccatga

SEQ ID NO: 30109 - DNA, 22 bp, Homo sapiens
ggagaggcttccagagtcgtgc

SEQ ID NO: 30110 - DNA, 22 bp, Homo sapiens
tcattgagttgcacttttacta

SEQ ID NO: 30111 - DNA, 22 bp, Homo sapiens
ttgagcaatgtcactgaggctt

SEQ ID NO: 30112 - DNA, 22 bp, Homo sapiens
ggaggcccagaaggaagcccag

SEQ ID NO: 30113 - DNA, 22 bp, Homo sapiens
tagcataacaggtaagagtgag

SEQ ID NO: 30114 - DNA, 22 bp, Homo sapiens
ggaactcctgctccaagcagct

SEQ ID NO: 30115 - DNA, 22 bp, Homo sapiens
ggctgtggagctgcagagttgg

SEQ ID NO: 30116 - DNA, 22 bp, Homo sapiens
catgtaaagaatttcacacaag

SEQ ID NO: 30117 - DNA, 22 bp, Homo sapiens
gccaggctgaggctctggaaga

SEQ ID NO: 30118 - DNA, 17 bp, Homo sapiens
tgcatgtcctttgttcc

SEQ ID NO: 30119 - DNA, 22 bp, Homo sapiens
agaaagtgcttccctttggact

SEQ ID NO: 30120 - DNA, 22 bp, Homo sapiens
aggtcaagggagctgagggcca

SEQ ID NO: 30121 - DNA, 22 bp, Homo sapiens
taggcatgcaaataaatgtgca

SEQ ID NO: 30122 - DNA, 22 bp, Homo sapiens
cctgacaggcggaggctgcagt

SEQ ID NO: 30123 - DNA, 22 bp, Homo sapiens
gggcttggcacatgggctcagc

SEQ ID NO: 30124 - DNA, 22 bp, Homo sapiens
caaagtgctaggattacaggcc

SEQ ID NO: 30125 - DNA, 22 bp, Homo sapiens
tctcctggagcccagatgctgg

SEQ ID NO: 30126 - DNA, 22 bp, Homo sapiens
cggatcctcagtcgtgcgggag

SEQ ID NO: 30127 - DNA, 22 bp, Homo sapiens
ggccagaagttggaaaagagcc

SEQ ID NO: 30128 - DNA, 22 bp, Homo sapiens
ctgggaggcggagcttgcagtg

SEQ ID NO: 30129 - DNA, 22 bp, Homo sapiens
cctccccacagcccaggagact

SEQ ID NO: 30130 - DNA, 22 bp, Homo sapiens
cccagcaggaggaggttgcagt

SEQ ID NO: 30131 - DNA, 22 bp, Homo sapiens
cctgggcctctcaaagtgctgg

SEQ ID NO: 30132 - DNA, 22 bp, Homo sapiens
caagaatcaacattatttagtg

SEQ ID NO: 30133 - DNA, 22 bp, Homo sapiens
tacaccattcccaggtggattt

SEQ ID NO: 30134 - DNA, 22 bp, Homo sapiens
tacaaagtcttgggttctaggc

SEQ ID NO: 30135 - DNA, 22 bp, Homo sapiens
ttcccttaaattatggcatcta

SEQ ID NO: 30136 - DNA, 22 bp, Homo sapiens
catttacatttaaggttaatat

SEQ ID NO: 30137 - DNA, 22 bp, Homo sapiens
tagtatagattgaagcagatca

SEQ ID NO: 30138 - DNA, 22 bp, Homo sapiens
agtgcagtggttaggagccagg

SEQ ID NO: 30139 - DNA, 22 bp, Homo sapiens
aagagggctgcaatcttattgc

SEQ ID NO: 30140 - DNA, 22 bp, Homo sapiens
caggctggagtgcaatgacgcc

SEQ ID NO: 30141 - DNA, 22 bp, Homo sapiens
gcgttggggaccccgaagctgg

SEQ ID NO: 30142 - DNA, 22 bp, Homo sapiens
gagggagggactagcattctct

SEQ ID NO: 30143 - DNA, 22 bp, Homo sapiens
taggcaagtggaccagaggttt

SEQ ID NO: 30144 - DNA, 22 bp, Homo sapiens
tgcactccaggctgggtgacag

SEQ ID NO: 30145 - DNA, 18 bp, Homo sapiens
tcctttctccctcatctt

SEQ ID NO: 30146 - DNA, 22 bp, Homo sapiens
aacccaggagttggaggctgtg

SEQ ID NO: 30147 - DNA, 22 bp, Homo sapiens
gtctttatttgagattgtcatt

SEQ ID NO: 30148 - DNA, 22 bp, Homo sapiens
gctgctgcttgaaggctcggag

SEQ ID NO: 30149 - DNA, 22 bp, Homo sapiens
atgaaatatcttgaagaaattc

SEQ ID NO: 30150 - DNA, 22 bp, Homo sapiens
ctggctggagtgcaggtgagtg

SEQ ID NO: 30151 - DNA, 16 bp, Homo sapiens
tggggatggggaagag

SEQ ID NO: 30152 - DNA, 22 bp, Homo sapiens
tgtgggagaaggaagcaagctg

SEQ ID NO: 30153 - DNA, 22 bp, Homo sapiens
ggaggtcccaggcctggcagca

SEQ ID NO: 30154 - DNA, 22 bp, Homo sapiens
ggcagcactgcagcttgttggg

SEQ ID NO: 30155 - DNA, 22 bp, Homo sapiens
ccaggctggagtgcaatggcgt

SEQ ID NO: 30156 - DNA, 22 bp, Homo sapiens
tgccaggcgtggtggtgcgcac

SEQ ID NO: 30157 - DNA, 22 bp, Homo sapiens
cactgcactccagcctgggtca

SEQ ID NO: 30158 - DNA, 22 bp, Homo sapiens
gggagtgggtttggcctaggcc

SEQ ID NO: 30159 - DNA, 21 bp, Homo sapiens
gctcctggtgctgcgtggcgc

SEQ ID NO: 30160 - DNA, 22 bp, Homo sapiens
cagcccaggactgcaggtgttt

SEQ ID NO: 30161 - DNA, 22 bp, Homo sapiens
aaggccctgtctccaaatacag

SEQ ID NO: 30162 - DNA, 22 bp, Homo sapiens
tcaccggcagacgtggcctgat

SEQ ID NO: 30163 - DNA, 22 bp, Homo sapiens
ggggatggaggcgtgtggtcct

SEQ ID NO: 30164 - DNA, 22 bp, Homo sapiens
actgcacttcagcctgggtgac

SEQ ID NO: 30165 - DNA, 22 bp, Homo sapiens
acaggcttacaggctgcaagta

SEQ ID NO: 30166 - DNA, 22 bp, Homo sapiens
tgtcatagtgtggtagcagtgg

SEQ ID NO: 30167 - DNA, 15 bp, Homo sapiens
tggcccacccgttga

SEQ ID NO: 30168 - DNA, 20 bp, Homo sapiens
gggcagtggcgctatctcag

SEQ ID NO: 30169 - DNA, 22 bp, Homo sapiens
tgatttacagtagtgtctaaac

SEQ ID NO: 30170 - DNA, 22 bp, Homo sapiens
cactgcaacctccacctcctgg

SEQ ID NO: 30171 - DNA, 21 bp, Homo sapiens
ctggaggcaggtggtgccagg

SEQ ID NO: 30172 - DNA, 22 bp, Homo sapiens
tataaagagtctcaaagaagtt

SEQ ID NO: 30173 - DNA, 22 bp, Homo sapiens
ttcctaagtcctgccagcagtc

SEQ ID NO: 30174 - DNA, 22 bp, Homo sapiens
ctggagggtggagagaagtctc

SEQ ID NO: 30175 - DNA, 22 bp, Homo sapiens
agcagctttcacctccccgcct

SEQ ID NO: 30176 - DNA, 22 bp, Homo sapiens
gatgcgggcccgctccactgcc

SEQ ID NO: 30177 - DNA, 22 bp, Homo sapiens
catataaatacaacatgtgtta

SEQ ID NO: 30178 - DNA, 22 bp, Homo sapiens
tttagattgtgacctcccccca

SEQ ID NO: 30179 - DNA, 22 bp, Homo sapiens
acccaggctggagtgcagtgat

SEQ ID NO: 30180 - DNA, 22 bp, Homo sapiens
gtggagagagataagcctggtc

SEQ ID NO: 30181 - DNA, 22 bp, Homo sapiens
agaggaggctctgggatcgtcc

SEQ ID NO: 30182 - DNA, 22 bp, Homo sapiens
gtctgctcatgctaccgcgggc

SEQ ID NO: 30183 - DNA, 22 bp, Homo sapiens
ggaggcagaatagagtgtgggt

SEQ ID NO: 30184 - DNA, 22 bp, Homo sapiens
gagatcggtaaagagcatgcac

SEQ ID NO: 30185 - DNA, 22 bp, Homo sapiens
atggggaagcaattggatttcc

SEQ ID NO: 30186 - DNA, 22 bp, Homo sapiens
tgggaggccaaggcaggcggat

SEQ ID NO: 30187 - DNA, 22 bp, Homo sapiens
ccaggctggagtgcagtggcac

SEQ ID NO: 30188 - DNA, 22 bp, Homo sapiens
ggggccgaccgcggttcaggcc

SEQ ID NO: 30189 - DNA, 22 bp, Homo sapiens
aagaggcgccgggtacgtggcg

SEQ ID NO: 30190 - DNA, 22 bp, Homo sapiens
cagggggctcaaaggagagtgc

SEQ ID NO: 30191 - DNA, 22 bp, Homo sapiens
aggacctactgatatcttagca

SEQ ID NO: 30192 - DNA, 22 bp, Homo sapiens
agaatacttgggaatgggttaa

SEQ ID NO: 30193 - DNA, 22 bp, Homo sapiens
tacaaaaaattgatactgacga

SEQ ID NO: 30194 - DNA, 22 bp, Homo sapiens
ggttggtaactccctgtgcagt

SEQ ID NO: 30195 - DNA, 22 bp, Homo sapiens
tgaactcctgacctcatgatcc

SEQ ID NO: 30196 - DNA, 22 bp, Homo sapiens
ctggaaggcagaggttgcagtg

SEQ ID NO: 30197 - DNA, 22 bp, Homo sapiens
cgtgccactgcactctagcctg

SEQ ID NO: 30198 - DNA, 19 bp, Homo sapiens
taggaccctggtggccccc

SEQ ID NO: 30199 - DNA, 22 bp, Homo sapiens
cgtcatcacggcaagcatctcc

SEQ ID NO: 30200 - DNA, 22 bp, Homo sapiens
tcctgggacaagccgtggaagt

SEQ ID NO: 30201 - DNA, 22 bp, Homo sapiens
ccactgcacttcagcctgggtg

SEQ ID NO: 30202 - DNA, 22 bp, Homo sapiens
caggaaggcgcggctgtgcctg

SEQ ID NO: 30203 - DNA, 22 bp, Homo sapiens
ccccatgaagtagggtctctga

SEQ ID NO: 30204 - DNA, 22 bp, Homo sapiens
ttggaacatgccggggtccagg

SEQ ID NO: 30205 - DNA, 22 bp, Homo sapiens
aaggctgtggttctatacagaa

SEQ ID NO: 30206 - DNA, 22 bp, Homo sapiens
acccagccatgttcagttctct

SEQ ID NO: 30207 - DNA, 22 bp, Homo sapiens
cgccggcttgaggcaggcggca

SEQ ID NO: 30208 - DNA, 20 bp, Homo sapiens
ctgccgaccacagccatgga

SEQ ID NO: 30209 - DNA, 22 bp, Homo sapiens
ctggtaggggtgactgttatcg

SEQ ID NO: 30210 - DNA, 22 bp, Homo sapiens
gaggtaggtgtaggaggcctgc

SEQ ID NO: 30211 - DNA, 22 bp, Homo sapiens
aggctctgtcaggcggagcagc

SEQ ID NO: 30212 - DNA, 22 bp, Homo sapiens
acttgtgttaccaaggtttggt

SEQ ID NO: 30213 - DNA, 22 bp, Homo sapiens
gagcaggaaggccagaagggtc

SEQ ID NO: 30214 - DNA, 22 bp, Homo sapiens
tagtggatgggtaaagtatttt

SEQ ID NO: 30215 - DNA, 22 bp, Homo sapiens
agccaggatggtctcgatcggc

SEQ ID NO: 30216 - DNA, 22 bp, Homo sapiens
aaacatctactgtaggctggag

SEQ ID NO: 30217 - DNA, 22 bp, Homo sapiens
cccaggaggtcaaggctgcagt

SEQ ID NO: 30218 - DNA, 22 bp, Homo sapiens
tttaaaaaactagtctgagtct

SEQ ID NO: 30219 - DNA, 22 bp, Homo sapiens
cctgcagacacttgtccagcaa

SEQ ID NO: 30220 - DNA, 22 bp, Homo sapiens
ccttcccacattccttacatgc

SEQ ID NO: 30221 - DNA, 18 bp, Homo sapiens
ccatcaccctaactagtg

SEQ ID NO: 30222 - DNA, 22 bp, Homo sapiens
gtgcagagaggaccttggggag

SEQ ID NO: 30223 - DNA, 22 bp, Homo sapiens
ggctcaatgcaacttctgcctc

SEQ ID NO: 30224 - DNA, 22 bp, Homo sapiens
aaatatcttaggagtatatgag

SEQ ID NO: 30225 - DNA, 22 bp, Homo sapiens
cagcttggaggaggatctaaga

SEQ ID NO: 30226 - DNA, 22 bp, Homo sapiens
agggatggagtgcggcccggac

SEQ ID NO: 30227 - DNA, 22 bp, Homo sapiens
ccacgtccagctaattttcgta

SEQ ID NO: 30228 - DNA, 22 bp, Homo sapiens
ggaggagcatgagagggtagtg

SEQ ID NO: 30229 - DNA, 22 bp, Homo sapiens
tgagccatgggactccaaggga

SEQ ID NO: 30230 - DNA, 22 bp, Homo sapiens
ttcctggaaattatgctcacct

SEQ ID NO: 30231 - DNA, 22 bp, Homo sapiens
aacccgggaggcggaggttgtg

SEQ ID NO: 30232 - DNA, 22 bp, Homo sapiens
acccgatgttggtgctctagta

SEQ ID NO: 30233 - DNA, 22 bp, Homo sapiens
gaccctctagatggaagcactg

SEQ ID NO: 30234 - DNA, 22 bp, Homo sapiens
ctggcctaaaaatacagaacaa

SEQ ID NO: 30235 - DNA, 22 bp, Homo sapiens
aggaaataggaccagacaaagc

SEQ ID NO: 30236 - DNA, 22 bp, Homo sapiens
tcccccaggctggagtgcagtg

SEQ ID NO: 30237 - DNA, 22 bp, Homo sapiens
tcgcccagctcatctcccacaa

SEQ ID NO: 30238 - DNA, 23 bp, Homo sapiens
tctgtgtctccacccaaatctca

SEQ ID NO: 30239 - DNA, 22 bp, Homo sapiens
tattgtccaataggatgttcct

SEQ ID NO: 30240 - DNA, 22 bp, Homo sapiens
gtagctctgtttaaagttcttt

SEQ ID NO: 30241 - DNA, 22 bp, Homo sapiens
tctcatttacttccacaggctg

SEQ ID NO: 30242 - DNA, 22 bp, Homo sapiens
agggaagcagcagccgcctgtc

SEQ ID NO: 30243 - DNA, 22 bp, Homo sapiens
tgcagtcttccagctgcacaaa

SEQ ID NO: 30244 - DNA, 22 bp, Homo sapiens
cctgggaggctgaggctgcagt

SEQ ID NO: 30245 - DNA, 22 bp, Homo sapiens
tacaggcatgtagcatggtgat

SEQ ID NO: 30246 - DNA, 22 bp, Homo sapiens
gcaggctgtctaaagttagagt

SEQ ID NO: 30247 - DNA, 22 bp, Homo sapiens
gtagaggggtgattctgtgaga

SEQ ID NO: 30248 - DNA, 22 bp, Homo sapiens
cagctttgccaagtaaggtctt

SEQ ID NO: 30249 - DNA, 22 bp, Homo sapiens
ggagtgctttgaagccttcatt

SEQ ID NO: 30250 - DNA, 22 bp, Homo sapiens
actggacagaggaaatatggag

SEQ ID NO: 30251 - DNA, 22 bp, Homo sapiens
aggccagcctcaggcagggacc

SEQ ID NO: 30252 - DNA, 22 bp, Homo sapiens
ctgaaatgacggtttggggcaa

SEQ ID NO: 30253 - DNA, 22 bp, Homo sapiens
ctagttctagatccctgaggaa

SEQ ID NO: 30254 - DNA, 22 bp, Homo sapiens
ggggaccctcaggactgcgtct

SEQ ID NO: 30255 - DNA, 22 bp, Homo sapiens
caggagtgttgattgctcagga

SEQ ID NO: 30256 - DNA, 22 bp, Homo sapiens
accagcctggccaacatggcaa

SEQ ID NO: 30257 - DNA, 22 bp, Homo sapiens
attctggacaaggcaagctcct

SEQ ID NO: 30258 - DNA, 22 bp, Homo sapiens
gcccaggctggagtgcagtggt

SEQ ID NO: 30259 - DNA, 22 bp, Homo sapiens
gaggcagaggttgttgcagtga

SEQ ID NO: 30260 - DNA, 22 bp, Homo sapiens
cattgctttgtgcatatttaaa

SEQ ID NO: 30261 - DNA, 22 bp, Homo sapiens
attttctctttgtatatgctag

SEQ ID NO: 30262 - DNA, 22 bp, Homo sapiens
aacccgagggccccaggctcgg

SEQ ID NO: 30263 - DNA, 22 bp, Homo sapiens
ggcctctcttgggacagctgtc

SEQ ID NO: 30264 - DNA, 21 bp, Homo sapiens
tgctccaggagggggcagtcc

SEQ ID NO: 30265 - DNA, 22 bp, Homo sapiens
caggcaggtcagtgaagaagga

SEQ ID NO: 30266 - DNA, 22 bp, Homo sapiens
tctttctacatcatttgcttct

SEQ ID NO: 30267 - DNA, 22 bp, Homo sapiens
ttacaaagtttaaggtggcact

SEQ ID NO: 30268 - DNA, 23 bp, Homo sapiens
aaataggagtatctggatcatga

SEQ ID NO: 30269 - DNA, 22 bp, Homo sapiens
ttcataaacaaattaaggcctg

SEQ ID NO: 30270 - DNA, 22 bp, Homo sapiens
tcccaggccacacttggggaac

SEQ ID NO: 30271 - DNA, 22 bp, Homo sapiens
ctgccaggattctgtgaacccc

SEQ ID NO: 30272 - DNA, 22 bp, Homo sapiens
aactatgttaataagtttcatt

SEQ ID NO: 30273 - DNA, 22 bp, Homo sapiens
aaagaaatagatggcatttaaa

SEQ ID NO: 30274 - DNA, 22 bp, Homo sapiens
caaaatgcatctgagaccaggc

SEQ ID NO: 30275 - DNA, 22 bp, Homo sapiens
aacccaggaggcggaggttgtg

SEQ ID NO: 30276 - DNA, 22 bp, Homo sapiens
agctgctgagccaggctgatgt

SEQ ID NO: 30277 - DNA, 22 bp, Homo sapiens
ttggttttgaaatagcttattg

SEQ ID NO: 30278 - DNA, 22 bp, Homo sapiens
gctgagactgacatgaagaggt

SEQ ID NO: 30279 - DNA, 22 bp, Homo sapiens
ctgcactgagcatctaacctta

SEQ ID NO: 30280 - DNA, 22 bp, Homo sapiens
caggctggagtacaattgtgtg

SEQ ID NO: 30281 - DNA, 22 bp, Homo sapiens
tccagcagtccatgtgagacac

SEQ ID NO: 30282 - DNA, 21 bp, Homo sapiens
taaacataaccttgtatggct

SEQ ID NO: 30283 - DNA, 22 bp, Homo sapiens
ggctccctgcaacctccgcctc

SEQ ID NO: 30284 - DNA, 22 bp, Homo sapiens
cggtcaggtgcagcgttggcac

SEQ ID NO: 30285 - DNA, 22 bp, Homo sapiens
cttctgagatgttgttttacag

SEQ ID NO: 30286 - DNA, 22 bp, Homo sapiens
catgaaattgtattggcctcaa

SEQ ID NO: 30287 - DNA, 22 bp, Homo sapiens
ctaggctggagtgcagtggcac

SEQ ID NO: 30288 - DNA, 22 bp, Homo sapiens
tcccgtcttgctgttgtctgcg

SEQ ID NO: 30289 - DNA, 22 bp, Homo sapiens
cgtctaggccgtgccctgaggt

SEQ ID NO: 30290 - DNA, 22 bp, Homo sapiens
gcacttgtggatttgatataca

SEQ ID NO: 30291 - DNA, 22 bp, Homo sapiens
gctgctctccaagcctccttga

SEQ ID NO: 30292 - DNA, 22 bp, Homo sapiens
agcgccactgcactccagcctg

SEQ ID NO: 30293 - DNA, 22 bp, Homo sapiens
gctggctgacagatttggggtg

SEQ ID NO: 30294 - DNA, 22 bp, Homo sapiens
ctgtcaggttggtctcagagct

SEQ ID NO: 30295 - DNA, 22 bp, Homo sapiens
tctcaagcttgttggtatgttt

SEQ ID NO: 30296 - DNA, 22 bp, Homo sapiens
ttttggctctgtctgtatcttt

SEQ ID NO: 30297 - DNA, 22 bp, Homo sapiens
aggagaagccaagttgtgagca

SEQ ID NO: 30298 - DNA, 22 bp, Homo sapiens
atgattgaaaatgacattgcca

SEQ ID NO: 30299 - DNA, 22 bp, Homo sapiens
tggggagtgatgcctcggataa

SEQ ID NO: 30300 - DNA, 22 bp, Homo sapiens
ctgtaatcccagctactcggga

SEQ ID NO: 30301 - DNA, 22 bp, Homo sapiens
gtagtctgaacagtaattttgt

SEQ ID NO: 30302 - DNA, 22 bp, Homo sapiens
ccaggaggttgaggctgcagtg

SEQ ID NO: 30303 - DNA, 22 bp, Homo sapiens
ttccatttggcacttcactgag

SEQ ID NO: 30304 - DNA, 22 bp, Homo sapiens
atttttctctttccactgagat

SEQ ID NO: 30305 - DNA, 22 bp, Homo sapiens
agctcaagctacacacagagtc

SEQ ID NO: 30306 - DNA, 22 bp, Homo sapiens
tcacagcctggacagttgcctg

SEQ ID NO: 30307 - DNA, 22 bp, Homo sapiens
actgccaatggtagtttgatgg

SEQ ID NO: 30308 - DNA, 22 bp, Homo sapiens
ttcaatatgatattagctgtgg

SEQ ID NO: 30309 - DNA, 22 bp, Homo sapiens
ctggcaggttatagagctgccc

SEQ ID NO: 30310 - DNA, 22 bp, Homo sapiens
ccacagtctatgcaacaaggtc

SEQ ID NO: 30311 - DNA, 21 bp, Homo sapiens
gggcctggctgcgcaggacgg

SEQ ID NO: 30312 - DNA, 22 bp, Homo sapiens
gagctgagaagcagcgcttgat

SEQ ID NO: 30313 - DNA, 22 bp, Homo sapiens
tcatggggccacagctgccagc

SEQ ID NO: 30314 - DNA, 22 bp, Homo sapiens
tgtctggtgggttgacaggcag

SEQ ID NO: 30315 - DNA, 19 bp, Homo sapiens
tggttgtgcacgggttggt

SEQ ID NO: 30316 - DNA, 22 bp, Homo sapiens
tgcaatctcggcactttgggag

SEQ ID NO: 30317 - DNA, 22 bp, Homo sapiens
tgtagatatagaaaaagactga

SEQ ID NO: 30318 - DNA, 21 bp, Homo sapiens
ggccccgcagacccagcacgt

SEQ ID NO: 30319 - DNA, 22 bp, Homo sapiens
aatgtcaaaggctatacattca

SEQ ID NO: 30320 - DNA, 22 bp, Homo sapiens
cagtcacaagcgtacctaattt

SEQ ID NO: 30321 - DNA, 22 bp, Homo sapiens
aacctcaaactcttgggcttaa

SEQ ID NO: 30322 - DNA, 22 bp, Homo sapiens
gcaggaggttgagccaggactg

SEQ ID NO: 30323 - DNA, 22 bp, Homo sapiens
tcactgcaacctccacctcctg

SEQ ID NO: 30324 - DNA, 22 bp, Homo sapiens
ccgggcctcgggacaccgggta

SEQ ID NO: 30325 - DNA, 19 bp, Homo sapiens
gttttgcaggcagagggga

SEQ ID NO: 30326 - DNA, 22 bp, Homo sapiens
gaagatgttatggagagctcag

SEQ ID NO: 30327 - DNA, 22 bp, Homo sapiens
tcacttagatggggatcatcac

SEQ ID NO: 30328 - DNA, 22 bp, Homo sapiens
cacatgaaggctggggtcgtga

SEQ ID NO: 30329 - DNA, 22 bp, Homo sapiens
tgggcagggagctggaaccaca

SEQ ID NO: 30330 - DNA, 22 bp, Homo sapiens
caaagtgctaggattacaggcg

SEQ ID NO: 30331 - DNA, 21 bp, Homo sapiens
aggcttggatctagacaggcc

SEQ ID NO: 30332 - DNA, 22 bp, Homo sapiens
ctgcatccatgttgctgcaaag

SEQ ID NO: 30333 - DNA, 22 bp, Homo sapiens
tgggaagctgcattttaacaag

SEQ ID NO: 30334 - DNA, 22 bp, Homo sapiens
agggaattcactggaacgccct

SEQ ID NO: 30335 - DNA, 23 bp, Homo sapiens
aaacttgctatggctgaaatcat

SEQ ID NO: 30336 - DNA, 22 bp, Homo sapiens
actgcaacacctcctgggttca

SEQ ID NO: 30337 - DNA, 22 bp, Homo sapiens
ccaaagtgctggggttacaggc

SEQ ID NO: 30338 - DNA, 22 bp, Homo sapiens
gagcccaggaagtggaggctga

SEQ ID NO: 30339 - DNA, 21 bp, Homo sapiens
agctgcctccacttctgaggc

SEQ ID NO: 30340 - DNA, 22 bp, Homo sapiens
acggggctagagaaggtttctt

SEQ ID NO: 30341 - DNA, 22 bp, Homo sapiens
gggctgagacgatggggtcttc

SEQ ID NO: 30342 - DNA, 18 bp, Homo sapiens
cagcctctgattggttgc

SEQ ID NO: 30343 - DNA, 22 bp, Homo sapiens
tgggaggccgaggcaggtggat

SEQ ID NO: 30344 - DNA, 22 bp, Homo sapiens
gcgccccatctacagtactttt

SEQ ID NO: 30345 - DNA, 21 bp, Homo sapiens
gcccacagtgaggaggatccc

SEQ ID NO: 30346 - DNA, 18 bp, Homo sapiens
tgagaggctattttttgc

SEQ ID NO: 30347 - DNA, 22 bp, Homo sapiens
tttaagaagttatgttataaat

SEQ ID NO: 30348 - DNA, 22 bp, Homo sapiens
ctgggggcagcaagaagccatg

SEQ ID NO: 30349 - DNA, 22 bp, Homo sapiens
tgcctgttgcccacctgataaa

SEQ ID NO: 30350 - DNA, 22 bp, Homo sapiens
ccaaagtgctgggattacaggc

SEQ ID NO: 30351 - DNA, 22 bp, Homo sapiens
cggaggttgaggctgcagtgag

SEQ ID NO: 30352 - DNA, 22 bp, Homo sapiens
cactgcacttcagcctgggtga

SEQ ID NO: 30353 - DNA, 22 bp, Homo sapiens
gtctcctccctttcattcacct

SEQ ID NO: 30354 - DNA, 19 bp, Homo sapiens
catggtgaaaccccgtctc

SEQ ID NO: 30355 - DNA, 21 bp, Homo sapiens
agcctcaggttgttggttctt

SEQ ID NO: 30356 - DNA, 22 bp, Homo sapiens
aagtggcagttcaggaagcaga

SEQ ID NO: 30357 - DNA, 19 bp, Homo sapiens
ggtatatgggcctcacttg

SEQ ID NO: 30358 - DNA, 22 bp, Homo sapiens
tgtagtagcattcacgaagtgt

SEQ ID NO: 30359 - DNA, 22 bp, Homo sapiens
cgcaccactgaattccagcctg

SEQ ID NO: 30360 - DNA, 22 bp, Homo sapiens
gggcccctgggaattctgtgat

SEQ ID NO: 30361 - DNA, 22 bp, Homo sapiens
tgttgcccaggttctctcctgc

SEQ ID NO: 30362 - DNA, 22 bp, Homo sapiens
tgggggtgtcctggtgcacaca

SEQ ID NO: 30363 - DNA, 22 bp, Homo sapiens
agaaagtgcttccctttggtga

SEQ ID NO: 30364 - DNA, 17 bp, Homo sapiens
cttcccaccatctcctg

SEQ ID NO: 30365 - DNA, 22 bp, Homo sapiens
ctggcaagaaatatatatctta

SEQ ID NO: 30366 - DNA, 22 bp, Homo sapiens
gatgtagacacttggaggctta

SEQ ID NO: 30367 - DNA, 22 bp, Homo sapiens
gggtggtggccagcagtgggca

SEQ ID NO: 30368 - DNA, 22 bp, Homo sapiens
aggctatttccactcttctcat

SEQ ID NO: 30369 - DNA, 22 bp, Homo sapiens
gtggcttggaccagtcacagtg

SEQ ID NO: 30370 - DNA, 22 bp, Homo sapiens
ccaggctggagtatagtggcgc

SEQ ID NO: 30371 - DNA, 22 bp, Homo sapiens
tattgacagtgactattggtag

SEQ ID NO: 30372 - DNA, 22 bp, Homo sapiens
aggaattcaagaccagctgggc

SEQ ID NO: 30373 - DNA, 22 bp, Homo sapiens
gcaccgccttggaccgcccgct

SEQ ID NO: 30374 - DNA, 22 bp, Homo sapiens
aatattatcaaaagctttttca

SEQ ID NO: 30375 - DNA, 22 bp, Homo sapiens
agtgaaaacctaatcatgcagt

SEQ ID NO: 30376 - DNA, 22 bp, Homo sapiens
tcccgcttcttccgaatcgcga

SEQ ID NO: 30377 - DNA, 20 bp, Homo sapiens
tagcatgggtgagggtagag

SEQ ID NO: 30378 - DNA, 22 bp, Homo sapiens
tatctgatacaacagaataaca

SEQ ID NO: 30379 - DNA, 22 bp, Homo sapiens
aacagcgacgtcctccccaaca

SEQ ID NO: 30380 - DNA, 22 bp, Homo sapiens
gtgctggggagataggaagaga

SEQ ID NO: 30381 - DNA, 22 bp, Homo sapiens
gatggaggagatggcagggtgc

SEQ ID NO: 30382 - DNA, 22 bp, Homo sapiens
aatgctctttaacctattctga

SEQ ID NO: 30383 - DNA, 22 bp, Homo sapiens
gaggctgaggttgcagtgagct

SEQ ID NO: 30384 - DNA, 22 bp, Homo sapiens
cccaggaggtggagcttgcagt

SEQ ID NO: 30385 - DNA, 22 bp, Homo sapiens
cattgcaacttcaaactcctgg

SEQ ID NO: 30386 - DNA, 22 bp, Homo sapiens
cattggccttttatcctagagg

SEQ ID NO: 30387 - DNA, 22 bp, Homo sapiens
cccattcatcctcgcttccttc

SEQ ID NO: 30388 - DNA, 22 bp, Homo sapiens
agggctgcccagtgtgagagct

SEQ ID NO: 30389 - DNA, 22 bp, Homo sapiens
agtcaggggatctagacttgaa

SEQ ID NO: 30390 - DNA, 22 bp, Homo sapiens
aggcgcctgcgggatccttgcc

SEQ ID NO: 30391 - DNA, 20 bp, Homo sapiens
acgtggccaccagtggctta

SEQ ID NO: 30392 - DNA, 22 bp, Homo sapiens
gtggagaggaacccagctctgt

SEQ ID NO: 30393 - DNA, 22 bp, Homo sapiens
attcccagatttatattgatag

SEQ ID NO: 30394 - DNA, 22 bp, Homo sapiens
ttgcatttggttctgcctggta

SEQ ID NO: 30395 - DNA, 22 bp, Homo sapiens
tacaacaatttccacattagaa

SEQ ID NO: 30396 - DNA, 22 bp, Homo sapiens
aatatttccaaggcctgtcagg

SEQ ID NO: 30397 - DNA, 22 bp, Homo sapiens
ggcaggaacacagatggtgccg

SEQ ID NO: 30398 - DNA, 20 bp, Homo sapiens
ggcagagggcctgggagaag

SEQ ID NO: 30399 - DNA, 22 bp, Homo sapiens
atggccgcctgtccttcccgcc

SEQ ID NO: 30400 - DNA, 22 bp, Homo sapiens
ttggagatatcacaccttcaca

SEQ ID NO: 30401 - DNA, 22 bp, Homo sapiens
ttactggctgggcctgagggct

SEQ ID NO: 30402 - DNA, 22 bp, Homo sapiens
aacccgtgatcctgactcccct

SEQ ID NO: 30403 - DNA, 20 bp, Homo sapiens
ctgggtggcaagcaaggggg

SEQ ID NO: 30404 - DNA, 21 bp, Homo sapiens
cgcagagcgaacttgcggcgc

SEQ ID NO: 30405 - DNA, 22 bp, Homo sapiens
gaggaggcttccgggaggcacg

SEQ ID NO: 30406 - DNA, 16 bp, Homo sapiens
gcagaggaaaggggag

SEQ ID NO: 30407 - DNA, 22 bp, Homo sapiens
tctcccaagcctggcaggggca

SEQ ID NO: 30408 - DNA, 22 bp, Homo sapiens
gttactcctggttgagcttggt

SEQ ID NO: 30409 - DNA, 22 bp, Homo sapiens
ctccagttggccccagttggtt

SEQ ID NO: 30410 - DNA, 22 bp, Homo sapiens
acggtgaccaagcatcaccgag

SEQ ID NO: 30411 - DNA, 20 bp, Homo sapiens
gttaggaggttggacatgga

SEQ ID NO: 30412 - DNA, 22 bp, Homo sapiens
gaccttgtgctccgaggcgggc

SEQ ID NO: 30413 - DNA, 22 bp, Homo sapiens
gggggctaccgtctctggagct

SEQ ID NO: 30414 - DNA, 22 bp, Homo sapiens
agcccaggtccagttcactgca

SEQ ID NO: 30415 - DNA, 22 bp, Homo sapiens
actgcactccagcctgggtgat

SEQ ID NO: 30416 - DNA, 22 bp, Homo sapiens
ttctcttttcaccagttgctaa

SEQ ID NO: 30417 - DNA, 22 bp, Homo sapiens
tttgagtagtgagactaggcag

SEQ ID NO: 30418 - DNA, 22 bp, Homo sapiens
agatgtttataactcatgagtg

SEQ ID NO: 30419 - DNA, 22 bp, Homo sapiens
cgtgcgcctcagcctcgtgcgc

SEQ ID NO: 30420 - DNA, 22 bp, Homo sapiens
ctgagtttccagataagacctt

SEQ ID NO: 30421 - DNA, 22 bp, Homo sapiens
tccattatacttctgattcaaa

SEQ ID NO: 30422 - DNA, 22 bp, Homo sapiens
ctggagggctgcagcgaggctg

SEQ ID NO: 30423 - DNA, 22 bp, Homo sapiens
aagtaaatatctgtagtcttta

SEQ ID NO: 30424 - DNA, 22 bp, Homo sapiens
ccaaagtgctaggattacaggc

SEQ ID NO: 30425 - DNA, 22 bp, Homo sapiens
acattacctggcatttgatctt

SEQ ID NO: 30426 - DNA, 22 bp, Homo sapiens
tcctcagaatcacctggcagct

SEQ ID NO: 30427 - DNA, 22 bp, Homo sapiens
tcccgttgatgacggtgcatcc

SEQ ID NO: 30428 - DNA, 22 bp, Homo sapiens
ggggtgtggacggctgtgccag

SEQ ID NO: 30429 - DNA, 22 bp, Homo sapiens
ctgtctgaatcctaagcttcct

SEQ ID NO: 30430 - DNA, 22 bp, Homo sapiens
gccaccctggacgcactgttcg

SEQ ID NO: 30431 - DNA, 22 bp, Homo sapiens
gtggcccatcacgtttcgcctt

SEQ ID NO: 30432 - DNA, 22 bp, Homo sapiens
atctccgccatcgcgaacgcct

SEQ ID NO: 30433 - DNA, 17 bp, Homo sapiens
tggtccaggtggagcca

SEQ ID NO: 30434 - DNA, 22 bp, Homo sapiens
gggaagtgagctggaatcaagg

SEQ ID NO: 30435 - DNA, 15 bp, Homo sapiens
tggtggtgttgagac

SEQ ID NO: 30436 - DNA, 22 bp, Homo sapiens
tcagggattgcaaaattcatcc

SEQ ID NO: 30437 - DNA, 19 bp, Homo sapiens
acacagggatcagagggtt

SEQ ID NO: 30438 - DNA, 22 bp, Homo sapiens
aacccgggaggcagaggttgtg

SEQ ID NO: 30439 - DNA, 22 bp, Homo sapiens
agggtgaatctcacaactctta

SEQ ID NO: 30440 - DNA, 22 bp, Homo sapiens
ttctttgcccatgtttcctaag

SEQ ID NO: 30441 - DNA, 22 bp, Homo sapiens
tctgacattagattaattggaa

SEQ ID NO: 30442 - DNA, 22 bp, Homo sapiens
acaccatactcatgttggttcc

SEQ ID NO: 30443 - DNA, 22 bp, Homo sapiens
tgagatgaataactcctgctaa

SEQ ID NO: 30444 - DNA, 22 bp, Homo sapiens
cctttcccgctttgagggcaag

SEQ ID NO: 30445 - DNA, 22 bp, Homo sapiens
tccaggattgtcagccagaagg

SEQ ID NO: 30446 - DNA, 22 bp, Homo sapiens
tgcgcggctcagtcatctccag

SEQ ID NO: 30447 - DNA, 22 bp, Homo sapiens
gcctcagtctcccgagtagctg

SEQ ID NO: 30448 - DNA, 22 bp, Homo sapiens
agtgcaggccccaggccaggcc

SEQ ID NO: 30449 - DNA, 22 bp, Homo sapiens
tttgttttcaatgtgtcattca

SEQ ID NO: 30450 - DNA, 22 bp, Homo sapiens
gccagggttcgaatccgtatgg

SEQ ID NO: 30451 - DNA, 22 bp, Homo sapiens
cctacagttatattcttgattg

SEQ ID NO: 30452 - DNA, 22 bp, Homo sapiens
tggcctcggcatccagcaagag

SEQ ID NO: 30453 - DNA, 22 bp, Homo sapiens
tgggcttaggtcggaggcggcc

SEQ ID NO: 30454 - DNA, 20 bp, Homo sapiens
caagggtttgcattggcttt

SEQ ID NO: 30455 - DNA, 22 bp, Homo sapiens
aaaggctcagatgaggccctgg

SEQ ID NO: 30456 - DNA, 22 bp, Homo sapiens
gaggtgggtgtatcacaggtca

SEQ ID NO: 30457 - DNA, 22 bp, Homo sapiens
atacaaagtattgatcctgagt

SEQ ID NO: 30458 - DNA, 22 bp, Homo sapiens
cactctgcagctgaagggctgg

SEQ ID NO: 30459 - DNA, 22 bp, Homo sapiens
cagcagcagtggctgcagaaca

SEQ ID NO: 30460 - DNA, 22 bp, Homo sapiens
tggaagctcaaggcagggtgag

SEQ ID NO: 30461 - DNA, 22 bp, Homo sapiens
ttgatcaaatcagctactgagg

SEQ ID NO: 30462 - DNA, 22 bp, Homo sapiens
gtcactgtatccaggttccagc

SEQ ID NO: 30463 - DNA, 22 bp, Homo sapiens
gaggcaggaggattgcttgagc

SEQ ID NO: 30464 - DNA, 22 bp, Homo sapiens
aggtggggaggagtgtctcttt

SEQ ID NO: 30465 - DNA, 22 bp, Homo sapiens
cagaaaccaaatgggatgggga

SEQ ID NO: 30466 - DNA, 22 bp, Homo sapiens
ggcctgcctcacagtcagcacc

SEQ ID NO: 30467 - DNA, 23 bp, Homo sapiens
gtctctagagtgtggagcaaaga

SEQ ID NO: 30468 - DNA, 22 bp, Homo sapiens
tccctgcaggtgtgcaagctga

SEQ ID NO: 30469 - DNA, 22 bp, Homo sapiens
cggccgcagcagtgtcggccca

SEQ ID NO: 30470 - DNA, 22 bp, Homo sapiens
gagggggctagcgcagtgccca

SEQ ID NO: 30471 - DNA, 22 bp, Homo sapiens
ggatgtcgaggatggggtagca

SEQ ID NO: 30472 - DNA, 22 bp, Homo sapiens
tatgctctgagacctttgtgca

SEQ ID NO: 30473 - DNA, 22 bp, Homo sapiens
gcaggtctatcaggctgcaggt

SEQ ID NO: 30474 - DNA, 21 bp, Homo sapiens
agtttcaggaagttcagctgc

SEQ ID NO: 30475 - DNA, 22 bp, Homo sapiens
atcaaatacaaagggcataagg

SEQ ID NO: 30476 - DNA, 22 bp, Homo sapiens
gatatcatgggaaggtgtactt

SEQ ID NO: 30477 - DNA, 23 bp, Homo sapiens
tgagctgggcctgcaggggtctc

SEQ ID NO: 30478 - DNA, 22 bp, Homo sapiens
gcccaggagttcaagtctagtg

SEQ ID NO: 30479 - DNA, 22 bp, Homo sapiens
atcccaggcggcacaggttgca

SEQ ID NO: 30480 - DNA, 22 bp, Homo sapiens
aaaagcaattgcagttcttgcc

SEQ ID NO: 30481 - DNA, 19 bp, Homo sapiens
acccagcccaggagtggca

SEQ ID NO: 30482 - DNA, 22 bp, Homo sapiens
gggacgacaggctctgtggtag

SEQ ID NO: 30483 - DNA, 18 bp, Homo sapiens
cttttcccctttggactc

SEQ ID NO: 30484 - DNA, 20 bp, Homo sapiens
tttgagaccagtctgcccaa

SEQ ID NO: 30485 - DNA, 22 bp, Homo sapiens
tgtacttgaacttgactgtaga

SEQ ID NO: 30486 - DNA, 20 bp, Homo sapiens
atggggtgagtgacgccctc

SEQ ID NO: 30487 - DNA, 22 bp, Homo sapiens
aggcaggaaaatcgcttgaacc

SEQ ID NO: 30488 - DNA, 22 bp, Homo sapiens
atgccactgcgctctagcctgg

SEQ ID NO: 30489 - DNA, 22 bp, Homo sapiens
aatggaatacctaggtggccca

SEQ ID NO: 30490 - DNA, 22 bp, Homo sapiens
gcccaggctggagttcagtggt

SEQ ID NO: 30491 - DNA, 22 bp, Homo sapiens
cctgccagagcagcttgtcctc

SEQ ID NO: 30492 - DNA, 22 bp, Homo sapiens
actgcactccagcctcggggtc

SEQ ID NO: 30493 - DNA, 22 bp, Homo sapiens
tcttgggcatgtgtttgatttc

SEQ ID NO: 30494 - DNA, 22 bp, Homo sapiens
gagccagactgcctgaagctca

SEQ ID NO: 30495 - DNA, 22 bp, Homo sapiens
gaatatcccgctatgcaaagta

SEQ ID NO: 30496 - DNA, 22 bp, Homo sapiens
cctgtgcttggccagagaggtt

SEQ ID NO: 30497 - DNA, 22 bp, Homo sapiens
ttttaatactgctattgtagga

SEQ ID NO: 30498 - DNA, 22 bp, Homo sapiens
cctggctgacagcttaattcca

SEQ ID NO: 30499 - DNA, 21 bp, Homo sapiens
cgtgactgggtccgtctggct

SEQ ID NO: 30500 - DNA, 22 bp, Homo sapiens
gggcggggggagctggaatgaa

SEQ ID NO: 30501 - DNA, 22 bp, Homo sapiens
caggaggacatactggctcaca

SEQ ID NO: 30502 - DNA, 22 bp, Homo sapiens
cccaggatggggctgcagttat

SEQ ID NO: 30503 - DNA, 22 bp, Homo sapiens
tggaatggaaacaaactgagga

SEQ ID NO: 30504 - DNA, 22 bp, Homo sapiens
gagagaagggggatatgagcct

SEQ ID NO: 30505 - DNA, 22 bp, Homo sapiens
tattgctatgagcattgttctt

SEQ ID NO: 30506 - DNA, 22 bp, Homo sapiens
aataaacaaaggacaaggaggt

SEQ ID NO: 30507 - DNA, 22 bp, Homo sapiens
ctaggaccactgtaacaaagta

SEQ ID NO: 30508 - DNA, 22 bp, Homo sapiens
tggtgccatcatagctcactgc

SEQ ID NO: 30509 - DNA, 22 bp, Homo sapiens
aagtgatgctacgactttgaca

SEQ ID NO: 30510 - DNA, 22 bp, Homo sapiens
gcggggggaggaacatcttgca

SEQ ID NO: 30511 - DNA, 22 bp, Homo sapiens
gaggctgaggttgcagtgagcc

SEQ ID NO: 30512 - DNA, 22 bp, Homo sapiens
gcctccggagtcacagtgtctt

SEQ ID NO: 30513 - DNA, 22 bp, Homo sapiens
gaatttcctctaaacccctgag

SEQ ID NO: 30514 - DNA, 21 bp, Homo sapiens
agtagtttagcacagggtttg

SEQ ID NO: 30515 - DNA, 22 bp, Homo sapiens
ccaggcagcctgctccattctg

SEQ ID NO: 30516 - DNA, 22 bp, Homo sapiens
tgggaagggtcaacagctggaa

SEQ ID NO: 30517 - DNA, 22 bp, Homo sapiens
cagcagcattgctctggattcc

SEQ ID NO: 30518 - DNA, 22 bp, Homo sapiens
tcgcccaggctggaagtgcagt

SEQ ID NO: 30519 - DNA, 22 bp, Homo sapiens
gacttctgaattcctatcaggt

SEQ ID NO: 30520 - DNA, 22 bp, Homo sapiens
gaatgcttggaacctgaagttc

SEQ ID NO: 30521 - DNA, 22 bp, Homo sapiens
tggctaggctggtgtcaagctc

SEQ ID NO: 30522 - DNA, 22 bp, Homo sapiens
tctagctctgcttatcatggct

SEQ ID NO: 30523 - DNA, 22 bp, Homo sapiens
gtggtgtttgagctgccaggga

SEQ ID NO: 30524 - DNA, 22 bp, Homo sapiens
taagggttcagaatgcagtggt

SEQ ID NO: 30525 - DNA, 22 bp, Homo sapiens
tgctccatgcgctcggccggcg

SEQ ID NO: 30526 - DNA, 22 bp, Homo sapiens
ctggaaggcggaggttgtagtg

SEQ ID NO: 30527 - DNA, 22 bp, Homo sapiens
gagctgggcctgcgagtgctgc

SEQ ID NO: 30528 - DNA, 17 bp, Homo sapiens
cgggcatggagggcagg

SEQ ID NO: 30529 - DNA, 22 bp, Homo sapiens
aggcaggaggatcatggatgca

SEQ ID NO: 30530 - DNA, 22 bp, Homo sapiens
ttgcccagagtcacccagctca

SEQ ID NO: 30531 - DNA, 17 bp, Homo sapiens
tactgaggggtctggag

SEQ ID NO: 30532 - DNA, 22 bp, Homo sapiens
tgtcctcgtccgcctcgaactc

SEQ ID NO: 30533 - DNA, 22 bp, Homo sapiens
aaaaaattatcatagttcctga

SEQ ID NO: 30534 - DNA, 22 bp, Homo sapiens
taggcctggatctctgggagca

SEQ ID NO: 30535 - DNA, 22 bp, Homo sapiens
tttcacagaggaggaagctgag

SEQ ID NO: 30536 - DNA, 22 bp, Homo sapiens
actgttgaagtgccagcttgat

SEQ ID NO: 30537 - DNA, 22 bp, Homo sapiens
aggctaggaacagcccggccct

SEQ ID NO: 30538 - DNA, 22 bp, Homo sapiens
ccctctacagggaagcgctttc

SEQ ID NO: 30539 - DNA, 22 bp, Homo sapiens
ggctgccttccctgagccccgg

SEQ ID NO: 30540 - DNA, 22 bp, Homo sapiens
gccatgcttggtatgctgtgag

SEQ ID NO: 30541 - DNA, 22 bp, Homo sapiens
tgcaggctcttggtgacgtggg

SEQ ID NO: 30542 - DNA, 22 bp, Homo sapiens
ggaggtgggctaaggactctct

SEQ ID NO: 30543 - DNA, 22 bp, Homo sapiens
tgctagtgtgtgagatgttcaa

SEQ ID NO: 30544 - DNA, 22 bp, Homo sapiens
ggggccttttctgaatgtggaa

SEQ ID NO: 30545 - DNA, 22 bp, Homo sapiens
agtgctatcgagttctaatgct

SEQ ID NO: 30546 - DNA, 22 bp, Homo sapiens
ggctagggatctagaccaggac

SEQ ID NO: 30547 - DNA, 22 bp, Homo sapiens
ccaaagtgctgagattacaggt

SEQ ID NO: 30548 - DNA, 22 bp, Homo sapiens
aaagcctcccaggttatgagta

SEQ ID NO: 30549 - DNA, 22 bp, Homo sapiens
gcaggatgagtgagtacattta

SEQ ID NO: 30550 - DNA, 19 bp, Homo sapiens
agtcctggcctgggggacc

SEQ ID NO: 30551 - DNA, 22 bp, Homo sapiens
ctctttggatagaattacaaag

SEQ ID NO: 30552 - DNA, 22 bp, Homo sapiens
aaagcagaactgagagagctgg

SEQ ID NO: 30553 - DNA, 22 bp, Homo sapiens
agttcgagatctgctgatgaga

SEQ ID NO: 30554 - DNA, 22 bp, Homo sapiens
gctccctggtagccatgctctc

SEQ ID NO: 30555 - DNA, 22 bp, Homo sapiens
atgtggcaccgatctttagcca

SEQ ID NO: 30556 - DNA, 23 bp, Homo sapiens
aaactacaacgccaggcactgag

SEQ ID NO: 30557 - DNA, 22 bp, Homo sapiens
gctgctctcagagctcatgctg

SEQ ID NO: 30558 - DNA, 23 bp, Homo sapiens
agctataaaatctgtgacagcag

SEQ ID NO: 30559 - DNA, 22 bp, Homo sapiens
ccatgtacatgaacacggcggc

SEQ ID NO: 30560 - DNA, 22 bp, Homo sapiens
gcagggtctgaggccacagagg

SEQ ID NO: 30561 - DNA, 22 bp, Homo sapiens
tggaacgtcgtaatgttggtta

SEQ ID NO: 30562 - DNA, 22 bp, Homo sapiens
tttgctattgtgaatagtgcca

SEQ ID NO: 30563 - DNA, 22 bp, Homo sapiens
tcagcctgctccaagtgctgcc

SEQ ID NO: 30564 - DNA, 22 bp, Homo sapiens
gcagaggacacaggagggcaag

SEQ ID NO: 30565 - DNA, 16 bp, Homo sapiens
atgctgctattagagg

SEQ ID NO: 30566 - DNA, 22 bp, Homo sapiens
atagaatatgacttttagatcc

SEQ ID NO: 30567 - DNA, 22 bp, Homo sapiens
gcctccccaagcagcagggatt

SEQ ID NO: 30568 - DNA, 22 bp, Homo sapiens
acatgagatttgggtggtgata

SEQ ID NO: 30569 - DNA, 22 bp, Homo sapiens
tgatcaggtctgaacagggagg

SEQ ID NO: 30570 - DNA, 22 bp, Homo sapiens
agcaggagtttgatgcttttat

SEQ ID NO: 30571 - DNA, 22 bp, Homo sapiens
agtgtattctgcatgggagact

SEQ ID NO: 30572 - DNA, 22 bp, Homo sapiens
gatgcacggtcatgtcttttca

SEQ ID NO: 30573 - DNA, 22 bp, Homo sapiens
tccaagatctacagcagtttag

SEQ ID NO: 30574 - DNA, 22 bp, Homo sapiens
acttcttcttcagctgggggat

SEQ ID NO: 30575 - DNA, 22 bp, Homo sapiens
agcctgggcaacagagcaaaac

SEQ ID NO: 30576 - DNA, 22 bp, Homo sapiens
cagggtttcaccatgttagcag

SEQ ID NO: 30577 - DNA, 20 bp, Homo sapiens
aaaatatgtataactcttct

SEQ ID NO: 30578 - DNA, 22 bp, Homo sapiens
gcccttctgctgttaggtagcc

SEQ ID NO: 30579 - DNA, 22 bp, Homo sapiens
ttgctcttgaaaattgatgctg

SEQ ID NO: 30580 - DNA, 21 bp, Homo sapiens
ctcccagggtgactgttcaac

SEQ ID NO: 30581 - DNA, 22 bp, Homo sapiens
tctgctggaaaaccagggaatt

SEQ ID NO: 30582 - DNA, 22 bp, Homo sapiens
cccacgtcgaacttgctccaga

SEQ ID NO: 30583 - DNA, 22 bp, Homo sapiens
gaatttaagaggatgaatctgt

SEQ ID NO: 30584 - DNA, 22 bp, Homo sapiens
tcaccgaggctggagtgcagtg

SEQ ID NO: 30585 - DNA, 22 bp, Homo sapiens
ctgtaatcccagctacctggga

SEQ ID NO: 30586 - DNA, 22 bp, Homo sapiens
ggtggcagtagcactgggcctg

SEQ ID NO: 30587 - DNA, 22 bp, Homo sapiens
caattgtcagtgctgtttaaat

SEQ ID NO: 30588 - DNA, 22 bp, Homo sapiens
aaagattaaatcaaattggtca

SEQ ID NO: 30589 - DNA, 22 bp, Homo sapiens
acatttttcacatttgtagggt

SEQ ID NO: 30590 - DNA, 22 bp, Homo sapiens
aacccaggagacaggttgcagt

SEQ ID NO: 30591 - DNA, 22 bp, Homo sapiens
agcccaggagtttgaggctgtg

SEQ ID NO: 30592 - DNA, 22 bp, Homo sapiens
aatgttgcagagtgattgtcca

SEQ ID NO: 30593 - DNA, 22 bp, Homo sapiens
acatcctcccgatctactggct

SEQ ID NO: 30594 - DNA, 22 bp, Homo sapiens
attttctatgttgtaattgtta

SEQ ID NO: 30595 - DNA, 22 bp, Homo sapiens
tgagccgtggtctctgagggtg

SEQ ID NO: 30596 - DNA, 22 bp, Homo sapiens
gcatatgatcacgtgtgtcggt

SEQ ID NO: 30597 - DNA, 22 bp, Homo sapiens
ctacaaaagtaattgtggtttt

SEQ ID NO: 30598 - DNA, 22 bp, Homo sapiens
aggaaaacagaccaaggagctc

SEQ ID NO: 30599 - DNA, 20 bp, Homo sapiens
tatttctgggcaaccattta

SEQ ID NO: 30600 - DNA, 22 bp, Homo sapiens
acgtgcaggatctggttggcga

SEQ ID NO: 30601 - DNA, 22 bp, Homo sapiens
tgcgatggcgtagacaaatccc

SEQ ID NO: 30602 - DNA, 22 bp, Homo sapiens
ccttgctcaagctagtgacggg

SEQ ID NO: 30603 - DNA, 22 bp, Homo sapiens
ccaggaggtggagattgcagtg

SEQ ID NO: 30604 - DNA, 22 bp, Homo sapiens
caggctggagttcagtggtgtg

SEQ ID NO: 30605 - DNA, 22 bp, Homo sapiens
cccactgctgcgccgggcgccg

SEQ ID NO: 30606 - DNA, 22 bp, Homo sapiens
gggcagatcacctgaggtcagg

SEQ ID NO: 30607 - DNA, 22 bp, Homo sapiens
ttgcttcttagatattcctctc

SEQ ID NO: 30608 - DNA, 22 bp, Homo sapiens
ccaggagttggaggctgcagtg

SEQ ID NO: 30609 - DNA, 22 bp, Homo sapiens
catgagatttgggaggggccag

SEQ ID NO: 30610 - DNA, 22 bp, Homo sapiens
ctgagccaaggggacagtgaca

SEQ ID NO: 30611 - DNA, 19 bp, Homo sapiens
ggctgccttctgctcatct

SEQ ID NO: 30612 - DNA, 22 bp, Homo sapiens
gcggggttccgtgccccagagt

SEQ ID NO: 30613 - DNA, 22 bp, Homo sapiens
gctggtagacctcactgcactc

SEQ ID NO: 30614 - DNA, 22 bp, Homo sapiens
ttcctggtctatttagaattgc

SEQ ID NO: 30615 - DNA, 22 bp, Homo sapiens
aacccaggaggtggaggttgtg

SEQ ID NO: 30616 - DNA, 22 bp, Homo sapiens
gccccagcctcccgagtagctg

SEQ ID NO: 30617 - DNA, 22 bp, Homo sapiens
ccctgcctacagggttttcttt

SEQ ID NO: 30618 - DNA, 22 bp, Homo sapiens
cgccccggacgtctgaccaaac

SEQ ID NO: 30619 - DNA, 22 bp, Homo sapiens
acccagggctcaagcgtaggca

SEQ ID NO: 30620 - DNA, 19 bp, Homo sapiens
ccctcttgcacaaagcaaa

SEQ ID NO: 30621 - DNA, 22 bp, Homo sapiens
aagttactggcaagggctgcag

SEQ ID NO: 30622 - DNA, 22 bp, Homo sapiens
agtccaaagcagatgagggcca

SEQ ID NO: 30623 - DNA, 21 bp, Homo sapiens
atgtagggtttgccttctcta

SEQ ID NO: 30624 - DNA, 22 bp, Homo sapiens
aaactgtcctcccgaggtttcc

SEQ ID NO: 30625 - DNA, 22 bp, Homo sapiens
tgattcatcagaataggagttt

SEQ ID NO: 30626 - DNA, 20 bp, Homo sapiens
gggcagagccagccagtccc

SEQ ID NO: 30627 - DNA, 22 bp, Homo sapiens
cagtgacgtaaactgcatgtgc

SEQ ID NO: 30628 - DNA, 22 bp, Homo sapiens
aataaaatggtcagttttctca

SEQ ID NO: 30629 - DNA, 22 bp, Homo sapiens
gggaagatagtgttgagggccc

SEQ ID NO: 30630 - DNA, 22 bp, Homo sapiens
tgctgagcgcatccggcggccg

SEQ ID NO: 30631 - DNA, 22 bp, Homo sapiens
tcaaattgtcatcttgataatg

SEQ ID NO: 30632 - DNA, 18 bp, Homo sapiens
acgtgctgtgccttttgc

SEQ ID NO: 30633 - DNA, 22 bp, Homo sapiens
cccaggaggttgaggctgcagt

SEQ ID NO: 30634 - DNA, 22 bp, Homo sapiens
ccaggctgctgttggtgtccgc

SEQ ID NO: 30635 - DNA, 22 bp, Homo sapiens
tgacaggaaacatgcagtgatt

SEQ ID NO: 30636 - DNA, 19 bp, Homo sapiens
tctgaagaattagagagca

SEQ ID NO: 30637 - DNA, 22 bp, Homo sapiens
aacgcccagccttgatcaaatg

SEQ ID NO: 30638 - DNA, 22 bp, Homo sapiens
cactgctacctctgcctcccgg

SEQ ID NO: 30639 - DNA, 21 bp, Homo sapiens
ggccgccgccttgtgctctgc

SEQ ID NO: 30640 - DNA, 23 bp, Homo sapiens
tgagtgtgaaaatcctggagatg

SEQ ID NO: 30641 - DNA, 22 bp, Homo sapiens
caaagtgctgggattacaggct

SEQ ID NO: 30642 - DNA, 22 bp, Homo sapiens
acccaggccattggcaagagtc

SEQ ID NO: 30643 - DNA, 22 bp, Homo sapiens
atttcagtattatacaactgct

SEQ ID NO: 30644 - DNA, 22 bp, Homo sapiens
aggagggagcttaagccaggca

SEQ ID NO: 30645 - DNA, 22 bp, Homo sapiens
accagcctggccaacatggtga

SEQ ID NO: 30646 - DNA, 22 bp, Homo sapiens
accactgcccatggtgaaaact

SEQ ID NO: 30647 - DNA, 22 bp, Homo sapiens
cccaggaggtcgaagctgcagt

SEQ ID NO: 30648 - DNA, 22 bp, Homo sapiens
cctggaggcggaggttgcagtg

SEQ ID NO: 30649 - DNA, 22 bp, Homo sapiens
tctcgatctcctgaccttgtga

SEQ ID NO: 30650 - DNA, 22 bp, Homo sapiens
tggggaaaatgcttgtagtcag

SEQ ID NO: 30651 - DNA, 22 bp, Homo sapiens
aggctgaggcaagaggatcact

SEQ ID NO: 30652 - DNA, 22 bp, Homo sapiens
gtggcccaggttggagtgcagt

SEQ ID NO: 30653 - DNA, 22 bp, Homo sapiens
atgcaggcagacactgtgggca

SEQ ID NO: 30654 - DNA, 22 bp, Homo sapiens
aaattgtaatgacttcacttga

SEQ ID NO: 30655 - DNA, 22 bp, Homo sapiens
acgcagtttgtggacatttttt

SEQ ID NO: 30656 - DNA, 22 bp, Homo sapiens
tgggtgagcggctgcacacccg

SEQ ID NO: 30657 - DNA, 22 bp, Homo sapiens
ataaaatttgctactgttaaat

SEQ ID NO: 30658 - DNA, 22 bp, Homo sapiens
gagccaggtcgggccgcggcga

SEQ ID NO: 30659 - DNA, 22 bp, Homo sapiens
atcgcaagtttaaaaatctttg

SEQ ID NO: 30660 - DNA, 22 bp, Homo sapiens
acaaacagagttgaaaaatagg

SEQ ID NO: 30661 - DNA, 22 bp, Homo sapiens
caggtgcctcaggatgagacaa

SEQ ID NO: 30662 - DNA, 22 bp, Homo sapiens
gagcctcgtggcggccactgcg

SEQ ID NO: 30663 - DNA, 19 bp, Homo sapiens
tttgatagggcataatata

SEQ ID NO: 30664 - DNA, 22 bp, Homo sapiens
gcgagtgccgagagggcagggc

SEQ ID NO: 30665 - DNA, 22 bp, Homo sapiens
tttctggcagcgggacaggggt

SEQ ID NO: 30666 - DNA, 22 bp, Homo sapiens
tggaaacacccacgcatgcata

SEQ ID NO: 30667 - DNA, 22 bp, Homo sapiens
tgcaggctgtgtcatttagtga

SEQ ID NO: 30668 - DNA, 22 bp, Homo sapiens
gccagccagaaacgtcacactg

SEQ ID NO: 30669 - DNA, 22 bp, Homo sapiens
gcagggcacaaggacgcacagg

SEQ ID NO: 30670 - DNA, 22 bp, Homo sapiens
gaggcagaggttgcagtgagct

SEQ ID NO: 30671 - DNA, 22 bp, Homo sapiens
ttgcttcagagggagacacttt

SEQ ID NO: 30672 - DNA, 22 bp, Homo sapiens
ctgaagagaaagggagctcttc

SEQ ID NO: 30673 - DNA, 22 bp, Homo sapiens
tcagcctccgaaagtgctggga

SEQ ID NO: 30674 - DNA, 22 bp, Homo sapiens
tcgaaataatttagaatataga

SEQ ID NO: 30675 - DNA, 23 bp, Homo sapiens
cctgcctccccatcagttataca

SEQ ID NO: 30676 - DNA, 22 bp, Homo sapiens
agggctggagccacagctggga

SEQ ID NO: 30677 - DNA, 22 bp, Homo sapiens
tctgacattttgagaatgacat

SEQ ID NO: 30678 - DNA, 22 bp, Homo sapiens
ccaattttattcttctgcaagt

SEQ ID NO: 30679 - DNA, 22 bp, Homo sapiens
tggcccagtatgtataatctta

SEQ ID NO: 30680 - DNA, 22 bp, Homo sapiens
tcagaattgtggagaaagggga

SEQ ID NO: 30681 - DNA, 22 bp, Homo sapiens
gagtcacatactatgtaataga

SEQ ID NO: 30682 - DNA, 22 bp, Homo sapiens
gcctgtgacccagggcccagga

SEQ ID NO: 30683 - DNA, 22 bp, Homo sapiens
aagaggttgtctgtgatgagtt

SEQ ID NO: 30684 - DNA, 22 bp, Homo sapiens
tggcttccccggagtgacatgt

SEQ ID NO: 30685 - DNA, 23 bp, Homo sapiens
aggttatgattatagagcgagga

SEQ ID NO: 30686 - DNA, 22 bp, Homo sapiens
ccacctgagataagagagctca

SEQ ID NO: 30687 - DNA, 22 bp, Homo sapiens
tgttggagcccgagtcagggag

SEQ ID NO: 30688 - DNA, 22 bp, Homo sapiens
ccctgccttgtctgggctaggt

SEQ ID NO: 30689 - DNA, 22 bp, Homo sapiens
actgcgtggggagctgtgacta

SEQ ID NO: 30690 - DNA, 22 bp, Homo sapiens
tatttcttttcgtgacttattg

SEQ ID NO: 30691 - DNA, 22 bp, Homo sapiens
ggtgctggacacgtggcactcc

SEQ ID NO: 30692 - DNA, 21 bp, Homo sapiens
gttcaaatcctgacactacac

SEQ ID NO: 30693 - DNA, 22 bp, Homo sapiens
ggctgcaggttggttggcagct

SEQ ID NO: 30694 - DNA, 22 bp, Homo sapiens
gcccagccacagtcactttcat

SEQ ID NO: 30695 - DNA, 22 bp, Homo sapiens
cactgcactccatcctgggaaa

SEQ ID NO: 30696 - DNA, 22 bp, Homo sapiens
cttgtcttgcacacggttgcca

SEQ ID NO: 30697 - DNA, 22 bp, Homo sapiens
tcttggattttaatggatcaaa

SEQ ID NO: 30698 - DNA, 22 bp, Homo sapiens
ccaggaggtggaggttgcggtg

SEQ ID NO: 30699 - DNA, 22 bp, Homo sapiens
cttctcttcctttgtcaactga

SEQ ID NO: 30700 - DNA, 22 bp, Homo sapiens
atatgggggggcgtgcagagga

SEQ ID NO: 30701 - DNA, 22 bp, Homo sapiens
gtggggtagatctttctcagga

SEQ ID NO: 30702 - DNA, 22 bp, Homo sapiens
tccacgtgagcttcgtgtgcag

SEQ ID NO: 30703 - DNA, 22 bp, Homo sapiens
tccctagtcgcatctgtggaga

SEQ ID NO: 30704 - DNA, 22 bp, Homo sapiens
acacttggagcaacacttatgg

SEQ ID NO: 30705 - DNA, 22 bp, Homo sapiens
agcgccgcccctgctggtgttg

SEQ ID NO: 30706 - DNA, 22 bp, Homo sapiens
tgtttcttacgtttttagaggc

SEQ ID NO: 30707 - DNA, 22 bp, Homo sapiens
ccgaggctggagtgcagtggcg

SEQ ID NO: 30708 - DNA, 22 bp, Homo sapiens
gcagtggcatgatgtgggctca

SEQ ID NO: 30709 - DNA, 22 bp, Homo sapiens
attgtggtgtcagttataggca

SEQ ID NO: 30710 - DNA, 22 bp, Homo sapiens
tcaggctcaggttaggggccaa

SEQ ID NO: 30711 - DNA, 22 bp, Homo sapiens
agtggtgataaccgctatcata

SEQ ID NO: 30712 - DNA, 22 bp, Homo sapiens
gtaatctcagctacttgggagg

SEQ ID NO: 30713 - DNA, 22 bp, Homo sapiens
gagccaggggtcagctccgagg

SEQ ID NO: 30714 - DNA, 23 bp, Homo sapiens
agcttttaggtggaaatggcact

SEQ ID NO: 30715 - DNA, 19 bp, Homo sapiens
gccttcccaccacccgtcc

SEQ ID NO: 30716 - DNA, 22 bp, Homo sapiens
ccaaagtgctaggattacaggt

SEQ ID NO: 30717 - DNA, 22 bp, Homo sapiens
tttcctcttctggcaggcaggg

SEQ ID NO: 30718 - DNA, 22 bp, Homo sapiens
ccaggcaggcgatggtgcagtg

SEQ ID NO: 30719 - DNA, 22 bp, Homo sapiens
gctgcagtgagccaagatcgtg

SEQ ID NO: 30720 - DNA, 22 bp, Homo sapiens
cacagagctggaaaggctgggc

SEQ ID NO: 30721 - DNA, 22 bp, Homo sapiens
ggctttgacatgctgaattaaa

SEQ ID NO: 30722 - DNA, 22 bp, Homo sapiens
tttcataatactgtacatgaaa

SEQ ID NO: 30723 - DNA, 22 bp, Homo sapiens
ggtgcagaggagccagctgggg

SEQ ID NO: 30724 - DNA, 22 bp, Homo sapiens
cacccaggctggagtgcagtgg

SEQ ID NO: 30725 - DNA, 22 bp, Homo sapiens
ctgggatccacgggctcccaag

SEQ ID NO: 30726 - DNA, 22 bp, Homo sapiens
cctcagacccctgctgagcttc

SEQ ID NO: 30727 - DNA, 22 bp, Homo sapiens
cctcggctgggccttggccact

SEQ ID NO: 30728 - DNA, 22 bp, Homo sapiens
agaaatatgctgattagatgaa

SEQ ID NO: 30729 - DNA, 22 bp, Homo sapiens
cccttggggtggaggttgcagt

SEQ ID NO: 30730 - DNA, 22 bp, Homo sapiens
ggtgacggggcccaggtttcct

SEQ ID NO: 30731 - DNA, 22 bp, Homo sapiens
ggtgggagagctctgtctccag

SEQ ID NO: 30732 - DNA, 21 bp, Homo sapiens
ccgccgctgatagctctgggc

SEQ ID NO: 30733 - DNA, 22 bp, Homo sapiens
tccgccaggactgagggcccat

SEQ ID NO: 30734 - DNA, 22 bp, Homo sapiens
gcactgcaggtgggtggagagg

SEQ ID NO: 30735 - DNA, 22 bp, Homo sapiens
aggggtgaaagagggccctcaa

SEQ ID NO: 30736 - DNA, 22 bp, Homo sapiens
atccccctgtatctggaagaat

SEQ ID NO: 30737 - DNA, 22 bp, Homo sapiens
ggcaatagttgtgggttcttta

SEQ ID NO: 30738 - DNA, 18 bp, Homo sapiens
ggtgagggagctggaagc

SEQ ID NO: 30739 - DNA, 22 bp, Homo sapiens
aagaagcaggtcacagacaggg

SEQ ID NO: 30740 - DNA, 22 bp, Homo sapiens
cccaggagttggaggctgcagt

SEQ ID NO: 30741 - DNA, 22 bp, Homo sapiens
ttcagcagtgcagacacccagt

SEQ ID NO: 30742 - DNA, 21 bp, Homo sapiens
cctcaagtgcctcctgctgct

SEQ ID NO: 30743 - DNA, 22 bp, Homo sapiens
tgcctccctggcaagtctctcc

SEQ ID NO: 30744 - DNA, 22 bp, Homo sapiens
cccaggaggcagaagttgcagt

SEQ ID NO: 30745 - DNA, 22 bp, Homo sapiens
cactgcactccagcccgggcaa

SEQ ID NO: 30746 - DNA, 22 bp, Homo sapiens
gaggtggctgcttgctgggaaa

SEQ ID NO: 30747 - DNA, 22 bp, Homo sapiens
tgccacagacaggacagaacag

SEQ ID NO: 30748 - DNA, 22 bp, Homo sapiens
agcctggcggtcgtcggtcagg

SEQ ID NO: 30749 - DNA, 22 bp, Homo sapiens
agctgccgatgcccagctgcat

SEQ ID NO: 30750 - DNA, 22 bp, Homo sapiens
gacaattagatcattcctttga

SEQ ID NO: 30751 - DNA, 22 bp, Homo sapiens
ttggcataccttagtggtggag

SEQ ID NO: 30752 - DNA, 22 bp, Homo sapiens
tatcacatttggagatttatga

SEQ ID NO: 30753 - DNA, 22 bp, Homo sapiens
tatcagtccagggttttgtgac

SEQ ID NO: 30754 - DNA, 22 bp, Homo sapiens
ttctatttttgtggaactgtag

SEQ ID NO: 30755 - DNA, 22 bp, Homo sapiens
ctcgggtaccatgctaggcact

SEQ ID NO: 30756 - DNA, 22 bp, Homo sapiens
cacccaggctggagtgcagtga

SEQ ID NO: 30757 - DNA, 22 bp, Homo sapiens
cgcggtggcggcctccagcgcc

SEQ ID NO: 30758 - DNA, 22 bp, Homo sapiens
tggtcgaccagttggaaagtaa

SEQ ID NO: 30759 - DNA, 22 bp, Homo sapiens
ctctggaggtggaggttgcagt

SEQ ID NO: 30760 - DNA, 22 bp, Homo sapiens
ttttctaacatctagtaatttg

SEQ ID NO: 30761 - DNA, 22 bp, Homo sapiens
tgtgtttctgagaatcccacct

SEQ ID NO: 30762 - DNA, 22 bp, Homo sapiens
ttcaatttgtgctaaggcaccg

SEQ ID NO: 30763 - DNA, 22 bp, Homo sapiens
agggaaattaatgtgagcaatg

SEQ ID NO: 30764 - DNA, 22 bp, Homo sapiens
atttagtagagaaattaagaaa

SEQ ID NO: 30765 - DNA, 22 bp, Homo sapiens
cgcgctgcagacagcggaggcc

SEQ ID NO: 30766 - DNA, 22 bp, Homo sapiens
gttcaagaccagcctggccaac

SEQ ID NO: 30767 - DNA, 22 bp, Homo sapiens
gcgagggcacgcggttgaaggc

SEQ ID NO: 30768 - DNA, 18 bp, Homo sapiens
ttgcttcttttctctagg

SEQ ID NO: 30769 - DNA, 22 bp, Homo sapiens
actggggtttaggcctgggcaa

SEQ ID NO: 30770 - DNA, 22 bp, Homo sapiens
agaggcagtatacaatccgagc

SEQ ID NO: 30771 - DNA, 22 bp, Homo sapiens
gctcaagccttctgcccacctc

SEQ ID NO: 30772 - DNA, 22 bp, Homo sapiens
tgcgttgcgctcctgcagcagg

SEQ ID NO: 30773 - DNA, 22 bp, Homo sapiens
tcctttgcttctgtcattctcc

SEQ ID NO: 30774 - DNA, 17 bp, Homo sapiens
tgggatccgtctctgtg

SEQ ID NO: 30775 - DNA, 22 bp, Homo sapiens
tccaccatgtaacaagctctgt

SEQ ID NO: 30776 - DNA, 23 bp, Homo sapiens
ccagtgattgcctggaaggaggt

SEQ ID NO: 30777 - DNA, 22 bp, Homo sapiens
tcacccctccattctctcatgt

SEQ ID NO: 30778 - DNA, 22 bp, Homo sapiens
tgtcatggggttgttttgtaca

SEQ ID NO: 30779 - DNA, 22 bp, Homo sapiens
gggaggcagtgctggaggctgg

SEQ ID NO: 30780 - DNA, 22 bp, Homo sapiens
tgccgctccaggtctcgcggtg

SEQ ID NO: 30781 - DNA, 20 bp, Homo sapiens
gagattaactgagaatctag

SEQ ID NO: 30782 - DNA, 22 bp, Homo sapiens
taagtcatagattaatggccac

SEQ ID NO: 30783 - DNA, 22 bp, Homo sapiens
ttcattcttcagagctgcgctt

SEQ ID NO: 30784 - DNA, 22 bp, Homo sapiens
tgggtgctctgcgaccgtaggg

SEQ ID NO: 30785 - DNA, 22 bp, Homo sapiens
ccattgtaaattctgtggaagt

SEQ ID NO: 30786 - DNA, 22 bp, Homo sapiens
gggccctgggattcagagcaag

SEQ ID NO: 30787 - DNA, 22 bp, Homo sapiens
aatgttacgatcaacaacacat

SEQ ID NO: 30788 - DNA, 22 bp, Homo sapiens
attgaaaataaggccagaaaca

SEQ ID NO: 30789 - DNA, 22 bp, Homo sapiens
ggcaaggggtcaggctgagaca

SEQ ID NO: 30790 - DNA, 22 bp, Homo sapiens
ttcctagggcagagccgctggg

SEQ ID NO: 30791 - DNA, 22 bp, Homo sapiens
ctggcctcggcagcaggaacag

SEQ ID NO: 30792 - DNA, 22 bp, Homo sapiens
tcatctaagagtcttacattta

SEQ ID NO: 30793 - DNA, 22 bp, Homo sapiens
acccggagtcggaggttgcagt

SEQ ID NO: 30794 - DNA, 22 bp, Homo sapiens
ctagggtcaggggcctgcgtcg

SEQ ID NO: 30795 - DNA, 22 bp, Homo sapiens
ccactgcactccagccttggca

SEQ ID NO: 30796 - DNA, 22 bp, Homo sapiens
gctgcagctcgccttccggcct

SEQ ID NO: 30797 - DNA, 22 bp, Homo sapiens
aggggagccagggctgcgagtt

SEQ ID NO: 30798 - DNA, 23 bp, Homo sapiens
tgctggagaagcaaagttctgag

SEQ ID NO: 30799 - DNA, 22 bp, Homo sapiens
caggaaagggatgggctgccac

SEQ ID NO: 30800 - DNA, 22 bp, Homo sapiens
agcccaggttgaggctgcagtg

SEQ ID NO: 30801 - DNA, 22 bp, Homo sapiens
aagagaattctggttttcctat

SEQ ID NO: 30802 - DNA, 22 bp, Homo sapiens
aaggctccagtgaatgctggca

SEQ ID NO: 30803 - DNA, 16 bp, Homo sapiens
gcaggcagatcacatg

SEQ ID NO: 30804 - DNA, 21 bp, Homo sapiens
acacaggcagtgtcccgaggt

SEQ ID NO: 30805 - DNA, 22 bp, Homo sapiens
ggtgggagccaacacccttctg

SEQ ID NO: 30806 - DNA, 22 bp, Homo sapiens
ttaaatattatgttgtctgcaa

SEQ ID NO: 30807 - DNA, 22 bp, Homo sapiens
cccaggaggcgcaggttgcggt

SEQ ID NO: 30808 - DNA, 22 bp, Homo sapiens
tgctggtaccgcgcctccgcca

SEQ ID NO: 30809 - DNA, 22 bp, Homo sapiens
cccatgcaccctctaagaagga

SEQ ID NO: 30810 - DNA, 22 bp, Homo sapiens
attcacatttagcctctgacat

SEQ ID NO: 30811 - DNA, 22 bp, Homo sapiens
cactgcactccagcctggcgac

SEQ ID NO: 30812 - DNA, 22 bp, Homo sapiens
actgcactccagcctgggtgac

SEQ ID NO: 30813 - DNA, 22 bp, Homo sapiens
cacagctgaagtagccatgtgg

SEQ ID NO: 30814 - DNA, 22 bp, Homo sapiens
ccaggctggagtgcaatggcat

SEQ ID NO: 30815 - DNA, 22 bp, Homo sapiens
gcaaatgctaaagtgtagagac

SEQ ID NO: 30816 - DNA, 22 bp, Homo sapiens
cagagatgtgatccagctgtct

SEQ ID NO: 30817 - DNA, 22 bp, Homo sapiens
tgtctgttattggtgtataaga

SEQ ID NO: 30818 - DNA, 22 bp, Homo sapiens
accgtgtctgacactttgggcg

SEQ ID NO: 30819 - DNA, 22 bp, Homo sapiens
atcagaatgttttggtgtgctc

SEQ ID NO: 30820 - DNA, 22 bp, Homo sapiens
gggcagagactcagaaacagaa

SEQ ID NO: 30821 - DNA, 22 bp, Homo sapiens
tcactacaacctccgcctcctg

SEQ ID NO: 30822 - DNA, 22 bp, Homo sapiens
ttatgatttgccacagattggt

SEQ ID NO: 30823 - DNA, 21 bp, Homo sapiens
aggagcattgttgtggtggag

SEQ ID NO: 30824 - DNA, 22 bp, Homo sapiens
cagtggcgtgatctctgctcac

SEQ ID NO: 30825 - DNA, 22 bp, Homo sapiens
atcttctcatgtgtaatgaggt

SEQ ID NO: 30826 - DNA, 22 bp, Homo sapiens
aggccttaccatagctgtagca

SEQ ID NO: 30827 - DNA, 22 bp, Homo sapiens
ctcattgcagctgcattactgt

SEQ ID NO: 30828 - DNA, 22 bp, Homo sapiens
atacttctttagcatattgaac

SEQ ID NO: 30829 - DNA, 22 bp, Homo sapiens
atgaaatgctattttggctaga

SEQ ID NO: 30830 - DNA, 22 bp, Homo sapiens
tgcagaaacaagccatcattca

SEQ ID NO: 30831 - DNA, 22 bp, Homo sapiens
cggctcactgcagctccgcctc

SEQ ID NO: 30832 - DNA, 22 bp, Homo sapiens
gcctcctgtcccaggctgagga

SEQ ID NO: 30833 - DNA, 22 bp, Homo sapiens
actgcacttcagcctgggtgtc

SEQ ID NO: 30834 - DNA, 22 bp, Homo sapiens
ggcaaaaaccataattactttt

SEQ ID NO: 30835 - DNA, 22 bp, Homo sapiens
gcggtcggcagaggggctctgc

SEQ ID NO: 30836 - DNA, 22 bp, Homo sapiens
attataggcttgagccaccgtg

SEQ ID NO: 30837 - DNA, 22 bp, Homo sapiens
ttgacacagtcaacttgatttt

SEQ ID NO: 30838 - DNA, 22 bp, Homo sapiens
ggtgacgaatccatagcatcga

SEQ ID NO: 30839 - DNA, 22 bp, Homo sapiens
atgtttttaaatagacttacag

SEQ ID NO: 30840 - DNA, 22 bp, Homo sapiens
taaggcaggaactggctgtttt

SEQ ID NO: 30841 - DNA, 22 bp, Homo sapiens
tctcctggtacccttcctagca

SEQ ID NO: 30842 - DNA, 22 bp, Homo sapiens
gcccgcagagatctttaacaaa

SEQ ID NO: 30843 - DNA, 22 bp, Homo sapiens
ccctcccaggagtggccagaga

SEQ ID NO: 30844 - DNA, 22 bp, Homo sapiens
tcacagagttaaaagtttcttt

SEQ ID NO: 30845 - DNA, 22 bp, Homo sapiens
actgcactcctgcctgggtaac

SEQ ID NO: 30846 - DNA, 22 bp, Homo sapiens
agaggctgcacttgctcatgat

SEQ ID NO: 30847 - DNA, 22 bp, Homo sapiens
tggctgtgtccctgtccagagt

SEQ ID NO: 30848 - DNA, 22 bp, Homo sapiens
ccctgctgtcaggtgctgggag

SEQ ID NO: 30849 - DNA, 22 bp, Homo sapiens
aatgagatggaattcccgccta

SEQ ID NO: 30850 - DNA, 22 bp, Homo sapiens
ctgagggtcaacttgattgtat

SEQ ID NO: 30851 - DNA, 22 bp, Homo sapiens
ttccatacgactgaggtctcgg

SEQ ID NO: 30852 - DNA, 22 bp, Homo sapiens
agtcccaacagcttacaaggaa

SEQ ID NO: 30853 - DNA, 23 bp, Homo sapiens
gtgccgacgctccagcaccatcc

SEQ ID NO: 30854 - DNA, 22 bp, Homo sapiens
gctggaggatggactggaagaa

SEQ ID NO: 30855 - DNA, 22 bp, Homo sapiens
tgagtgaggctgggcagtccct

SEQ ID NO: 30856 - DNA, 22 bp, Homo sapiens
ggtagtcggccttgccctgggc

SEQ ID NO: 30857 - DNA, 22 bp, Homo sapiens
aagactgagtggcttaagaaaa

SEQ ID NO: 30858 - DNA, 22 bp, Homo sapiens
gtcggccacgcaggtgcggtag

SEQ ID NO: 30859 - DNA, 22 bp, Homo sapiens
gtgggctgcccttgaggtcagc

SEQ ID NO: 30860 - DNA, 22 bp, Homo sapiens
tttattctgtgctacatgaaga

SEQ ID NO: 30861 - DNA, 22 bp, Homo sapiens
cgagcatgatgacggctgtggc

SEQ ID NO: 30862 - DNA, 22 bp, Homo sapiens
tggtggctaccaggtcctgggg

SEQ ID NO: 30863 - DNA, 22 bp, Homo sapiens
aggagctgtcagagtgccagag

SEQ ID NO: 30864 - DNA, 22 bp, Homo sapiens
ttgttgtcattgtagaggattt

SEQ ID NO: 30865 - DNA, 22 bp, Homo sapiens
ctgggaggcggaggttgtagtg

SEQ ID NO: 30866 - DNA, 18 bp, Homo sapiens
cagggctgtggggtcact

SEQ ID NO: 30867 - DNA, 22 bp, Homo sapiens
ctggtgtggactccgcgcggag

SEQ ID NO: 30868 - DNA, 22 bp, Homo sapiens
ctggcaggtggaggttgcagtg

SEQ ID NO: 30869 - DNA, 22 bp, Homo sapiens
tagaaaagccccagctggaggg

SEQ ID NO: 30870 - DNA, 22 bp, Homo sapiens
tgggcaggggccctgcttccgt

SEQ ID NO: 30871 - DNA, 22 bp, Homo sapiens
ccttttgctctcccatccagaa

SEQ ID NO: 30872 - DNA, 22 bp, Homo sapiens
gctggcagacttcctctggaac

SEQ ID NO: 30873 - DNA, 22 bp, Homo sapiens
actgtgaacggactgaagccca

SEQ ID NO: 30874 - DNA, 22 bp, Homo sapiens
aattcacatccgaccaggtcaa

SEQ ID NO: 30875 - DNA, 22 bp, Homo sapiens
gccctgccctctcggcactcgc

SEQ ID NO: 30876 - DNA, 22 bp, Homo sapiens
gccagggttgccaatgggggca

SEQ ID NO: 30877 - DNA, 22 bp, Homo sapiens
gttggagtgcagcttgtgcgat

SEQ ID NO: 30878 - DNA, 22 bp, Homo sapiens
aaaatatgtataactcttctgc

SEQ ID NO: 30879 - DNA, 22 bp, Homo sapiens
gcgtctcaaggcccccaggcca

SEQ ID NO: 30880 - DNA, 22 bp, Homo sapiens
agaaggggcccaaggatgtcag

SEQ ID NO: 30881 - DNA, 22 bp, Homo sapiens
cactgcactccagcttgggcaa

SEQ ID NO: 30882 - DNA, 22 bp, Homo sapiens
ttcgttgctttaagccactacg

SEQ ID NO: 30883 - DNA, 22 bp, Homo sapiens
tggagccagagcgcagcctggg

SEQ ID NO: 30884 - DNA, 22 bp, Homo sapiens
cccaggcttttctcttgcccca

SEQ ID NO: 30885 - DNA, 22 bp, Homo sapiens
gggaagtgatggagccaggatt

SEQ ID NO: 30886 - DNA, 22 bp, Homo sapiens
tggaaccatcaaagagatcctg

SEQ ID NO: 30887 - DNA, 22 bp, Homo sapiens
tttggaggggaagaccttggag

SEQ ID NO: 30888 - DNA, 22 bp, Homo sapiens
tcacattttcaaaagctggtgc

SEQ ID NO: 30889 - DNA, 22 bp, Homo sapiens
agaggccggccgagcccatggg

SEQ ID NO: 30890 - DNA, 22 bp, Homo sapiens
tccttcagcctcccagctcaaa

SEQ ID NO: 30891 - DNA, 21 bp, Homo sapiens
cggaaaggactagggctcaga

SEQ ID NO: 30892 - DNA, 22 bp, Homo sapiens
gagctctgactgctgggtgaca

SEQ ID NO: 30893 - DNA, 22 bp, Homo sapiens
atacaaaaattagccgggagta

SEQ ID NO: 30894 - DNA, 22 bp, Homo sapiens
caggagtgtctccacacagcaa

SEQ ID NO: 30895 - DNA, 22 bp, Homo sapiens
gttatataagacaaatcagagt

SEQ ID NO: 30896 - DNA, 22 bp, Homo sapiens
tgagcctgggagatggaggctg

SEQ ID NO: 30897 - DNA, 22 bp, Homo sapiens
cctcgcggcactcgggccggat

SEQ ID NO: 30898 - DNA, 22 bp, Homo sapiens
gcaaacaaggacatacatcctg

SEQ ID NO: 30899 - DNA, 22 bp, Homo sapiens
caggctggagtgcagtggcgct

SEQ ID NO: 30900 - DNA, 22 bp, Homo sapiens
ataataacaatgccagatgcct

SEQ ID NO: 30901 - DNA, 22 bp, Homo sapiens
gtgctccctccttcctcaagga

SEQ ID NO: 30902 - DNA, 22 bp, Homo sapiens
gttactcttccccggggtctgg

SEQ ID NO: 30903 - DNA, 22 bp, Homo sapiens
cacccaggttggagtgcagtgg

SEQ ID NO: 30904 - DNA, 22 bp, Homo sapiens
gggattacagatgtgagccatt

SEQ ID NO: 30905 - DNA, 22 bp, Homo sapiens
ggcggtctcagcaccctcttgg

SEQ ID NO: 30906 - DNA, 22 bp, Homo sapiens
aaccaccattctctcctcttcc

SEQ ID NO: 30907 - DNA, 22 bp, Homo sapiens
ctgctctgctgatcagtgtctc

SEQ ID NO: 30908 - DNA, 22 bp, Homo sapiens
tttcaggacacctttaaaaacg

SEQ ID NO: 30909 - DNA, 22 bp, Homo sapiens
aacccaggagatggaggttgtg

SEQ ID NO: 30910 - DNA, 22 bp, Homo sapiens
tttggcggactgagaacgcggg

SEQ ID NO: 30911 - DNA, 22 bp, Homo sapiens
ttccaaaggctgcaccttgccc

SEQ ID NO: 30912 - DNA, 19 bp, Homo sapiens
gcctatgtcttcaaatcat

SEQ ID NO: 30913 - DNA, 19 bp, Homo sapiens
accttctgggaaacattcc

SEQ ID NO: 30914 - DNA, 22 bp, Homo sapiens
ttcattcttttacatgtgaata

SEQ ID NO: 30915 - DNA, 22 bp, Homo sapiens
ctcattgcaacctccgcctccc

SEQ ID NO: 30916 - DNA, 22 bp, Homo sapiens
aatgccagtgtgttgattccag

SEQ ID NO: 30917 - DNA, 22 bp, Homo sapiens
taagaaatttagttatagaatg

SEQ ID NO: 30918 - DNA, 22 bp, Homo sapiens
cacagggcttctcatggggtgc

SEQ ID NO: 30919 - DNA, 22 bp, Homo sapiens
gcctccggagttgcagtgtctt

SEQ ID NO: 30920 - DNA, 22 bp, Homo sapiens
tggtgctgccaggctcctgcca

SEQ ID NO: 30921 - DNA, 22 bp, Homo sapiens
cacattggcaaacggggttgca

SEQ ID NO: 30922 - DNA, 22 bp, Homo sapiens
ctggcagagttgggtctcaaat

SEQ ID NO: 30923 - DNA, 22 bp, Homo sapiens
ggctgggctccgggagcatgcg

SEQ ID NO: 30924 - DNA, 22 bp, Homo sapiens
ggtccccgtggaggctggagcg

SEQ ID NO: 30925 - DNA, 20 bp, Homo sapiens
gtttctgattcagtaggtct

SEQ ID NO: 30926 - DNA, 22 bp, Homo sapiens
tacatgctccttatgagaatct

SEQ ID NO: 30927 - DNA, 22 bp, Homo sapiens
ccctgctgtgtagcggaggaac

SEQ ID NO: 30928 - DNA, 23 bp, Homo sapiens
ctcaaccctagtaagggagtagg

SEQ ID NO: 30929 - DNA, 22 bp, Homo sapiens
ggcatcttgttgctcaaatcta

SEQ ID NO: 30930 - DNA, 22 bp, Homo sapiens
cccgactagctgggattacagg

SEQ ID NO: 30931 - DNA, 22 bp, Homo sapiens
taaagggtaggttttactgtaa

SEQ ID NO: 30932 - DNA, 22 bp, Homo sapiens
tttctaatctgattctcctacc

SEQ ID NO: 30933 - DNA, 22 bp, Homo sapiens
gaattttattactagtcaactg

SEQ ID NO: 30934 - DNA, 22 bp, Homo sapiens
ctgggggtcttgaaagggagag

SEQ ID NO: 30935 - DNA, 22 bp, Homo sapiens
acaggcacctgccaccacatct

SEQ ID NO: 30936 - DNA, 22 bp, Homo sapiens
aacccaggagccggaggttgtg

SEQ ID NO: 30937 - DNA, 22 bp, Homo sapiens
tgatatgcatgtaagggagaca

SEQ ID NO: 30938 - DNA, 20 bp, Homo sapiens
ataaaataactgccacaaga

SEQ ID NO: 30939 - DNA, 22 bp, Homo sapiens
gtcagtgtcttaacagagatta

SEQ ID NO: 30940 - DNA, 22 bp, Homo sapiens
gcccaggctggagtgcagtggc

SEQ ID NO: 30941 - DNA, 22 bp, Homo sapiens
ggccagcctggggctcccagac

SEQ ID NO: 30942 - DNA, 22 bp, Homo sapiens
gccggggctggggagagacatg

SEQ ID NO: 30943 - DNA, 19 bp, Homo sapiens
tcctgcctggggccgcctg

SEQ ID NO: 30944 - DNA, 22 bp, Homo sapiens
tctttggtttctgtctctgtaa

SEQ ID NO: 30945 - DNA, 22 bp, Homo sapiens
gccgggttcaagccattctcct

SEQ ID NO: 30946 - DNA, 20 bp, Homo sapiens
tcactgtaacatttgggggg

SEQ ID NO: 30947 - DNA, 22 bp, Homo sapiens
tcctccccaaagcccagcctgg

SEQ ID NO: 30948 - DNA, 22 bp, Homo sapiens
cccagggaggcccaggctctgc

SEQ ID NO: 30949 - DNA, 22 bp, Homo sapiens
agcattccacactgaagtctgc

SEQ ID NO: 30950 - DNA, 22 bp, Homo sapiens
tcacagagaaatgtggcacaaa

SEQ ID NO: 30951 - DNA, 22 bp, Homo sapiens
attgggatgccggctgataaga

SEQ ID NO: 30952 - DNA, 22 bp, Homo sapiens
gtggagggtgattgccggctgt

SEQ ID NO: 30953 - DNA, 22 bp, Homo sapiens
ggttcccggatctccgagtccc

SEQ ID NO: 30954 - DNA, 22 bp, Homo sapiens
agacagggtgatcgcttgagcc

SEQ ID NO: 30955 - DNA, 22 bp, Homo sapiens
gggccaccccactgcccacgct

SEQ ID NO: 30956 - DNA, 22 bp, Homo sapiens
attgcactccagcctgggtgac

SEQ ID NO: 30957 - DNA, 22 bp, Homo sapiens
tgggagaaagaaccctgagtga

SEQ ID NO: 30958 - DNA, 22 bp, Homo sapiens
ggaggctgagaggtcgcagtgg

SEQ ID NO: 30959 - DNA, 21 bp, Homo sapiens
gccagcggccgccctccagga

SEQ ID NO: 30960 - DNA, 22 bp, Homo sapiens
ttgtgaatagtgccacaataaa

SEQ ID NO: 30961 - DNA, 22 bp, Homo sapiens
gccagtgcctcgccgcgctcct

SEQ ID NO: 30962 - DNA, 22 bp, Homo sapiens
gctgcagctgtaggacacaatt

SEQ ID NO: 30963 - DNA, 22 bp, Homo sapiens
agctgattccactttttcccca

SEQ ID NO: 30964 - DNA, 22 bp, Homo sapiens
accattgccccctagtgtctgt

SEQ ID NO: 30965 - DNA, 22 bp, Homo sapiens
aacccagggtggaggttgcagt

SEQ ID NO: 30966 - DNA, 22 bp, Homo sapiens
caggcagaagaagtggaaggac

SEQ ID NO: 30967 - DNA, 22 bp, Homo sapiens
tgtaatattgtagtgacagtac

SEQ ID NO: 30968 - DNA, 22 bp, Homo sapiens
catggcggtcaggatgtaggtg

SEQ ID NO: 30969 - DNA, 22 bp, Homo sapiens
aggcaaggtgctacagacagtg

SEQ ID NO: 30970 - DNA, 22 bp, Homo sapiens
ctggggtcagggatcagagagc

SEQ ID NO: 30971 - DNA, 23 bp, Homo sapiens
ggatggacgtgatgccttagcca

SEQ ID NO: 30972 - DNA, 22 bp, Homo sapiens
ctccccagccctggtattctga

SEQ ID NO: 30973 - DNA, 22 bp, Homo sapiens
tcaggaggtccgcccgggaggg

SEQ ID NO: 30974 - DNA, 22 bp, Homo sapiens
gaccttgtgatccacccgcctt

SEQ ID NO: 30975 - DNA, 22 bp, Homo sapiens
ggccactgctctccagcctggg

SEQ ID NO: 30976 - DNA, 22 bp, Homo sapiens
acccacgaagatgagcggcatg

SEQ ID NO: 30977 - DNA, 22 bp, Homo sapiens
gcccagcccagaaaggttcgga

SEQ ID NO: 30978 - DNA, 22 bp, Homo sapiens
ttgatcatttttctggtaaaat

SEQ ID NO: 30979 - DNA, 22 bp, Homo sapiens
aggactgggtgcagagggcatc

SEQ ID NO: 30980 - DNA, 22 bp, Homo sapiens
atgagttgaagctacaagaggc

SEQ ID NO: 30981 - DNA, 22 bp, Homo sapiens
ttcttcatgggttcttttagga

SEQ ID NO: 30982 - DNA, 22 bp, Homo sapiens
gctgccgacccacaggggttaa

SEQ ID NO: 30983 - DNA, 22 bp, Homo sapiens
atccaccctgtggtggctttct

SEQ ID NO: 30984 - DNA, 22 bp, Homo sapiens
gactggaaagcctgtcctcaga

SEQ ID NO: 30985 - DNA, 22 bp, Homo sapiens
ttatttttaaaagttcacacag

SEQ ID NO: 30986 - DNA, 23 bp, Homo sapiens
ggagtgcaatggcgccatctcgg

SEQ ID NO: 30987 - DNA, 22 bp, Homo sapiens
ttgtgaatagtgccgctataaa

SEQ ID NO: 30988 - DNA, 22 bp, Homo sapiens
ggctcactgcaacttccgcctc

SEQ ID NO: 30989 - DNA, 22 bp, Homo sapiens
caggaggattgcttgaggccag

SEQ ID NO: 30990 - DNA, 22 bp, Homo sapiens
taggtagctttggcgtttcttg

SEQ ID NO: 30991 - DNA, 22 bp, Homo sapiens
gatgtgtttccaggatttgttt

SEQ ID NO: 30992 - DNA, 22 bp, Homo sapiens
cctggagagctcgggccaggca

SEQ ID NO: 30993 - DNA, 19 bp, Homo sapiens
gggcttggggctgaagcct

SEQ ID NO: 30994 - DNA, 22 bp, Homo sapiens
gtggcccaggctggagtgcagt

SEQ ID NO: 30995 - DNA, 22 bp, Homo sapiens
cttgcctttgtcttcaaaggct

SEQ ID NO: 30996 - DNA, 22 bp, Homo sapiens
tgggccactgctgcggaaggcg

SEQ ID NO: 30997 - DNA, 22 bp, Homo sapiens
ggggaaggaaagttattagcag

SEQ ID NO: 30998 - DNA, 22 bp, Homo sapiens
gaggctgaggcaggaggatcac

SEQ ID NO: 30999 - DNA, 22 bp, Homo sapiens
ggcaggaggtgagtggcgggtg

SEQ ID NO: 31000 - DNA, 22 bp, Homo sapiens
ggcgccagcactgcagcgcctc

SEQ ID NO: 31001 - DNA, 22 bp, Homo sapiens
caaagtggaggctctggggcca

SEQ ID NO: 31002 - DNA, 22 bp, Homo sapiens
cctggcaggtggcgccctcggc

SEQ ID NO: 31003 - DNA, 22 bp, Homo sapiens
aagggggcggcagccagtggaa

SEQ ID NO: 31004 - DNA, 18 bp, Homo sapiens
gaggatggaaggagatgc

SEQ ID NO: 31005 - DNA, 22 bp, Homo sapiens
ctggacacactggagtctggca

SEQ ID NO: 31006 - DNA, 22 bp, Homo sapiens
ggcccaggctggagtgcagtgg

SEQ ID NO: 31007 - DNA, 22 bp, Homo sapiens
caaagtgctggaattacaggtg

SEQ ID NO: 31008 - DNA, 22 bp, Homo sapiens
cacgcacgctgggtggaggcgc

SEQ ID NO: 31009 - DNA, 22 bp, Homo sapiens
gggaagagggagctggaatgat

SEQ ID NO: 31010 - DNA, 22 bp, Homo sapiens
agcctattccaggatgagctca

SEQ ID NO: 31011 - DNA, 22 bp, Homo sapiens
tggaatgcagtgggagcttacc

SEQ ID NO: 31012 - DNA, 22 bp, Homo sapiens
acccaggctggagtgcagtggg

SEQ ID NO: 31013 - DNA, 23 bp, Homo sapiens
caccactttctccttctccttgg

SEQ ID NO: 31014 - DNA, 22 bp, Homo sapiens
ctttttcctcgtagagcctaat

SEQ ID NO: 31015 - DNA, 22 bp, Homo sapiens
tttgctttgtttaaaagtggta

SEQ ID NO: 31016 - DNA, 22 bp, Homo sapiens
ggagaagaggagctggaagcct

SEQ ID NO: 31017 - DNA, 22 bp, Homo sapiens
ggagtgactcacagctgggaca

SEQ ID NO: 31018 - DNA, 22 bp, Homo sapiens
ccaggagctggagggtgcagtg

SEQ ID NO: 31019 - DNA, 22 bp, Homo sapiens
tggtagtcggcctcggtggctc

SEQ ID NO: 31020 - DNA, 21 bp, Homo sapiens
tgcaatccagcctgggcgaca

SEQ ID NO: 31021 - DNA, 22 bp, Homo sapiens
gaggagggagctggaagctctt

SEQ ID NO: 31022 - DNA, 22 bp, Homo sapiens
aaggcaaggcttccagctcccc

SEQ ID NO: 31023 - DNA, 22 bp, Homo sapiens
aagcgccatggttcctgcgcag

SEQ ID NO: 31024 - DNA, 22 bp, Homo sapiens
cagcaagtcatccaggatgatg

SEQ ID NO: 31025 - DNA, 22 bp, Homo sapiens
agaggaagtaatcaggacctgc

SEQ ID NO: 31026 - DNA, 22 bp, Homo sapiens
gaggctggacgtgcatttctac

SEQ ID NO: 31027 - DNA, 22 bp, Homo sapiens
ctcaggagttggaggctacagt

SEQ ID NO: 31028 - DNA, 22 bp, Homo sapiens
aatgcaatgcagcacctccttg

SEQ ID NO: 31029 - DNA, 22 bp, Homo sapiens
ctcactgcaagctctgcctcca

SEQ ID NO: 31030 - DNA, 14 bp, Homo sapiens
gcaggcggatcact

SEQ ID NO: 31031 - DNA, 22 bp, Homo sapiens
gctaatcaatgttaaggctgtg

SEQ ID NO: 31032 - DNA, 22 bp, Homo sapiens
ggagtgactctcggggccacta

SEQ ID NO: 31033 - DNA, 22 bp, Homo sapiens
ctgcaccctcaaactcctgggc

SEQ ID NO: 31034 - DNA, 22 bp, Homo sapiens
ggagtagctgcattccgagcac

SEQ ID NO: 31035 - DNA, 22 bp, Homo sapiens
tggctaacaaggtgaaaccccg

SEQ ID NO: 31036 - DNA, 22 bp, Homo sapiens
aaagtgcaaggattacaggcat

SEQ ID NO: 31037 - DNA, 22 bp, Homo sapiens
gggccggagctgggtcccgcgc

SEQ ID NO: 31038 - DNA, 22 bp, Homo sapiens
ggaggaggggtgactgaatgct

SEQ ID NO: 31039 - DNA, 22 bp, Homo sapiens
gtcagaggggcagctgccaggc

SEQ ID NO: 31040 - DNA, 22 bp, Homo sapiens
tatgcacaacatgcaggtttgt

SEQ ID NO: 31041 - DNA, 22 bp, Homo sapiens
gttgagtgggttaggatgctga

SEQ ID NO: 31042 - DNA, 22 bp, Homo sapiens
ttccgagggctcggcggccgcc

SEQ ID NO: 31043 - DNA, 22 bp, Homo sapiens
gggctgtgaggtgagaacttac

SEQ ID NO: 31044 - DNA, 22 bp, Homo sapiens
agctgaaacttcccattaattg

SEQ ID NO: 31045 - DNA, 22 bp, Homo sapiens
caggctgctgacaggcttggag

SEQ ID NO: 31046 - DNA, 22 bp, Homo sapiens
tgcctcagctgaggccgctcca

SEQ ID NO: 31047 - DNA, 22 bp, Homo sapiens
actgcaacctccacctcctggg

SEQ ID NO: 31048 - DNA, 22 bp, Homo sapiens
gtccacagctctgaggtctccc

SEQ ID NO: 31049 - DNA, 22 bp, Homo sapiens
agccacatggacctgatgctag

SEQ ID NO: 31050 - DNA, 22 bp, Homo sapiens
caaagtgctgggattacaggtg

SEQ ID NO: 31051 - DNA, 22 bp, Homo sapiens
ctgaggagaggtggcctgtgtt

SEQ ID NO: 31052 - DNA, 22 bp, Homo sapiens
agagtgtaccaaatatcctaca

SEQ ID NO: 31053 - DNA, 22 bp, Homo sapiens
ggggtcggggcatagccactta

SEQ ID NO: 31054 - DNA, 22 bp, Homo sapiens
ccaaagtgctgggattacaggt

SEQ ID NO: 31055 - DNA, 22 bp, Homo sapiens
ctcccagccttcgccagtctga

SEQ ID NO: 31056 - DNA, 22 bp, Homo sapiens
gctactgattgaccttggagag

SEQ ID NO: 31057 - DNA, 22 bp, Homo sapiens
caggctggagtgcagtggtgcc

SEQ ID NO: 31058 - DNA, 22 bp, Homo sapiens
tttctttatcatagcatctttg

SEQ ID NO: 31059 - DNA, 22 bp, Homo sapiens
atacagggacatccagtttttc

SEQ ID NO: 31060 - DNA, 22 bp, Homo sapiens
gggttggatcctggtggctgcc

SEQ ID NO: 31061 - DNA, 22 bp, Homo sapiens
ttttcatttttgtagatgcaag

SEQ ID NO: 31062 - DNA, 22 bp, Homo sapiens
ttatttaatgtgatctgaagag

SEQ ID NO: 31063 - DNA, 22 bp, Homo sapiens
ggaaactagaagaatactagtc

SEQ ID NO: 31064 - DNA, 22 bp, Homo sapiens
ctcactgcaacctctgcctccc

SEQ ID NO: 31065 - DNA, 22 bp, Homo sapiens
taatgtataacaaatactcatc

SEQ ID NO: 31066 - DNA, 22 bp, Homo sapiens
cttctggcgttggaggtctgag

SEQ ID NO: 31067 - DNA, 21 bp, Homo sapiens
cagtggcacgatttcggctca

SEQ ID NO: 31068 - DNA, 22 bp, Homo sapiens
gggcaccttgggtctcaggcaa

SEQ ID NO: 31069 - DNA, 22 bp, Homo sapiens
tagctttgtttatcaaggggca

SEQ ID NO: 31070 - DNA, 22 bp, Homo sapiens
cggtctcccgtgtgtgtgcgct

SEQ ID NO: 31071 - DNA, 22 bp, Homo sapiens
tcttaattctgtgtcttcacta

SEQ ID NO: 31072 - DNA, 22 bp, Homo sapiens
ccacagaattctgtctccagga

SEQ ID NO: 31073 - DNA, 22 bp, Homo sapiens
ttgtgttaaggtgcatctagtg

SEQ ID NO: 31074 - DNA, 22 bp, Homo sapiens
ctggggaacgcagcgagcagcg

SEQ ID NO: 31075 - DNA, 22 bp, Homo sapiens
agacccaggattggggctgccg

SEQ ID NO: 31076 - DNA, 22 bp, Homo sapiens
cggagtcttgctatgttgccca

SEQ ID NO: 31077 - DNA, 22 bp, Homo sapiens
aataaacaaatccttccttccc

SEQ ID NO: 31078 - DNA, 22 bp, Homo sapiens
tggacaggcaagcaagacatac

SEQ ID NO: 31079 - DNA, 22 bp, Homo sapiens
gcacggctaatttttgtatttt

SEQ ID NO: 31080 - DNA, 22 bp, Homo sapiens
ttcacagtggtagtgcatttag

SEQ ID NO: 31081 - DNA, 22 bp, Homo sapiens
accatgtcatttattggccaaa

SEQ ID NO: 31082 - DNA, 22 bp, Homo sapiens
cacatttttactgccaacttaa

SEQ ID NO: 31083 - DNA, 22 bp, Homo sapiens
tgctgggggtagctctgcgtag

SEQ ID NO: 31084 - DNA, 22 bp, Homo sapiens
acacggcactttaggaaggggc

SEQ ID NO: 31085 - DNA, 22 bp, Homo sapiens
ccagtgtatttttgggacctgc

SEQ ID NO: 31086 - DNA, 19 bp, Homo sapiens
tcctggggaggggcatggc

SEQ ID NO: 31087 - DNA, 22 bp, Homo sapiens
agcctggcctgggcaggcacat

SEQ ID NO: 31088 - DNA, 19 bp, Homo sapiens
catctggatgattctcctg

SEQ ID NO: 31089 - DNA, 22 bp, Homo sapiens
caggccagggttgagaagagaa

SEQ ID NO: 31090 - DNA, 22 bp, Homo sapiens
atgttatgtctgggaaggggta

SEQ ID NO: 31091 - DNA, 22 bp, Homo sapiens
tggggtgagattcagatattca

SEQ ID NO: 31092 - DNA, 22 bp, Homo sapiens
ccagggtggcgtagatgctggg

SEQ ID NO: 31093 - DNA, 22 bp, Homo sapiens
aagaaatgtgaatattgaatag

SEQ ID NO: 31094 - DNA, 22 bp, Homo sapiens
tcactgcgcttcagcctgggtg

SEQ ID NO: 31095 - DNA, 22 bp, Homo sapiens
tgcaataactactttaatgttg

SEQ ID NO: 31096 - DNA, 22 bp, Homo sapiens
gcccagcacctctctcagggtt

SEQ ID NO: 31097 - DNA, 22 bp, Homo sapiens
tgtgggtggcatcgtcctggcc

SEQ ID NO: 31098 - DNA, 22 bp, Homo sapiens
attgtaaatagtgccacaataa

SEQ ID NO: 31099 - DNA, 22 bp, Homo sapiens
aagtcagacagctgagctgcct

SEQ ID NO: 31100 - DNA, 22 bp, Homo sapiens
tgactcctggtatggatgacag

SEQ ID NO: 31101 - DNA, 22 bp, Homo sapiens
ggtgacctcacctggtcccacc

SEQ ID NO: 31102 - DNA, 22 bp, Homo sapiens
agagagcagtggatcacctagc

SEQ ID NO: 31103 - DNA, 22 bp, Homo sapiens
tacagaggaggggattttaata

SEQ ID NO: 31104 - DNA, 20 bp, Homo sapiens
gccactgggcaccagcaggg

SEQ ID NO: 31105 - DNA, 22 bp, Homo sapiens
aggaaaatggaccagagttgtt

SEQ ID NO: 31106 - DNA, 22 bp, Homo sapiens
ccgggagcaggcgccaccgcca

SEQ ID NO: 31107 - DNA, 22 bp, Homo sapiens
cactgcactccagcctgggtga

SEQ ID NO: 31108 - DNA, 22 bp, Homo sapiens
tttctcttcactgtgtgcctca

SEQ ID NO: 31109 - DNA, 22 bp, Homo sapiens
agcccaggctggagtgcagtgg

SEQ ID NO: 31110 - DNA, 22 bp, Homo sapiens
accccaggaagtggaggtcatg

SEQ ID NO: 31111 - DNA, 22 bp, Homo sapiens
catgagataatttttctccagt

SEQ ID NO: 31112 - DNA, 22 bp, Homo sapiens
atctggttcttcttaggcatca

SEQ ID NO: 31113 - DNA, 22 bp, Homo sapiens
gtagttctgcagtgtcacctga

SEQ ID NO: 31114 - DNA, 22 bp, Homo sapiens
tgaagaaacgcagagaggtagg

SEQ ID NO: 31115 - DNA, 22 bp, Homo sapiens
gcaggtggatcacctgaggtca

SEQ ID NO: 31116 - DNA, 22 bp, Homo sapiens
tgccgcagtgcggggagggccc

SEQ ID NO: 31117 - DNA, 22 bp, Homo sapiens
ttggaaacgtcaccttttcctt

SEQ ID NO: 31118 - DNA, 22 bp, Homo sapiens
actgcacttcaccctgggtgac

SEQ ID NO: 31119 - DNA, 22 bp, Homo sapiens
gcaggagaacaaagcaagctgc

SEQ ID NO: 31120 - DNA, 22 bp, Homo sapiens
agaaaatttaaagagacacaca

SEQ ID NO: 31121 - DNA, 22 bp, Homo sapiens
actgcaacctccgcctgccagg

SEQ ID NO: 31122 - DNA, 22 bp, Homo sapiens
cgccaggcttggtagctcatgc

SEQ ID NO: 31123 - DNA, 22 bp, Homo sapiens
atacaaagtattaatcctggat

SEQ ID NO: 31124 - DNA, 22 bp, Homo sapiens
atacataattacttccgatgtt

SEQ ID NO: 31125 - DNA, 22 bp, Homo sapiens
gtggttcacttgaggtcaggag

SEQ ID NO: 31126 - DNA, 22 bp, Homo sapiens
cagcaggaggtgagtagcaggt

SEQ ID NO: 31127 - DNA, 22 bp, Homo sapiens
gctgcagggagctggaaggctc

SEQ ID NO: 31128 - DNA, 18 bp, Homo sapiens
cccggctaatttttggta

SEQ ID NO: 31129 - DNA, 22 bp, Homo sapiens
caggcagggagctggaaaggat

SEQ ID NO: 31130 - DNA, 22 bp, Homo sapiens
tcacatctaattccatttctgc

SEQ ID NO: 31131 - DNA, 22 bp, Homo sapiens
ggccttggcctagccctccagg

SEQ ID NO: 31132 - DNA, 22 bp, Homo sapiens
aggacagagggaccagagccca

SEQ ID NO: 31133 - DNA, 22 bp, Homo sapiens
tctgtcttagccatctcaggct

SEQ ID NO: 31134 - DNA, 22 bp, Homo sapiens
gagccccaccctagacattctg

SEQ ID NO: 31135 - DNA, 22 bp, Homo sapiens
aagagggaaattgttggctgct

SEQ ID NO: 31136 - DNA, 22 bp, Homo sapiens
gcggcggagacagcaggaagcc

SEQ ID NO: 31137 - DNA, 22 bp, Homo sapiens
tgagatggagccactgcactct

SEQ ID NO: 31138 - DNA, 22 bp, Homo sapiens
agctggggctgtggttgtgatt

SEQ ID NO: 31139 - DNA, 22 bp, Homo sapiens
atatatttgagaatattcatga

SEQ ID NO: 31140 - DNA, 17 bp, Homo sapiens
gggcagggactcctggg

SEQ ID NO: 31141 - DNA, 22 bp, Homo sapiens
gggaggttgaggctgcagtgag

SEQ ID NO: 31142 - DNA, 22 bp, Homo sapiens
cgcccaggctggagtgcagtgg

SEQ ID NO: 31143 - DNA, 22 bp, Homo sapiens
gggaggcacgaggcgcgcagtg

SEQ ID NO: 31144 - DNA, 22 bp, Homo sapiens
aggacgctctcgctgaacttct

SEQ ID NO: 31145 - DNA, 22 bp, Homo sapiens
agttatgtcctcagcaaatcaa

SEQ ID NO: 31146 - DNA, 22 bp, Homo sapiens
tcttcccagaggaggtgccagc

SEQ ID NO: 31147 - DNA, 22 bp, Homo sapiens
cgggttcacgccattctcctgc

SEQ ID NO: 31148 - DNA, 22 bp, Homo sapiens
gcccccgtagtagatgaggcgc

SEQ ID NO: 31149 - DNA, 22 bp, Homo sapiens
cggggttcatccatgctgtggc

SEQ ID NO: 31150 - DNA, 20 bp, Homo sapiens
cgcccagtgcggttctgacc

SEQ ID NO: 31151 - DNA, 22 bp, Homo sapiens
tcctgccttgcctgggacatca

SEQ ID NO: 31152 - DNA, 22 bp, Homo sapiens
tgacttcctgcactcaggtgat

SEQ ID NO: 31153 - DNA, 22 bp, Homo sapiens
agcccggcttccccggttgcta

SEQ ID NO: 31154 - DNA, 22 bp, Homo sapiens
aaaagcaattgcgggttttgcc

SEQ ID NO: 31155 - DNA, 22 bp, Homo sapiens
gcttctcaattctcaccctcca

SEQ ID NO: 31156 - DNA, 21 bp, Homo sapiens
tggcggggacttgtggctgcc

SEQ ID NO: 31157 - DNA, 20 bp, Homo sapiens
aactcctagcctcaagtgat

SEQ ID NO: 31158 - DNA, 22 bp, Homo sapiens
cacagcctcctctggctcacgg

SEQ ID NO: 31159 - DNA, 22 bp, Homo sapiens
tagggggctttgctgcttgaca

SEQ ID NO: 31160 - DNA, 22 bp, Homo sapiens
cttagatgaagtcacagaaccc

SEQ ID NO: 31161 - DNA, 22 bp, Homo sapiens
gggagctgagctggaagagaat

SEQ ID NO: 31162 - DNA, 22 bp, Homo sapiens
cgcgctctccttctggcaccca

SEQ ID NO: 31163 - DNA, 22 bp, Homo sapiens
cgaggaggaaacgcggagaact

SEQ ID NO: 31164 - DNA, 22 bp, Homo sapiens
ggtccccccatggtgagcactg

SEQ ID NO: 31165 - DNA, 22 bp, Homo sapiens
gagatggagtctttttctgtca

SEQ ID NO: 31166 - DNA, 22 bp, Homo sapiens
aagtggactaatacaaggacta

SEQ ID NO: 31167 - DNA, 22 bp, Homo sapiens
tactgcgccttcaccaagcggc

SEQ ID NO: 31168 - DNA, 22 bp, Homo sapiens
gaggcagaagttgcagtgagca

SEQ ID NO: 31169 - DNA, 22 bp, Homo sapiens
ctctgcaacttctagcagtgtc

SEQ ID NO: 31170 - DNA, 21 bp, Homo sapiens
agaaggcaaaagcagacatct

SEQ ID NO: 31171 - DNA, 22 bp, Homo sapiens
ctcaggacccggtccaggtggg

SEQ ID NO: 31172 - DNA, 22 bp, Homo sapiens
cgtcccgggttcacgccattct

SEQ ID NO: 31173 - DNA, 22 bp, Homo sapiens
tcataaattctggtgctgtgag

SEQ ID NO: 31174 - DNA, 22 bp, Homo sapiens
ggcagacctctccagccccaca

SEQ ID NO: 31175 - DNA, 22 bp, Homo sapiens
ttccagctaactcacatccctt

SEQ ID NO: 31176 - DNA, 22 bp, Homo sapiens
tgggactcactcttttggccag

SEQ ID NO: 31177 - DNA, 22 bp, Homo sapiens
acgcccagactcccatactttg

SEQ ID NO: 31178 - DNA, 22 bp, Homo sapiens
gggttgaggcggatgtcggcgg

SEQ ID NO: 31179 - DNA, 22 bp, Homo sapiens
gggccctgcgactcgcggcgga

SEQ ID NO: 31180 - DNA, 22 bp, Homo sapiens
ctgaagcagggagtgatgaagt

SEQ ID NO: 31181 - DNA, 22 bp, Homo sapiens
ttagggttacaccagcctcctg

SEQ ID NO: 31182 - DNA, 22 bp, Homo sapiens
aaacaacctaaagttactgatc

SEQ ID NO: 31183 - DNA, 22 bp, Homo sapiens
agagagcccgggccagggcaca

SEQ ID NO: 31184 - DNA, 22 bp, Homo sapiens
cctcgacctccccaggctcagg

SEQ ID NO: 31185 - DNA, 22 bp, Homo sapiens
caggctggagtgcagtggggcg

SEQ ID NO: 31186 - DNA, 22 bp, Homo sapiens
gctccaaagtacagtgacttac

SEQ ID NO: 31187 - DNA, 22 bp, Homo sapiens
tgccagctgcttgtcccccaca

SEQ ID NO: 31188 - DNA, 22 bp, Homo sapiens
actaggggctcaggcccaggga

SEQ ID NO: 31189 - DNA, 22 bp, Homo sapiens
acgaggttggagagttgtttgg

SEQ ID NO: 31190 - DNA, 22 bp, Homo sapiens
agctcaccacaacctccgcctc

SEQ ID NO: 31191 - DNA, 22 bp, Homo sapiens
ctcagggccaaggatgctgttg

SEQ ID NO: 31192 - DNA, 22 bp, Homo sapiens
accctcaacaaattcactctat

SEQ ID NO: 31193 - DNA, 22 bp, Homo sapiens
ccagcttgaagatgtgctggtt

SEQ ID NO: 31194 - DNA, 21 bp, Homo sapiens
gttgtggttggggctgcagct

SEQ ID NO: 31195 - DNA, 22 bp, Homo sapiens
cctgcctatgagacgttttgcc

SEQ ID NO: 31196 - DNA, 22 bp, Homo sapiens
atttgtgggactataatgcagg

SEQ ID NO: 31197 - DNA, 23 bp, Homo sapiens
aggtaggttattgctgctacctg

SEQ ID NO: 31198 - DNA, 22 bp, Homo sapiens
gcctcctgagtagctgggattg

SEQ ID NO: 31199 - DNA, 22 bp, Homo sapiens
aggcgagaggcttgggctagta

SEQ ID NO: 31200 - DNA, 22 bp, Homo sapiens
cggccaagccggggccccgaag

SEQ ID NO: 31201 - DNA, 22 bp, Homo sapiens
gaagccttgaactgcaaacccc

SEQ ID NO: 31202 - DNA, 22 bp, Homo sapiens
acagaactgggaaatgcacata

SEQ ID NO: 31203 - DNA, 22 bp, Homo sapiens
tgagaacggatactaagggctg

SEQ ID NO: 31204 - DNA, 22 bp, Homo sapiens
atacaaaatatatactggagac

SEQ ID NO: 31205 - DNA, 22 bp, Homo sapiens
ttgcaaatcagaagtatagatt

SEQ ID NO: 31206 - DNA, 19 bp, Homo sapiens
gatttaaacgtggctctat

SEQ ID NO: 31207 - DNA, 22 bp, Homo sapiens
gaggtgggcggatcacaaggtc

SEQ ID NO: 31208 - DNA, 22 bp, Homo sapiens
cagtgcagccaaggacaggcac

SEQ ID NO: 31209 - DNA, 22 bp, Homo sapiens
aatggcactttataaatgttaa

SEQ ID NO: 31210 - DNA, 22 bp, Homo sapiens
gggacatctttctagtcagggt

SEQ ID NO: 31211 - DNA, 22 bp, Homo sapiens
tcaggggcttgaggtgcatgtc

SEQ ID NO: 31212 - DNA, 22 bp, Homo sapiens
ctcactgcaagctctgcctccc

SEQ ID NO: 31213 - DNA, 22 bp, Homo sapiens
gctcccaccttaaccttcacat

SEQ ID NO: 31214 - DNA, 18 bp, Homo sapiens
ccctgccagctcccagca

SEQ ID NO: 31215 - DNA, 22 bp, Homo sapiens
agtgaggggcagctgagtgggc

SEQ ID NO: 31216 - DNA, 22 bp, Homo sapiens
cccaggaggtggaggctgcagt

SEQ ID NO: 31217 - DNA, 21 bp, Homo sapiens
ccgtgctcggctatggaccac

SEQ ID NO: 31218 - DNA, 22 bp, Homo sapiens
ctgggagtggtgacagctctcg

SEQ ID NO: 31219 - DNA, 22 bp, Homo sapiens
ttctagtgtccttggacttgct

SEQ ID NO: 31220 - DNA, 22 bp, Homo sapiens
atgaattgaggaaaacagtcgt

SEQ ID NO: 31221 - DNA, 16 bp, Homo sapiens
ccacctgcagctctca

SEQ ID NO: 31222 - DNA, 22 bp, Homo sapiens
gacctccgtgtacacctcccag

SEQ ID NO: 31223 - DNA, 23 bp, Homo sapiens
cgcccagcctcagtgacctgggc

SEQ ID NO: 31224 - DNA, 22 bp, Homo sapiens
ggctgtggcagctggaagtggt

SEQ ID NO: 31225 - DNA, 22 bp, Homo sapiens
aaaaatcacttttataggcagc

SEQ ID NO: 31226 - DNA, 20 bp, Homo sapiens
ggccggggagctctccaggg

SEQ ID NO: 31227 - DNA, 22 bp, Homo sapiens
ctcattgcccagatccccacag

SEQ ID NO: 31228 - DNA, 22 bp, Homo sapiens
cccagttgttgccggctctgga

SEQ ID NO: 31229 - DNA, 22 bp, Homo sapiens
gaaccattgttgaaaagaatag

SEQ ID NO: 31230 - DNA, 22 bp, Homo sapiens
tcttcaggtagtgagtggggtg

SEQ ID NO: 31231 - DNA, 22 bp, Homo sapiens
ggctcactgcaagctccgcctc

SEQ ID NO: 31232 - DNA, 22 bp, Homo sapiens
actaaagctcacagagttgaac

SEQ ID NO: 31233 - DNA, 21 bp, Homo sapiens
aaactgaccttgcctgagaca

SEQ ID NO: 31234 - DNA, 22 bp, Homo sapiens
ttaatgacaggataggctctga

SEQ ID NO: 31235 - DNA, 22 bp, Homo sapiens
ctggcaggagcattcacagagg

SEQ ID NO: 31236 - DNA, 22 bp, Homo sapiens
agaaaatgtgaacttgtgaatt

SEQ ID NO: 31237 - DNA, 22 bp, Homo sapiens
ctgctccccagcctgcgccttt

SEQ ID NO: 31238 - DNA, 22 bp, Homo sapiens
tccagcttataggtagatttaa

SEQ ID NO: 31239 - DNA, 22 bp, Homo sapiens
cactgcactccagcctgggaga

SEQ ID NO: 31240 - DNA, 22 bp, Homo sapiens
ctcgttgctgaagccaaagtca

SEQ ID NO: 31241 - DNA, 22 bp, Homo sapiens
gctgggttttcttccgggccta

SEQ ID NO: 31242 - DNA, 21 bp, Homo sapiens
aggcatgagccctgcatggac

SEQ ID NO: 31243 - DNA, 22 bp, Homo sapiens
acccaggctggagtgcagtggc

SEQ ID NO: 31244 - DNA, 22 bp, Homo sapiens
tgagccaggagtttgaggctgt

SEQ ID NO: 31245 - DNA, 22 bp, Homo sapiens
taacaatacccattctaattac

SEQ ID NO: 31246 - DNA, 22 bp, Homo sapiens
attgctaggaacaggttgcacc

SEQ ID NO: 31247 - DNA, 19 bp, Homo sapiens
actgcactttagcctgggc

SEQ ID NO: 31248 - DNA, 22 bp, Homo sapiens
gatttagtggcccttggtacac

SEQ ID NO: 31249 - DNA, 22 bp, Homo sapiens
atcggcaagccccacaccgtcc

SEQ ID NO: 31250 - DNA, 22 bp, Homo sapiens
attctaaatcagagagctctgt

SEQ ID NO: 31251 - DNA, 22 bp, Homo sapiens
agagggtgggcacgtgatggat

SEQ ID NO: 31252 - DNA, 22 bp, Homo sapiens
tgacagcctcactttgttaatt

SEQ ID NO: 31253 - DNA, 22 bp, Homo sapiens
tctcgctctgtcgcccaggctg

SEQ ID NO: 31254 - DNA, 22 bp, Homo sapiens
tagcaaaggatgactatgtacc

SEQ ID NO: 31255 - DNA, 19 bp, Homo sapiens
agccagccagcaggtatgc

SEQ ID NO: 31256 - DNA, 22 bp, Homo sapiens
caagtgatcctcccatcttggc

SEQ ID NO: 31257 - DNA, 22 bp, Homo sapiens
cttggggaagccactgatccct

SEQ ID NO: 31258 - DNA, 22 bp, Homo sapiens
agggactatttacccatctcac

SEQ ID NO: 31259 - DNA, 22 bp, Homo sapiens
cgttgtttgagattttcagaat

SEQ ID NO: 31260 - DNA, 22 bp, Homo sapiens
gctgctgggatcctgggtctca

SEQ ID NO: 31261 - DNA, 22 bp, Homo sapiens
tgaagctttaggatgggttcat

SEQ ID NO: 31262 - DNA, 22 bp, Homo sapiens
cccaggagttagaggttgtggt

SEQ ID NO: 31263 - DNA, 22 bp, Homo sapiens
gtgcgcaccctcccggcatccc

SEQ ID NO: 31264 - DNA, 22 bp, Homo sapiens
tttgaagactactgggagtgaa

SEQ ID NO: 31265 - DNA, 22 bp, Homo sapiens
tccagggagagccgctgctcca

SEQ ID NO: 31266 - DNA, 22 bp, Homo sapiens
cctcccctcagacagagactgg

SEQ ID NO: 31267 - DNA, 22 bp, Homo sapiens
agatacattgttctaagcattg

SEQ ID NO: 31268 - DNA, 22 bp, Homo sapiens
ttatttaaaagtggtaagattc

SEQ ID NO: 31269 - DNA, 23 bp, Homo sapiens
aatgggtgcaactatccatgaca

SEQ ID NO: 31270 - DNA, 22 bp, Homo sapiens
atagttttaaaacctcaggaag

SEQ ID NO: 31271 - DNA, 22 bp, Homo sapiens
ctctcagtcctgcgcgcctctg

SEQ ID NO: 31272 - DNA, 22 bp, Homo sapiens
taggctgggaagaaagattctc

SEQ ID NO: 31273 - DNA, 22 bp, Homo sapiens
gtctatgatattttgttatagc

SEQ ID NO: 31274 - DNA, 22 bp, Homo sapiens
ttctgcagtgttaacaatgtca

SEQ ID NO: 31275 - DNA, 22 bp, Homo sapiens
attggtagttttgtatttctct

SEQ ID NO: 31276 - DNA, 22 bp, Homo sapiens
ctgcactgacttccccggctgc

SEQ ID NO: 31277 - DNA, 22 bp, Homo sapiens
gcccagtggtaaaagcaggcct

SEQ ID NO: 31278 - DNA, 22 bp, Homo sapiens
ttccggaaggttctctagaatt

SEQ ID NO: 31279 - DNA, 22 bp, Homo sapiens
taccagggaacagggatattaa

SEQ ID NO: 31280 - DNA, 22 bp, Homo sapiens
tagccgggtgttgtgtcatgca

SEQ ID NO: 31281 - DNA, 22 bp, Homo sapiens
cccaggaggcagagatagcagt

SEQ ID NO: 31282 - DNA, 22 bp, Homo sapiens
cagcgtctcgttgtgggcctcg

SEQ ID NO: 31283 - DNA, 22 bp, Homo sapiens
actttaaaactgatcatcagag

SEQ ID NO: 31284 - DNA, 22 bp, Homo sapiens
tattattgacatttacttggtg

SEQ ID NO: 31285 - DNA, 22 bp, Homo sapiens
cccaggaggcctgcctggccgg

SEQ ID NO: 31286 - DNA, 22 bp, Homo sapiens
tcactgcaacctccacctcccg

SEQ ID NO: 31287 - DNA, 22 bp, Homo sapiens
ccagcatccatgctccctcggg

SEQ ID NO: 31288 - DNA, 23 bp, Homo sapiens
cagagctggctcagagctgcctg

SEQ ID NO: 31289 - DNA, 22 bp, Homo sapiens
gtaaaaaggccaagcccttgtg

SEQ ID NO: 31290 - DNA, 22 bp, Homo sapiens
gctggggaggcagcagagaaca

SEQ ID NO: 31291 - DNA, 22 bp, Homo sapiens
ccaggtgtgctctgcagtggat

SEQ ID NO: 31292 - DNA, 22 bp, Homo sapiens
atggagttctgccagcgctgct

SEQ ID NO: 31293 - DNA, 17 bp, Homo sapiens
aggaggccctggcgttt

SEQ ID NO: 31294 - DNA, 22 bp, Homo sapiens
aaatgtaagtctttgtttctta

SEQ ID NO: 31295 - DNA, 22 bp, Homo sapiens
agttggagtgaacatgagattg

SEQ ID NO: 31296 - DNA, 22 bp, Homo sapiens
tgctggaggccagaagtctgag

SEQ ID NO: 31297 - DNA, 22 bp, Homo sapiens
cagtggaggccttgggaccttt

SEQ ID NO: 31298 - DNA, 23 bp, Homo sapiens
actcgtggaattctctgcgatcg

SEQ ID NO: 31299 - DNA, 22 bp, Homo sapiens
ttgagggtctggatctgctgct

SEQ ID NO: 31300 - DNA, 22 bp, Homo sapiens
ccctcccagatgggcttgaggt

SEQ ID NO: 31301 - DNA, 23 bp, Homo sapiens
gctcatcaggcttagagtcaagg

SEQ ID NO: 31302 - DNA, 22 bp, Homo sapiens
gccaggcgggtctcaaactcct

SEQ ID NO: 31303 - DNA, 22 bp, Homo sapiens
gagccgaggcgcacagctcggg

SEQ ID NO: 31304 - DNA, 22 bp, Homo sapiens
gttctgggagatcttgagcttc

SEQ ID NO: 31305 - DNA, 22 bp, Homo sapiens
aggtgggcgctgctcccgctgg

SEQ ID NO: 31306 - DNA, 22 bp, Homo sapiens
ttcatatgtgaactcagtgatg

SEQ ID NO: 31307 - DNA, 22 bp, Homo sapiens
cacccaggcaaggattctgcaa

SEQ ID NO: 31308 - DNA, 22 bp, Homo sapiens
actgcactccagcctgggtaac

SEQ ID NO: 31309 - DNA, 22 bp, Homo sapiens
actgcactccaacctgggtgac

SEQ ID NO: 31310 - DNA, 22 bp, Homo sapiens
ttacatgtggtgtgaagaagag

SEQ ID NO: 31311 - DNA, 22 bp, Homo sapiens
cagcctggtccccggctcaccc

SEQ ID NO: 31312 - DNA, 22 bp, Homo sapiens
cgtgtacagtctatcttttttc

SEQ ID NO: 31313 - DNA, 22 bp, Homo sapiens
gtccaggagctcagggcttatt

SEQ ID NO: 31314 - DNA, 22 bp, Homo sapiens
gcacatccaatgattgttttga

SEQ ID NO: 31315 - DNA, 22 bp, Homo sapiens
ttggaggcaatgggaaggaggc

SEQ ID NO: 31316 - DNA, 22 bp, Homo sapiens
gcaggcaggcttccttgaactg

SEQ ID NO: 31317 - DNA, 22 bp, Homo sapiens
tcactgcaagctccacctcccg

SEQ ID NO: 31318 - DNA, 22 bp, Homo sapiens
agaaaacataggagacaggaaa

SEQ ID NO: 31319 - DNA, 22 bp, Homo sapiens
tggagaagattggtcaccattc

SEQ ID NO: 31320 - DNA, 22 bp, Homo sapiens
gcggcaggagtaaaggaggaag

SEQ ID NO: 31321 - DNA, 22 bp, Homo sapiens
aagccaggttccatggaggagc

SEQ ID NO: 31322 - DNA, 22 bp, Homo sapiens
gggcaggggtcagtggccccaa

SEQ ID NO: 31323 - DNA, 21 bp, Homo sapiens
ggtgacacgtggccccgctct

SEQ ID NO: 31324 - DNA, 22 bp, Homo sapiens
tcctcattcttggtgcatcaaa

SEQ ID NO: 31325 - DNA, 22 bp, Homo sapiens
tgataaacttagaaagaatgtt

SEQ ID NO: 31326 - DNA, 22 bp, Homo sapiens
tgagcttccctcctgcactaca

SEQ ID NO: 31327 - DNA, 21 bp, Homo sapiens
tctgccagctgaagaggtgga

SEQ ID NO: 31328 - DNA, 22 bp, Homo sapiens
ttagatttacaagcactgttta

SEQ ID NO: 31329 - DNA, 22 bp, Homo sapiens
tcgtgatctgtccacctcggcc

SEQ ID NO: 31330 - DNA, 22 bp, Homo sapiens
ccagatatcactgccgtgttgt

SEQ ID NO: 31331 - DNA, 22 bp, Homo sapiens
tccgggagctgaacgtcttgcg

SEQ ID NO: 31332 - DNA, 22 bp, Homo sapiens
gaaactctcgcatcctgggaac

SEQ ID NO: 31333 - DNA, 22 bp, Homo sapiens
gtctctatcatagctgaaccct

SEQ ID NO: 31334 - DNA, 22 bp, Homo sapiens
actcttgattgatttagtcttt

SEQ ID NO: 31335 - DNA, 22 bp, Homo sapiens
gcaggcagaggtggaggagaca

SEQ ID NO: 31336 - DNA, 22 bp, Homo sapiens
cccaggaggcagagcttgcagt

SEQ ID NO: 31337 - DNA, 22 bp, Homo sapiens
ttgtatagcccagagagtgaga

SEQ ID NO: 31338 - DNA, 22 bp, Homo sapiens
taagagaatgttgtggctaggt

SEQ ID NO: 31339 - DNA, 23 bp, Homo sapiens
gtgcgccaggacaacctgacgga

SEQ ID NO: 31340 - DNA, 22 bp, Homo sapiens
actgattgcattcatagggttt

SEQ ID NO: 31341 - DNA, 23 bp, Homo sapiens
agagcaaggaaatgaggtgtgat

SEQ ID NO: 31342 - DNA, 22 bp, Homo sapiens
ttgagaaccactgagttagata

SEQ ID NO: 31343 - DNA, 22 bp, Homo sapiens
acccaggctggcgtgcagtggc

SEQ ID NO: 31344 - DNA, 22 bp, Homo sapiens
caaggtgccatgctgggcgggg

SEQ ID NO: 31345 - DNA, 22 bp, Homo sapiens
aaattagtcatgttgtattact

SEQ ID NO: 31346 - DNA, 22 bp, Homo sapiens
agtgcattcctggggaagaagc

SEQ ID NO: 31347 - DNA, 22 bp, Homo sapiens
tccacaaggcagctcctccagg

SEQ ID NO: 31348 - DNA, 22 bp, Homo sapiens
gaaagtgctctctctatacaca

SEQ ID NO: 31349 - DNA, 22 bp, Homo sapiens
caggaaggggctcactctggcc

SEQ ID NO: 31350 - DNA, 20 bp, Homo sapiens
tggcctctgagatgccacgg

SEQ ID NO: 31351 - DNA, 19 bp, Homo sapiens
cgcctggcaggccctgcgc

SEQ ID NO: 31352 - DNA, 22 bp, Homo sapiens
ggatgttctggggttctcttgt

SEQ ID NO: 31353 - DNA, 22 bp, Homo sapiens
gcggcccgagcaggacgggtgg

SEQ ID NO: 31354 - DNA, 22 bp, Homo sapiens
cgcccaggctggagtgcagtga

SEQ ID NO: 31355 - DNA, 22 bp, Homo sapiens
cttgaatgtcctgtggcaaagt

SEQ ID NO: 31356 - DNA, 22 bp, Homo sapiens
tagatttgtttccttctctcca

SEQ ID NO: 31357 - DNA, 22 bp, Homo sapiens
ggcctgggctccgggagttact

SEQ ID NO: 31358 - DNA, 22 bp, Homo sapiens
atgccactgcacttcagcctgg

SEQ ID NO: 31359 - DNA, 22 bp, Homo sapiens
acgcccggtctccatagttttt

SEQ ID NO: 31360 - DNA, 22 bp, Homo sapiens
gcagctgacatctggctgggcc

SEQ ID NO: 31361 - DNA, 22 bp, Homo sapiens
ctgggaggcagaggttgtagtg

SEQ ID NO: 31362 - DNA, 22 bp, Homo sapiens
cttagagatgggttttacttag

SEQ ID NO: 31363 - DNA, 22 bp, Homo sapiens
aggtggaaatggctttcctagg

SEQ ID NO: 31364 - DNA, 22 bp, Homo sapiens
agttattactctttaacatatt

SEQ ID NO: 31365 - DNA, 20 bp, Homo sapiens
tcagccattccttacctttc

SEQ ID NO: 31366 - DNA, 22 bp, Homo sapiens
tccaggattgcaggtgcacaac

SEQ ID NO: 31367 - DNA, 22 bp, Homo sapiens
cccaggccctggcagagcttgt

SEQ ID NO: 31368 - DNA, 22 bp, Homo sapiens
gcaaaagtacagccggatttct

SEQ ID NO: 31369 - DNA, 22 bp, Homo sapiens
ggggtggatttcaggcggtgtc

SEQ ID NO: 31370 - DNA, 18 bp, Homo sapiens
gtcaggcatgaatctggg

SEQ ID NO: 31371 - DNA, 22 bp, Homo sapiens
gttactcttgagaggctgaggt

SEQ ID NO: 31372 - DNA, 22 bp, Homo sapiens
gcaggcagatcacctgtcagga

SEQ ID NO: 31373 - DNA, 22 bp, Homo sapiens
gaagcctcaacatctctgcgtc

SEQ ID NO: 31374 - DNA, 22 bp, Homo sapiens
cggggccctggggctgaaggtc

SEQ ID NO: 31375 - DNA, 22 bp, Homo sapiens
gtaaaaggtcaaggccaagtct

SEQ ID NO: 31376 - DNA, 22 bp, Homo sapiens
atatattttttgagacagagtc

SEQ ID NO: 31377 - DNA, 22 bp, Homo sapiens
caccaggctggagtgcagtggc

SEQ ID NO: 31378 - DNA, 22 bp, Homo sapiens
gtctttcttaaacaacagaaca

SEQ ID NO: 31379 - DNA, 22 bp, Homo sapiens
ctggctgggagcgagctgctca

SEQ ID NO: 31380 - DNA, 22 bp, Homo sapiens
cttcttgctgggggcctcagtg

SEQ ID NO: 31381 - DNA, 22 bp, Homo sapiens
gaggcaggcagattgcttgagg

SEQ ID NO: 31382 - DNA, 22 bp, Homo sapiens
atttcacttagtgtaatgtctt

SEQ ID NO: 31383 - DNA, 22 bp, Homo sapiens
caggaagctgtgaaggagacgg

SEQ ID NO: 31384 - DNA, 22 bp, Homo sapiens
attgagaagaaaatctaatata

SEQ ID NO: 31385 - DNA, 23 bp, Homo sapiens
tgaatgtttattctcggtgcaga

SEQ ID NO: 31386 - DNA, 22 bp, Homo sapiens
ggaggtggaggttgcagtgagc

SEQ ID NO: 31387 - DNA, 19 bp, Homo sapiens
actgcactccagcctgggt

SEQ ID NO: 31388 - DNA, 22 bp, Homo sapiens
tgtagctctccagccagcaagg

SEQ ID NO: 31389 - DNA, 22 bp, Homo sapiens
caaagtgggtgccctgatgctc

SEQ ID NO: 31390 - DNA, 22 bp, Homo sapiens
atgctatgtaactggcagatag

SEQ ID NO: 31391 - DNA, 22 bp, Homo sapiens
aggggatggagctggaaggcag

SEQ ID NO: 31392 - DNA, 22 bp, Homo sapiens
aacttaggaaaataaggcatga

SEQ ID NO: 31393 - DNA, 22 bp, Homo sapiens
aactcaaagatgcatgacgctt

SEQ ID NO: 31394 - DNA, 22 bp, Homo sapiens
accgggtaggtgtcaactctga

SEQ ID NO: 31395 - DNA, 22 bp, Homo sapiens
ttgcactccagcccgagcaaca

SEQ ID NO: 31396 - DNA, 22 bp, Homo sapiens
gctgaggctcctcgggaggaca

SEQ ID NO: 31397 - DNA, 22 bp, Homo sapiens
ttggccatctaagcccagccac

SEQ ID NO: 31398 - DNA, 22 bp, Homo sapiens
taaaatttgtccctgagtgttg

SEQ ID NO: 31399 - DNA, 22 bp, Homo sapiens
gccctagcgccagctcagcacc

SEQ ID NO: 31400 - DNA, 22 bp, Homo sapiens
catccaggctgaagtgcagtgg

SEQ ID NO: 31401 - DNA, 23 bp, Homo sapiens
tgttccagatacgccttttcctc

SEQ ID NO: 31402 - DNA, 22 bp, Homo sapiens
catggggcccatgtgctccaag

SEQ ID NO: 31403 - DNA, 21 bp, Homo sapiens
accactgcctccaaggttcag

SEQ ID NO: 31404 - DNA, 22 bp, Homo sapiens
gtgggggctggaaatcttgcca

SEQ ID NO: 31405 - DNA, 23 bp, Homo sapiens
tcgttgaatagcaatagcacaac

SEQ ID NO: 31406 - DNA, 22 bp, Homo sapiens
cgcgaggtggaggttgcagtga

SEQ ID NO: 31407 - DNA, 22 bp, Homo sapiens
ttgccttgttattctctcagaa

SEQ ID NO: 31408 - DNA, 22 bp, Homo sapiens
ggaagggcaaaagagatgaact

SEQ ID NO: 31409 - DNA, 22 bp, Homo sapiens
ggccctgggccctctagcttgt

SEQ ID NO: 31410 - DNA, 22 bp, Homo sapiens
ggtgccaggctgtagtcagggt

SEQ ID NO: 31411 - DNA, 22 bp, Homo sapiens
taggctgggggtaggaattgag

SEQ ID NO: 31412 - DNA, 19 bp, Homo sapiens
ccatggcaatgatctgatg

SEQ ID NO: 31413 - DNA, 22 bp, Homo sapiens
ttgcaattgctatggagagcgt

SEQ ID NO: 31414 - DNA, 22 bp, Homo sapiens
atgcagaagactgaaaagctga

SEQ ID NO: 31415 - DNA, 22 bp, Homo sapiens
aacccaggctggagtgcagtgg

SEQ ID NO: 31416 - DNA, 22 bp, Homo sapiens
atcagtgtgtcaaaagcacaaa

SEQ ID NO: 31417 - DNA, 22 bp, Homo sapiens
aacgcccgtggttgccaaggta

SEQ ID NO: 31418 - DNA, 23 bp, Homo sapiens
gacagagtgagaccttgtcttac

SEQ ID NO: 31419 - DNA, 22 bp, Homo sapiens
gcgggccaccttggagagcgct

SEQ ID NO: 31420 - DNA, 22 bp, Homo sapiens
attgcacttcagcctgggtgac

SEQ ID NO: 31421 - DNA, 18 bp, Homo sapiens
gcactgaggaaaacctct

SEQ ID NO: 31422 - DNA, 22 bp, Homo sapiens
ggtaccaccaattcagctgcca

SEQ ID NO: 31423 - DNA, 22 bp, Homo sapiens
attgttcaatgtaataattttg

SEQ ID NO: 31424 - DNA, 22 bp, Homo sapiens
cccaggccccagggcttgtcag

SEQ ID NO: 31425 - DNA, 22 bp, Homo sapiens
tgaaatgattatatggtgtttg

SEQ ID NO: 31426 - DNA, 22 bp, Homo sapiens
ttaaattttagaaacagactct

SEQ ID NO: 31427 - DNA, 22 bp, Homo sapiens
tgcaaatgtgttttaaaccaaa

SEQ ID NO: 31428 - DNA, 19 bp, Homo sapiens
aggaatggaattaattctg

SEQ ID NO: 31429 - DNA, 22 bp, Homo sapiens
actgcactccagcccgagcaac

SEQ ID NO: 31430 - DNA, 22 bp, Homo sapiens
cacccaggctggagagcagtgg

SEQ ID NO: 31431 - DNA, 22 bp, Homo sapiens
gaggcacagagtaggtgcacac

SEQ ID NO: 31432 - DNA, 22 bp, Homo sapiens
taacatttaaatttttcacata

SEQ ID NO: 31433 - DNA, 22 bp, Homo sapiens
agctttacctgccttggggcac

SEQ ID NO: 31434 - DNA, 22 bp, Homo sapiens
cctggcctttgaacgctagact

SEQ ID NO: 31435 - DNA, 22 bp, Homo sapiens
gccagggttcaagctattctcc

SEQ ID NO: 31436 - DNA, 22 bp, Homo sapiens
tgaacatgctgttgatggcctg

SEQ ID NO: 31437 - DNA, 22 bp, Homo sapiens
gaactcattagcctgctttcag

SEQ ID NO: 31438 - DNA, 22 bp, Homo sapiens
gtatcacttttgagagtgagaa

SEQ ID NO: 31439 - DNA, 22 bp, Homo sapiens
gaaaaggcagagttccggggaa

SEQ ID NO: 31440 - DNA, 22 bp, Homo sapiens
tttccctttagcctgagaatcc

SEQ ID NO: 31441 - DNA, 22 bp, Homo sapiens
tttggcggggcaattctgaagc

SEQ ID NO: 31442 - DNA, 22 bp, Homo sapiens
tcgcgcccccaagcgtcattgg

SEQ ID NO: 31443 - DNA, 22 bp, Homo sapiens
tttaggttttttcacgtggcta

SEQ ID NO: 31444 - DNA, 22 bp, Homo sapiens
attgcactccggcctgggtgac

SEQ ID NO: 31445 - DNA, 22 bp, Homo sapiens
ctggcccaggtggtcgttgagg

SEQ ID NO: 31446 - DNA, 22 bp, Homo sapiens
ttgaccactgaatggttctgaa

SEQ ID NO: 31447 - DNA, 22 bp, Homo sapiens
gggcatggtggcaggcacctgt

SEQ ID NO: 31448 - DNA, 22 bp, Homo sapiens
cgcccaggctggagagcagtgg

SEQ ID NO: 31449 - DNA, 22 bp, Homo sapiens
caggtgttggaagggcagtggg

SEQ ID NO: 31450 - DNA, 22 bp, Homo sapiens
agtatgtcagagtgaaaatggt

SEQ ID NO: 31451 - DNA, 20 bp, Homo sapiens
tgcagcacgggccctttcca

SEQ ID NO: 31452 - DNA, 22 bp, Homo sapiens
taagcctgcatgaaccatgaga

SEQ ID NO: 31453 - DNA, 22 bp, Homo sapiens
ataaaaactgacccatcctttg

SEQ ID NO: 31454 - DNA, 22 bp, Homo sapiens
tgatattttatgagctttcata

SEQ ID NO: 31455 - DNA, 22 bp, Homo sapiens
tggattcacaccattctcctgc

SEQ ID NO: 31456 - DNA, 22 bp, Homo sapiens
gaaaattattgaaaatggctct

SEQ ID NO: 31457 - DNA, 22 bp, Homo sapiens
gccagggtcctgaagaccaagt

SEQ ID NO: 31458 - DNA, 18 bp, Homo sapiens
cttgttcttctcttggcg

SEQ ID NO: 31459 - DNA, 22 bp, Homo sapiens
tgtttacagctgatcaggcatc

SEQ ID NO: 31460 - DNA, 22 bp, Homo sapiens
tgtttctgtatgatcaatattg

SEQ ID NO: 31461 - DNA, 22 bp, Homo sapiens
atattagtttggagactacaat

SEQ ID NO: 31462 - DNA, 22 bp, Homo sapiens
ccactattactgtgtggcagtc

SEQ ID NO: 31463 - DNA, 22 bp, Homo sapiens
gcgagaaactaagtgccctttg

SEQ ID NO: 31464 - DNA, 22 bp, Homo sapiens
ggcagggagtggagactcccta

SEQ ID NO: 31465 - DNA, 22 bp, Homo sapiens
ggcagggcaggaaagtcaggaa

SEQ ID NO: 31466 - DNA, 22 bp, Homo sapiens
agcctctctgttagtcactggg

SEQ ID NO: 31467 - DNA, 22 bp, Homo sapiens
cactgcagcctcgctctcctga

SEQ ID NO: 31468 - DNA, 22 bp, Homo sapiens
tggaaatgtttcttgagctcag

SEQ ID NO: 31469 - DNA, 22 bp, Homo sapiens
ggcgggaagttcttgcccactt

SEQ ID NO: 31470 - DNA, 22 bp, Homo sapiens
attgcacatctgcactacagcc

SEQ ID NO: 31471 - DNA, 22 bp, Homo sapiens
caggctggagtgcagtggcgcc

SEQ ID NO: 31472 - DNA, 22 bp, Homo sapiens
caaagggaaaagccatgtgggc

SEQ ID NO: 31473 - DNA, 22 bp, Homo sapiens
caacaacatgggattcatttct

SEQ ID NO: 31474 - DNA, 22 bp, Homo sapiens
ggacaagcctgtgagtgggttt

SEQ ID NO: 31475 - DNA, 22 bp, Homo sapiens
ggaggctgaggcaggcggatca

SEQ ID NO: 31476 - DNA, 22 bp, Homo sapiens
tatttaataaaactatggcatg

SEQ ID NO: 31477 - DNA, 22 bp, Homo sapiens
ggtcagccttggatttggtagc

SEQ ID NO: 31478 - DNA, 22 bp, Homo sapiens
ccttgtttctctcccagataag

SEQ ID NO: 31479 - DNA, 22 bp, Homo sapiens
agatttatgtggtcacactcag

SEQ ID NO: 31480 - DNA, 22 bp, Homo sapiens
cctgtctctgcagggccctgcc

SEQ ID NO: 31481 - DNA, 22 bp, Homo sapiens
aggtggagaagagatgggcagt

SEQ ID NO: 31482 - DNA, 22 bp, Homo sapiens
ttttgcaatgagatgcttgtca

SEQ ID NO: 31483 - DNA, 22 bp, Homo sapiens
acatttatataactcactagga

SEQ ID NO: 31484 - DNA, 22 bp, Homo sapiens
ggctcactacaacctccgcctt

SEQ ID NO: 31485 - DNA, 22 bp, Homo sapiens
aaagcagaggttgcagtgagct

SEQ ID NO: 31486 - DNA, 22 bp, Homo sapiens
ccagcagagcatggggaggaag

SEQ ID NO: 31487 - DNA, 22 bp, Homo sapiens
tccgaggccaaagctgtgaata

SEQ ID NO: 31488 - DNA, 22 bp, Homo sapiens
agccagggacgctgcaggctac

SEQ ID NO: 31489 - DNA, 22 bp, Homo sapiens
agcagcttgaggctggattcca

SEQ ID NO: 31490 - DNA, 22 bp, Homo sapiens
cctggctctgccacttactgcc

SEQ ID NO: 31491 - DNA, 22 bp, Homo sapiens
gagcccaggcagaggttgcagt

SEQ ID NO: 31492 - DNA, 22 bp, Homo sapiens
ttgtcgggcttacgcagggcca

SEQ ID NO: 31493 - DNA, 22 bp, Homo sapiens
agtgaccgaggcacttggcaac

SEQ ID NO: 31494 - DNA, 22 bp, Homo sapiens
gtcttagatttcaccgataatg

SEQ ID NO: 31495 - DNA, 22 bp, Homo sapiens
ttaataaagtatgaattggaaa

SEQ ID NO: 31496 - DNA, 22 bp, Homo sapiens
agatgcagtggttaacaataca

SEQ ID NO: 31497 - DNA, 22 bp, Homo sapiens
tcacccaggctggagtgcagtg

SEQ ID NO: 31498 - DNA, 22 bp, Homo sapiens
tagcataggaaagtactgggaa

SEQ ID NO: 31499 - DNA, 22 bp, Homo sapiens
aggaggggttctcgggtgctga

SEQ ID NO: 31500 - DNA, 22 bp, Homo sapiens
gggaggaggaatgttttgtgta

SEQ ID NO: 31501 - DNA, 22 bp, Homo sapiens
cacctagggtttcgcctttctt

SEQ ID NO: 31502 - DNA, 22 bp, Homo sapiens
taactaggattacaagcgtgcg

SEQ ID NO: 31503 - DNA, 22 bp, Homo sapiens
catataaatacaacatgtgtta

SEQ ID NO: 31504 - DNA, 19 bp, Homo sapiens
gatttaaacgtggctctat

SEQ ID NO: 31505 - DNA, 22 bp, Homo sapiens
aagaataagaggatttagaaca

SEQ ID NO: 31506 - DNA, 22 bp, Homo sapiens
aggaaataggaccagacaaagc

SEQ ID NO: 31507 - DNA, 20 bp, Homo sapiens
ataaaataactgccacaaga

SEQ ID NO: 31508 - DNA, 22 bp, Homo sapiens
aaagcactgcacatatatttgc

SEQ ID NO: 31509 - DNA, 22 bp, Homo sapiens
aataaaatggtcagttttctca

SEQ ID NO: 31510 - DNA, 22 bp, Homo sapiens
ttgtgctcctatgagaatctaa

SEQ ID NO: 31511 - DNA, 22 bp, Homo sapiens
acatttttcacatttgtagggt

SEQ ID NO: 31512 - DNA, 22 bp, Homo sapiens
tctgcggtccccttctcgccct

SEQ ID NO: 31513 - DNA, 22 bp, Homo sapiens
ccctggctggctctgcccggac

SEQ ID NO: 31514 - DNA, 22 bp, Homo sapiens
ctccttctgggcctggcagtgg

SEQ ID NO: 31515 - DNA, 22 bp, Homo sapiens
gagatggagtctttttctgtca

SEQ ID NO: 31516 - DNA, 22 bp, Homo sapiens
ttttcatttttgtagatgcaag

SEQ ID NO: 31517 - DNA, 22 bp, Homo sapiens
aagatattcaaagatttattag

SEQ ID NO: 31518 - DNA, 22 bp, Homo sapiens
tttcataatactgtacatgaaa

SEQ ID NO: 31519 - DNA, 22 bp, Homo sapiens
tgtttctgtatgatcaatattg

SEQ ID NO: 31520 - DNA, 22 bp, Homo sapiens
ttgtgctcctgtgagaatctag

SEQ ID NO: 31521 - DNA, 22 bp, Homo sapiens
taacatttaaatttttcacata

SEQ ID NO: 31522 - DNA, 22 bp, Homo sapiens
taagcattgtttctgaggatgg

SEQ ID NO: 31523 - DNA, 22 bp, Homo sapiens
ccctggctgcgtgatggatgaa

SEQ ID NO: 31524 - DNA, 20 bp, Homo sapiens
tatttctgggcaaccattta

SEQ ID NO: 31525 - DNA, 21 bp, Homo sapiens
taaacataaccttgtatggct

SEQ ID NO: 31526 - DNA, 22 bp, Homo sapiens
aagcatttcaggtagagatatt

SEQ ID NO: 31527 - DNA, 22 bp, Homo sapiens
aataaacaaaggacaaggaggt

SEQ ID NO: 31528 - DNA, 18 bp, Homo sapiens
gcctggcttcggagccgc

SEQ ID NO: 31529 - DNA, 22 bp, Homo sapiens
ccctggctgataccggaaaggc

SEQ ID NO: 31530 - DNA, 22 bp, Homo sapiens
aaagcagaggttgcagtgagct

SEQ ID NO: 31531 - DNA, 22 bp, Homo sapiens
tgaatgtgatgctaaacatatg

SEQ ID NO: 31532 - DNA, 22 bp, Homo sapiens
attgaaaataaggccagaaaca

SEQ ID NO: 31533 - DNA, 18 bp, Homo sapiens
ggctcaagtgatcctcct

SEQ ID NO: 31534 - DNA, 22 bp, Homo sapiens
tcctggcttgtcacatctacgt

SEQ ID NO: 31535 - DNA, 22 bp, Homo sapiens
cttccttctcactagcagcgcc

SEQ ID NO: 31536 - DNA, 22 bp, Homo sapiens
atttcatactaaggctcaaaaa

SEQ ID NO: 31537 - DNA, 22 bp, Homo sapiens
ataaaaactgacccatcctttg

SEQ ID NO: 31538 - DNA, 22 bp, Homo sapiens
cctgcctatgagacgttttgcc

SEQ ID NO: 31539 - DNA, 18 bp, Homo sapiens
tcctttctccctcatctt

SEQ ID NO: 31540 - DNA, 22 bp, Homo sapiens
tgtacacatggtgtacactccc

SEQ ID NO: 31541 - DNA, 22 bp, Homo sapiens
atgaaatatcttgaagaaattc

SEQ ID NO: 31542 - DNA, 21 bp, Homo sapiens
tctctttctggaagcttccct

SEQ ID NO: 31543 - DNA, 22 bp, Homo sapiens
aaagcagaactgagagagctgg

SEQ ID NO: 31544 - DNA, 22 bp, Homo sapiens
gctaatcaatgttaaggctgtg

SEQ ID NO: 31545 - DNA, 17 bp, Homo sapiens
cccgttctcttcgctgg

SEQ ID NO: 31546 - DNA, 22 bp, Homo sapiens
ataaagctattcctctcttttt

SEQ ID NO: 31547 - DNA, 22 bp, Homo sapiens
attttctctttgtatatgctag

SEQ ID NO: 31548 - DNA, 22 bp, Homo sapiens
gagcagtgccaaagaatttgcg

SEQ ID NO: 31549 - DNA, 22 bp, Homo sapiens
taactgattcctttttgaaaat

SEQ ID NO: 31550 - DNA, 22 bp, Homo sapiens
atatatttgagaatattcatga

SEQ ID NO: 31551 - DNA, 22 bp, Homo sapiens
agctacctgatccttcttctga

SEQ ID NO: 31552 - DNA, 22 bp, Homo sapiens
ctcttcctagtgtgcagcgtgg

SEQ ID NO: 31553 - DNA, 22 bp, Homo sapiens
tcatctaagagtcttacattta

SEQ ID NO: 31554 - DNA, 22 bp, Homo sapiens
aggcaggaaaatcgcttgaacc

SEQ ID NO: 31555 - DNA, 19 bp, Homo sapiens
ggagccgccgcccttcatt

SEQ ID NO: 31556 - DNA, 22 bp, Homo sapiens
aggtacatggggtgtgtgcacg

SEQ ID NO: 31557 - DNA, 22 bp, Homo sapiens
tgtaggacatgtacttgtaaca

SEQ ID NO: 31558 - DNA, 22 bp, Homo sapiens
ggcccaggctggagtgcagtgg

SEQ ID NO: 31559 - DNA, 22 bp, Homo sapiens
tgttctctaagccacccatttt

SEQ ID NO: 31560 - DNA, 22 bp, Homo sapiens
ttgtgctcctgtgagaatctag

SEQ ID NO: 31561 - DNA, 22 bp, Homo sapiens
gaaagacatagttgcaagatgg

SEQ ID NO: 31562 - DNA, 22 bp, Homo sapiens
actgcacttcagcctgggtgtc

SEQ ID NO: 31563 - DNA, 22 bp, Homo sapiens
cactgcactccagcttgggtga

SEQ ID NO: 31564 - DNA, 22 bp, Homo sapiens
ggaccaggactggtggtatctc

SEQ ID NO: 31565 - DNA, 22 bp, Homo sapiens
tggccttgagagatcaaaaggt

SEQ ID NO: 31566 - DNA, 22 bp, Homo sapiens
ttgtgctctgtgttatttaagg

SEQ ID NO: 31567 - DNA, 22 bp, Homo sapiens
tgcactccaggctgggtgacag

SEQ ID NO: 31568 - DNA, 22 bp, Homo sapiens
tccctgatgccttgatccgtgg

SEQ ID NO: 31569 - DNA, 22 bp, Homo sapiens
gagccaggtcgggccgcggcga

SEQ ID NO: 31570 - DNA, 22 bp, Homo sapiens
tgggcagggagctggaaccaca

SEQ ID NO: 31571 - DNA, 22 bp, Homo sapiens
actgcacttcagcctgggtgac

SEQ ID NO: 31572 - DNA, 22 bp, Homo sapiens
ttgcactccagcccgagcaaca

SEQ ID NO: 31573 - DNA, 22 bp, Homo sapiens
actgcactccagcctgggtgac

SEQ ID NO: 31574 - DNA, 22 bp, Homo sapiens
ccaggctggagtgcagtggcac

SEQ ID NO: 31575 - DNA, 22 bp, Homo sapiens
aatccaggtggcggaggttgtg

SEQ ID NO: 31576 - DNA, 22 bp, Homo sapiens
gagccaggaggcagagactgca

SEQ ID NO: 31577 - DNA, 22 bp, Homo sapiens
agaaaatgtgaacttgtgaatt

SEQ ID NO: 31578 - DNA, 22 bp, Homo sapiens
tttccagagggtgctcagggcg

SEQ ID NO: 31579 - DNA, 22 bp, Homo sapiens
ccaggagttggaggctgcagtg

SEQ ID NO: 31580 - DNA, 22 bp, Homo sapiens
cggaggttgaggctgcagtgag

SEQ ID NO: 31581 - DNA, 22 bp, Homo sapiens
attgcactccggcctgggtgac

SEQ ID NO: 31582 - DNA, 22 bp, Homo sapiens
gcctcctgagtagctgggattg

SEQ ID NO: 31583 - DNA, 22 bp, Homo sapiens
ggaaaatgggaacctgaagcca

SEQ ID NO: 31584 - DNA, 22 bp, Homo sapiens
gcaagacctatctagttgctgt

SEQ ID NO: 31585 - DNA, 22 bp, Homo sapiens
aggccttaccatagctgtagca

SEQ ID NO: 31586 - DNA, 22 bp, Homo sapiens
ccaggtgtgctctgcagtggat

SEQ ID NO: 31587 - DNA, 22 bp, Homo sapiens
caggagtccatctggcctggtg

SEQ ID NO: 31588 - DNA, 22 bp, Homo sapiens
tttgccctttctgagcctcatc

SEQ ID NO: 31589 - DNA, 22 bp, Homo sapiens
tccctagtcgcatctgtggaga

SEQ ID NO: 31590 - DNA, 22 bp, Homo sapiens
caattcccagctgccgggctgc

SEQ ID NO: 31591 - DNA, 22 bp, Homo sapiens
tgcacgtgggctctctgctctt

SEQ ID NO: 31592 - DNA, 22 bp, Homo sapiens
tagagctggccgggacagctgg

SEQ ID NO: 31593 - DNA, 22 bp, Homo sapiens
ttcccttaaattatggcatcta

SEQ ID NO: 31594 - DNA, 22 bp, Homo sapiens
ctggcaggttatagagctgccc

SEQ ID NO: 31595 - DNA, 22 bp, Homo sapiens
ctcaggagttggaggctacagt

SEQ ID NO: 31596 - DNA, 17 bp, Homo sapiens
cgggcatggagggcagg

SEQ ID NO: 31597 - DNA, 22 bp, Homo sapiens
gattgtggaagtcagtggttct

SEQ ID NO: 31598 - DNA, 22 bp, Homo sapiens
gggaggttgaggctgcagtgag

SEQ ID NO: 31599 - DNA, 22 bp, Homo sapiens
tctgacattttgagaatgacat

SEQ ID NO: 31600 - DNA, 22 bp, Homo sapiens
gcctgtaatcccagcactttgt

SEQ ID NO: 31601 - DNA, 22 bp, Homo sapiens
ggtggcagtagcactgggcctg

SEQ ID NO: 31602 - DNA, 22 bp, Homo sapiens
tagggtacatgtgcacaacatg

SEQ ID NO: 31603 - DNA, 22 bp, Homo sapiens
actgcactcctgcctgggtaac

SEQ ID NO: 31604 - DNA, 22 bp, Homo sapiens
tgccacagacaggacagaacag

SEQ ID NO: 31605 - DNA, 22 bp, Homo sapiens
gcctgtaatcccagcactttgg

SEQ ID NO: 31606 - DNA, 22 bp, Homo sapiens
cactgcacttcagcctgggtga

SEQ ID NO: 31607 - DNA, 22 bp, Homo sapiens
actgcactccagcctcggggtc

SEQ ID NO: 31608 - DNA, 22 bp, Homo sapiens
gtagggctcagtaaatactttg

SEQ ID NO: 31609 - DNA, 22 bp, Homo sapiens
ctcctgcttcacgggcaccgcc

SEQ ID NO: 31610 - DNA, 22 bp, Homo sapiens
tctgccttttactagctggatg

SEQ ID NO: 31611 - DNA, 22 bp, Homo sapiens
taactaggattacaagcgtgcg

SEQ ID NO: 31612 - DNA, 22 bp, Homo sapiens
gcaccgagaaggaagcatgcct

SEQ ID NO: 31613 - DNA, 22 bp, Homo sapiens
gttcaagaccagcctggccaac

SEQ ID NO: 31614 - DNA, 22 bp, Homo sapiens
ttgtgctcctatgagaatctaa

SEQ ID NO: 31615 - DNA, 22 bp, Homo sapiens
actgcgctccagcctgggtgac

SEQ ID NO: 31616 - DNA, 22 bp, Homo sapiens
tcccagctactctagaggctga

SEQ ID NO: 31617 - DNA, 22 bp, Homo sapiens
gaccctgtttctacaaataatt

SEQ ID NO: 31618 - DNA, 22 bp, Homo sapiens
ccaggagttggaagctgccatg

SEQ ID NO: 31619 - DNA, 22 bp, Homo sapiens
caggagtgttgattgctcagga

SEQ ID NO: 31620 - DNA, 21 bp, Homo sapiens
aggcttggatctagacaggcc

SEQ ID NO: 31621 - DNA, 21 bp, Homo sapiens
tgactgaggcttcttcacaca

SEQ ID NO: 31622 - DNA, 22 bp, Homo sapiens
actgcactccagcctgggtgat

SEQ ID NO: 31623 - DNA, 22 bp, Homo sapiens
actgcactccagcctgggtaac

SEQ ID NO: 31624 - DNA, 22 bp, Homo sapiens
actgcactccaacctgggtgac

SEQ ID NO: 31625 - DNA, 22 bp, Homo sapiens
agcaggcctgccacctcggggt

SEQ ID NO: 31626 - DNA, 22 bp, Homo sapiens
cactgcactccagcctgggtca

SEQ ID NO: 31627 - DNA, 22 bp, Homo sapiens
gtcaggactctgacccgtcccg

SEQ ID NO: 31628 - DNA, 22 bp, Homo sapiens
aagccaggttccatggaggagc

SEQ ID NO: 31629 - DNA, 22 bp, Homo sapiens
agtccaggcattccagccattc

SEQ ID NO: 31630 - DNA, 23 bp, Homo sapiens
cgtcttgtcctcgggcgcctggg

SEQ ID NO: 31631 - DNA, 22 bp, Homo sapiens
actgcacttcaccctgggtgac

SEQ ID NO: 31632 - DNA, 23 bp, Homo sapiens
ggagtgcaatggcgccatctcgg

SEQ ID NO: 31633 - DNA, 22 bp, Homo sapiens
cgtgtggtcccggcaaggcaag

SEQ ID NO: 31634 - DNA, 22 bp, Homo sapiens
gtcactgtatccaggttccagc

SEQ ID NO: 31635 - DNA, 22 bp, Homo sapiens
tctgacattagattaattggaa

SEQ ID NO: 31636 - DNA, 22 bp, Homo sapiens
attgcactccagcctgggtgac

SEQ ID NO: 31637 - DNA, 22 bp, Homo sapiens
attggtagttttgtatttctct

SEQ ID NO: 31638 - DNA, 22 bp, Homo sapiens
cactgcactccagcctgggtga

SEQ ID NO: 31639 - DNA, 22 bp, Homo sapiens
attgcacttcagcctgggtgac

SEQ ID NO: 31640 - DNA, 22 bp, Homo sapiens
actgcgtggggagctgtgacta

SEQ ID NO: 31641 - DNA, 22 bp, Homo sapiens
ttctgattgctgatgaggccca

SEQ ID NO: 31642 - DNA, 22 bp, Homo sapiens
atatccagcagcaggtgagtat

SEQ ID NO: 31643 - DNA, 18 bp, Homo sapiens
actctttctgcccacagg

SEQ ID NO: 31644 - DNA, 23 bp, Homo sapiens
tcagaacagttcttggtgcatag

SEQ ID NO: 31645 - DNA, 19 bp, Homo sapiens
tccaaagaagttcacattt

SEQ ID NO: 31646 - DNA, 22 bp, Homo sapiens
tgggagcagcctcagcttcggg

SEQ ID NO: 31647 - DNA, 22 bp, Homo sapiens
gccagtggtcactgaggaagaa

SEQ ID NO: 31648 - DNA, 22 bp, Homo sapiens
aagagggctgcaatcttattgc

SEQ ID NO: 31649 - DNA, 21 bp, Homo sapiens
atcagggatgggttggacacc

SEQ ID NO: 31650 - DNA, 18 bp, Homo sapiens
gcctggcttcggagccgc

SEQ ID NO: 31651 - DNA, 22 bp, Homo sapiens
cggcatccccacttcctcctgc

SEQ ID NO: 31652 - DNA, 20 bp, Homo sapiens
ggcagagggcctgggagaag

SEQ ID NO: 31653 - DNA, 22 bp, Homo sapiens
atcttcccaggctggggagagg

SEQ ID NO: 31654 - DNA, 22 bp, Homo sapiens
agcccaggttgaggctgcagtg

SEQ ID NO: 31655 - DNA, 22 bp, Homo sapiens
tgagccagaggaggctgtgtgg

SEQ ID NO: 31656 - DNA, 22 bp, Homo sapiens
agcctattccaggatgagctca

SEQ ID NO: 31657 - DNA, 22 bp, Homo sapiens
gttgctcaggcaggagtacagt

SEQ ID NO: 31658 - DNA, 22 bp, Homo sapiens
aagcctggactatcgcgtgtgc

SEQ ID NO: 31659 - DNA, 22 bp, Homo sapiens
ttccgctgtttagttgaagttt

SEQ ID NO: 31660 - DNA, 22 bp, Homo sapiens
gcccaggagttcaagtctagtg

SEQ ID NO: 31661 - DNA, 22 bp, Homo sapiens
tgggcaggggccctgcttccgt

SEQ ID NO: 31662 - DNA, 22 bp, Homo sapiens
caagaggattattaataaataa

SEQ ID NO: 31663 - DNA, 22 bp, Homo sapiens
tggatctcggcaatgcgggact

SEQ ID NO: 31664 - DNA, 22 bp, Homo sapiens
ctcctctttagccccagctgga

SEQ ID NO: 31665 - DNA, 22 bp, Homo sapiens
aagaagcattctttcattggtt

SEQ ID NO: 31666 - DNA, 22 bp, Homo sapiens
ttcttcagcctaccttgacctc

SEQ ID NO: 31667 - DNA, 22 bp, Homo sapiens
cttcctctgtggccagagtgta

SEQ ID NO: 31668 - DNA, 22 bp, Homo sapiens
aggggcacgagtagagctctag

SEQ ID NO: 31669 - DNA, 22 bp, Homo sapiens
cacgggagacgtgatcttggac

SEQ ID NO: 31670 - DNA, 22 bp, Homo sapiens
caagccattctcctgcctcagc

SEQ ID NO: 31671 - DNA, 22 bp, Homo sapiens
ggctgtggcagctggaagtggt

SEQ ID NO: 31672 - DNA, 22 bp, Homo sapiens
tgaggcacaggcagtgcccccg

SEQ ID NO: 31673 - DNA, 22 bp, Homo sapiens
aggctctgtcaggcggagcagc

SEQ ID NO: 31674 - DNA, 22 bp, Homo sapiens
tcagaacatgtttgagtaagac

SEQ ID NO: 31675 - DNA, 23 bp, Homo sapiens
ccagtgattgcctggaaggaggt

SEQ ID NO: 31676 - DNA, 22 bp, Homo sapiens
ctcttcctagtgtgcagcgtgg

SEQ ID NO: 31677 - DNA, 22 bp, Homo sapiens
ctgggggtcttgaaagggagag

SEQ ID NO: 31678 - DNA, 16 bp, Homo sapiens
atgctgctattagagg

SEQ ID NO: 31679 - DNA, 23 bp, Homo sapiens
gcagaggagcaagctggacacca

SEQ ID NO: 31680 - DNA, 22 bp, Homo sapiens
cctcttcaggcactcgaaggcc

SEQ ID NO: 31681 - DNA, 22 bp, Homo sapiens
ctgcttctccctgagatagtgt

SEQ ID NO: 31682 - DNA, 22 bp, Homo sapiens
agcccaggctggagtgcagtgg

SEQ ID NO: 31683 - DNA, 22 bp, Homo sapiens
attttctatgttgtaattgtta

SEQ ID NO: 31684 - DNA, 22 bp, Homo sapiens
catggcagctcctccagtgtga

SEQ ID NO: 31685 - DNA, 22 bp, Homo sapiens
gccttgtttcattacacgtggt

SEQ ID NO: 31686 - DNA, 22 bp, Homo sapiens
tcctccccaaagcccagcctgg

SEQ ID NO: 31687 - DNA, 21 bp, Homo sapiens
agggttttatagatctcttcc

SEQ ID NO: 31688 - DNA, 22 bp, Homo sapiens
gggaggttgaggctgcagtgag

SEQ ID NO: 31689 - DNA, 22 bp, Homo sapiens
cgggcaaggcgagactaggccc

SEQ ID NO: 31690 - DNA, 22 bp, Homo sapiens
tgcgcggctcagtcatctccag

SEQ ID NO: 31691 - DNA, 22 bp, Homo sapiens
ttgtcgggcttacgcagggcca

SEQ ID NO: 31692 - DNA, 22 bp, Homo sapiens
tcagtgatttctggggtgaggg

SEQ ID NO: 31693 - DNA, 22 bp, Homo sapiens
aatccaggtggcggaggttgtg

SEQ ID NO: 31694 - DNA, 22 bp, Homo sapiens
catccaggctggagtacagtgg

SEQ ID NO: 31695 - DNA, 22 bp, Homo sapiens
gcttaattctggctcagtttcc

SEQ ID NO: 31696 - DNA, 22 bp, Homo sapiens
agcaggaaggggatgatgggca

SEQ ID NO: 31697 - DNA, 22 bp, Homo sapiens
ggaggtgggctaaggactctct

SEQ ID NO: 31698 - DNA, 22 bp, Homo sapiens
cctggcaggtggcgccctcggc

SEQ ID NO: 31699 - DNA, 22 bp, Homo sapiens
agaagcagaaactgggcttgtg

SEQ ID NO: 31700 - DNA, 22 bp, Homo sapiens
gagcaccgcctccacgatgccc

SEQ ID NO: 31701 - DNA, 22 bp, Homo sapiens
ttttctgtttgcttcaagacat

SEQ ID NO: 31702 - DNA, 22 bp, Homo sapiens
tggccggggctgatggacagtg

SEQ ID NO: 31703 - DNA, 22 bp, Homo sapiens
cttcagctgcagttatgtttag

SEQ ID NO: 31704 - DNA, 18 bp, Homo sapiens
cagctgccagctcatgga

SEQ ID NO: 31705 - DNA, 14 bp, Homo sapiens
gcaggcggatcact

SEQ ID NO: 31706 - DNA, 22 bp, Homo sapiens
gtctatgatattttgttatagc

SEQ ID NO: 31707 - DNA, 22 bp, Homo sapiens
cactccagcctcagtgacagag

SEQ ID NO: 31708 - DNA, 22 bp, Homo sapiens
gcccaggaggagaggctgcagt

SEQ ID NO: 31709 - DNA, 22 bp, Homo sapiens
tgtaagtagtaatggaaggaca

SEQ ID NO: 31710 - DNA, 22 bp, Homo sapiens
aagaggagaaaggctggctttg

SEQ ID NO: 31711 - DNA, 22 bp, Homo sapiens
gaggcctgggcaagggggtctg

SEQ ID NO: 31712 - DNA, 22 bp, Homo sapiens
aatggctctgatgttgttgtga

SEQ ID NO: 31713 - DNA, 22 bp, Homo sapiens
tctgctctgtggcttcagctaa

SEQ ID NO: 31714 - DNA, 22 bp, Homo sapiens
cccttggggtggaggttgcagt

SEQ ID NO: 31715 - DNA, 22 bp, Homo sapiens
caccagagtgggtgagggtgat

SEQ ID NO: 31716 - DNA, 22 bp, Homo sapiens
tggccttgagagatcaaaaggt

SEQ ID NO: 31717 - DNA, 22 bp, Homo sapiens
ctctgcctgtctcatcctgcaa

SEQ ID NO: 31718 - DNA, 22 bp, Homo sapiens
cagctgctgttcagttttgttt

SEQ ID NO: 31719 - DNA, 22 bp, Homo sapiens
gatggcctcatggctgcaggcc

SEQ ID NO: 31720 - DNA, 22 bp, Homo sapiens
gagagagctctgtgcctgggat

SEQ ID NO: 31721 - DNA, 22 bp, Homo sapiens
taggcactgtgtttgtaggagt

SEQ ID NO: 31722 - DNA, 22 bp, Homo sapiens
gctgtgtatcagatgccacggg

SEQ ID NO: 31723 - DNA, 22 bp, Homo sapiens
tgggggtgtcctggtgcacaca

SEQ ID NO: 31724 - DNA, 22 bp, Homo sapiens
tatggcattgttggtgatgata

SEQ ID NO: 31725 - DNA, 22 bp, Homo sapiens
catccaggctgaagtgcagtgg

SEQ ID NO: 31726 - DNA, 22 bp, Homo sapiens
taagtcgtggatgattcttcgg

SEQ ID NO: 31727 - DNA, 22 bp, Homo sapiens
atctggttcttcttaggcatca

SEQ ID NO: 31728 - DNA, 22 bp, Homo sapiens
agggagcattgtgacatatcac

SEQ ID NO: 31729 - DNA, 22 bp, Homo sapiens
cggctgggttcggctgcaggcc

SEQ ID NO: 31730 - DNA, 22 bp, Homo sapiens
ctggaaggagcccgggcggatc

SEQ ID NO: 31731 - DNA, 22 bp, Homo sapiens
tggggagtgatgcctcggataa

SEQ ID NO: 31732 - DNA, 22 bp, Homo sapiens
ttctatttttgtggaactgtag

SEQ ID NO: 31733 - DNA, 22 bp, Homo sapiens
ctgagccaaggggacagtgaca

SEQ ID NO: 31734 - DNA, 21 bp, Homo sapiens
tctctttctggaagcttccct

SEQ ID NO: 31735 - DNA, 22 bp, Homo sapiens
tacatagctcctagtgatgcat

SEQ ID NO: 31736 - DNA, 22 bp, Homo sapiens
tgagatgtaaggtatgcttact

SEQ ID NO: 31737 - DNA, 22 bp, Homo sapiens
gaggtgctgctgtacttcttgc

SEQ ID NO: 31738 - DNA, 22 bp, Homo sapiens
cagaccagaaggaagccgacaa

SEQ ID NO: 31739 - DNA, 22 bp, Homo sapiens
tttgaagggcacgacaatagtt

SEQ ID NO: 31740 - DNA, 22 bp, Homo sapiens
aagaagcaggtcacagacaggg

SEQ ID NO: 31741 - DNA, 22 bp, Homo sapiens
tcctcagaatcacctggcagct

SEQ ID NO: 31742 - DNA, 22 bp, Homo sapiens
gacccaggggcagggagaaagt

SEQ ID NO: 31743 - DNA, 22 bp, Homo sapiens
cttctgagatgttgttttacag

SEQ ID NO: 31744 - DNA, 22 bp, Homo sapiens
gcccagtggtaaaagcaggcct

SEQ ID NO: 31745 - DNA, 22 bp, Homo sapiens
tgggcagggagctggaaccaca

SEQ ID NO: 31746 - DNA, 22 bp, Homo sapiens
catggcattgcataacggggct

SEQ ID NO: 31747 - DNA, 22 bp, Homo sapiens
tttctagttgttcatgaaagga

SEQ ID NO: 31748 - DNA, 22 bp, Homo sapiens
tggcactgaagctggaaagcct

SEQ ID NO: 31749 - DNA, 22 bp, Homo sapiens
actaggggctcaggcccaggga

SEQ ID NO: 31750 - DNA, 22 bp, Homo sapiens
gggagctgagctggaagagaat

SEQ ID NO: 31751 - DNA, 22 bp, Homo sapiens
tgaggcactccaggatgctgtt

SEQ ID NO: 31752 - DNA, 22 bp, Homo sapiens
gaggagctgcccgtgtgtctgc

SEQ ID NO: 31753 - DNA, 22 bp, Homo sapiens
gcccgcagagatctttaacaaa

SEQ ID NO: 31754 - DNA, 22 bp, Homo sapiens
gggacatctttctagtcagggt

SEQ ID NO: 31755 - DNA, 22 bp, Homo sapiens
gaggctggacgtgcatttctac

SEQ ID NO: 31756 - DNA, 22 bp, Homo sapiens
atctggttttggctgtgtccct

SEQ ID NO: 31757 - DNA, 22 bp, Homo sapiens
agcccaggagtttgaggctgtg

SEQ ID NO: 31758 - DNA, 22 bp, Homo sapiens
acttttaaatgagtttcagttg

SEQ ID NO: 31759 - DNA, 22 bp, Homo sapiens
ttttctaacatctagtaatttg

SEQ ID NO: 31760 - DNA, 22 bp, Homo sapiens
ctgctctgctgatcagtgtctc

SEQ ID NO: 31761 - DNA, 22 bp, Homo sapiens
agcccagaggctgggcgtgcat

SEQ ID NO: 31762 - DNA, 22 bp, Homo sapiens
agcataagttggtacagccact

SEQ ID NO: 31763 - DNA, 22 bp, Homo sapiens
ttctgattgctgatgaggccca

SEQ ID NO: 31764 - DNA, 22 bp, Homo sapiens
aggaggggttctcgggtgctga

SEQ ID NO: 31765 - DNA, 22 bp, Homo sapiens
atgaaaacggaccagagctatt

SEQ ID NO: 31766 - DNA, 22 bp, Homo sapiens
gtgaggtggtacaatattaact

SEQ ID NO: 31767 - DNA, 22 bp, Homo sapiens
atggtgtttataggcaaagatc

SEQ ID NO: 31768 - DNA, 22 bp, Homo sapiens
aggagggagcttaagccaggca

SEQ ID NO: 31769 - DNA, 22 bp, Homo sapiens
caagctgaacactgtcttcaag

SEQ ID NO: 31770 - DNA, 22 bp, Homo sapiens
aactagaaaaagactttctgag

SEQ ID NO: 31771 - DNA, 22 bp, Homo sapiens
cctccccacagcccaggagact

SEQ ID NO: 31772 - DNA, 22 bp, Homo sapiens
aatgccttggagagcctagagg

SEQ ID NO: 31773 - DNA, 23 bp, Homo sapiens
aggatgtaggatgtatggcagag

SEQ ID NO: 31774 - DNA, 22 bp, Homo sapiens
tgagcaggcgcagcaggaggtc

SEQ ID NO: 31775 - DNA, 22 bp, Homo sapiens
aggacaaaggaccagatctgga

SEQ ID NO: 31776 - DNA, 22 bp, Homo sapiens
ctgctcttcacactacacccgt

SEQ ID NO: 31777 - DNA, 22 bp, Homo sapiens
tcctgcagctgataaatacagt

SEQ ID NO: 31778 - DNA, 22 bp, Homo sapiens
cccagggaggcccaggctctgc

SEQ ID NO: 31779 - DNA, 22 bp, Homo sapiens
caaagctggaaaaggaggctgg

SEQ ID NO: 31780 - DNA, 22 bp, Homo sapiens
tcctttgcttctgtcattctcc

SEQ ID NO: 31781 - DNA, 22 bp, Homo sapiens
gcagagccatgggaggtttttg

SEQ ID NO: 31782 - DNA, 22 bp, Homo sapiens
cctggcaggtggcgccctcggc

SEQ ID NO: 31783 - DNA, 22 bp, Homo sapiens
agaacagaggccttatgtttca

SEQ ID NO: 31784 - DNA, 22 bp, Homo sapiens
gcttccacctactaaatgccac

SEQ ID NO: 31785 - DNA, 22 bp, Homo sapiens
tacgcgaagaaggacctgatgg

SEQ ID NO: 31786 - DNA, 22 bp, Homo sapiens
acagtgcttagcacagagtaga

SEQ ID NO: 31787 - DNA, 22 bp, Homo sapiens
ttggatccatctcaggcatagg

SEQ ID NO: 31788 - DNA, 22 bp, Homo sapiens
catttacatttaaggttaatat

SEQ ID NO: 31789 - DNA, 22 bp, Homo sapiens
tccaaatgagctctgccttcca

SEQ ID NO: 31790 - DNA, 22 bp, Homo sapiens
tgagatgtaaggtatgcttact

SEQ ID NO: 31791 - DNA, 22 bp, Homo sapiens
tgacagaggagctggaatgatt

SEQ ID NO: 31792 - DNA, 22 bp, Homo sapiens
tagggtacatgtgcacaacatg

SEQ ID NO: 31793 - DNA, 22 bp, Homo sapiens
caggctggagtgcagtggcgct

SEQ ID NO: 31794 - DNA, 22 bp, Homo sapiens
actgttttctgtaaagggccag

SEQ ID NO: 31795 - DNA, 22 bp, Homo sapiens
gcctccggagttgcagtgtctt

SEQ ID NO: 31796 - DNA, 23 bp, Homo sapiens
tatgaactgcattgctggtgtgt

SEQ ID NO: 31797 - DNA, 22 bp, Homo sapiens
ggggacctgggcttcaagggtt

SEQ ID NO: 31798 - DNA, 22 bp, Homo sapiens
ttatttaatgtgatctgaagag

SEQ ID NO: 31799 - DNA, 22 bp, Homo sapiens
actgccaatggtagtttgatgg

SEQ ID NO: 31800 - DNA, 22 bp, Homo sapiens
atttttctctttccactgagat

SEQ ID NO: 31801 - DNA, 22 bp, Homo sapiens
ttattaggaactcaggattttt

SEQ ID NO: 31802 - DNA, 22 bp, Homo sapiens
acaaacagagttgaaaaatagg

SEQ ID NO: 31803 - DNA, 22 bp, Homo sapiens
ttatttaaaagtggtaagattc

SEQ ID NO: 31804 - DNA, 22 bp, Homo sapiens
ggggtactggctggagccccac

SEQ ID NO: 31805 - DNA, 22 bp, Homo sapiens
agcgtgaattagttggtacaca

SEQ ID NO: 31806 - DNA, 22 bp, Homo sapiens
gacccggctccaggcccagcag

SEQ ID NO: 31807 - DNA, 22 bp, Homo sapiens
gcttggccagcagccgggatgc

SEQ ID NO: 31808 - DNA, 22 bp, Homo sapiens
tggatctcggcaatgcgggact

SEQ ID NO: 31809 - DNA, 22 bp, Homo sapiens
ggtaccaccaattcagctgcca

SEQ ID NO: 31810 - DNA, 22 bp, Homo sapiens
gcttaattctggctcagtttcc

SEQ ID NO: 31811 - DNA, 22 bp, Homo sapiens
aagccctggacggcccttcccc

SEQ ID NO: 31812 - DNA, 22 bp, Homo sapiens
gagagtctaggaacctcatata

SEQ ID NO: 31813 - DNA, 22 bp, Homo sapiens
aacctcaaactcttgggcttaa

SEQ ID NO: 31814 - DNA, 22 bp, Homo sapiens
gagctgaaggagaaagcagggg

SEQ ID NO: 31815 - DNA, 22 bp, Homo sapiens
ataaaatttgctactgttaaat

SEQ ID NO: 31816 - DNA, 22 bp, Homo sapiens
tgctgagcgcatccggcggccg

SEQ ID NO: 31817 - DNA, 22 bp, Homo sapiens
agccagggtctctcgctctgtt

SEQ ID NO: 31818 - DNA, 22 bp, Homo sapiens
acagattcactgcactggccat

SEQ ID NO: 31819 - DNA, 22 bp, Homo sapiens
gagcagtaggagaaccctgagc

SEQ ID NO: 31820 - DNA, 22 bp, Homo sapiens
tccagggagagccgctgctcca

SEQ ID NO: 31821 - DNA, 22 bp, Homo sapiens
gggcggatcacctgaggtcagg

SEQ ID NO: 31822 - DNA, 20 bp, Homo sapiens
aggaaaaatggaaactggag

SEQ ID NO: 31823 - DNA, 22 bp, Homo sapiens
gcaccgccttggaccgcccgct

SEQ ID NO: 31824 - DNA, 22 bp, Homo sapiens
catagcggtattccacgtggtt

SEQ ID NO: 31825 - DNA, 22 bp, Homo sapiens
atgcacctgaactccatcagct

SEQ ID NO: 31826 - DNA, 22 bp, Homo sapiens
tctgttgactcctagcagccat

SEQ ID NO: 31827 - DNA, 22 bp, Homo sapiens
ttgtaagtcacaccagggcagg

SEQ ID NO: 31828 - DNA, 23 bp, Homo sapiens
gttttacaggtgagaaaatggag

SEQ ID NO: 31829 - DNA, 22 bp, Homo sapiens
ctagcctgggatttgaacttat

SEQ ID NO: 31830 - DNA, 22 bp, Homo sapiens
tgtgttcagaatttgctgcttt

SEQ ID NO: 31831 - DNA, 22 bp, Homo sapiens
attaggtcatggggaggcccta

SEQ ID NO: 31832 - DNA, 22 bp, Homo sapiens
gtggtgtttgagctgccaggga

SEQ ID NO: 31833 - DNA, 22 bp, Homo sapiens
aacccaggagatggaggttgtg

SEQ ID NO: 31834 - DNA, 22 bp, Homo sapiens
ctattgtttctatgctctgagg

SEQ ID NO: 31835 - DNA, 22 bp, Homo sapiens
aaaaaattatcatagttcctga

SEQ ID NO: 31836 - DNA, 22 bp, Homo sapiens
aaagaaggtagggctggtgact

SEQ ID NO: 31837 - DNA, 19 bp, Homo sapiens
agagtattgaatttgccct

SEQ ID NO: 31838 - DNA, 22 bp, Homo sapiens
gcagcctcaaactccccagctc

SEQ ID NO: 31839 - DNA, 22 bp, Homo sapiens
ggtgttcaaatgaacacatgca

SEQ ID NO: 31840 - DNA, 21 bp, Homo sapiens
aggcttggatctagacaggcc

SEQ ID NO: 31841 - DNA, 20 bp, Homo sapiens
tgcagcacgggccctttcca

SEQ ID NO: 31842 - DNA, 22 bp, Homo sapiens
tctacctggagtccgttgttaa

SEQ ID NO: 31843 - DNA, 22 bp, Homo sapiens
ttgtgagtagtgccgcaataaa

SEQ ID NO: 31844 - DNA, 22 bp, Homo sapiens
ttatttttaaaagttcacacag

SEQ ID NO: 31845 - DNA, 22 bp, Homo sapiens
gccagccagaaacgtcacactg

SEQ ID NO: 31846 - DNA, 22 bp, Homo sapiens
gcctccggagtcacagtgtctt

SEQ ID NO: 31847 - DNA, 22 bp, Homo sapiens
cactgcactccagcctgggaga

SEQ ID NO: 31848 - DNA, 22 bp, Homo sapiens
tgagccaggagtttgaggctgt

SEQ ID NO: 31849 - DNA, 22 bp, Homo sapiens
tgggcgacagagcaagactccg

SEQ ID NO: 31850 - DNA, 22 bp, Homo sapiens
cactccagcctcagtgacagag

SEQ ID NO: 31851 - DNA, 22 bp, Homo sapiens
tgctcccaaacctgacaggctc

SEQ ID NO: 31852 - DNA, 22 bp, Homo sapiens
cttaatctcacctgcaaagtcc

SEQ ID NO: 31853 - DNA, 22 bp, Homo sapiens
gaagcctcaacatctctgcgtc

SEQ ID NO: 31854 - DNA, 22 bp, Homo sapiens
ctcattgcaacctccgcctccc

SEQ ID NO: 31855 - DNA, 22 bp, Homo sapiens
aacccaggagccggaggttgtg

SEQ ID NO: 31856 - DNA, 22 bp, Homo sapiens
tttctttatcatagcatctttg

SEQ ID NO: 31857 - DNA, 22 bp, Homo sapiens
tatttcttttcgtgacttattg

SEQ ID NO: 31858 - DNA, 22 bp, Homo sapiens
cacccaggctggagagcagtgg

SEQ ID NO: 31859 - DNA, 22 bp, Homo sapiens
aggccaggaatccttgtcccag

SEQ ID NO: 31860 - DNA, 20 bp, Homo sapiens
tttgagaccagtctgcccaa

SEQ ID NO: 31861 - DNA, 22 bp, Homo sapiens
tcttcctgtcaatgagaattaa

SEQ ID NO: 31862 - DNA, 22 bp, Homo sapiens
tagcagtgtctaggtaggccat

SEQ ID NO: 31863 - DNA, 22 bp, Homo sapiens
agttgcagacgcagagatgttg

SEQ ID NO: 31864 - DNA, 22 bp, Homo sapiens
ggtgacggggcccaggtttcct

SEQ ID NO: 31865 - DNA, 22 bp, Homo sapiens
aagcgccatggttcctgcgcag

SEQ ID NO: 31866 - DNA, 22 bp, Homo sapiens
tgagtgaccagaagtccccctc

SEQ ID NO: 31867 - DNA, 22 bp, Homo sapiens
ttcctggcttgtcacatctacg

SEQ ID NO: 31868 - DNA, 22 bp, Homo sapiens
ccagggatgcagaggttgcagt

SEQ ID NO: 31869 - DNA, 22 bp, Homo sapiens
cgccccggacgtctgaccaaac

SEQ ID NO: 31870 - DNA, 22 bp, Homo sapiens
ccaggagttggaggttgcagtg

SEQ ID NO: 31871 - DNA, 22 bp, Homo sapiens
gcgggccaccttggagagcgct

SEQ ID NO: 31872 - DNA, 22 bp, Homo sapiens
agcccggcttccccggttgcta

SEQ ID NO: 31873 - DNA, 22 bp, Homo sapiens
ctccaggctcgtccaagatcga

SEQ ID NO: 31874 - DNA, 22 bp, Homo sapiens
cccgagtgtctactcactccca

SEQ ID NO: 31875 - DNA, 22 bp, Homo sapiens
gtaatctcagctacttgggagg

SEQ ID NO: 31876 - DNA, 22 bp, Homo sapiens
atattacacacggtatcacggg

SEQ ID NO: 31877 - DNA, 22 bp, Homo sapiens
aagtcgtggcaggcttgcacga

SEQ ID NO: 31878 - DNA, 22 bp, Homo sapiens
ctgaggaggctaatttgaggat

SEQ ID NO: 31879 - DNA, 22 bp, Homo sapiens
ggctccaccctgcttccagaag

SEQ ID NO: 31880 - DNA, 22 bp, Homo sapiens
ttgagggtctggatctgctgct

SEQ ID NO: 31881 - DNA, 22 bp, Homo sapiens
ggcaaggggtcaggctgagaca

SEQ ID NO: 31882 - DNA, 22 bp, Homo sapiens
gcaaatacatgttgagcaccta

SEQ ID NO: 31883 - DNA, 22 bp, Homo sapiens
tccagtgtttttcttcacaggt

SEQ ID NO: 31884 - DNA, 22 bp, Homo sapiens
cacttgttggtggtgaaatcac

SEQ ID NO: 31885 - DNA, 22 bp, Homo sapiens
ggcagcactgcagcttgttggg

SEQ ID NO: 31886 - DNA, 22 bp, Homo sapiens
agggcgacaatggagagcgttt

SEQ ID NO: 31887 - DNA, 22 bp, Homo sapiens
actagaaagaagttttttgaga

SEQ ID NO: 31888 - DNA, 22 bp, Homo sapiens
atacttctttagcatattgaac

SEQ ID NO: 31889 - DNA, 22 bp, Homo sapiens
agaggaggctctgggatcgtcc

SEQ ID NO: 31890 - DNA, 22 bp, Homo sapiens
gccatcatatcccctgtgacct

SEQ ID NO: 31891 - DNA, 22 bp, Homo sapiens
tgggaggccgaggcaggtggat

SEQ ID NO: 31892 - DNA, 22 bp, Homo sapiens
gcctacatttcccagttgaatg

SEQ ID NO: 31893 - DNA, 22 bp, Homo sapiens
tttaaaaaactagtctgagtct

SEQ ID NO: 31894 - DNA, 22 bp, Homo sapiens
gtcttaagaatgaatgctgaga

SEQ ID NO: 31895 - DNA, 22 bp, Homo sapiens
cgtgccactgcactccagtctg

SEQ ID NO: 31896 - DNA, 22 bp, Homo sapiens
aagatattcaaagatttattag

SEQ ID NO: 31897 - DNA, 22 bp, Homo sapiens
cctgacaggcggaggctgcagt

SEQ ID NO: 31898 - DNA, 22 bp, Homo sapiens
atgttctacagatggaaagggg

SEQ ID NO: 31899 - DNA, 22 bp, Homo sapiens
ccatgaattcactccatgctag

SEQ ID NO: 31900 - DNA, 22 bp, Homo sapiens
atatatttgagaatattcatga

SEQ ID NO: 31901 - DNA, 22 bp, Homo sapiens
aagggggcggcagccagtggaa

SEQ ID NO: 31902 - DNA, 22 bp, Homo sapiens
gattgtggaagtcagtggttct

SEQ ID NO: 31903 - DNA, 22 bp, Homo sapiens
tggtacaatcacagctcactgt

SEQ ID NO: 31904 - DNA, 22 bp, Homo sapiens
taatttcagtgcaagctcacgg

SEQ ID NO: 31905 - DNA, 21 bp, Homo sapiens
tctgccagctgaagaggtgga

SEQ ID NO: 31906 - DNA, 22 bp, Homo sapiens
gtctttatttgagattgtcatt

SEQ ID NO: 31907 - DNA, 22 bp, Homo sapiens
tttgcttgttcaagatttctgt

SEQ ID NO: 31908 - DNA, 22 bp, Homo sapiens
tttagggacaagggtctggggt

SEQ ID NO: 31909 - DNA, 22 bp, Homo sapiens
tgctcattggcgatctgaggga

SEQ ID NO: 31910 - DNA, 22 bp, Homo sapiens
tttattctgtgctacatgaaga

SEQ ID NO: 31911 - DNA, 22 bp, Homo sapiens
ttccatacgactgaggtctcgg

SEQ ID NO: 31912 - DNA, 22 bp, Homo sapiens
gcttttacaagagccagagagg

SEQ ID NO: 31913 - DNA, 22 bp, Homo sapiens
tacttttagcctatttgattct

SEQ ID NO: 31914 - DNA, 22 bp, Homo sapiens
cccagaaggtcgaggctgcagt

SEQ ID NO: 31915 - DNA, 22 bp, Homo sapiens
tcctagttctctgccagtcgct

SEQ ID NO: 31916 - DNA, 22 bp, Homo sapiens
ggaagaaaggtggacaacaggt

SEQ ID NO: 31917 - DNA, 22 bp, Homo sapiens
cctagatgggatggcggccggg

SEQ ID NO: 31918 - DNA, 22 bp, Homo sapiens
catggcggtcaggatgtaggtg

SEQ ID NO: 31919 - DNA, 22 bp, Homo sapiens
tgcctgatgcaggagtatcaga

SEQ ID NO: 31920 - DNA, 22 bp, Homo sapiens
cactgcactccagcctgggtga

SEQ ID NO: 31921 - DNA, 22 bp, Homo sapiens
gttgctcaggcaggagtacagt

SEQ ID NO: 31922 - DNA, 22 bp, Homo sapiens
tatccaattcaccattgatggg

SEQ ID NO: 31923 - DNA, 18 bp, Homo sapiens
cttgttcttctcttggcg

SEQ ID NO: 31924 - DNA, 22 bp, Homo sapiens
agaaatatgctgattagatgaa

SEQ ID NO: 31925 - DNA, 22 bp, Homo sapiens
tgggactcactcttttggccag

SEQ ID NO: 31926 - DNA, 22 bp, Homo sapiens
cagagactggagtgcagtggcg

SEQ ID NO: 31927 - DNA, 22 bp, Homo sapiens
caggctggagtgcagtggggcg

SEQ ID NO: 31928 - DNA, 22 bp, Homo sapiens
tagcgaggtgtttctaggactg

SEQ ID NO: 31929 - DNA, 22 bp, Homo sapiens
ctgcagggagaggggacagcct

SEQ ID NO: 31930 - DNA, 22 bp, Homo sapiens
ctgctcttgagggactgcggtc

SEQ ID NO: 31931 - DNA, 22 bp, Homo sapiens
agctcctgaaaatccagactgg

SEQ ID NO: 31932 - DNA, 21 bp, Homo sapiens
agtttcaggaagttcagctgc

SEQ ID NO: 31933 - DNA, 22 bp, Homo sapiens
taaatacttagttttgtgtcta

SEQ ID NO: 31934 - DNA, 22 bp, Homo sapiens
aaggagaaatggtagatgtgca

SEQ ID NO: 31935 - DNA, 22 bp, Homo sapiens
caggaggttgagggtgcagtga

SEQ ID NO: 31936 - DNA, 23 bp, Homo sapiens
aggaaagcattcatttttaccat

SEQ ID NO: 31937 - DNA, 22 bp, Homo sapiens
tgcagattcaaatgaaatgcaa

SEQ ID NO: 31938 - DNA, 22 bp, Homo sapiens
cccaggctggagtgtaatggtg

SEQ ID NO: 31939 - DNA, 22 bp, Homo sapiens
aaagaaatagatggcatttaaa

SEQ ID NO: 31940 - DNA, 22 bp, Homo sapiens
gtgctccctccttcctcaagga

SEQ ID NO: 31941 - DNA, 22 bp, Homo sapiens
aaagcctcccaggttatgagta

SEQ ID NO: 31942 - DNA, 23 bp, Homo sapiens
tgaggcaggcggatcacgaggtc

SEQ ID NO: 31943 - DNA, 22 bp, Homo sapiens
tctgacattagattaattggaa

SEQ ID NO: 31944 - DNA, 22 bp, Homo sapiens
cttctttcaagaatggattagg

SEQ ID NO: 31945 - DNA, 22 bp, Homo sapiens
aaaagcaattgcgggttttgcc

SEQ ID NO: 31946 - DNA, 22 bp, Homo sapiens
tcgcaccattgcactccagcca

SEQ ID NO: 31947 - DNA, 22 bp, Homo sapiens
cccaggaggcctgcctggccgg

SEQ ID NO: 31948 - DNA, 22 bp, Homo sapiens
tgcctaggctggagtgtagtgg

SEQ ID NO: 31949 - DNA, 22 bp, Homo sapiens
aacccaggaggcggaggttgtg

SEQ ID NO: 31950 - DNA, 22 bp, Homo sapiens
agcctgcgatcccacctggcct

SEQ ID NO: 31951 - DNA, 22 bp, Homo sapiens
tccgggaggcagaggttgcagt

SEQ ID NO: 31952 - DNA, 22 bp, Homo sapiens
agatttggtgtctggttgatat

SEQ ID NO: 31953 - DNA, 22 bp, Homo sapiens
tcataaattctggtgctgtgag

SEQ ID NO: 31954 - DNA, 22 bp, Homo sapiens
actttatttcctattgcatcca

SEQ ID NO: 31955 - DNA, 22 bp, Homo sapiens
ctggtagtttgcaaaatggtgt

SEQ ID NO: 31956 - DNA, 22 bp, Homo sapiens
gcccagtagttcaaggttgcag

SEQ ID NO: 31957 - DNA, 22 bp, Homo sapiens
cactgcactccatcctgggaaa

SEQ ID NO: 31958 - DNA, 22 bp, Homo sapiens
aggtgcttggctcgtgcacaca

SEQ ID NO: 31959 - DNA, 19 bp, Homo sapiens
atgtacccagtgtcaatcc

SEQ ID NO: 31960 - DNA, 22 bp, Homo sapiens
actgttgaagtgccagcttgat

SEQ ID NO: 31961 - DNA, 22 bp, Homo sapiens
cgaggaggaaacgcggagaact

SEQ ID NO: 31962 - DNA, 22 bp, Homo sapiens
acccagggctcaagcgtaggca

SEQ ID NO: 31963 - DNA, 22 bp, Homo sapiens
tcctcagtcacggtagcacatt

SEQ ID NO: 31964 - DNA, 22 bp, Homo sapiens
ctgctaaacctctctgagagct

SEQ ID NO: 31965 - DNA, 18 bp, Homo sapiens
actctgcggaggccccag

SEQ ID NO: 31966 - DNA, 22 bp, Homo sapiens
tcattccctcattgttcactgg

SEQ ID NO: 31967 - DNA, 21 bp, Homo sapiens
gctcctggtgctgcgtggcgc

SEQ ID NO: 31968 - DNA, 22 bp, Homo sapiens
cactgcactccagcccgggcaa

SEQ ID NO: 31969 - DNA, 22 bp, Homo sapiens
tgagtgaggctgggcagtccct

SEQ ID NO: 31970 - DNA, 22 bp, Homo sapiens
tgaaatgattatatggtgtttg

SEQ ID NO: 31971 - DNA, 22 bp, Homo sapiens
agcgccactgcactccagcctg

SEQ ID NO: 31972 - DNA, 22 bp, Homo sapiens
agaggccggccgagcccatggg

SEQ ID NO: 31973 - DNA, 22 bp, Homo sapiens
agtccggggtctggacacctgg

SEQ ID NO: 31974 - DNA, 22 bp, Homo sapiens
tggggtcccaactctgattgat

SEQ ID NO: 31975 - DNA, 22 bp, Homo sapiens
ggcaagagggcagatggagtgc

SEQ ID NO: 31976 - DNA, 22 bp, Homo sapiens
agggccagcactcctggcagga

SEQ ID NO: 31977 - DNA, 22 bp, Homo sapiens
cactgcactccagcctgggtca

SEQ ID NO: 31978 - DNA, 22 bp, Homo sapiens
ggcctttgcgtccacgccgctt

SEQ ID NO: 31979 - DNA, 22 bp, Homo sapiens
cccagagcatgtgctgcctttg

SEQ ID NO: 31980 - DNA, 22 bp, Homo sapiens
tgtttgagttctagcgcattta

SEQ ID NO: 31981 - DNA, 22 bp, Homo sapiens
gacaagctcccggtggccctcc

SEQ ID NO: 31982 - DNA, 23 bp, Homo sapiens
ctcaccaagcgccgccgctgtgt

SEQ ID NO: 31983 - DNA, 22 bp, Homo sapiens
gcgcaccacctccaggtggccg

SEQ ID NO: 31984 - DNA, 22 bp, Homo sapiens
ctggagggctgcagcgaggctg

SEQ ID NO: 31985 - DNA, 18 bp, Homo sapiens
gcctgagggtcaagtgtg

SEQ ID NO: 31986 - DNA, 22 bp, Homo sapiens
ggttcccggatctccgagtccc

SEQ ID NO: 31987 - DNA, 22 bp, Homo sapiens
gaaaattattgaaaatggctct

SEQ ID NO: 31988 - DNA, 22 bp, Homo sapiens
gaattcttttctttctgaaagt

SEQ ID NO: 31989 - DNA, 22 bp, Homo sapiens
tccaccctgcttttgtctttga

SEQ ID NO: 31990 - DNA, 22 bp, Homo sapiens
atacacgtgccatgttggtgtg

SEQ ID NO: 31991 - DNA, 22 bp, Homo sapiens
tagctcaaaggttaagtgtgga

SEQ ID NO: 31992 - DNA, 22 bp, Homo sapiens
taggtttactgaattagtggaa

SEQ ID NO: 31993 - DNA, 22 bp, Homo sapiens
tctaattttggcattttaacct

SEQ ID NO: 31994 - DNA, 22 bp, Homo sapiens
tgtcttcgctacaatgaaaagg

SEQ ID NO: 31995 - DNA, 23 bp, Homo sapiens
aggttatgattatagagcgagga

SEQ ID NO: 31996 - DNA, 22 bp, Homo sapiens
gggaggcagtgctggaggctgg

SEQ ID NO: 31997 - DNA, 22 bp, Homo sapiens
gtcaggactctgacccgtcccg

SEQ ID NO: 31998 - DNA, 22 bp, Homo sapiens
tgggaggccaaggcaggcggat

SEQ ID NO: 31999 - DNA, 22 bp, Homo sapiens
aggcaggaaaatcgcttgaacc

SEQ ID NO: 32000 - DNA, 22 bp, Homo sapiens
aagtgatgctacgactttgaca

SEQ ID NO: 32001 - DNA, 22 bp, Homo sapiens
gaatttcctctaaacccctgag

SEQ ID NO: 32002 - DNA, 22 bp, Homo sapiens
tggaatggaaacaaactgagga

SEQ ID NO: 32003 - DNA, 23 bp, Homo sapiens
cgcccagcctcagtgacctgggc

SEQ ID NO: 32004 - DNA, 22 bp, Homo sapiens
ctgagcctcctgcttctatttc

SEQ ID NO: 32005 - DNA, 22 bp, Homo sapiens
tcctggcaaagatgttggtgtt

SEQ ID NO: 32006 - DNA, 22 bp, Homo sapiens
caggcagggagctggaaaggat

SEQ ID NO: 32007 - DNA, 22 bp, Homo sapiens
atgtcactgttgttattgttat

SEQ ID NO: 32008 - DNA, 22 bp, Homo sapiens
tttaagaagttatgttataaat

SEQ ID NO: 32009 - DNA, 22 bp, Homo sapiens
ttaccaaatgaaatagagattt

SEQ ID NO: 32010 - DNA, 22 bp, Homo sapiens
accactgcccatggtgaaaact

SEQ ID NO: 32011 - DNA, 22 bp, Homo sapiens
tgctgtgaggttgagaaggaag

SEQ ID NO: 32012 - DNA, 22 bp, Homo sapiens
agagcacagccaccatttacaa

SEQ ID NO: 32013 - DNA, 22 bp, Homo sapiens
tccgccaggactgagggcccat

SEQ ID NO: 32014 - DNA, 22 bp, Homo sapiens
ttctcccatctcagtcttacat

SEQ ID NO: 32015 - DNA, 22 bp, Homo sapiens
agctcttacatttaggtctatg

SEQ ID NO: 32016 - DNA, 22 bp, Homo sapiens
tcatcagggatattggcctgaa

SEQ ID NO: 32017 - DNA, 22 bp, Homo sapiens
atatacacatctttttaaatat

SEQ ID NO: 32018 - DNA, 22 bp, Homo sapiens
ggcagacctctccagccccaca

SEQ ID NO: 32019 - DNA, 22 bp, Homo sapiens
aacccaggaggcagatgttgtg

SEQ ID NO: 32020 - DNA, 20 bp, Homo sapiens
agcagagtgcccatcccgga

SEQ ID NO: 32021 - DNA, 22 bp, Homo sapiens
ttaaattttagaaacagactct

SEQ ID NO: 32022 - DNA, 22 bp, Homo sapiens
tgaagctttaggatgggttcat

SEQ ID NO: 32023 - DNA, 22 bp, Homo sapiens
tcatggcttttattatgttgag

SEQ ID NO: 32024 - DNA, 22 bp, Homo sapiens
tcgccatggaagtccttgcgga

SEQ ID NO: 32025 - DNA, 22 bp, Homo sapiens
ccacgacgagtcatcagggcga

SEQ ID NO: 32026 - DNA, 22 bp, Homo sapiens
cccagcaggtcggtgctgcctg

SEQ ID NO: 32027 - DNA, 22 bp, Homo sapiens
ttatgggagcaattggggaggt

SEQ ID NO: 32028 - DNA, 22 bp, Homo sapiens
ccaggctggagtgcagtggcac

SEQ ID NO: 32029 - DNA, 22 bp, Homo sapiens
tttgaaatgtatcagtataggt

SEQ ID NO: 32030 - DNA, 22 bp, Homo sapiens
ggctgagttgagaggattactt

SEQ ID NO: 32031 - DNA, 22 bp, Homo sapiens
atgcccaatgtcacaatttttg

SEQ ID NO: 32032 - DNA, 22 bp, Homo sapiens
aagtcattggtagcttgatagg

SEQ ID NO: 32033 - DNA, 22 bp, Homo sapiens
ggggtgggcgtgcagggacacc

SEQ ID NO: 32034 - DNA, 22 bp, Homo sapiens
tgccatagcaatggtaagctga

SEQ ID NO: 32035 - DNA, 22 bp, Homo sapiens
ttcccacattctttacattcat

SEQ ID NO: 32036 - DNA, 22 bp, Homo sapiens
taagcctgcatgaaccatgaga

SEQ ID NO: 32037 - DNA, 22 bp, Homo sapiens
cttctcggccgtgtggatgcgc

SEQ ID NO: 32038 - DNA, 21 bp, Homo sapiens
tgaaggggtggcagtgtgctt

SEQ ID NO: 32039 - DNA, 19 bp, Homo sapiens
ggcttcgaggctggggaag

SEQ ID NO: 32040 - DNA, 22 bp, Homo sapiens
gggtaggcaaagcaatgacgtt

SEQ ID NO: 32041 - DNA, 22 bp, Homo sapiens
ccagctttatagcttcaaagga

SEQ ID NO: 32042 - DNA, 22 bp, Homo sapiens
ttcctggtctatttagaattgc

SEQ ID NO: 32043 - DNA, 22 bp, Homo sapiens
cacagctgaagtagccatgtgg

SEQ ID NO: 32044 - DNA, 22 bp, Homo sapiens
gactggaaagcctgtcctcaga

SEQ ID NO: 32045 - DNA, 22 bp, Homo sapiens
agtgaaaacctaatcatgcagt

SEQ ID NO: 32046 - DNA, 22 bp, Homo sapiens
ggctttgacatgctgaattaaa

SEQ ID NO: 32047 - DNA, 20 bp, Homo sapiens
aaattactgccacacatttc

SEQ ID NO: 32048 - DNA, 22 bp, Homo sapiens
ccaagctacttaggagtctgag

SEQ ID NO: 32049 - DNA, 22 bp, Homo sapiens
ttcaggcccagcacagcgcgtg

SEQ ID NO: 32050 - DNA, 22 bp, Homo sapiens
ggggcaggagcccttcttcagc

SEQ ID NO: 32051 - DNA, 22 bp, Homo sapiens
atacctgtgtatccacaagcgt

SEQ ID NO: 32052 - DNA, 22 bp, Homo sapiens
atgaattgaggaaaacagtcgt

SEQ ID NO: 32053 - DNA, 22 bp, Homo sapiens
tgtctggtgggttgacaggcag

SEQ ID NO: 32054 - DNA, 22 bp, Homo sapiens
aatttgttataacttgggctga

SEQ ID NO: 32055 - DNA, 22 bp, Homo sapiens
aatggcactttataaatgttaa

SEQ ID NO: 32056 - DNA, 22 bp, Homo sapiens
ctggctgggagcgagctgctca

SEQ ID NO: 32057 - DNA, 22 bp, Homo sapiens
cttgcctttgtcttcaaaggct

SEQ ID NO: 32058 - DNA, 22 bp, Homo sapiens
ggacctgaacataaaacgaggc

SEQ ID NO: 32059 - DNA, 22 bp, Homo sapiens
acaattctgatggtttcccagt

SEQ ID NO: 32060 - DNA, 22 bp, Homo sapiens
taggtataggattctaggttgg

SEQ ID NO: 32061 - DNA, 22 bp, Homo sapiens
tgagtccgaagttgcagtgagc

SEQ ID NO: 32062 - DNA, 22 bp, Homo sapiens
cccagttgttgccggctctgga

SEQ ID NO: 32063 - DNA, 22 bp, Homo sapiens
tggcctcggcatccagcaagag

SEQ ID NO: 32064 - DNA, 22 bp, Homo sapiens
tacagtgcttggtatctagtaa

SEQ ID NO: 32065 - DNA, 22 bp, Homo sapiens
aaaaatcacttttataggcagc

SEQ ID NO: 32066 - DNA, 22 bp, Homo sapiens
catataaatacaacatgtgtta

SEQ ID NO: 32067 - DNA, 22 bp, Homo sapiens
accctaataatcacagactagt

SEQ ID NO: 32068 - DNA, 17 bp, Homo sapiens
gtaaggcttgcagatgc

SEQ ID NO: 32069 - DNA, 22 bp, Homo sapiens
ccaggcaggcgatggtgcagtg

SEQ ID NO: 32070 - DNA, 22 bp, Homo sapiens
tccctgatgccttgatccgtgg

SEQ ID NO: 32071 - DNA, 22 bp, Homo sapiens
actttaaaactgatcatcagag

SEQ ID NO: 32072 - DNA, 22 bp, Homo sapiens
aacccaggaggtggaggttgtg

SEQ ID NO: 32073 - DNA, 22 bp, Homo sapiens
gtcactgtatccaggttccagc

SEQ ID NO: 32074 - DNA, 22 bp, Homo sapiens
ctttaattgtagctcccataat

SEQ ID NO: 32075 - DNA, 22 bp, Homo sapiens
aagaataagaggatttagaaca

SEQ ID NO: 32076 - DNA, 20 bp, Homo sapiens
atcggcttgcctggaaacaa

SEQ ID NO: 32077 - DNA, 22 bp, Homo sapiens
gttaggtagaagtttactttga

SEQ ID NO: 32078 - DNA, 17 bp, Homo sapiens
ttcttttctgagccttg

SEQ ID NO: 32079 - DNA, 22 bp, Homo sapiens
ttttggccacatccttttgagt

SEQ ID NO: 32080 - DNA, 22 bp, Homo sapiens
gttgaggtgatgccagccctgc

SEQ ID NO: 32081 - DNA, 22 bp, Homo sapiens
gctgtgtatcagatgccacggg

SEQ ID NO: 32082 - DNA, 22 bp, Homo sapiens
gtcttagatttcaccgataatg

SEQ ID NO: 32083 - DNA, 21 bp, Homo sapiens
tcacgtggtcacatgagcttt

SEQ ID NO: 32084 - DNA, 22 bp, Homo sapiens
agcattccacactgaagtctgc

SEQ ID NO: 32085 - DNA, 22 bp, Homo sapiens
ctgaccaacatggtgaaacctt

SEQ ID NO: 32086 - DNA, 22 bp, Homo sapiens
cgcaccactgaattccagcctg

SEQ ID NO: 32087 - DNA, 22 bp, Homo sapiens
attggtagttttgtatttctct

SEQ ID NO: 32088 - DNA, 22 bp, Homo sapiens
tgctggtaccgcgcctccgcca

SEQ ID NO: 32089 - DNA, 22 bp, Homo sapiens
ctcaggagttggaggctacagt

SEQ ID NO: 32090 - DNA, 22 bp, Homo sapiens
tagggaccttagaattgtatgt

SEQ ID NO: 32091 - DNA, 22 bp, Homo sapiens
ttcccttaaattatggcatcta

SEQ ID NO: 32092 - DNA, 21 bp, Homo sapiens
tcgtgcagcagctgaggcttg

SEQ ID NO: 32093 - DNA, 22 bp, Homo sapiens
atacaaaatatatactggagac

SEQ ID NO: 32094 - DNA, 22 bp, Homo sapiens
ttcttctttccaattacatggt

SEQ ID NO: 32095 - DNA, 18 bp, Homo sapiens
ttcggcagatacgcttgg

SEQ ID NO: 32096 - DNA, 22 bp, Homo sapiens
tttattggatatttacaagata

SEQ ID NO: 32097 - DNA, 22 bp, Homo sapiens
ctcattgcccagatccccacag

SEQ ID NO: 32098 - DNA, 22 bp, Homo sapiens
aggaaagcttggcaaactaaat

SEQ ID NO: 32099 - DNA, 22 bp, Homo sapiens
taaaggtagtgtgacatattgt

SEQ ID NO: 32100 - DNA, 22 bp, Homo sapiens
tctcctggtacccttcctagca

SEQ ID NO: 32101 - DNA, 20 bp, Homo sapiens
tcagccattccttacctttc

SEQ ID NO: 32102 - DNA, 22 bp, Homo sapiens
aagggctctgtgcttgtcccat

SEQ ID NO: 32103 - DNA, 22 bp, Homo sapiens
cattgcaacttcaaactcctgg

SEQ ID NO: 32104 - DNA, 22 bp, Homo sapiens
ggctcacgcaattatcccggcc

SEQ ID NO: 32105 - DNA, 22 bp, Homo sapiens
gccttgtttcattacacgtggt

SEQ ID NO: 32106 - DNA, 22 bp, Homo sapiens
tttcttaggctctaaaatgact

SEQ ID NO: 32107 - DNA, 21 bp, Homo sapiens
ctctgtttgcctgctgccatc

SEQ ID NO: 32108 - DNA, 22 bp, Homo sapiens
ggaggtggaggttgcagtgagc

SEQ ID NO: 32109 - DNA, 22 bp, Homo sapiens
aaaagcaattgcagttcttgcc

SEQ ID NO: 32110 - DNA, 22 bp, Homo sapiens
cggggccctggggctgaaggtc

SEQ ID NO: 32111 - DNA, 22 bp, Homo sapiens
cgtgccactgcactctagcctg

SEQ ID NO: 32112 - DNA, 20 bp, Homo sapiens
ataaaataactgccacaaga

SEQ ID NO: 32113 - DNA, 22 bp, Homo sapiens
actttcttggtcccatgtttga

SEQ ID NO: 32114 - DNA, 22 bp, Homo sapiens
aggctcccaagcactgacccca

SEQ ID NO: 32115 - DNA, 22 bp, Homo sapiens
ttgagcaggatggctatgcaca

SEQ ID NO: 32116 - DNA, 22 bp, Homo sapiens
tttgcattgcattaagtattct

SEQ ID NO: 32117 - DNA, 22 bp, Homo sapiens
ctccaggccatggctgcggagg

SEQ ID NO: 32118 - DNA, 22 bp, Homo sapiens
atcttgttaaaaagcagattct

SEQ ID NO: 32119 - DNA, 22 bp, Homo sapiens
tacaaaaaattgatactgacga

SEQ ID NO: 32120 - DNA, 22 bp, Homo sapiens
tggctgtgtccctgtccagagt

SEQ ID NO: 32121 - DNA, 22 bp, Homo sapiens
ggggtctcactatgttacccag

SEQ ID NO: 32122 - DNA, 22 bp, Homo sapiens
tggttaagtccagaaaggaagc

SEQ ID NO: 32123 - DNA, 22 bp, Homo sapiens
ctgagatctttatacgaggcac

SEQ ID NO: 32124 - DNA, 22 bp, Homo sapiens
tgaagaaacgcagagaggtagg

SEQ ID NO: 32125 - DNA, 22 bp, Homo sapiens
atacaaaaattagccgggagta

SEQ ID NO: 32126 - DNA, 22 bp, Homo sapiens
tggaaacacccacgcatgcata

SEQ ID NO: 32127 - DNA, 22 bp, Homo sapiens
gagcctcgtggcggccactgcg

SEQ ID NO: 32128 - DNA, 22 bp, Homo sapiens
tgctcgccccacatgccctcat

SEQ ID NO: 32129 - DNA, 22 bp, Homo sapiens
tgagtagagaattcagctaagg

SEQ ID NO: 32130 - DNA, 22 bp, Homo sapiens
acctgcaggcacaggtgtgcgc

SEQ ID NO: 32131 - DNA, 22 bp, Homo sapiens
aatttaagagcatagctccaac

SEQ ID NO: 32132 - DNA, 22 bp, Homo sapiens
ctgtaatcccagctactcggga

SEQ ID NO: 32133 - DNA, 19 bp, Homo sapiens
catggtgaaaccccgtctc

SEQ ID NO: 32134 - DNA, 17 bp, Homo sapiens
ttaaggtggatcagcac

SEQ ID NO: 32135 - DNA, 22 bp, Homo sapiens
tggaaaactttggtggtgaggg

SEQ ID NO: 32136 - DNA, 22 bp, Homo sapiens
tcttgggcatgtgtttgatttc

SEQ ID NO: 32137 - DNA, 22 bp, Homo sapiens
cataaaaggtagcagtttgaaa

SEQ ID NO: 32138 - DNA, 21 bp, Homo sapiens
ccgtgctcggctatggaccac

SEQ ID NO: 32139 - DNA, 22 bp, Homo sapiens
atacatgcgccatgttggtgtg

SEQ ID NO: 32140 - DNA, 22 bp, Homo sapiens
gatttttatataaagtgagaaa

SEQ ID NO: 32141 - DNA, 22 bp, Homo sapiens
gaggcaggcagattgcttgagg

SEQ ID NO: 32142 - DNA, 22 bp, Homo sapiens
cagggtttcaccatgttagcag

SEQ ID NO: 32143 - DNA, 16 bp, Homo sapiens
gcaggcagatcacatg

SEQ ID NO: 32144 - DNA, 22 bp, Homo sapiens
ctacaaaagtaattgtggtttt

SEQ ID NO: 32145 - DNA, 22 bp, Homo sapiens
atcagagtgtaagttctttcct

SEQ ID NO: 32146 - DNA, 22 bp, Homo sapiens
ttttaatactgctattgtagga

SEQ ID NO: 32147 - DNA, 22 bp, Homo sapiens
taaagggtaggttttactgtaa

SEQ ID NO: 32148 - DNA, 22 bp, Homo sapiens
tcgcttgaacccaggaagtgga

SEQ ID NO: 32149 - DNA, 22 bp, Homo sapiens
aacactatctgccttacaggga

SEQ ID NO: 32150 - DNA, 21 bp, Homo sapiens
gtggttctagagaaacagaat

SEQ ID NO: 32151 - DNA, 22 bp, Homo sapiens
gggtttcatggttctcacaatg

SEQ ID NO: 32152 - DNA, 22 bp, Homo sapiens
tcgggctcgctctcctagcgga

SEQ ID NO: 32153 - DNA, 22 bp, Homo sapiens
agagtgtaccaaatatcctaca

SEQ ID NO: 32154 - DNA, 22 bp, Homo sapiens
tgattcatcagaataggagttt

SEQ ID NO: 32155 - DNA, 22 bp, Homo sapiens
ggaggcagaatagagtgtgggt

SEQ ID NO: 32156 - DNA, 22 bp, Homo sapiens
taagaaatttagttatagaatg

SEQ ID NO: 32157 - DNA, 22 bp, Homo sapiens
ggagaagaggagctggaagcct

SEQ ID NO: 32158 - DNA, 22 bp, Homo sapiens
tgtttcttacgtttttagaggc

SEQ ID NO: 32159 - DNA, 22 bp, Homo sapiens
ctatacagcagcttactagtta

SEQ ID NO: 32160 - DNA, 22 bp, Homo sapiens
acgtgcaggatctggttggcga

SEQ ID NO: 32161 - DNA, 22 bp, Homo sapiens
tgggaagggtcaacagctggaa

SEQ ID NO: 32162 - DNA, 22 bp, Homo sapiens
ttgggctcaggagtttgagacc

SEQ ID NO: 32163 - DNA, 22 bp, Homo sapiens
atggcctgcagtgctgccacag

SEQ ID NO: 32164 - DNA, 21 bp, Homo sapiens
tgcaatccagcctgggcgaca

SEQ ID NO: 32165 - DNA, 22 bp, Homo sapiens
ttggaaacgtcaccttttcctt

SEQ ID NO: 32166 - DNA, 17 bp, Homo sapiens
cgggcatggagggcagg

SEQ ID NO: 32167 - DNA, 22 bp, Homo sapiens
atcctagaatcagcccttgctg

SEQ ID NO: 32168 - DNA, 22 bp, Homo sapiens
aacccaggagttggaggctgtg

SEQ ID NO: 32169 - DNA, 22 bp, Homo sapiens
ctcctgagctctgaggaagctt

SEQ ID NO: 32170 - DNA, 22 bp, Homo sapiens
gcgagcctctggagtcctctgg

SEQ ID NO: 32171 - DNA, 22 bp, Homo sapiens
gtgtatgttctacttaatatta

SEQ ID NO: 32172 - DNA, 22 bp, Homo sapiens
acattaaaattgggtggggtaa

SEQ ID NO: 32173 - DNA, 22 bp, Homo sapiens
agctttacctgccttggggcac

SEQ ID NO: 32174 - DNA, 23 bp, Homo sapiens
ctcaaccctagtaagggagtagg

SEQ ID NO: 32175 - DNA, 22 bp, Homo sapiens
ttaataaagtatgaattggaaa

SEQ ID NO: 32176 - DNA, 22 bp, Homo sapiens
cctacagttatattcttgattg

SEQ ID NO: 32177 - DNA, 22 bp, Homo sapiens
tcagggattgcaaaattcatcc

SEQ ID NO: 32178 - DNA, 22 bp, Homo sapiens
cgtcacttcttagtctattttc

SEQ ID NO: 32179 - DNA, 22 bp, Homo sapiens
aaaatcttgtgacttaggaagg

SEQ ID NO: 32180 - DNA, 19 bp, Homo sapiens
agaaccactgctctcttca

SEQ ID NO: 32181 - DNA, 22 bp, Homo sapiens
ggcagggagtggagactcccta

SEQ ID NO: 32182 - DNA, 22 bp, Homo sapiens
tgtttacagctgatcaggcatc

SEQ ID NO: 32183 - DNA, 22 bp, Homo sapiens
cggctcactgcagctccgcctc

SEQ ID NO: 32184 - DNA, 22 bp, Homo sapiens
gaggcaggaggattgcttgagc

SEQ ID NO: 32185 - DNA, 22 bp, Homo sapiens
gagcactgatttatttttgtct

SEQ ID NO: 32186 - DNA, 22 bp, Homo sapiens
gcgagtgccgagagggcagggc

SEQ ID NO: 32187 - DNA, 22 bp, Homo sapiens
gctgcagggagctggaaggctc

SEQ ID NO: 32188 - DNA, 22 bp, Homo sapiens
agatgtgtttctagttcctgca

SEQ ID NO: 32189 - DNA, 22 bp, Homo sapiens
gatagtcacctcccttaacttt

SEQ ID NO: 32190 - DNA, 22 bp, Homo sapiens
cggaggttgaggctgcagtgag

SEQ ID NO: 32191 - DNA, 17 bp, Homo sapiens
cactagtagtctctggc

SEQ ID NO: 32192 - DNA, 22 bp, Homo sapiens
tcttgcacttcatgaatatgtt

SEQ ID NO: 32193 - DNA, 23 bp, Homo sapiens
ggcactcggccgtgaactcgtgc

SEQ ID NO: 32194 - DNA, 22 bp, Homo sapiens
gccggggctggggagagacatg

SEQ ID NO: 32195 - DNA, 22 bp, Homo sapiens
gttacagtcaggagatattttg

SEQ ID NO: 32196 - DNA, 22 bp, Homo sapiens
taggtttaggagtgaaggtgaa

SEQ ID NO: 32197 - DNA, 22 bp, Homo sapiens
ggagaacatatctcccacattg

SEQ ID NO: 32198 - DNA, 22 bp, Homo sapiens
atctggttttggctgtgtccct

SEQ ID NO: 32199 - DNA, 22 bp, Homo sapiens
caggagttcaaggttgcagtga

SEQ ID NO: 32200 - DNA, 22 bp, Homo sapiens
ttgtgctcctgtgagaatctag

SEQ ID NO: 32201 - DNA, 22 bp, Homo sapiens
tgtgtggattcatctcaaagag

SEQ ID NO: 32202 - DNA, 22 bp, Homo sapiens
cactgcactccagcactccagc

SEQ ID NO: 32203 - DNA, 22 bp, Homo sapiens
caggctggagtgcagtggtgcc

SEQ ID NO: 32204 - DNA, 22 bp, Homo sapiens
ggccgtgctccaaagtcatcgt

SEQ ID NO: 32205 - DNA, 22 bp, Homo sapiens
tttggtaagtacccacctgggt

SEQ ID NO: 32206 - DNA, 22 bp, Homo sapiens
tggtatgtaaattgtaactcaa

SEQ ID NO: 32207 - DNA, 23 bp, Homo sapiens
attttttgtctttgtaactagat

SEQ ID NO: 32208 - DNA, 22 bp, Homo sapiens
tttgtagcagcatgatttataa

SEQ ID NO: 32209 - DNA, 22 bp, Homo sapiens
tttcataatactgtacatgaaa

SEQ ID NO: 32210 - DNA, 22 bp, Homo sapiens
gcccggcagtcacacacccagg

SEQ ID NO: 32211 - DNA, 19 bp, Homo sapiens
agggttacccgctgccacc

SEQ ID NO: 32212 - DNA, 22 bp, Homo sapiens
gaagccttgaactgcaaacccc

SEQ ID NO: 32213 - DNA, 22 bp, Homo sapiens
tctgtcttagccatctcaggct

SEQ ID NO: 32214 - DNA, 22 bp, Homo sapiens
ctgaggagaggtggcctgtgtt

SEQ ID NO: 32215 - DNA, 22 bp, Homo sapiens
tgcactccaggctgggtgacag

SEQ ID NO: 32216 - DNA, 22 bp, Homo sapiens
gcctgcagggcctgggcctacc

SEQ ID NO: 32217 - DNA, 22 bp, Homo sapiens
gcctgatgagcttccagctgag

SEQ ID NO: 32218 - DNA, 22 bp, Homo sapiens
ccaggagttggaggctgcagtg

SEQ ID NO: 32219 - DNA, 22 bp, Homo sapiens
ttcctggaaattatgctcacct

SEQ ID NO: 32220 - DNA, 22 bp, Homo sapiens
acattaaacttgcttggctgta

SEQ ID NO: 32221 - DNA, 22 bp, Homo sapiens
tgtgctctgactttctcctggt

SEQ ID NO: 32222 - DNA, 22 bp, Homo sapiens
gctctagtaggaatgtccctct

SEQ ID NO: 32223 - DNA, 22 bp, Homo sapiens
tttctcttcactgtgtgcctca

SEQ ID NO: 32224 - DNA, 22 bp, Homo sapiens
aaagttctctatggtgtaaaaa

SEQ ID NO: 32225 - DNA, 22 bp, Homo sapiens
caggctggagtgcaatgacgcc

SEQ ID NO: 32226 - DNA, 22 bp, Homo sapiens
caggctggagtgcagtggcgcc

SEQ ID NO: 32227 - DNA, 22 bp, Homo sapiens
tctgcatattgttaatggaatg

SEQ ID NO: 32228 - DNA, 22 bp, Homo sapiens
tcagagagcagaacttttttac

SEQ ID NO: 32229 - DNA, 22 bp, Homo sapiens
ttgtttaatccttgtacccatg

SEQ ID NO: 32230 - DNA, 22 bp, Homo sapiens
aatgagatggaattcccgccta

SEQ ID NO: 32231 - DNA, 22 bp, Homo sapiens
ctgaacttattgagtgcttgct

SEQ ID NO: 32232 - DNA, 22 bp, Homo sapiens
agcccttggtattttccgatcc

SEQ ID NO: 32233 - DNA, 22 bp, Homo sapiens
atgctatgtaactggcagatag

SEQ ID NO: 32234 - DNA, 22 bp, Homo sapiens
gcaggcaggcttccttgaactg

SEQ ID NO: 32235 - DNA, 23 bp, Homo sapiens
ccagtgattgcctggaaggaggt

SEQ ID NO: 32236 - DNA, 22 bp, Homo sapiens
gcctggccgggtcttggatttt

SEQ ID NO: 32237 - DNA, 22 bp, Homo sapiens
cgtgagcaaaatggacactccc

SEQ ID NO: 32238 - DNA, 22 bp, Homo sapiens
tctgcaacattcctctccccac

SEQ ID NO: 32239 - DNA, 22 bp, Homo sapiens
gtggattacaagacagttgaga

SEQ ID NO: 32240 - DNA, 22 bp, Homo sapiens
atggagttctgccagcgctgct

SEQ ID NO: 32241 - DNA, 22 bp, Homo sapiens
ctctctgggcccagttggcacc

SEQ ID NO: 32242 - DNA, 22 bp, Homo sapiens
gccgggaccaaggccacggagc

SEQ ID NO: 32243 - DNA, 22 bp, Homo sapiens
cactgcacttcagcctgggtga

SEQ ID NO: 32244 - DNA, 22 bp, Homo sapiens
gggaggttgaggctgcagtgag

SEQ ID NO: 32245 - DNA, 17 bp, Homo sapiens
tgtagcttctccttctc

SEQ ID NO: 32246 - DNA, 20 bp, Homo sapiens
ttcaggaataagatagcagc

SEQ ID NO: 32247 - DNA, 22 bp, Homo sapiens
tgagatcattgacttgttcctg

SEQ ID NO: 32248 - DNA, 22 bp, Homo sapiens
ggtccccccatggtgagcactg

SEQ ID NO: 32249 - DNA, 22 bp, Homo sapiens
attataggcttgagccaccgtg

SEQ ID NO: 32250 - DNA, 22 bp, Homo sapiens
ttagatttacaagcactgttta

SEQ ID NO: 32251 - DNA, 22 bp, Homo sapiens
agaaaatttaaagagacacaca

SEQ ID NO: 32252 - DNA, 22 bp, Homo sapiens
taacaatacccattctaattac

SEQ ID NO: 32253 - DNA, 22 bp, Homo sapiens
gctttatccgcttgacccttac

SEQ ID NO: 32254 - DNA, 22 bp, Homo sapiens
tttgttttcaatgtgtcattca

SEQ ID NO: 32255 - DNA, 22 bp, Homo sapiens
agttattactctttaacatatt

SEQ ID NO: 32256 - DNA, 22 bp, Homo sapiens
ggaccaggactggtggtatctc

SEQ ID NO: 32257 - DNA, 22 bp, Homo sapiens
tgggcaggggccctgcttccgt

SEQ ID NO: 32258 - DNA, 22 bp, Homo sapiens
ttatgatttgccacagattggt

SEQ ID NO: 32259 - DNA, 23 bp, Homo sapiens
gcgtccggcctctctcgctcccg

SEQ ID NO: 32260 - DNA, 22 bp, Homo sapiens
atccaccctgtggtggctttct

SEQ ID NO: 32261 - DNA, 22 bp, Homo sapiens
cctgggaggctgaggctgcagt

SEQ ID NO: 32262 - DNA, 22 bp, Homo sapiens
gggaggttctgttcgcacttga

SEQ ID NO: 32263 - DNA, 22 bp, Homo sapiens
aggtatatattctggtccttat

SEQ ID NO: 32264 - DNA, 22 bp, Homo sapiens
ccaggagttggaagctgccatg

SEQ ID NO: 32265 - DNA, 22 bp, Homo sapiens
tgtcagtgtctatgaagaattt

SEQ ID NO: 32266 - DNA, 22 bp, Homo sapiens
taattcttcaggccttttgtct

SEQ ID NO: 32267 - DNA, 22 bp, Homo sapiens
tcaggcagtagaattgcttgaa

SEQ ID NO: 32268 - DNA, 17 bp, Homo sapiens
catcaaagaaatttcca

SEQ ID NO: 32269 - DNA, 22 bp, Homo sapiens
tttgaggttagctagcagatca

SEQ ID NO: 32270 - DNA, 22 bp, Homo sapiens
attgtggtgtcagttataggca

SEQ ID NO: 32271 - DNA, 22 bp, Homo sapiens
gaaggaagtcattagtgcagac

SEQ ID NO: 32272 - DNA, 22 bp, Homo sapiens
gatgaaggggctggtgccctct

SEQ ID NO: 32273 - DNA, 22 bp, Homo sapiens
gatgggcgtggcgcgtttggtg

SEQ ID NO: 32274 - DNA, 22 bp, Homo sapiens
aataaaatggtcagttttctca

SEQ ID NO: 32275 - DNA, 22 bp, Homo sapiens
gcctggattccttgtttctcag

SEQ ID NO: 32276 - DNA, 22 bp, Homo sapiens
cttctgagatgttgttttacag

SEQ ID NO: 32277 - DNA, 22 bp, Homo sapiens
gcctcctggggtgccatcatct

SEQ ID NO: 32278 - DNA, 22 bp, Homo sapiens
tcactcaggctggagtgcagtg

SEQ ID NO: 32279 - DNA, 22 bp, Homo sapiens
gctgctctcagagctcatgctg

SEQ ID NO: 32280 - DNA, 22 bp, Homo sapiens
tatgtgtttgacaccctgcaag

SEQ ID NO: 32281 - DNA, 22 bp, Homo sapiens
ctgtatttcttggacagttgct

SEQ ID NO: 32282 - DNA, 22 bp, Homo sapiens
gtagggttggagagcacaacca

SEQ ID NO: 32283 - DNA, 22 bp, Homo sapiens
ggccagcctggggctcccagac

SEQ ID NO: 32284 - DNA, 22 bp, Homo sapiens
ttattttaccttcctctgagct

SEQ ID NO: 32285 - DNA, 22 bp, Homo sapiens
tgctcttcacagtttcagcatc

SEQ ID NO: 32286 - DNA, 19 bp, Homo sapiens
tcctgcctggggccgcctg

SEQ ID NO: 32287 - DNA, 22 bp, Homo sapiens
gctgaggctcctcgggaggaca

SEQ ID NO: 32288 - DNA, 22 bp, Homo sapiens
cccaagaggtggaggttgcagt

SEQ ID NO: 32289 - DNA, 19 bp, Homo sapiens
ggtatatgggcctcacttg

SEQ ID NO: 32290 - DNA, 22 bp, Homo sapiens
ttgctaccattgataccagcac

SEQ ID NO: 32291 - DNA, 22 bp, Homo sapiens
caatttctaacattccatggat

SEQ ID NO: 32292 - DNA, 22 bp, Homo sapiens
ctagggacctcagctcctggag

SEQ ID NO: 32293 - DNA, 22 bp, Homo sapiens
ctgccgttgtgaagctcttaga

SEQ ID NO: 32294 - DNA, 22 bp, Homo sapiens
atgtatacgtgcaggtcacagg

SEQ ID NO: 32295 - DNA, 23 bp, Homo sapiens
gtctctagagtgtggagcaaaga

SEQ ID NO: 32296 - DNA, 22 bp, Homo sapiens
gaccatcctggccaacgtggta

SEQ ID NO: 32297 - DNA, 22 bp, Homo sapiens
tgagaaacacaggcatgaatag

SEQ ID NO: 32298 - DNA, 22 bp, Homo sapiens
agtggcctggagccccgcctgg

SEQ ID NO: 32299 - DNA, 22 bp, Homo sapiens
agtgctgggctatctactgcta

SEQ ID NO: 32300 - DNA, 22 bp, Homo sapiens
tactgtgtgcccagccgagctg

SEQ ID NO: 32301 - DNA, 22 bp, Homo sapiens
ctggcaggagcattcacagagg

SEQ ID NO: 32302 - DNA, 22 bp, Homo sapiens
aggtagaaggaccagaatttat

SEQ ID NO: 32303 - DNA, 22 bp, Homo sapiens
tctgacattttgagaatgacat

SEQ ID NO: 32304 - DNA, 23 bp, Homo sapiens
agagtgcagagatatgcttgtgt

SEQ ID NO: 32305 - DNA, 22 bp, Homo sapiens
tgcgaccctagccccctcactt

SEQ ID NO: 32306 - DNA, 22 bp, Homo sapiens
acccggagtcggaggttgcagt

SEQ ID NO: 32307 - DNA, 22 bp, Homo sapiens
caggagatgacagggaagaacc

SEQ ID NO: 32308 - DNA, 22 bp, Homo sapiens
acggtgctgggtattggggttc

SEQ ID NO: 32309 - DNA, 22 bp, Homo sapiens
acggggctagagaaggtttctt

SEQ ID NO: 32310 - DNA, 22 bp, Homo sapiens
agcccttagtacatttctcaag

SEQ ID NO: 32311 - DNA, 22 bp, Homo sapiens
aagcatttcaggtagagatatt

SEQ ID NO: 32312 - DNA, 22 bp, Homo sapiens
ttaaatattatgttgtctgcaa

SEQ ID NO: 32313 - DNA, 22 bp, Homo sapiens
gggttgaggcggatgtcggcgg

SEQ ID NO: 32314 - DNA, 23 bp, Homo sapiens
gtgcgccaggacaacctgacgga

SEQ ID NO: 32315 - DNA, 22 bp, Homo sapiens
gaagattgaaggctgggaatta

SEQ ID NO: 32316 - DNA, 22 bp, Homo sapiens
gttcaagaccagcctggccaac

SEQ ID NO: 32317 - DNA, 22 bp, Homo sapiens
ggaggaggggtgactgaatgct

SEQ ID NO: 32318 - DNA, 22 bp, Homo sapiens
attggtggtgaggacatgccag

SEQ ID NO: 32319 - DNA, 22 bp, Homo sapiens
caaatgaatatttccatgggtt

SEQ ID NO: 32320 - DNA, 20 bp, Homo sapiens
cagagccagggttttgtttt

SEQ ID NO: 32321 - DNA, 22 bp, Homo sapiens
gagtagaactggttatctaata

SEQ ID NO: 32322 - DNA, 22 bp, Homo sapiens
aacccgggaggcagaggttgtg

SEQ ID NO: 32323 - DNA, 22 bp, Homo sapiens
gtctatgatattttgttatagc

SEQ ID NO: 32324 - DNA, 22 bp, Homo sapiens
ttgtgctcctatgagaatctaa

SEQ ID NO: 32325 - DNA, 22 bp, Homo sapiens
gccaggttgctgacgacgatct

SEQ ID NO: 32326 - DNA, 22 bp, Homo sapiens
acgcctgtaatcccagcacttt

SEQ ID NO: 32327 - DNA, 22 bp, Homo sapiens
ggaactgaggaacgaactggga

SEQ ID NO: 32328 - DNA, 22 bp, Homo sapiens
aaccccgctcaggctgggtgag

SEQ ID NO: 32329 - DNA, 22 bp, Homo sapiens
aggcaatcccctgaggatactt

SEQ ID NO: 32330 - DNA, 22 bp, Homo sapiens
gagaggtggaggttgcagtgag

SEQ ID NO: 32331 - DNA, 22 bp, Homo sapiens
actgtgaacggactgaagccca

SEQ ID NO: 32332 - DNA, 22 bp, Homo sapiens
gggcggatcatttgaggtcagg

SEQ ID NO: 32333 - DNA, 22 bp, Homo sapiens
tacgcctgtaatcccagcactt

SEQ ID NO: 32334 - DNA, 22 bp, Homo sapiens
aacttaggaaaataaggcatga

SEQ ID NO: 32335 - DNA, 22 bp, Homo sapiens
ctgtaatcccagctacctggga

SEQ ID NO: 32336 - DNA, 22 bp, Homo sapiens
tccgggcaactgaagggaggtt

SEQ ID NO: 32337 - DNA, 22 bp, Homo sapiens
caaggtgccatgctgggcgggg

SEQ ID NO: 32338 - DNA, 19 bp, Homo sapiens
aggaatggaattaattctg

SEQ ID NO: 32339 - DNA, 22 bp, Homo sapiens
cagggatggcgctggctgcccg

SEQ ID NO: 32340 - DNA, 19 bp, Homo sapiens
ccagagagctaggtacaga

SEQ ID NO: 32341 - DNA, 22 bp, Homo sapiens
ccggctactcgggaggctgacg

SEQ ID NO: 32342 - DNA, 22 bp, Homo sapiens
ccaggaggttgaggctgcagtg

SEQ ID NO: 32343 - DNA, 22 bp, Homo sapiens
gctgcgccggatcccacgttcc

SEQ ID NO: 32344 - DNA, 22 bp, Homo sapiens
atagagtgatgtaaggtatgtg

SEQ ID NO: 32345 - DNA, 22 bp, Homo sapiens
cgggcaaggcgagactaggccc

SEQ ID NO: 32346 - DNA, 22 bp, Homo sapiens
gagagtctagtgcacctagttt

SEQ ID NO: 32347 - DNA, 22 bp, Homo sapiens
gctggcagacttcctctggaac

SEQ ID NO: 32348 - DNA, 22 bp, Homo sapiens
ggtgtccacattccctggcagg

SEQ ID NO: 32349 - DNA, 23 bp, Homo sapiens
aaataggagtatctggatcatga

SEQ ID NO: 32350 - DNA, 22 bp, Homo sapiens
ggcaatagttgtgggttcttta

SEQ ID NO: 32351 - DNA, 22 bp, Homo sapiens
gctggtagacctcactgcactc

SEQ ID NO: 32352 - DNA, 22 bp, Homo sapiens
ggaggacaggggctgcagcaca

SEQ ID NO: 32353 - DNA, 20 bp, Homo sapiens
tggcctctgagatgccacgg

SEQ ID NO: 32354 - DNA, 22 bp, Homo sapiens
tggctaacaaggtgaaaccccg

SEQ ID NO: 32355 - DNA, 22 bp, Homo sapiens
ttcatagtgtttccttccagtg

SEQ ID NO: 32356 - DNA, 22 bp, Homo sapiens
tcagtcttgaacagccccctgt

SEQ ID NO: 32357 - DNA, 22 bp, Homo sapiens
atgtttaaagggttgagaaata

SEQ ID NO: 32358 - DNA, 23 bp, Homo sapiens
gggggccgtcctggggattatag

SEQ ID NO: 32359 - DNA, 22 bp, Homo sapiens
cggctggtgtcgggcacagcaa

SEQ ID NO: 32360 - DNA, 22 bp, Homo sapiens
ccaggaggcggaaggtacagtg

SEQ ID NO: 32361 - DNA, 22 bp, Homo sapiens
cagagctggtgtgtcctggcat

SEQ ID NO: 32362 - DNA, 22 bp, Homo sapiens
cagctttgccaagtaaggtctt

SEQ ID NO: 32363 - DNA, 22 bp, Homo sapiens
ctcggcaggtggaggttgtagt

SEQ ID NO: 32364 - DNA, 22 bp, Homo sapiens
ttatttgtggcatatgagacga

SEQ ID NO: 32365 - DNA, 22 bp, Homo sapiens
cggccaggcacagtggcccacg

SEQ ID NO: 32366 - DNA, 22 bp, Homo sapiens
ttcttctaaatgtgcttattaa

SEQ ID NO: 32367 - DNA, 22 bp, Homo sapiens
aaaatcctgctgactcgagatg

SEQ ID NO: 32368 - DNA, 22 bp, Homo sapiens
agggacctcatgtaagtggatt

SEQ ID NO: 32369 - DNA, 20 bp, Homo sapiens
tctcgcactcggagcagccg

SEQ ID NO: 32370 - DNA, 22 bp, Homo sapiens
gtgtaagtatctttgtatcttt

SEQ ID NO: 32371 - DNA, 22 bp, Homo sapiens
ggtgccaggctgtagtcagggt

SEQ ID NO: 32372 - DNA, 20 bp, Homo sapiens
tttcttgtcggctgttgctg

SEQ ID NO: 32373 - DNA, 19 bp, Homo sapiens
gttctttcatagtaagagc

SEQ ID NO: 32374 - DNA, 22 bp, Homo sapiens
tagcacagcttcttgatgtcac

SEQ ID NO: 32375 - DNA, 22 bp, Homo sapiens
tgaaggggttcagcatgggggt

SEQ ID NO: 32376 - DNA, 22 bp, Homo sapiens
ggggaccctcaggactgcgtct

SEQ ID NO: 32377 - DNA, 22 bp, Homo sapiens
acatcctcccgatctactggct

SEQ ID NO: 32378 - DNA, 22 bp, Homo sapiens
gtaatagtctcaaactcctgga

SEQ ID NO: 32379 - DNA, 22 bp, Homo sapiens
ggtcccatgactgacacagcag

SEQ ID NO: 32380 - DNA, 22 bp, Homo sapiens
cagtgatatttatcctactcac

SEQ ID NO: 32381 - DNA, 22 bp, Homo sapiens
cagtggctggttagggacagga

SEQ ID NO: 32382 - DNA, 22 bp, Homo sapiens
cagtcactggaatagctgagga

SEQ ID NO: 32383 - DNA, 22 bp, Homo sapiens
tatcttaaaaatcgaagcagat

SEQ ID NO: 32384 - DNA, 22 bp, Homo sapiens
gaggggcacagtaaagggtccc

SEQ ID NO: 32385 - DNA, 22 bp, Homo sapiens
attaagactgcccatgttttta

SEQ ID NO: 32386 - DNA, 22 bp, Homo sapiens
ccccatgaagtagggtctctga

SEQ ID NO: 32387 - DNA, 18 bp, Homo sapiens
tgagaggctattttttgc

SEQ ID NO: 32388 - DNA, 22 bp, Homo sapiens
tctcctggagcccagatgctgg

SEQ ID NO: 32389 - DNA, 22 bp, Homo sapiens
gtagctctgtttaaagttcttt

SEQ ID NO: 32390 - DNA, 22 bp, Homo sapiens
tgtagctctccagccagcaagg

SEQ ID NO: 32391 - DNA, 22 bp, Homo sapiens
tataaagagtctcaaagaagtt

SEQ ID NO: 32392 - DNA, 22 bp, Homo sapiens
tggatgctgtaggacacgctct

SEQ ID NO: 32393 - DNA, 22 bp, Homo sapiens
caggctggagttcagtggtgtg

SEQ ID NO: 32394 - DNA, 22 bp, Homo sapiens
tttctgagaaattaaacacttt

SEQ ID NO: 32395 - DNA, 22 bp, Homo sapiens
tgagatgtcatagttcagttca

SEQ ID NO: 32396 - DNA, 22 bp, Homo sapiens
gctcatgactgtaatcccagca

SEQ ID NO: 32397 - DNA, 22 bp, Homo sapiens
catgagataatttttctccagt

SEQ ID NO: 32398 - DNA, 22 bp, Homo sapiens
gggtgctttggctcacgcctgt

SEQ ID NO: 32399 - DNA, 22 bp, Homo sapiens
tttccagagggtgctcagggcg

SEQ ID NO: 32400 - DNA, 22 bp, Homo sapiens
tggtatgaccgtggtgcaagca

SEQ ID NO: 32401 - DNA, 22 bp, Homo sapiens
tctttcattctagtctgaggtt

SEQ ID NO: 32402 - DNA, 22 bp, Homo sapiens
gagcaccgcctccacgatgccc

SEQ ID NO: 32403 - DNA, 20 bp, Homo sapiens
aaaatatgtataactcttct

SEQ ID NO: 32404 - DNA, 22 bp, Homo sapiens
aacccgggaggcggaggttgtg

SEQ ID NO: 32405 - DNA, 22 bp, Homo sapiens
taagtcttcatagtctaatgtc

SEQ ID NO: 32406 - DNA, 22 bp, Homo sapiens
actaaagctcacagagttgaac

SEQ ID NO: 32407 - DNA, 22 bp, Homo sapiens
agtccaggcattccagccattc

SEQ ID NO: 32408 - DNA, 22 bp, Homo sapiens
ataataacaatgccagatgcct

SEQ ID NO: 32409 - DNA, 22 bp, Homo sapiens
ttggaacatgccggggtccagg

SEQ ID NO: 32410 - DNA, 22 bp, Homo sapiens
cctagagctctgctttatctaa

SEQ ID NO: 32411 - DNA, 22 bp, Homo sapiens
aaagatcacgtcccaggactcg

SEQ ID NO: 32412 - DNA, 22 bp, Homo sapiens
aaacttttttaggttcataggc

SEQ ID NO: 32413 - DNA, 22 bp, Homo sapiens
tagaagaaagtgaagctgggga

SEQ ID NO: 32414 - DNA, 22 bp, Homo sapiens
tgttcttgagcctttagaccta

SEQ ID NO: 32415 - DNA, 22 bp, Homo sapiens
tgagatgtaaggtatgcttact

SEQ ID NO: 32416 - DNA, 22 bp, Homo sapiens
gcaggtggatcacctgaggtca

SEQ ID NO: 32417 - DNA, 18 bp, Homo sapiens
cttgttcttctcttggcg

SEQ ID NO: 32418 - DNA, 20 bp, Homo sapiens
gggcagagccagccagtccc

SEQ ID NO: 32419 - DNA, 22 bp, Homo sapiens
gggaggcagtgctggaggctgg

SEQ ID NO: 32420 - DNA, 22 bp, Homo sapiens
aggacgctctcgctgaacttct

SEQ ID NO: 32421 - DNA, 22 bp, Homo sapiens
ttggatccatctcaggcatagg

SEQ ID NO: 32422 - DNA, 22 bp, Homo sapiens
tgtgtttctgagaatcccacct

SEQ ID NO: 32423 - DNA, 22 bp, Homo sapiens
tggagaattctatgttgagggg

SEQ ID NO: 32424 - DNA, 22 bp, Homo sapiens
agaaatatgctgattagatgaa

SEQ ID NO: 32425 - DNA, 22 bp, Homo sapiens
ggacctgaacataaaacgaggc

SEQ ID NO: 32426 - DNA, 20 bp, Homo sapiens
attagagctacatggctaca

SEQ ID NO: 32427 - DNA, 22 bp, Homo sapiens
tcatctaagagtcttacattta

SEQ ID NO: 32428 - DNA, 22 bp, Homo sapiens
ttattttaccttcctctgagct

SEQ ID NO: 32429 - DNA, 22 bp, Homo sapiens
gagaaatgcatgcatgtcatca

SEQ ID NO: 32430 - DNA, 22 bp, Homo sapiens
aggggaatgggtagactgttga

SEQ ID NO: 32431 - DNA, 22 bp, Homo sapiens
gaaaattattgaaaatggctct

SEQ ID NO: 32432 - DNA, 22 bp, Homo sapiens
aactatgttaataagtttcatt

SEQ ID NO: 32433 - DNA, 22 bp, Homo sapiens
atatatttgagaatattcatga

SEQ ID NO: 32434 - DNA, 22 bp, Homo sapiens
aaatgtggggctggaggcagga

SEQ ID NO: 32435 - DNA, 22 bp, Homo sapiens
tagcaaaggatgactatgtacc

SEQ ID NO: 32436 - DNA, 22 bp, Homo sapiens
ctgggaggcggagcttgcagtg

SEQ ID NO: 32437 - DNA, 22 bp, Homo sapiens
ttcattcttcagagctgcgctt

SEQ ID NO: 32438 - DNA, 22 bp, Homo sapiens
atatattttttgagacagagtc

SEQ ID NO: 32439 - DNA, 22 bp, Homo sapiens
tagtatagattgaagcagatca

SEQ ID NO: 32440 - DNA, 22 bp, Homo sapiens
tctgtgctaggcagcctggccc

SEQ ID NO: 32441 - DNA, 22 bp, Homo sapiens
atttagtagagaaattaagaaa

SEQ ID NO: 32442 - DNA, 22 bp, Homo sapiens
ataaaaactgacccatcctttg

SEQ ID NO: 32443 - DNA, 22 bp, Homo sapiens
ttaaattttagaaacagactct

SEQ ID NO: 32444 - DNA, 22 bp, Homo sapiens
ctagggtcaggggcctgcgtcg

SEQ ID NO: 32445 - DNA, 22 bp, Homo sapiens
ggctgggctccgggagcatgcg

SEQ ID NO: 32446 - DNA, 22 bp, Homo sapiens
acttttcttatcagaaaggcca

SEQ ID NO: 32447 - DNA, 22 bp, Homo sapiens
cttgcctttgtcttcaaaggct

SEQ ID NO: 32448 - DNA, 22 bp, Homo sapiens
caaagtaattacggttttggcc

SEQ ID NO: 32449 - DNA, 22 bp, Homo sapiens
attttctatgttgtaattgtta

SEQ ID NO: 32450 - DNA, 22 bp, Homo sapiens
caggaggattgcttgaggccag

SEQ ID NO: 32451 - DNA, 22 bp, Homo sapiens
tcctgggtccatggcagccgaa

SEQ ID NO: 32452 - DNA, 22 bp, Homo sapiens
atacaaaatatatactggagac

SEQ ID NO: 32453 - DNA, 22 bp, Homo sapiens
gaactcattagcctgctttcag

SEQ ID NO: 32454 - DNA, 22 bp, Homo sapiens
ggctgagttgagaggattactt

SEQ ID NO: 32455 - DNA, 22 bp, Homo sapiens
tgggcagggagctggaaccaca

SEQ ID NO: 32456 - DNA, 22 bp, Homo sapiens
ctgctctgctgatcagtgtctc

SEQ ID NO: 32457 - DNA, 22 bp, Homo sapiens
acatttatataactcactagga

SEQ ID NO: 32458 - DNA, 22 bp, Homo sapiens
ctgcatccatgttgctgcaaag

SEQ ID NO: 32459 - DNA, 22 bp, Homo sapiens
tggggtacttgtatcaaagcac

SEQ ID NO: 32460 - DNA, 22 bp, Homo sapiens
tttctaatctgattctcctacc

SEQ ID NO: 32461 - DNA, 22 bp, Homo sapiens
tctggtgtcagtattctttgaa

SEQ ID NO: 32462 - DNA, 22 bp, Homo sapiens
tccagcagtccatgtgagacac

SEQ ID NO: 32463 - DNA, 22 bp, Homo sapiens
gaatttaagaggatgaatctgt

SEQ ID NO: 32464 - DNA, 22 bp, Homo sapiens
caggaggacatactggctcaca

SEQ ID NO: 32465 - DNA, 19 bp, Homo sapiens
agagtattgaatttgccct

SEQ ID NO: 32466 - DNA, 22 bp, Homo sapiens
aagaatgagctcaaagatctta

SEQ ID NO: 32467 - DNA, 22 bp, Homo sapiens
taattataacagttacatctta

SEQ ID NO: 32468 - DNA, 22 bp, Homo sapiens
tttgaagactactgggagtgaa

SEQ ID NO: 32469 - DNA, 22 bp, Homo sapiens
ctaaatctcatcatgtacctcc

SEQ ID NO: 32470 - DNA, 22 bp, Homo sapiens
ttagatttacaagcactgttta

SEQ ID NO: 32471 - DNA, 22 bp, Homo sapiens
gagatggagtctttttctgtca

SEQ ID NO: 32472 - DNA, 22 bp, Homo sapiens
atgctatgtaactggcagatag

SEQ ID NO: 32473 - DNA, 22 bp, Homo sapiens
attttttgttaactcaggatag

SEQ ID NO: 32474 - DNA, 22 bp, Homo sapiens
gcaaatgctaaagtgtagagac

SEQ ID NO: 32475 - DNA, 22 bp, Homo sapiens
gtgaaatatttaacgtccaggt

SEQ ID NO: 32476 - DNA, 22 bp, Homo sapiens
attggtagttttgtatttctct

SEQ ID NO: 32477 - DNA, 22 bp, Homo sapiens
gcaaacaaggacatacatcctg

SEQ ID NO: 32478 - DNA, 22 bp, Homo sapiens
ttcttcatgggttcttttagga

SEQ ID NO: 32479 - DNA, 22 bp, Homo sapiens
tcttaattctgtgtcttcacta

SEQ ID NO: 32480 - DNA, 22 bp, Homo sapiens
agcaggagtttgatgcttttat

SEQ ID NO: 32481 - DNA, 22 bp, Homo sapiens
tttgctattgtgaatagtgcca

SEQ ID NO: 32482 - DNA, 22 bp, Homo sapiens
gaattttattactagtcaactg

SEQ ID NO: 32483 - DNA, 22 bp, Homo sapiens
gaatgcttggaacctgaagttc

SEQ ID NO: 32484 - DNA, 22 bp, Homo sapiens
cggctggtgtcgggcacagcaa

SEQ ID NO: 32485 - DNA, 22 bp, Homo sapiens
aagaaatgtgaatattgaatag

SEQ ID NO: 32486 - DNA, 20 bp, Homo sapiens
cagagccagggttttgtttt

SEQ ID NO: 32487 - DNA, 22 bp, Homo sapiens
gaagatgttatggagagctcag

SEQ ID NO: 32488 - DNA, 20 bp, Homo sapiens
tatttctgggcaaccattta

SEQ ID NO: 32489 - DNA, 18 bp, Homo sapiens
tggaggaaaaatctcatg

SEQ ID NO: 32490 - DNA, 22 bp, Homo sapiens
cctggtgctgctatcaggggta

SEQ ID NO: 32491 - DNA, 22 bp, Homo sapiens
ttcattcttttacatgtgaata

SEQ ID NO: 32492 - DNA, 22 bp, Homo sapiens
ggctgggcaggtctgcacaggg

SEQ ID NO: 32493 - DNA, 22 bp, Homo sapiens
aatggcactttataaatgttaa

SEQ ID NO: 32494 - DNA, 19 bp, Homo sapiens
accttctgggaaacattcc

SEQ ID NO: 32495 - DNA, 22 bp, Homo sapiens
aagacttgaccaggttgaaggc

SEQ ID NO: 32496 - DNA, 22 bp, Homo sapiens
tgcctgtggaaaggctggtgct

SEQ ID NO: 32497 - DNA, 22 bp, Homo sapiens
tgaagaaacgcagagaggtagg

SEQ ID NO: 32498 - DNA, 22 bp, Homo sapiens
gaggggctgccctggtgtcagg

SEQ ID NO: 32499 - DNA, 21 bp, Homo sapiens
gggcagaggggcctcctgggt

SEQ ID NO: 32500 - DNA, 22 bp, Homo sapiens
tcgtctgtgaaattgggataag

SEQ ID NO: 32501 - DNA, 22 bp, Homo sapiens
gtagctctgtttaaagttcttt

SEQ ID NO: 32502 - DNA, 22 bp, Homo sapiens
aaaatatgtataactcttctgc

SEQ ID NO: 32503 - DNA, 22 bp, Homo sapiens
ctgcagtctacctggattttta

SEQ ID NO: 32504 - DNA, 22 bp, Homo sapiens
gcggggggaggaacatcttgca

SEQ ID NO: 32505 - DNA, 22 bp, Homo sapiens
atacaaaaattagccgggagta

SEQ ID NO: 32506 - DNA, 22 bp, Homo sapiens
aggaattcaagaccagctgggc

SEQ ID NO: 32507 - DNA, 22 bp, Homo sapiens
tttgccagtattttattgatga

SEQ ID NO: 32508 - DNA, 22 bp, Homo sapiens
tacaaaaaattgatactgacga

SEQ ID NO: 32509 - DNA, 22 bp, Homo sapiens
ttaataaagtatgaattggaaa

SEQ ID NO: 32510 - DNA, 22 bp, Homo sapiens
tgggcaggggccctgcttccgt

SEQ ID NO: 32511 - DNA, 22 bp, Homo sapiens
tgggaggccgaggcaggtggat

SEQ ID NO: 32512 - DNA, 22 bp, Homo sapiens
ttttctcttccctctggacctg

SEQ ID NO: 32513 - DNA, 20 bp, Homo sapiens
ctgggtggcaagcaaggggg

SEQ ID NO: 32514 - DNA, 22 bp, Homo sapiens
atttggcagtataaattctggc

SEQ ID NO: 32515 - DNA, 22 bp, Homo sapiens
gttgagtgggttaggatgctga

SEQ ID NO: 32516 - DNA, 22 bp, Homo sapiens
agggctggagccacagctggga

SEQ ID NO: 32517 - DNA, 22 bp, Homo sapiens
gggcaggggtcagtggccccaa

SEQ ID NO: 32518 - DNA, 22 bp, Homo sapiens
ttctatttttgtggaactgtag

SEQ ID NO: 32519 - DNA, 22 bp, Homo sapiens
ttttaatactgctattgtagga

SEQ ID NO: 32520 - DNA, 22 bp, Homo sapiens
cggctgggttcggctgcaggcc

SEQ ID NO: 32521 - DNA, 22 bp, Homo sapiens
gcaggcagatcacctgtcagga

SEQ ID NO: 32522 - DNA, 22 bp, Homo sapiens
tttgaaatgtatcagtataggt

SEQ ID NO: 32523 - DNA, 22 bp, Homo sapiens
atatgtggcattatttctgagg

SEQ ID NO: 32524 - DNA, 22 bp, Homo sapiens
gctgcagtgagccaagatcgtg

SEQ ID NO: 32525 - DNA, 22 bp, Homo sapiens
cctgaggatgccagcatgggtg

SEQ ID NO: 32526 - DNA, 22 bp, Homo sapiens
tggggtacttgtatcaaagcac

SEQ ID NO: 32527 - DNA, 22 bp, Homo sapiens
tgagaaattacttcagtgatgg

SEQ ID NO: 32528 - DNA, 22 bp, Homo sapiens
gttgcagatgtggaactcgtgc

SEQ ID NO: 32529 - DNA, 19 bp, Homo sapiens
cataatacagtggatctga

SEQ ID NO: 32530 - DNA, 22 bp, Homo sapiens
agtccaaagcagatgagggcca

SEQ ID NO: 32531 - DNA, 22 bp, Homo sapiens
tctgtgttgagaaggatcatga

SEQ ID NO: 32532 - DNA, 22 bp, Homo sapiens
tgctgggggtagctctgcgtag

SEQ ID NO: 32533 - DNA, 22 bp, Homo sapiens
tttgaaatgtatcagtataggt

SEQ ID NO: 32534 - DNA, 22 bp, Homo sapiens
ataaaagatcccttctgagctc

SEQ ID NO: 32535 - DNA, 22 bp, Homo sapiens
atgcccaatgtcacaatttttg

SEQ ID NO: 32536 - DNA, 23 bp, Homo sapiens
ttggggacaaacatgctactttc

SEQ ID NO: 32537 - DNA, 22 bp, Homo sapiens
gagatcggtaaagagcatgcac

SEQ ID NO: 32538 - DNA, 22 bp, Homo sapiens
gagaaatgcatgcatgtcatca

SEQ ID NO: 32539 - DNA, 22 bp, Homo sapiens
ggcagacctctccagccccaca

SEQ ID NO: 32540 - DNA, 22 bp, Homo sapiens
tctggtgtcagtattctttgaa

SEQ ID NO: 32541 - DNA, 22 bp, Homo sapiens
gggcaggggtcagtggccccaa

SEQ ID NO: 32542 - DNA, 22 bp, Homo sapiens
ccaggcaggcgatggtgcagtg

SEQ ID NO: 32543 - DNA, 22 bp, Homo sapiens
cggtcaggtgcagcgttggcac

SEQ ID NO: 32544 - DNA, 22 bp, Homo sapiens
caggcagggagctggaaaggat

SEQ ID NO: 32545 - DNA, 22 bp, Homo sapiens
tcgcgcccccaagcgtcattgg

SEQ ID NO: 32546 - DNA, 22 bp, Homo sapiens
taattataacagttacatctta

SEQ ID NO: 32547 - DNA, 22 bp, Homo sapiens
gcagatggatgtggacggcgcc

SEQ ID NO: 32548 - DNA, 20 bp, Homo sapiens
cagagccagggttttgtttt

SEQ ID NO: 32549 - DNA, 22 bp, Homo sapiens
ctgcagtctacctggattttta

SEQ ID NO: 32550 - DNA, 22 bp, Homo sapiens
aaatatcttaggagtatatgag

SEQ ID NO: 32551 - DNA, 22 bp, Homo sapiens
ctaaatctcatcatgtacctcc

SEQ ID NO: 32552 - DNA, 22 bp, Homo sapiens
tagtatagattgaagcagatca

SEQ ID NO: 32553 - DNA, 22 bp, Homo sapiens
cggctggtgtcgggcacagcaa

SEQ ID NO: 32554 - DNA, 22 bp, Homo sapiens
tcgtctgtgaaattgggataag

SEQ ID NO: 32555 - DNA, 22 bp, Homo sapiens
gcaaatgctaaagtgtagagac

SEQ ID NO: 32556 - DNA, 22 bp, Homo sapiens
gcgagtgccgagagggcagggc

SEQ ID NO: 32557 - DNA, 22 bp, Homo sapiens
ctggtgggagataattgaatca

SEQ ID NO: 32558 - DNA, 22 bp, Homo sapiens
tgcccagggtggagtgcagtgg

SEQ ID NO: 32559 - DNA, 22 bp, Homo sapiens
atacaaaatatatactggagac

SEQ ID NO: 32560 - DNA, 22 bp, Homo sapiens
tgcttgtgacagaactgtgtcc

SEQ ID NO: 32561 - DNA, 16 bp, Homo sapiens
gcgcctcctcggcctc

SEQ ID NO: 32562 - DNA, 22 bp, Homo sapiens
ggctgagttgagaggattactt

SEQ ID NO: 32563 - DNA, 22 bp, Homo sapiens
tatgcttattgtctcatccact

SEQ ID NO: 32564 - DNA, 22 bp, Homo sapiens
ctgcccgcaccatccccgggct

SEQ ID NO: 32565 - DNA, 22 bp, Homo sapiens
cccaggcttttctcttgcccca

SEQ ID NO: 32566 - DNA, 22 bp, Homo sapiens
ggcgcccccttcaaacagagca

SEQ ID NO: 32567 - DNA, 22 bp, Homo sapiens
caactgggataaagagctaaag

SEQ ID NO: 32568 - DNA, 22 bp, Homo sapiens
aagtccaggtcctcattccatc

SEQ ID NO: 32569 - DNA, 22 bp, Homo sapiens
atgtgtattacctcgattgtga

SEQ ID NO: 32570 - DNA, 22 bp, Homo sapiens
tgggggacaccagtctctctct

SEQ ID NO: 32571 - DNA, 22 bp, Homo sapiens
gcggggggaggaacatcttgca

SEQ ID NO: 32572 - DNA, 19 bp, Homo sapiens
cggcccctcctctcgcgcc

SEQ ID NO: 32573 - DNA, 22 bp, Homo sapiens
tgtgtggattcatctcaaagag

SEQ ID NO: 32574 - DNA, 22 bp, Homo sapiens
ggcgggaagttcttgcccactt

SEQ ID NO: 32575 - DNA, 19 bp, Homo sapiens
ggggcctgtgatggtcaca

SEQ ID NO: 32576 - DNA, 22 bp, Homo sapiens
gcgggccaccttggagagcgct

SEQ ID NO: 32577 - DNA, 22 bp, Homo sapiens
agtgtgttgtaggctcaaatgg

SEQ ID NO: 32578 - DNA, 22 bp, Homo sapiens
attttttgttaactcaggatag

SEQ ID NO: 32579 - DNA, 22 bp, Homo sapiens
gctgcagtgagccaagatcgtg

SEQ ID NO: 32580 - DNA, 22 bp, Homo sapiens
aggaattcaagaccagctgggc

SEQ ID NO: 32581 - DNA, 22 bp, Homo sapiens
ctgggaggcggagcttgcagtg

SEQ ID NO: 32582 - DNA, 19 bp, Homo sapiens
agagtattgaatttgccct

SEQ ID NO: 32583 - DNA, 22 bp, Homo sapiens
aggcaaggtgctacagacagtg

SEQ ID NO: 32584 - DNA, 22 bp, Homo sapiens
catgtgtgtctccaccagctgc

SEQ ID NO: 32585 - DNA, 18 bp, Homo sapiens
tggaggaaaaatctcatg

SEQ ID NO: 32586 - DNA, 22 bp, Homo sapiens
caggcaggtcagtgaagaagga

SEQ ID NO: 32587 - DNA, 22 bp, Homo sapiens
aggtggggaggagtgtctcttt

SEQ ID NO: 32588 - DNA, 22 bp, Homo sapiens
tctgtgctaggcagcctggccc

SEQ ID NO: 32589 - DNA, 22 bp, Homo sapiens
tgggcagggagctggaaccaca

SEQ ID NO: 32590 - DNA, 22 bp, Homo sapiens
tttctttatcatagcatctttg

SEQ ID NO: 32591 - DNA, 22 bp, Homo sapiens
attgaaaataaggccagaaaca

SEQ ID NO: 32592 - DNA, 20 bp, Homo sapiens
gggcagagccagccagtccc

SEQ ID NO: 32593 - DNA, 22 bp, Homo sapiens
ttctgattgctgatgaggccca

SEQ ID NO: 32594 - DNA, 22 bp, Homo sapiens
ctgcatccatgttgctgcaaag

SEQ ID NO: 32595 - DNA, 22 bp, Homo sapiens
aatattatacagtcaacctctt

SEQ ID NO: 32596 - DNA, 22 bp, Homo sapiens
gaggggctgccctggtgtcagg

SEQ ID NO: 32597 - DNA, 22 bp, Homo sapiens
gcccaggaggagaggctgcagt

SEQ ID NO: 32598 - DNA, 22 bp, Homo sapiens
gggtacagttcttccagtgtca

SEQ ID NO: 32599 - DNA, 22 bp, Homo sapiens
gcccagagttcaaggctgcagt

SEQ ID NO: 32600 - DNA, 22 bp, Homo sapiens
atgtttcaataatgctgtgagt

SEQ ID NO: 32601 - DNA, 22 bp, Homo sapiens
cctgaggatgccagcatgggtg

SEQ ID NO: 32602 - DNA, 22 bp, Homo sapiens
tttgctattgtgaatagtgcca

SEQ ID NO: 32603 - DNA, 22 bp, Homo sapiens
gcggggacagaaggcggttctc

SEQ ID NO: 32604 - DNA, 19 bp, Homo sapiens
gtaatatgtgctgagtcct

SEQ ID NO: 32605 - DNA, 20 bp, Homo sapiens
ctgggtggcaagcaaggggg

SEQ ID NO: 32606 - DNA, 22 bp, Homo sapiens
agaaatatgctgattagatgaa

SEQ ID NO: 32607 - DNA, 22 bp, Homo sapiens
caggaggacatactggctcaca

SEQ ID NO: 32608 - DNA, 21 bp, Homo sapiens
gggcagaggggcctcctgggt

SEQ ID NO: 32609 - DNA, 22 bp, Homo sapiens
atttggcagtataaattctggc

SEQ ID NO: 32610 - DNA, 22 bp, Homo sapiens
aggggaatgggtagactgttga

SEQ ID NO: 32611 - DNA, 22 bp, Homo sapiens
tttgccagtattttattgatga

SEQ ID NO: 32612 - DNA, 22 bp, Homo sapiens
cgtgtgttgaaagatgtacatc

SEQ ID NO: 32613 - DNA, 22 bp, Homo sapiens
tgcccaggctggagtgcagtgg

SEQ ID NO: 32614 - DNA, 22 bp, Homo sapiens
gtcggccacgcaggtgcggtag

SEQ ID NO: 32615 - DNA, 22 bp, Homo sapiens
atctagattaggtataagagct

SEQ ID NO: 32616 - DNA, 22 bp, Homo sapiens
tgagtgtggggaatgtcatgag

SEQ ID NO: 32617 - DNA, 22 bp, Homo sapiens
agcccaggagtttgaggctgtg

SEQ ID NO: 32618 - DNA, 22 bp, Homo sapiens
aagaatgagctcaaagatctta

SEQ ID NO: 32619 - DNA, 22 bp, Homo sapiens
cccaggaattggaggctgcagt

SEQ ID NO: 32620 - DNA, 22 bp, Homo sapiens
gggcagagagctggaactcctt

SEQ ID NO: 32621 - DNA, 22 bp, Homo sapiens
aaatgtggggctggaggcagga

SEQ ID NO: 32622 - DNA, 22 bp, Homo sapiens
ttgcccagagtcacccagctca

SEQ ID NO: 32623 - DNA, 21 bp, Homo sapiens
tgtaagtttcatctgaattgg

SEQ ID NO: 32624 - DNA, 22 bp, Homo sapiens
tccagcagtccatgtgagacac

SEQ ID NO: 32625 - DNA, 22 bp, Homo sapiens
gttgagtgggttaggatgctga

SEQ ID NO: 32626 - DNA, 22 bp, Homo sapiens
ctgctctgctgatcagtgtctc

SEQ ID NO: 32627 - DNA, 22 bp, Homo sapiens
caggaagaccagggctgtggct

SEQ ID NO: 32628 - DNA, 22 bp, Homo sapiens
atatacacatctttttaaatat

SEQ ID NO: 32629 - DNA, 22 bp, Homo sapiens
tctccgatcacaggttttcaat

SEQ ID NO: 32630 - DNA, 22 bp, Homo sapiens
atacaaaaattagccgggagta

SEQ ID NO: 32631 - DNA, 22 bp, Homo sapiens
caaagtaattacggttttggcc

SEQ ID NO: 32632 - DNA, 22 bp, Homo sapiens
cttatttgcccatgtttcttta

SEQ ID NO: 32633 - DNA, 22 bp, Homo sapiens
aagacttgaccaggttgaaggc

SEQ ID NO: 32634 - DNA, 22 bp, Homo sapiens
gcaggcagatcacctgtcagga

SEQ ID NO: 32635 - DNA, 22 bp, Homo sapiens
aatattatcaaaagctttttca

SEQ ID NO: 32636 - DNA, 22 bp, Homo sapiens
ttgtgctcctatgagaatctaa

SEQ ID NO: 32637 - DNA, 22 bp, Homo sapiens
caggctggagtgcaatgacgcc

SEQ ID NO: 32638 - DNA, 22 bp, Homo sapiens
caggaggattgcttgaggccag

SEQ ID NO: 32639 - DNA, 22 bp, Homo sapiens
tcctgggtccatggcagccgaa

SEQ ID NO: 32640 - DNA, 22 bp, Homo sapiens
tgccgcaagtactgctgcctgt

SEQ ID NO: 32641 - DNA, 22 bp, Homo sapiens
cccaggaagtggaggttgcagt

SEQ ID NO: 32642 - DNA, 22 bp, Homo sapiens
tttcactcagctctcattgtct

SEQ ID NO: 32643 - DNA, 22 bp, Homo sapiens
tatttaataaaactatggcatg

SEQ ID NO: 32644 - DNA, 22 bp, Homo sapiens
gggtaaatctcttttcatggct

SEQ ID NO: 32645 - DNA, 22 bp, Homo sapiens
ctagggtcaggggcctgcgtcg

SEQ ID NO: 32646 - DNA, 18 bp, Homo sapiens
cttgttcttctcttggcg

SEQ ID NO: 32647 - DNA, 22 bp, Homo sapiens
gggcagcagccactcatttagc

SEQ ID NO: 32648 - DNA, 22 bp, Homo sapiens
ttgtgctctgtgttatttaagg

SEQ ID NO: 32649 - DNA, 22 bp, Homo sapiens
gcccgcgccagcctctccatct

SEQ ID NO: 32650 - DNA, 22 bp, Homo sapiens
tgggcaggggccctgcttccgt

SEQ ID NO: 32651 - DNA, 20 bp, Homo sapiens
cagcagtggatgagagtttt

SEQ ID NO: 32652 - DNA, 22 bp, Homo sapiens
gttttgaatactactagaactt

SEQ ID NO: 32653 - DNA, 22 bp, Homo sapiens
gggaggcagtgctggaggctgg

SEQ ID NO: 32654 - DNA, 22 bp, Homo sapiens
tggagaattctatgttgagggg

SEQ ID NO: 32655 - DNA, 22 bp, Homo sapiens
tttaaaaaactagtctgagtct

SEQ ID NO: 32656 - DNA, 22 bp, Homo sapiens
gtgtatgttctacttaatatta

SEQ ID NO: 32657 - DNA, 22 bp, Homo sapiens
tgttcagaacaaaggtaaatga

SEQ ID NO: 32658 - DNA, 22 bp, Homo sapiens
gctggggaggcagcagagaaca

SEQ ID NO: 32659 - DNA, 22 bp, Homo sapiens
ttattttaccttcctctgagct

SEQ ID NO: 32660 - DNA, 22 bp, Homo sapiens
gcagctggaagtgacactctgt

SEQ ID NO: 32661 - DNA, 22 bp, Homo sapiens
cattctgaccctatgatttaag

SEQ ID NO: 32662 - DNA, 22 bp, Homo sapiens
gaacgggtgcagccatgggccc

SEQ ID NO: 32663 - DNA, 22 bp, Homo sapiens
ttaaattttagaaacagactct

SEQ ID NO: 32664 - DNA, 22 bp, Homo sapiens
aaagaaatagatggcatttaaa

SEQ ID NO: 32665 - DNA, 22 bp, Homo sapiens
cggctgggttcggctgcaggcc

SEQ ID NO: 32666 - DNA, 22 bp, Homo sapiens
ttcttcatgggttcttttagga

SEQ ID NO: 32667 - DNA, 22 bp, Homo sapiens
gcaggtggatcacctgaggtca

SEQ ID NO: 32668 - DNA, 22 bp, Homo sapiens
cctggtgctgctatcaggggta

SEQ ID NO: 32669 - DNA, 22 bp, Homo sapiens
ggaggcagaatagagtgtgggt

SEQ ID NO: 32670 - DNA, 22 bp, Homo sapiens
ggacctgaacataaaacgaggc

SEQ ID NO: 32671 - DNA, 22 bp, Homo sapiens
ccctcccggcgtgctgggctcg

SEQ ID NO: 32672 - DNA, 22 bp, Homo sapiens
atatgtggcattatttctgagg

SEQ ID NO: 32673 - DNA, 22 bp, Homo sapiens
gccggggctggggagagacatg

SEQ ID NO: 32674 - DNA, 22 bp, Homo sapiens
acttttcttatcagaaaggcca

SEQ ID NO: 32675 - DNA, 22 bp, Homo sapiens
tgggaggccgaggcaggtggat

SEQ ID NO: 32676 - DNA, 20 bp, Homo sapiens
attagagctacatggctaca

SEQ ID NO: 32677 - DNA, 22 bp, Homo sapiens
tgcctgtggaaaggctggtgct

SEQ ID NO: 32678 - DNA, 22 bp, Homo sapiens
tgaaggggttcagcatgggggt

SEQ ID NO: 32679 - DNA, 22 bp, Homo sapiens
gagatggagtctttttctgtca

SEQ ID NO: 32680 - DNA, 22 bp, Homo sapiens
agggctggagccacagctggga

SEQ ID NO: 32681 - DNA, 22 bp, Homo sapiens
ttgtgctcctgtgagaatctag

SEQ ID NO: 32682 - DNA, 22 bp, Homo sapiens
gctctctgcagcctccttggag

SEQ ID NO: 32683 - DNA, 22 bp, Homo sapiens
cttgcctttgtcttcaaaggct

SEQ ID NO: 32684 - DNA, 22 bp, Homo sapiens
cctgagagcattccacactgaa

SEQ ID NO: 32685 - DNA, 22 bp, Homo sapiens
catataaatacaacatgtgtta

SEQ ID NO: 32686 - DNA, 22 bp, Homo sapiens
ttggatccatctcaggcatagg

SEQ ID NO: 32687 - DNA, 22 bp, Homo sapiens
caagcgtggctgctctgatgga

SEQ ID NO: 32688 - DNA, 22 bp, Homo sapiens
ggagtgactcacagctgggaca

SEQ ID NO: 32689 - DNA, 22 bp, Homo sapiens
ggccactgacctacatctgggg

SEQ ID NO: 32690 - DNA, 22 bp, Homo sapiens
ggtggcagtagcactgggcctg

SEQ ID NO: 32691 - DNA, 22 bp, Homo sapiens
gtagctctgtttaaagttcttt

SEQ ID NO: 32692 - DNA, 22 bp, Homo sapiens
ccaggctagaaactgaggcaca

SEQ ID NO: 32693 - DNA, 22 bp, Homo sapiens
ggctgggcaggtctgcacaggg

SEQ ID NO: 32694 - DNA, 22 bp, Homo sapiens
agcctctcagagtgctgggatt

SEQ ID NO: 32695 - DNA, 19 bp, Homo sapiens
gggcaaagtgatcgtcctg

SEQ ID NO: 32696 - DNA, 22 bp, Homo sapiens
gtgaaatatttaacgtccaggt

SEQ ID NO: 32697 - DNA, 22 bp, Homo sapiens
cagcgtctcgttgtgggcctcg

SEQ ID NO: 32698 - DNA, 22 bp, Homo sapiens
tgtggggatcttctagcttttc

SEQ ID NO: 32699 - DNA, 22 bp, Homo sapiens
tgagatgtaaggtatgcttact

SEQ ID NO: 32700 - DNA, 23 bp, Homo sapiens
tcggtgggcgtggaggccgaggc

SEQ ID NO: 32701 - DNA, 22 bp, Homo sapiens
ttttctcttccctctggacctg

SEQ ID NO: 32702 - DNA, 22 bp, Homo sapiens
ggctgggctccgggagcatgcg

SEQ ID NO: 32703 - DNA, 22 bp, Homo sapiens
aggctctgtcaggcggagcagc

SEQ ID NO: 32704 - DNA, 18 bp, Homo sapiens
cccggctaatttttggta

SEQ ID NO: 32705 - DNA, 22 bp, Homo sapiens
tagtatagattgaagcagatca

SEQ ID NO: 32706 - DNA, 22 bp, Homo sapiens
cccaccagtacagatggtagat

SEQ ID NO: 32707 - DNA, 22 bp, Homo sapiens
gttggccaggctggtctcaaac

SEQ ID NO: 32708 - DNA, 22 bp, Homo sapiens
ctaggtgatccactgctctctt

SEQ ID NO: 32709 - DNA, 22 bp, Homo sapiens
tctgcaacagtgccctgtaaat

SEQ ID NO: 32710 - DNA, 22 bp, Homo sapiens
gcgcaccacctccaggtggccg

SEQ ID NO: 32711 - DNA, 22 bp, Homo sapiens
gcgccccatctacagtactttt

SEQ ID NO: 32712 - DNA, 22 bp, Homo sapiens
ctggagtagccggacgggtctg

SEQ ID NO: 32713 - DNA, 22 bp, Homo sapiens
ccgcccacactaaatatgagcg

SEQ ID NO: 32714 - DNA, 22 bp, Homo sapiens
ccctggctgcgtgatggatgaa

SEQ ID NO: 32715 - DNA, 17 bp, Homo sapiens
tggctctgtcctcagct

SEQ ID NO: 32716 - DNA, 22 bp, Homo sapiens
ggatgttctggggttctcttgt

SEQ ID NO: 32717 - DNA, 22 bp, Homo sapiens
tgcctaggctggagtgtagtgg

SEQ ID NO: 32718 - DNA, 23 bp, Homo sapiens
cctgcctccccatcagttataca

SEQ ID NO: 32719 - DNA, 22 bp, Homo sapiens
gttggccaggctggtctcaatc

SEQ ID NO: 32720 - DNA, 22 bp, Homo sapiens
tgggactcactcttttggccag

SEQ ID NO: 32721 - DNA, 22 bp, Homo sapiens
cgggttcacgccattctcctgc

SEQ ID NO: 32722 - DNA, 22 bp, Homo sapiens
atcttcccaggctggggagagg

SEQ ID NO: 32723 - DNA, 22 bp, Homo sapiens
cactgctacctctgcctcccgg

SEQ ID NO: 32724 - DNA, 22 bp, Homo sapiens
gccaggttgctgacgacgatct

SEQ ID NO: 32725 - DNA, 22 bp, Homo sapiens
tactgcgccttcaccaagcggc

SEQ ID NO: 32726 - DNA, 22 bp, Homo sapiens
tctcgctctgtcgcccaggctg

SEQ ID NO: 32727 - DNA, 22 bp, Homo sapiens
actgcaacctccgcctgccagg

SEQ ID NO: 32728 - DNA, 22 bp, Homo sapiens
ccccatgaagtagggtctctga

SEQ ID NO: 32729 - DNA, 23 bp, Homo sapiens
tgacctcatgatccgcccacctc

SEQ ID NO: 32730 - DNA, 21 bp, Homo sapiens
ctggccactgcacctcttcct

SEQ ID NO: 32731 - DNA, 22 bp, Homo sapiens
ggcctcacccatcggtgccttt

SEQ ID NO: 32732 - DNA, 19 bp, Homo sapiens
aatgtcagcatgttaattt

SEQ ID NO: 32733 - DNA, 22 bp, Homo sapiens
ggtttgttggggtccaggccca

SEQ ID NO: 32734 - DNA, 22 bp, Homo sapiens
gcttggccagcagccgggatgc

SEQ ID NO: 32735 - DNA, 22 bp, Homo sapiens
tagaggattttgcatttcatat

SEQ ID NO: 32736 - DNA, 22 bp, Homo sapiens
ccaggaggtggaggttgcggtg

SEQ ID NO: 32737 - DNA, 22 bp, Homo sapiens
tagcagcaaagcaggatctgct

SEQ ID NO: 32738 - DNA, 22 bp, Homo sapiens
cttgctttcagtctcggcctca

SEQ ID NO: 32739 - DNA, 19 bp, Homo sapiens
ggcttgtctcggcagccgc

SEQ ID NO: 32740 - DNA, 22 bp, Homo sapiens
tcgcgcccccaagcgtcattgg

SEQ ID NO: 32741 - DNA, 22 bp, Homo sapiens
gctggccacagatccccaggga

SEQ ID NO: 32742 - DNA, 22 bp, Homo sapiens
cacaaaccttctgcagcctgta

SEQ ID NO: 32743 - DNA, 19 bp, Homo sapiens
taaaacgtgcatggcagca

SEQ ID NO: 32744 - DNA, 22 bp, Homo sapiens
gacttttgaataaggtaggata

SEQ ID NO: 32745 - DNA, 22 bp, Homo sapiens
tcttgaattgtactcccataag

SEQ ID NO: 32746 - DNA, 22 bp, Homo sapiens
aatatgcactctgatttagcag

SEQ ID NO: 32747 - DNA, 22 bp, Homo sapiens
tgcttctgactaagctgcatga

SEQ ID NO: 32748 - DNA, 22 bp, Homo sapiens
tcttgggcatgtgtttgatttc

SEQ ID NO: 32749 - DNA, 22 bp, Homo sapiens
aagaagcattctttcattggtt

SEQ ID NO: 32750 - DNA, 22 bp, Homo sapiens
cacgactgttaccggacccatg

SEQ ID NO: 32751 - DNA, 22 bp, Homo sapiens
ttggatgggcattaggaaagtc

SEQ ID NO: 32752 - DNA, 17 bp, Homo sapiens
tgcatgtcctttgttcc

SEQ ID NO: 32753 - DNA, 22 bp, Homo sapiens
cactgcactccagcctgggaga

SEQ ID NO: 32754 - DNA, 22 bp, Homo sapiens
gccctagcgccagctcagcacc

SEQ ID NO: 32755 - DNA, 22 bp, Homo sapiens
cagcccaggactgcaggtgttt

SEQ ID NO: 32756 - DNA, 22 bp, Homo sapiens
aatctcatttacaacatgagga

SEQ ID NO: 32757 - DNA, 22 bp, Homo sapiens
ggatcagggctggggatattct

SEQ ID NO: 32758 - DNA, 22 bp, Homo sapiens
ggggctgaacctggaggtggtc

SEQ ID NO: 32759 - DNA, 22 bp, Homo sapiens
agttgggtttgtgtcagttgca

SEQ ID NO: 32760 - DNA, 22 bp, Homo sapiens
ctcactgcaagctctgcctcca

SEQ ID NO: 32761 - DNA, 22 bp, Homo sapiens
aaggccctggcaggaagcagga

SEQ ID NO: 32762 - DNA, 22 bp, Homo sapiens
aggcaaggtgctacagacagtg

SEQ ID NO: 32763 - DNA, 20 bp, Homo sapiens
aaaatatgtataactcttct

SEQ ID NO: 32764 - DNA, 22 bp, Homo sapiens
acaggggcaagggctcacggcc

SEQ ID NO: 32765 - DNA, 22 bp, Homo sapiens
tcaaattgtcatcttgataatg

SEQ ID NO: 32766 - DNA, 22 bp, Homo sapiens
ctggcctaggaatggttttccg

SEQ ID NO: 32767 - DNA, 22 bp, Homo sapiens
agggaagaggaccagagtctct

SEQ ID NO: 32768 - DNA, 22 bp, Homo sapiens
actgcaaagggaagccctttct

SEQ ID NO: 32769 - DNA, 22 bp, Homo sapiens
aaggtccttttgcagtgtgatc

SEQ ID NO: 32770 - DNA, 22 bp, Homo sapiens
tctctatttgcctaggcttgtg

SEQ ID NO: 32771 - DNA, 22 bp, Homo sapiens
ttgttcttgtctttgccttcac

SEQ ID NO: 32772 - DNA, 22 bp, Homo sapiens
gtgcccagcagcagcgtccccg

SEQ ID NO: 32773 - DNA, 22 bp, Homo sapiens
aaaagcaattgcagttcttgcc

SEQ ID NO: 32774 - DNA, 22 bp, Homo sapiens
ttcctagggcagagccgctggg

SEQ ID NO: 32775 - DNA, 22 bp, Homo sapiens
tgagctgcttcttataatgtgt

SEQ ID NO: 32776 - DNA, 20 bp, Homo sapiens
tcaggtgacacacgtggcac

SEQ ID NO: 32777 - DNA, 22 bp, Homo sapiens
tgtcttcagcagtcatctgggg

SEQ ID NO: 32778 - DNA, 22 bp, Homo sapiens
gaccatcctggccaacgtggta

SEQ ID NO: 32779 - DNA, 22 bp, Homo sapiens
tgcagtcttccagctgcacaaa

SEQ ID NO: 32780 - DNA, 22 bp, Homo sapiens
gggggctaccgtctctggagct

SEQ ID NO: 32781 - DNA, 22 bp, Homo sapiens
ttccctccatttcattttataa

SEQ ID NO: 32782 - DNA, 22 bp, Homo sapiens
cggagtcttgctatgttgccca

SEQ ID NO: 32783 - DNA, 22 bp, Homo sapiens
gagcagtaggagaaccctgagc

SEQ ID NO: 32784 - DNA, 22 bp, Homo sapiens
gacgagagactccatccaccac

SEQ ID NO: 32785 - DNA, 22 bp, Homo sapiens
tgatattttatgagctttcata

SEQ ID NO: 32786 - DNA, 22 bp, Homo sapiens
cccaggatggggctgcagttat

SEQ ID NO: 32787 - DNA, 22 bp, Homo sapiens
caccaggctggagtgcagtggc

SEQ ID NO: 32788 - DNA, 22 bp, Homo sapiens
agccctcttccagccagcacag

SEQ ID NO: 32789 - DNA, 22 bp, Homo sapiens
gcaaaaagtagtgctggttagg

SEQ ID NO: 32790 - DNA, 22 bp, Homo sapiens
taaattgagattattagggtaa

SEQ ID NO: 32791 - DNA, 22 bp, Homo sapiens
gcgggcgggggttcccaggtct

SEQ ID NO: 32792 - DNA, 22 bp, Homo sapiens
aaccaggtgactcatggtgagc

SEQ ID NO: 32793 - DNA, 22 bp, Homo sapiens
tacttttctataggtttgaaat

SEQ ID NO: 32794 - DNA, 22 bp, Homo sapiens
aacccgggaggtggaggttatg

SEQ ID NO: 32795 - DNA, 22 bp, Homo sapiens
ggcctttgcgtccacgccgctt

SEQ ID NO: 32796 - DNA, 22 bp, Homo sapiens
agaaagagatgaatgctttaag

SEQ ID NO: 32797 - DNA, 22 bp, Homo sapiens
tcaccagatctctctgtaatgg

SEQ ID NO: 32798 - DNA, 22 bp, Homo sapiens
gggacgacaggctctgtggtag

SEQ ID NO: 32799 - DNA, 22 bp, Homo sapiens
gagctcatccccatggtccgtc

SEQ ID NO: 32800 - DNA, 22 bp, Homo sapiens
aaagcagaactgagagagctgg

SEQ ID NO: 32801 - DNA, 22 bp, Homo sapiens
aaaagaggaactcttatatact

SEQ ID NO: 32802 - DNA, 21 bp, Homo sapiens
cggaaaggactagggctcaga

SEQ ID NO: 32803 - DNA, 22 bp, Homo sapiens
tcaaatgttccctgtactggcc

SEQ ID NO: 32804 - DNA, 22 bp, Homo sapiens
aatgttacgatcaacaacacat

SEQ ID NO: 32805 - DNA, 22 bp, Homo sapiens
tgagtagagaattcagctaagg

SEQ ID NO: 32806 - DNA, 22 bp, Homo sapiens
ctggtaggggtgactgttatcg

SEQ ID NO: 32807 - DNA, 22 bp, Homo sapiens
cggctgggttcggctgcaggcc

SEQ ID NO: 32808 - DNA, 22 bp, Homo sapiens
gcccagagttcaaggctgcagt

SEQ ID NO: 32809 - DNA, 22 bp, Homo sapiens
aaggggtgcaagttaatcagca

SEQ ID NO: 32810 - DNA, 22 bp, Homo sapiens
ggctagcaaggtagcagaatgc

SEQ ID NO: 32811 - DNA, 22 bp, Homo sapiens
cttctttcaagaatggattagg

SEQ ID NO: 32812 - DNA, 22 bp, Homo sapiens
agaaggggcccaaggatgtcag

SEQ ID NO: 32813 - DNA, 22 bp, Homo sapiens
gggtggaaagtatttggggacc

SEQ ID NO: 32814 - DNA, 22 bp, Homo sapiens
ttgagaaccactgagttagata

SEQ ID NO: 32815 - DNA, 22 bp, Homo sapiens
tccccatgtctgcagggagggt

SEQ ID NO: 32816 - DNA, 22 bp, Homo sapiens
gaggcctgggcaagggggtctg

SEQ ID NO: 32817 - DNA, 22 bp, Homo sapiens
gcagaggacacaggagggcaag

SEQ ID NO: 32818 - DNA, 22 bp, Homo sapiens
actgtactccaacctgggcaac

SEQ ID NO: 32819 - DNA, 22 bp, Homo sapiens
cccaggaggcgcaggttgcggt

SEQ ID NO: 32820 - DNA, 14 bp, Homo sapiens
aagatcaccttcct

SEQ ID NO: 32821 - DNA, 22 bp, Homo sapiens
gctggtagacctcactgcactc

SEQ ID NO: 32822 - DNA, 22 bp, Homo sapiens
ggctcttccgccaccagccaca

SEQ ID NO: 32823 - DNA, 22 bp, Homo sapiens
tgctgtgaggttgagaaggaag

SEQ ID NO: 32824 - DNA, 22 bp, Homo sapiens
gtccaagagtcaagaagggggc

SEQ ID NO: 32825 - DNA, 22 bp, Homo sapiens
aagtgctgggattacaggggtg

SEQ ID NO: 32826 - DNA, 22 bp, Homo sapiens
atttggcagtataaattctggc

SEQ ID NO: 32827 - DNA, 22 bp, Homo sapiens
tcctggtcttcaggttgcaaaa

SEQ ID NO: 32828 - DNA, 23 bp, Homo sapiens
aaaacagcttcctccagtggctc

SEQ ID NO: 32829 - DNA, 22 bp, Homo sapiens
attggccagacttatccttcag

SEQ ID NO: 32830 - DNA, 22 bp, Homo sapiens
aaattgcaaaagtacttttagg

SEQ ID NO: 32831 - DNA, 22 bp, Homo sapiens
agatacattgcacgatgcagat

SEQ ID NO: 32832 - DNA, 22 bp, Homo sapiens
ttgtgttaaggtgcatctagtg

SEQ ID NO: 32833 - DNA, 21 bp, Homo sapiens
acgggaatgaacatggtggag

SEQ ID NO: 32834 - DNA, 22 bp, Homo sapiens
atggagttctgccagcgctgct

SEQ ID NO: 32835 - DNA, 22 bp, Homo sapiens
gtccaaaagagccagccgggcg

SEQ ID NO: 32836 - DNA, 22 bp, Homo sapiens
ctgctttggacaactattcttg

SEQ ID NO: 32837 - DNA, 22 bp, Homo sapiens
ggctgggctccgggagcatgcg

SEQ ID NO: 32838 - DNA, 22 bp, Homo sapiens
taaatacttagttttgtgtcta

SEQ ID NO: 32839 - DNA, 22 bp, Homo sapiens
tggtatgcttattatcttcaac

SEQ ID NO: 32840 - DNA, 22 bp, Homo sapiens
gctctctgcagcctccttggag

SEQ ID NO: 32841 - DNA, 22 bp, Homo sapiens
gttgggaatttattccttttct

SEQ ID NO: 32842 - DNA, 22 bp, Homo sapiens
tctggcttccctctgttctggg

SEQ ID NO: 32843 - DNA, 22 bp, Homo sapiens
tcatcagcaccctatgtccttt

SEQ ID NO: 32844 - DNA, 20 bp, Homo sapiens
gtgtggccaggagctgcgct

SEQ ID NO: 32845 - DNA, 22 bp, Homo sapiens
actgagctccaagcctggaatc

SEQ ID NO: 32846 - DNA, 22 bp, Homo sapiens
tctcatttacttccacaggctg

SEQ ID NO: 32847 - DNA, 22 bp, Homo sapiens
tttctcatggaacatcgtttag

SEQ ID NO: 32848 - DNA, 22 bp, Homo sapiens
agctgccgatgcccagctgcat

SEQ ID NO: 32849 - DNA, 21 bp, Homo sapiens
tccttcagtctagatgattgt

SEQ ID NO: 32850 - DNA, 22 bp, Homo sapiens
cactccagcctcagtgacagag

SEQ ID NO: 32851 - DNA, 21 bp, Homo sapiens
gttcttgcaggatttccttcc

SEQ ID NO: 32852 - DNA, 22 bp, Homo sapiens
tattctcatcatcactggagct

SEQ ID NO: 32853 - DNA, 22 bp, Homo sapiens
ctgggctcaagtgatccaccca

SEQ ID NO: 32854 - DNA, 22 bp, Homo sapiens
gtctgaatacgtacttgtgaag

SEQ ID NO: 32855 - DNA, 22 bp, Homo sapiens
atttgtgggactataatgcagg

SEQ ID NO: 32856 - DNA, 22 bp, Homo sapiens
agtaatcaatttttcggtggat

SEQ ID NO: 32857 - DNA, 22 bp, Homo sapiens
agctggaagtgcatttctcact

SEQ ID NO: 32858 - DNA, 22 bp, Homo sapiens
ttcatatgtgaactcagtgatg

SEQ ID NO: 32859 - DNA, 22 bp, Homo sapiens
gtagatgagctcacatgacctt

SEQ ID NO: 32860 - DNA, 22 bp, Homo sapiens
tacaggcatgtagcatggtgat

SEQ ID NO: 32861 - DNA, 22 bp, Homo sapiens
gtctgttttctcttctgtggga

SEQ ID NO: 32862 - DNA, 22 bp, Homo sapiens
aggtcaccatggcatgctccac

SEQ ID NO: 32863 - DNA, 22 bp, Homo sapiens
tcacagcctggacagttgcctg

SEQ ID NO: 32864 - DNA, 22 bp, Homo sapiens
aaggctgaggcagtgaggcaga

SEQ ID NO: 32865 - DNA, 22 bp, Homo sapiens
gctcccaccttaaccttcacat

SEQ ID NO: 32866 - DNA, 17 bp, Homo sapiens
gcccgcggcccggggtg

SEQ ID NO: 32867 - DNA, 22 bp, Homo sapiens
actgtgtgtttgtctagcacag

SEQ ID NO: 32868 - DNA, 22 bp, Homo sapiens
tgcagcttcactcctgaagcca

SEQ ID NO: 32869 - DNA, 22 bp, Homo sapiens
aagcctaggcctactctggttt

SEQ ID NO: 32870 - DNA, 22 bp, Homo sapiens
tagctgcttgaccaggcagtgg

SEQ ID NO: 32871 - DNA, 22 bp, Homo sapiens
cccagttgttgccggctctgga

SEQ ID NO: 32872 - DNA, 20 bp, Homo sapiens
ttcaggaataagatagcagc

SEQ ID NO: 32873 - DNA, 22 bp, Homo sapiens
tacctcaagttccaggaaagcg

SEQ ID NO: 32874 - DNA, 22 bp, Homo sapiens
cccaggggttcaaggctgcagt

SEQ ID NO: 32875 - DNA, 22 bp, Homo sapiens
tacaaaaaattgatactgacga

SEQ ID NO: 32876 - DNA, 22 bp, Homo sapiens
gagagtgagatcctcctgggga

SEQ ID NO: 32877 - DNA, 18 bp, Homo sapiens
tgtagagccaggtttgcc

SEQ ID NO: 32878 - DNA, 22 bp, Homo sapiens
cgagagagacatggtgacctgc

SEQ ID NO: 32879 - DNA, 22 bp, Homo sapiens
caggtgttggaagggcagtggg

SEQ ID NO: 32880 - DNA, 22 bp, Homo sapiens
acactggttggttgaatttact

SEQ ID NO: 32881 - DNA, 22 bp, Homo sapiens
tggatctcggcaatgcgggact

SEQ ID NO: 32882 - DNA, 22 bp, Homo sapiens
ttgcagattcggctgctcagga

SEQ ID NO: 32883 - DNA, 22 bp, Homo sapiens
gtgggtggacggtgcttttgtt

SEQ ID NO: 32884 - DNA, 22 bp, Homo sapiens
gcccagcgagcagaggtggacg

SEQ ID NO: 32885 - DNA, 21 bp, Homo sapiens
aggtgctggcgccccaggaga

SEQ ID NO: 32886 - DNA, 22 bp, Homo sapiens
gcttcggggtccaagcgcgtgt

SEQ ID NO: 32887 - DNA, 22 bp, Homo sapiens
ttgcacagaatgacaatatgta

SEQ ID NO: 32888 - DNA, 22 bp, Homo sapiens
cttatagtatgatgttgagaat

SEQ ID NO: 32889 - DNA, 22 bp, Homo sapiens
ttaaattttagaaacagactct

SEQ ID NO: 32890 - DNA, 22 bp, Homo sapiens
tgatatgcatgtaagggagaca

SEQ ID NO: 32891 - DNA, 23 bp, Homo sapiens
gtgtggccccagggcctcctcgc

SEQ ID NO: 32892 - DNA, 22 bp, Homo sapiens
gtgagactcgcctttgtgtagc

SEQ ID NO: 32893 - DNA, 23 bp, Homo sapiens
tctctgcatgtcctgagcacatc

SEQ ID NO: 32894 - DNA, 22 bp, Homo sapiens
ttcagcttgctgactgcggcag

SEQ ID NO: 32895 - DNA, 22 bp, Homo sapiens
cattctcagtatcagccagccc

SEQ ID NO: 32896 - DNA, 22 bp, Homo sapiens
tagactagaggatcagcaaggg

SEQ ID NO: 32897 - DNA, 22 bp, Homo sapiens
agagtactgcctcagttatgaa

SEQ ID NO: 32898 - DNA, 22 bp, Homo sapiens
tcactcaggctggagtgcagtg

SEQ ID NO: 32899 - DNA, 22 bp, Homo sapiens
aagaactgagtacgttaataaa

SEQ ID NO: 32900 - DNA, 20 bp, Homo sapiens
aaattactgccacacatttc

SEQ ID NO: 32901 - DNA, 19 bp, Homo sapiens
cccaggaagcggaggttgc

SEQ ID NO: 32902 - DNA, 22 bp, Homo sapiens
gcggccttgtggcggagcaggc

SEQ ID NO: 32903 - DNA, 22 bp, Homo sapiens
ggccctggtcctaggggtggaa

SEQ ID NO: 32904 - DNA, 22 bp, Homo sapiens
caaagtgctggaattacaggtg

SEQ ID NO: 32905 - DNA, 22 bp, Homo sapiens
tttctaatctgattctcctacc

SEQ ID NO: 32906 - DNA, 22 bp, Homo sapiens
gcccagctgcaccctggtgggt

SEQ ID NO: 32907 - DNA, 22 bp, Homo sapiens
ttctttcagaacacaagtgatt

SEQ ID NO: 32908 - DNA, 22 bp, Homo sapiens
ggagttccagaccagactggcc

SEQ ID NO: 32909 - DNA, 22 bp, Homo sapiens
tcctcgatgggcaggaagatct

SEQ ID NO: 32910 - DNA, 22 bp, Homo sapiens
gtgagaaatgacaaatgtgtcg

SEQ ID NO: 32911 - DNA, 22 bp, Homo sapiens
cggccgcgtccagggccgccag

SEQ ID NO: 32912 - DNA, 22 bp, Homo sapiens
attgtcgtcaatggacacatag

SEQ ID NO: 32913 - DNA, 20 bp, Homo sapiens
cagagccagggttttgtttt

SEQ ID NO: 32914 - DNA, 22 bp, Homo sapiens
tgtaatactccattgtatggat

SEQ ID NO: 32915 - DNA, 22 bp, Homo sapiens
aagactgagtggcttaagaaaa

SEQ ID NO: 32916 - DNA, 22 bp, Homo sapiens
ttcactgcaacctccgcctccc

SEQ ID NO: 32917 - DNA, 22 bp, Homo sapiens
ggtgacctcacctggtcccacc

SEQ ID NO: 32918 - DNA, 22 bp, Homo sapiens
taggaatggtgctcagcagaaa

SEQ ID NO: 32919 - DNA, 22 bp, Homo sapiens
tggtggctcacgtctgtaatct

SEQ ID NO: 32920 - DNA, 22 bp, Homo sapiens
atcatgttttaattagcaaact

SEQ ID NO: 32921 - DNA, 22 bp, Homo sapiens
acaggtcctcaagtcagctggg

SEQ ID NO: 32922 - DNA, 21 bp, Homo sapiens
cccgcacagcggtaggccgcc

SEQ ID NO: 32923 - DNA, 22 bp, Homo sapiens
ctctcagtcctgcgcgcctctg

SEQ ID NO: 32924 - DNA, 22 bp, Homo sapiens
tcataaattctggtgctgtgag

SEQ ID NO: 32925 - DNA, 22 bp, Homo sapiens
tacagaagcttttgaaaagatg

SEQ ID NO: 32926 - DNA, 22 bp, Homo sapiens
acaccatactcatgttggttcc

SEQ ID NO: 32927 - DNA, 22 bp, Homo sapiens
aactatgttaataagtttcatt

SEQ ID NO: 32928 - DNA, 22 bp, Homo sapiens
tgtggcacatacacaggagggc

SEQ ID NO: 32929 - DNA, 22 bp, Homo sapiens
ttctgggcacacaggccctggt

SEQ ID NO: 32930 - DNA, 22 bp, Homo sapiens
ccttggcaggcacgtcctgcgg

SEQ ID NO: 32931 - DNA, 22 bp, Homo sapiens
tgggagcagttgcatctccagt

SEQ ID NO: 32932 - DNA, 22 bp, Homo sapiens
tgagtgacattttatattgcca

SEQ ID NO: 32933 - DNA, 22 bp, Homo sapiens
ctcacctccaggagctgctggc

SEQ ID NO: 32934 - DNA, 22 bp, Homo sapiens
gaagattgaaggctgggaatta

SEQ ID NO: 32935 - DNA, 22 bp, Homo sapiens
tcagcctgctccaagtgctgcc

SEQ ID NO: 32936 - DNA, 22 bp, Homo sapiens
gtcggccacgcaggtgcggtag

SEQ ID NO: 32937 - DNA, 22 bp, Homo sapiens
gagagcaggaggcagcgggacg

SEQ ID NO: 32938 - DNA, 22 bp, Homo sapiens
tgatttacagtagtgtctaaac

SEQ ID NO: 32939 - DNA, 22 bp, Homo sapiens
ggagcatgcgctctgtgaccga

SEQ ID NO: 32940 - DNA, 22 bp, Homo sapiens
agccaccaccactgaaaggtta

SEQ ID NO: 32941 - DNA, 22 bp, Homo sapiens
tgccctggctcttcttgttcca

SEQ ID NO: 32942 - DNA, 22 bp, Homo sapiens
taagtcaaggtggcatttgaga

SEQ ID NO: 32943 - DNA, 22 bp, Homo sapiens
cattggccttttatcctagagg

SEQ ID NO: 32944 - DNA, 22 bp, Homo sapiens
atggggctgttctctgccctgc

SEQ ID NO: 32945 - DNA, 22 bp, Homo sapiens
tttaatgtagcgtgaaatgatt

SEQ ID NO: 32946 - DNA, 22 bp, Homo sapiens
atcggcaagccccacaccgtcc

SEQ ID NO: 32947 - DNA, 22 bp, Homo sapiens
ttgggtgctgtcatggggcacg

SEQ ID NO: 32948 - DNA, 22 bp, Homo sapiens
atcctagaatcagcccttgctg

SEQ ID NO: 32949 - DNA, 22 bp, Homo sapiens
atcactgtgtatgtatatgcag

SEQ ID NO: 32950 - DNA, 19 bp, Homo sapiens
gcataaatacactattgtc

SEQ ID NO: 32951 - DNA, 22 bp, Homo sapiens
gtggatggagctggaagccatt

SEQ ID NO: 32952 - DNA, 22 bp, Homo sapiens
tctggctccaggaccgggcaca

SEQ ID NO: 32953 - DNA, 22 bp, Homo sapiens
gcagctctatgtgatggtaaat

SEQ ID NO: 32954 - DNA, 22 bp, Homo sapiens
ccaggagttggaggttgcagtg

SEQ ID NO: 32955 - DNA, 22 bp, Homo sapiens
gggagaggttacccgagcaact

SEQ ID NO: 32956 - DNA, 22 bp, Homo sapiens
acaagcatgggctttgacatca

SEQ ID NO: 32957 - DNA, 22 bp, Homo sapiens
tgccgcagtgcggggagggccc

SEQ ID NO: 32958 - DNA, 22 bp, Homo sapiens
tgggaggccaaggcaggcggat

SEQ ID NO: 32959 - DNA, 22 bp, Homo sapiens
gagtgtgtcggtcagcgtggcg

SEQ ID NO: 32960 - DNA, 23 bp, Homo sapiens
ttctgggctgtggaagcctcggg

SEQ ID NO: 32961 - DNA, 22 bp, Homo sapiens
gcagagctcatgcctgcacctc

SEQ ID NO: 32962 - DNA, 22 bp, Homo sapiens
cttttgtgattcctcagttact

SEQ ID NO: 32963 - DNA, 22 bp, Homo sapiens
aggcaagggggcgccaccttcc

SEQ ID NO: 32964 - DNA, 22 bp, Homo sapiens
agcgggtctgcaagccttccct

SEQ ID NO: 32965 - DNA, 22 bp, Homo sapiens
tggggtacttgtatcaaagcac

SEQ ID NO: 32966 - DNA, 22 bp, Homo sapiens
tgaactcctgacctcatgatcc

SEQ ID NO: 32967 - DNA, 22 bp, Homo sapiens
agcagctttcacctccccgcct

SEQ ID NO: 32968 - DNA, 22 bp, Homo sapiens
gaccttgtgatccacccgcttt

SEQ ID NO: 32969 - DNA, 22 bp, Homo sapiens
ttacaattacttgatctcagct

SEQ ID NO: 32970 - DNA, 22 bp, Homo sapiens
aggtcacccgtttgactatcca

SEQ ID NO: 32971 - DNA, 19 bp, Homo sapiens
aggcttcaggccacatgct

SEQ ID NO: 32972 - DNA, 22 bp, Homo sapiens
tgagtgaggctgggcagtccct

SEQ ID NO: 32973 - DNA, 22 bp, Homo sapiens
aagcacaatgaacatcttagat

SEQ ID NO: 32974 - DNA, 21 bp, Homo sapiens
ccgccacctctaagctgggtc

SEQ ID NO: 32975 - DNA, 22 bp, Homo sapiens
tgtggacgtcattaaagcagtg

SEQ ID NO: 32976 - DNA, 22 bp, Homo sapiens
aggattgtgcctccagtcagaa

SEQ ID NO: 32977 - DNA, 22 bp, Homo sapiens
gtggcctggctggcaccacctc

SEQ ID NO: 32978 - DNA, 22 bp, Homo sapiens
cgcaccactgaattccagcctg

SEQ ID NO: 32979 - DNA, 22 bp, Homo sapiens
gctgtctcatacaaggccctgc

SEQ ID NO: 32980 - DNA, 22 bp, Homo sapiens
gaccggttctgccgtggactgg

SEQ ID NO: 32981 - DNA, 22 bp, Homo sapiens
ggatgacccgagtctggggaac

SEQ ID NO: 32982 - DNA, 22 bp, Homo sapiens
gcggggcctgactctgacccgc

SEQ ID NO: 32983 - DNA, 22 bp, Homo sapiens
tatgaggtaggtattatactta

SEQ ID NO: 32984 - DNA, 22 bp, Homo sapiens
acaaagtgctgacattacaggc

SEQ ID NO: 32985 - DNA, 22 bp, Homo sapiens
ccctagtccacaggttcctgga

SEQ ID NO: 32986 - DNA, 18 bp, Homo sapiens
cagcctctgattggttgc

SEQ ID NO: 32987 - DNA, 22 bp, Homo sapiens
agaatagaattctcatagaatt

SEQ ID NO: 32988 - DNA, 22 bp, Homo sapiens
gtcacccgtttgactatccacc

SEQ ID NO: 32989 - DNA, 22 bp, Homo sapiens
gggaaactttcacaatgtccag

SEQ ID NO: 32990 - DNA, 19 bp, Homo sapiens
agagtattgaatttgccct

SEQ ID NO: 32991 - DNA, 22 bp, Homo sapiens
ggaatcgttaggtaagcaggga

SEQ ID NO: 32992 - DNA, 22 bp, Homo sapiens
tccaggattgcaggtgcacaac

SEQ ID NO: 32993 - DNA, 22 bp, Homo sapiens
gtggagagagataagcctggtc

SEQ ID NO: 32994 - DNA, 22 bp, Homo sapiens
tatttgtctggtctaaggaggg

SEQ ID NO: 32995 - DNA, 22 bp, Homo sapiens
atacaaagtattgatcctgagt

SEQ ID NO: 32996 - DNA, 22 bp, Homo sapiens
cttgaggctgcactccagggcc

SEQ ID NO: 32997 - DNA, 22 bp, Homo sapiens
tgaggcaggaggttgagaactg

SEQ ID NO: 32998 - DNA, 22 bp, Homo sapiens
gaaagacatagttgcaagatgg

SEQ ID NO: 32999 - DNA, 22 bp, Homo sapiens
ctgcatccatgttgctgcaaag

SEQ ID NO: 33000 - DNA, 22 bp, Homo sapiens
atgatccaaagccacaggggca

SEQ ID NO: 33001 - DNA, 22 bp, Homo sapiens
tgaagttgttaaggttgccatt

SEQ ID NO: 33002 - DNA, 22 bp, Homo sapiens
caggctgctgacaggcttggag

SEQ ID NO: 33003 - DNA, 22 bp, Homo sapiens
gatttagtggcccttggtacac

SEQ ID NO: 33004 - DNA, 22 bp, Homo sapiens
tcaagcaaagtttagctggtta

SEQ ID NO: 33005 - DNA, 22 bp, Homo sapiens
tcctccagttccttggtttcag

SEQ ID NO: 33006 - DNA, 19 bp, Homo sapiens
ccagagagctaggtacaga

SEQ ID NO: 33007 - DNA, 22 bp, Homo sapiens
gtacagtgggtgtagggaccag

SEQ ID NO: 33008 - DNA, 22 bp, Homo sapiens
tttacacagaggacactgggct

SEQ ID NO: 33009 - DNA, 22 bp, Homo sapiens
ctctggaccctcctgctgagag

SEQ ID NO: 33010 - DNA, 22 bp, Homo sapiens
tggagaattctatgttgagggg

SEQ ID NO: 33011 - DNA, 22 bp, Homo sapiens
ggtcccaggttgacagggagac

SEQ ID NO: 33012 - DNA, 22 bp, Homo sapiens
tctgagaaatttctttgtgatg

SEQ ID NO: 33013 - DNA, 22 bp, Homo sapiens
tgagcacatttcacatgacagg

SEQ ID NO: 33014 - DNA, 22 bp, Homo sapiens
gttaaggatcttgagatgagga

SEQ ID NO: 33015 - DNA, 18 bp, Homo sapiens
agagtatacagacaacaa

SEQ ID NO: 33016 - DNA, 23 bp, Homo sapiens
ccaagactgttaggagtggggag

SEQ ID NO: 33017 - DNA, 22 bp, Homo sapiens
tgggcaggggccctgcttccgt

SEQ ID NO: 33018 - DNA, 22 bp, Homo sapiens
aagcagcacagcaatgactcta

SEQ ID NO: 33019 - DNA, 21 bp, Homo sapiens
tgttttccaccttgaggcaag

SEQ ID NO: 33020 - DNA, 22 bp, Homo sapiens
aacttaggaaaataaggcatga

SEQ ID NO: 33021 - DNA, 22 bp, Homo sapiens
cagtgccagctgcttggcctac

SEQ ID NO: 33022 - DNA, 22 bp, Homo sapiens
gattgcgtctgtgtcaccttca

SEQ ID NO: 33023 - DNA, 22 bp, Homo sapiens
tttccctttagcctgagaatcc

SEQ ID NO: 33024 - DNA, 22 bp, Homo sapiens
gctgatggaaggacaggcgccg

SEQ ID NO: 33025 - DNA, 22 bp, Homo sapiens
ggtgggagccaacacccttctg

SEQ ID NO: 33026 - DNA, 22 bp, Homo sapiens
gttaagtgagggcttttgagtc

SEQ ID NO: 33027 - DNA, 22 bp, Homo sapiens
gaggtgggtgtatcacaggtca

SEQ ID NO: 33028 - DNA, 22 bp, Homo sapiens
tgaccaatactgtggatgccag

SEQ ID NO: 33029 - DNA, 22 bp, Homo sapiens
ttgagggtctggatctgctgct

SEQ ID NO: 33030 - DNA, 22 bp, Homo sapiens
tctgagaatggtggatgtggtg

SEQ ID NO: 33031 - DNA, 22 bp, Homo sapiens
gaggggcacagtaaagggtccc

SEQ ID NO: 33032 - DNA, 22 bp, Homo sapiens
tgtggttttggttcagaaacaa

SEQ ID NO: 33033 - DNA, 22 bp, Homo sapiens
cactgcaacctccacctcctgg

SEQ ID NO: 33034 - DNA, 18 bp, Homo sapiens
ggctcaagtgatcctcct

SEQ ID NO: 33035 - DNA, 22 bp, Homo sapiens
ccccacaactcatgttgaaact

SEQ ID NO: 33036 - DNA, 22 bp, Homo sapiens
caggtggcagtgcctgcattct

SEQ ID NO: 33037 - DNA, 22 bp, Homo sapiens
tctacctggagtccgttgttaa

SEQ ID NO: 33038 - DNA, 22 bp, Homo sapiens
acctagaatttaaaacattgct

SEQ ID NO: 33039 - DNA, 22 bp, Homo sapiens
tgacctattagatttccttgcc

SEQ ID NO: 33040 - DNA, 22 bp, Homo sapiens
ggcttagcaactcctgaggctc

SEQ ID NO: 33041 - DNA, 22 bp, Homo sapiens
actgattgcattcatagggttt

SEQ ID NO: 33042 - DNA, 22 bp, Homo sapiens
aaggatacttttagagcctgag

SEQ ID NO: 33043 - DNA, 20 bp, Homo sapiens
cctgtcatcccagcattttg

SEQ ID NO: 33044 - DNA, 22 bp, Homo sapiens
agccggccatgtggtcttgtgc

SEQ ID NO: 33045 - DNA, 22 bp, Homo sapiens
cgtgattggcttctgcattgga

SEQ ID NO: 33046 - DNA, 18 bp, Homo sapiens
tgagagcattcgaggcaa

SEQ ID NO: 33047 - DNA, 22 bp, Homo sapiens
tagatacctgctggacctcatt

SEQ ID NO: 33048 - DNA, 22 bp, Homo sapiens
gcaggcagatcacctgtcagga

SEQ ID NO: 33049 - DNA, 22 bp, Homo sapiens
gggctgcatcagcaggacccgg

SEQ ID NO: 33050 - DNA, 22 bp, Homo sapiens
atcccaggcggcacaggttgca

SEQ ID NO: 33051 - DNA, 22 bp, Homo sapiens
aggggctcctttgtgctgcgtc

SEQ ID NO: 33052 - DNA, 22 bp, Homo sapiens
gccagccagaaacgtcacactg

SEQ ID NO: 33053 - DNA, 22 bp, Homo sapiens
tggctgagttacgaacagagca

SEQ ID NO: 33054 - DNA, 22 bp, Homo sapiens
tgtccccacccaaatctcatct

SEQ ID NO: 33055 - DNA, 22 bp, Homo sapiens
tcacagagttaaaagtttcttt

SEQ ID NO: 33056 - DNA, 22 bp, Homo sapiens
taagtcatagattaatggccac

SEQ ID NO: 33057 - DNA, 22 bp, Homo sapiens
tcctagttctctgccagtcgct

SEQ ID NO: 33058 - DNA, 22 bp, Homo sapiens
gtctcctccctttcattcacct

SEQ ID NO: 33059 - DNA, 22 bp, Homo sapiens
tcagtttttctatactttgtag

SEQ ID NO: 33060 - DNA, 22 bp, Homo sapiens
tagggggctttgctgcttgaca

SEQ ID NO: 33061 - DNA, 22 bp, Homo sapiens
caatcaatgctgctagttcctt

SEQ ID NO: 33062 - DNA, 22 bp, Homo sapiens
tgcctcaagccctccactgcac

SEQ ID NO: 33063 - DNA, 22 bp, Homo sapiens
ggggtgggcgtgcagggacacc

SEQ ID NO: 33064 - DNA, 21 bp, Homo sapiens
gctgctcgagatccagtgctt

SEQ ID NO: 33065 - DNA, 22 bp, Homo sapiens
gcgcaccacctccaggtggccg

SEQ ID NO: 33066 - DNA, 22 bp, Homo sapiens
tgtgtctttgttccaggtacga

SEQ ID NO: 33067 - DNA, 22 bp, Homo sapiens
gtgtggaatggagtttttgccc

SEQ ID NO: 33068 - DNA, 20 bp, Homo sapiens
gttaggaggttggacatgga

SEQ ID NO: 33069 - DNA, 22 bp, Homo sapiens
caaatctctgctactagctatg

SEQ ID NO: 33070 - DNA, 22 bp, Homo sapiens
atttattcctttatggctggag

SEQ ID NO: 33071 - DNA, 22 bp, Homo sapiens
tcacttcgtaaacccctcccat

SEQ ID NO: 33072 - DNA, 22 bp, Homo sapiens
ggctgcaggttggttggcagct

SEQ ID NO: 33073 - DNA, 22 bp, Homo sapiens
tggcctctcctggctgagtttc

SEQ ID NO: 33074 - DNA, 22 bp, Homo sapiens
agtgggtgacagtgaacacgta

SEQ ID NO: 33075 - DNA, 22 bp, Homo sapiens
gaaagcatccgcctggaggtgg

SEQ ID NO: 33076 - DNA, 22 bp, Homo sapiens
tcgaaggaggcactcagacatg

SEQ ID NO: 33077 - DNA, 22 bp, Homo sapiens
tgaggcaggagttcaggctgcg

SEQ ID NO: 33078 - DNA, 22 bp, Homo sapiens
agctcaatgcaacctccgcctc

SEQ ID NO: 33079 - DNA, 21 bp, Homo sapiens
tcgtgcagcagctgaggcttg

SEQ ID NO: 33080 - DNA, 22 bp, Homo sapiens
ccaggagttggaggctgcagtg

SEQ ID NO: 33081 - DNA, 22 bp, Homo sapiens
gggcagagagctggaactcctt

SEQ ID NO: 33082 - DNA, 22 bp, Homo sapiens
atcttcccaggctggggagagg

SEQ ID NO: 33083 - DNA, 22 bp, Homo sapiens
aatactgcctgtgaggtaactc

SEQ ID NO: 33084 - DNA, 22 bp, Homo sapiens
agatgaatccacacatggcaaa

SEQ ID NO: 33085 - DNA, 22 bp, Homo sapiens
ccaggagctggagggtgcagtg

SEQ ID NO: 33086 - DNA, 22 bp, Homo sapiens
tacatagctcctagtgatgcat

SEQ ID NO: 33087 - DNA, 22 bp, Homo sapiens
agcggggtgttttgggtggcct

SEQ ID NO: 33088 - DNA, 22 bp, Homo sapiens
ctcccataattctcatatgtca

SEQ ID NO: 33089 - DNA, 22 bp, Homo sapiens
ctgaggcaggcagatcacttga

SEQ ID NO: 33090 - DNA, 19 bp, Homo sapiens
taccatccaagctggtttg

SEQ ID NO: 33091 - DNA, 22 bp, Homo sapiens
ctgtccagcgactaggggatgg

SEQ ID NO: 33092 - DNA, 22 bp, Homo sapiens
ctggctggagtgcaggtgagtg

SEQ ID NO: 33093 - DNA, 22 bp, Homo sapiens
ccccatgaagtagggtctctga

SEQ ID NO: 33094 - DNA, 22 bp, Homo sapiens
tggttacccagtcgctggagtt

SEQ ID NO: 33095 - DNA, 22 bp, Homo sapiens
atagaataatggttgtcaggag

SEQ ID NO: 33096 - DNA, 22 bp, Homo sapiens
gtccaggagctcagggcttatt

SEQ ID NO: 33097 - DNA, 22 bp, Homo sapiens
attcactgtgggtcctttggat

SEQ ID NO: 33098 - DNA, 22 bp, Homo sapiens
cctggctctgccacttactgcc

SEQ ID NO: 33099 - DNA, 22 bp, Homo sapiens
gttcccaccatgctgcacccat

SEQ ID NO: 33100 - DNA, 22 bp, Homo sapiens
gggcggggggagctggaatgaa

SEQ ID NO: 33101 - DNA, 22 bp, Homo sapiens
tgatctaggttggcttcaactg

SEQ ID NO: 33102 - DNA, 22 bp, Homo sapiens
gtgggccactgggaggcaaggg

SEQ ID NO: 33103 - DNA, 22 bp, Homo sapiens
tgaggcaggagaatcacatgaa

SEQ ID NO: 33104 - DNA, 22 bp, Homo sapiens
tagctgggactactggccctgc

SEQ ID NO: 33105 - DNA, 19 bp, Homo sapiens
ggagtttccaatgggtaaa

SEQ ID NO: 33106 - DNA, 22 bp, Homo sapiens
cagtggcctctggctttgctgt

SEQ ID NO: 33107 - DNA, 22 bp, Homo sapiens
ccgaggctggagtgcagtggcg

SEQ ID NO: 33108 - DNA, 22 bp, Homo sapiens
tctaatccttgctacctgggtg

SEQ ID NO: 33109 - DNA, 22 bp, Homo sapiens
ctggatgtccaggtagaagttt

SEQ ID NO: 33110 - DNA, 22 bp, Homo sapiens
aagaactgtttacaattttcac

SEQ ID NO: 33111 - DNA, 17 bp, Homo sapiens
tgtatttatcatgtcag

SEQ ID NO: 33112 - DNA, 22 bp, Homo sapiens
gcctgtgtggatgcgccggtgc

SEQ ID NO: 33113 - DNA, 22 bp, Homo sapiens
gtacaaatgcaggtttgttaca

SEQ ID NO: 33114 - DNA, 22 bp, Homo sapiens
gaaatctttgccttagctgtgt

SEQ ID NO: 33115 - DNA, 22 bp, Homo sapiens
ccttttgctctcccatccagaa

SEQ ID NO: 33116 - DNA, 22 bp, Homo sapiens
tacgggcacgcaccacgatgcc

SEQ ID NO: 33117 - DNA, 22 bp, Homo sapiens
gcagacgtcaccgagtcgatgg

SEQ ID NO: 33118 - DNA, 22 bp, Homo sapiens
accctggacatcttgtcatagc

SEQ ID NO: 33119 - DNA, 22 bp, Homo sapiens
tgggaagctgcattttaacaag

SEQ ID NO: 33120 - DNA, 22 bp, Homo sapiens
tatggctaattctttactgacc

SEQ ID NO: 33121 - DNA, 22 bp, Homo sapiens
ggcttggaaactagagtgtgca

SEQ ID NO: 33122 - DNA, 22 bp, Homo sapiens
ttcttctcagggtcccacatgg

SEQ ID NO: 33123 - DNA, 23 bp, Homo sapiens
tgagtgtgaaaatcctggagatg

SEQ ID NO: 33124 - DNA, 22 bp, Homo sapiens
tgaccacattgatttctcatcc

SEQ ID NO: 33125 - DNA, 22 bp, Homo sapiens
aggtacatggggtgtgtgcacg

SEQ ID NO: 33126 - DNA, 22 bp, Homo sapiens
gaggctgaggcggatggatcac

SEQ ID NO: 33127 - DNA, 22 bp, Homo sapiens
ttcctggtctatttagaattgc

SEQ ID NO: 33128 - DNA, 22 bp, Homo sapiens
aagtcattggtagcttgatagg

SEQ ID NO: 33129 - DNA, 22 bp, Homo sapiens
ttgtgaatagtgctgcagtaaa

SEQ ID NO: 33130 - DNA, 18 bp, Homo sapiens
actctttctgcccacagg

SEQ ID NO: 33131 - DNA, 22 bp, Homo sapiens
gtagaccatttatctggggagt

SEQ ID NO: 33132 - DNA, 22 bp, Homo sapiens
tggtggaattgtaaaatagtgt

SEQ ID NO: 33133 - DNA, 22 bp, Homo sapiens
gtttctctgtctgttacattgg

SEQ ID NO: 33134 - DNA, 22 bp, Homo sapiens
gtcgtggagctcacagtgtgcc

SEQ ID NO: 33135 - DNA, 22 bp, Homo sapiens
aggctcccaagcactgacccca

SEQ ID NO: 33136 - DNA, 19 bp, Homo sapiens
gcagacaggtccagagagg

SEQ ID NO: 33137 - DNA, 22 bp, Homo sapiens
agagggaagatggtccaatctt

SEQ ID NO: 33138 - DNA, 22 bp, Homo sapiens
atagagtgatgtaaggtatgtg

SEQ ID NO: 33139 - DNA, 22 bp, Homo sapiens
cttccgtgtcagttccaggtgg

SEQ ID NO: 33140 - DNA, 22 bp, Homo sapiens
gggccctgggattcagagcaag

SEQ ID NO: 33141 - DNA, 22 bp, Homo sapiens
acaagcgggccacagtgctggt

SEQ ID NO: 33142 - DNA, 22 bp, Homo sapiens
ttacctaaaatagctcaattta

SEQ ID NO: 33143 - DNA, 22 bp, Homo sapiens
ggttctctaactttgactggag

SEQ ID NO: 33144 - DNA, 22 bp, Homo sapiens
caaaatgcatctgagaccaggc

SEQ ID NO: 33145 - DNA, 22 bp, Homo sapiens
cagctggttgaagaggagctgg

SEQ ID NO: 33146 - DNA, 22 bp, Homo sapiens
actgcactccagcccgagcaac

SEQ ID NO: 33147 - DNA, 22 bp, Homo sapiens
agaagtatcaggaagattctca

SEQ ID NO: 33148 - DNA, 22 bp, Homo sapiens
tgtgccatgaggctctgatatg

SEQ ID NO: 33149 - DNA, 22 bp, Homo sapiens
atgtgctgagtgtgtatataca

SEQ ID NO: 33150 - DNA, 22 bp, Homo sapiens
agacgcgcagaaggaagcggcc

SEQ ID NO: 33151 - DNA, 22 bp, Homo sapiens
tccttgcagggtttgataaaga

SEQ ID NO: 33152 - DNA, 22 bp, Homo sapiens
tgcccaggctggagtgcagtgg

SEQ ID NO: 33153 - DNA, 22 bp, Homo sapiens
agtgaggggcagctgagtgggc

SEQ ID NO: 33154 - DNA, 22 bp, Homo sapiens
tcactgcactccagcctgggca

SEQ ID NO: 33155 - DNA, 22 bp, Homo sapiens
ccaagcaaataatcacccacta

SEQ ID NO: 33156 - DNA, 22 bp, Homo sapiens
aagtcagacagctgagctgcct

SEQ ID NO: 33157 - DNA, 22 bp, Homo sapiens
taattataacagttacatctta

SEQ ID NO: 33158 - DNA, 22 bp, Homo sapiens
taattataacatgctttctggc

SEQ ID NO: 33159 - DNA, 22 bp, Homo sapiens
ttgaggtcttcaggatcaggct

SEQ ID NO: 33160 - DNA, 22 bp, Homo sapiens
gcaacaatggaggtttggaggg

SEQ ID NO: 33161 - DNA, 22 bp, Homo sapiens
cctggaagttggaggttgcagt

SEQ ID NO: 33162 - DNA, 22 bp, Homo sapiens
atgagttgaagctacaagaggc

SEQ ID NO: 33163 - DNA, 22 bp, Homo sapiens
ggtgtctatgattcagtttatg

SEQ ID NO: 33164 - DNA, 22 bp, Homo sapiens
atttagtagagaaattaagaaa

SEQ ID NO: 33165 - DNA, 22 bp, Homo sapiens
tcaccttgtgatctccctgcct

SEQ ID NO: 33166 - DNA, 22 bp, Homo sapiens
agttgagggtgggagagaaatg

SEQ ID NO: 33167 - DNA, 23 bp, Homo sapiens
ttttgcaataagtcactggaata

SEQ ID NO: 33168 - DNA, 17 bp, Homo sapiens
tactgaggggtctggag

SEQ ID NO: 33169 - DNA, 22 bp, Homo sapiens
aggtcaagagtaaatttgggta

SEQ ID NO: 33170 - DNA, 22 bp, Homo sapiens
gaacttggaactggggctactg

SEQ ID NO: 33171 - DNA, 22 bp, Homo sapiens
ctcagctgcagcctggctggca

SEQ ID NO: 33172 - DNA, 19 bp, Homo sapiens
gctgaaggaggtgcctgca

SEQ ID NO: 33173 - DNA, 22 bp, Homo sapiens
cacactgtctttcagaatggtt

SEQ ID NO: 33174 - DNA, 22 bp, Homo sapiens
aagatactttgcatgcatgaag

SEQ ID NO: 33175 - DNA, 22 bp, Homo sapiens
gaccttgtgatccccctgcctt

SEQ ID NO: 33176 - DNA, 22 bp, Homo sapiens
tctgccttctatcttttgtctg

SEQ ID NO: 33177 - DNA, 22 bp, Homo sapiens
gctgtgcagaggtgagaatcca

SEQ ID NO: 33178 - DNA, 22 bp, Homo sapiens
cactctgcgctgggcgccagcg

SEQ ID NO: 33179 - DNA, 22 bp, Homo sapiens
cccaggaggcagagatagcagt

SEQ ID NO: 33180 - DNA, 22 bp, Homo sapiens
acaggatcgccctgttgcccag

SEQ ID NO: 33181 - DNA, 22 bp, Homo sapiens
ttggagagtgatattcagatgc

SEQ ID NO: 33182 - DNA, 22 bp, Homo sapiens
gatgatcatctgtaaagttaga

SEQ ID NO: 33183 - DNA, 22 bp, Homo sapiens
gctccctggtagccatgctctc

SEQ ID NO: 33184 - DNA, 22 bp, Homo sapiens
aggggaatgggtagactgttga

SEQ ID NO: 33185 - DNA, 23 bp, Homo sapiens
cggatttgactgaggtcctgcca

SEQ ID NO: 33186 - DNA, 22 bp, Homo sapiens
tttttgggtccaggctgtatct

SEQ ID NO: 33187 - DNA, 22 bp, Homo sapiens
ctcggcaggtggaggttgtagt

SEQ ID NO: 33188 - DNA, 22 bp, Homo sapiens
aggggatggagctggaaggcag

SEQ ID NO: 33189 - DNA, 22 bp, Homo sapiens
ggcaagagggcagatggagtgc

SEQ ID NO: 33190 - DNA, 22 bp, Homo sapiens
cactctgcagctgaagggctgg

SEQ ID NO: 33191 - DNA, 22 bp, Homo sapiens
aaaagcaattgcgggttttgcc

SEQ ID NO: 33192 - DNA, 22 bp, Homo sapiens
ccctgcctacagggttttcttt

SEQ ID NO: 33193 - DNA, 20 bp, Homo sapiens
attagctcaggtgaggtcat

SEQ ID NO: 33194 - DNA, 22 bp, Homo sapiens
aggaattcaagaccagctgggc

SEQ ID NO: 33195 - DNA, 22 bp, Homo sapiens
gacatagctcagagctcagcac

SEQ ID NO: 33196 - DNA, 22 bp, Homo sapiens
tcgtgaggctctgcatcgcaca

SEQ ID NO: 33197 - DNA, 22 bp, Homo sapiens
tatattgagatttgagcattgt

SEQ ID NO: 33198 - DNA, 22 bp, Homo sapiens
agaatttcctatgagagattcc

SEQ ID NO: 33199 - DNA, 22 bp, Homo sapiens
cctggaaagagaatgaatgagc

SEQ ID NO: 33200 - DNA, 22 bp, Homo sapiens
ttgccttcctgcccagcttctg

SEQ ID NO: 33201 - DNA, 22 bp, Homo sapiens
cttagatgaagtcacagaaccc

SEQ ID NO: 33202 - DNA, 22 bp, Homo sapiens
aaactgctttccacagtggcta

SEQ ID NO: 33203 - DNA, 23 bp, Homo sapiens
tcaactgctctgggaaggtcccc

SEQ ID NO: 33204 - DNA, 22 bp, Homo sapiens
tgagagttctctcttcaggtgg

SEQ ID NO: 33205 - DNA, 22 bp, Homo sapiens
tggcaccatcaaggctgagaac

SEQ ID NO: 33206 - DNA, 22 bp, Homo sapiens
ctctttggatagaattacaaag

SEQ ID NO: 33207 - DNA, 22 bp, Homo sapiens
agtggagacaggacagtcgata

SEQ ID NO: 33208 - DNA, 22 bp, Homo sapiens
ggctcagatggtttgttctaga

SEQ ID NO: 33209 - DNA, 22 bp, Homo sapiens
gcctcctgtcccaggctgagga

SEQ ID NO: 33210 - DNA, 22 bp, Homo sapiens
gtcagtaggaacctagggtcaa

SEQ ID NO: 33211 - DNA, 22 bp, Homo sapiens
cctgggccctcaccgccggtgg

SEQ ID NO: 33212 - DNA, 21 bp, Homo sapiens
tgcaatccagcctgggcgaca

SEQ ID NO: 33213 - DNA, 22 bp, Homo sapiens
agctttgtttgctcacccgccg

SEQ ID NO: 33214 - DNA, 19 bp, Homo sapiens
actgcactccagcctgggt

SEQ ID NO: 33215 - DNA, 20 bp, Homo sapiens
atgctttcttgtgtgctgct

SEQ ID NO: 33216 - DNA, 22 bp, Homo sapiens
gagagaagggggatatgagcct

SEQ ID NO: 33217 - DNA, 22 bp, Homo sapiens
gagaaatgcatgcatgtcatca

SEQ ID NO: 33218 - DNA, 22 bp, Homo sapiens
gagcctcagggttttgttgaca

SEQ ID NO: 33219 - DNA, 22 bp, Homo sapiens
tgggagcagcctcagcttcggg

SEQ ID NO: 33220 - DNA, 18 bp, Homo sapiens
ttgcttcttttctctagg

SEQ ID NO: 33221 - DNA, 22 bp, Homo sapiens
atacaatgacccgggtccaagg

SEQ ID NO: 33222 - DNA, 22 bp, Homo sapiens
cgtgcggcctcggggcccggct

SEQ ID NO: 33223 - DNA, 22 bp, Homo sapiens
ctcctccacccgctggggccca

SEQ ID NO: 33224 - DNA, 22 bp, Homo sapiens
agagcacagccaccatttacaa

SEQ ID NO: 33225 - DNA, 22 bp, Homo sapiens
ggtccccccatggtgagcactg

SEQ ID NO: 33226 - DNA, 22 bp, Homo sapiens
ccttacactgcctggggccacg

SEQ ID NO: 33227 - DNA, 22 bp, Homo sapiens
gagcctggagctggaacgaagc

SEQ ID NO: 33228 - DNA, 22 bp, Homo sapiens
gtcccataagtagtgcaacttg

SEQ ID NO: 33229 - DNA, 22 bp, Homo sapiens
gaggcagaggttgttgcagtga

SEQ ID NO: 33230 - DNA, 22 bp, Homo sapiens
cctcatcgtttccagaatgtgg

SEQ ID NO: 33231 - DNA, 22 bp, Homo sapiens
ctgaggtgtgaaatggtggcaa

SEQ ID NO: 33232 - DNA, 22 bp, Homo sapiens
accttgatggggctgttggagt

SEQ ID NO: 33233 - DNA, 22 bp, Homo sapiens
ggtgacagtggttaaaatttgt

SEQ ID NO: 33234 - DNA, 22 bp, Homo sapiens
ctgtctgtagacatttttggtt

SEQ ID NO: 33235 - DNA, 22 bp, Homo sapiens
tattcatagtaaacaaaagtgg

SEQ ID NO: 33236 - DNA, 22 bp, Homo sapiens
aggagaagccaagttgtgagca

SEQ ID NO: 33237 - DNA, 22 bp, Homo sapiens
atgtgccaacgtgcaggtttgt

SEQ ID NO: 33238 - DNA, 22 bp, Homo sapiens
tgcccagggtggagtgcagtgg

SEQ ID NO: 33239 - DNA, 22 bp, Homo sapiens
aaagtgctgagattacaagcgt

SEQ ID NO: 33240 - DNA, 22 bp, Homo sapiens
aaagtgctgggattacaggcgt

SEQ ID NO: 33241 - DNA, 22 bp, Homo sapiens
tgactcctggtatggatgacag

SEQ ID NO: 33242 - DNA, 23 bp, Homo sapiens
aatatcaaggtgatgttcccaga

SEQ ID NO: 33243 - DNA, 22 bp, Homo sapiens
tataactacttgaagagttcag

SEQ ID NO: 33244 - DNA, 22 bp, Homo sapiens
tagcccctgcctttgaacctgg

SEQ ID NO: 33245 - DNA, 22 bp, Homo sapiens
caatcactctgcaacattcctg

SEQ ID NO: 33246 - DNA, 22 bp, Homo sapiens
ccactgcacttcagcctgggtg

SEQ ID NO: 33247 - DNA, 22 bp, Homo sapiens
cgccggcttgaggcaggcggca

SEQ ID NO: 33248 - DNA, 22 bp, Homo sapiens
tcccagctactctagaggctga

SEQ ID NO: 33249 - DNA, 22 bp, Homo sapiens
tcactgcaacctctgcctcccg

SEQ ID NO: 33250 - DNA, 22 bp, Homo sapiens
ctggagggtggagagaagtctc

SEQ ID NO: 33251 - DNA, 22 bp, Homo sapiens
gagccaggttggaggctgcagt

SEQ ID NO: 33252 - DNA, 22 bp, Homo sapiens
tagatttgtttccttctctcca

SEQ ID NO: 33253 - DNA, 23 bp, Homo sapiens
tcagaacagttcttggtgcatag

SEQ ID NO: 33254 - DNA, 22 bp, Homo sapiens
tccaggattgtcagccagaagg

SEQ ID NO: 33255 - DNA, 22 bp, Homo sapiens
gccttgatctgctgtgtttgag

SEQ ID NO: 33256 - DNA, 22 bp, Homo sapiens
tcagcctggcaggatggcctgg

SEQ ID NO: 33257 - DNA, 22 bp, Homo sapiens
ttgtgctcctgtgagaatctag

SEQ ID NO: 33258 - DNA, 22 bp, Homo sapiens
gagcctcgtggcggccactgcg

SEQ ID NO: 33259 - DNA, 22 bp, Homo sapiens
ccaggctggagtgcaatggcgt

SEQ ID NO: 33260 - DNA, 22 bp, Homo sapiens
aaagccttcttgtatcgagcca

SEQ ID NO: 33261 - DNA, 22 bp, Homo sapiens
tggcatgcatctgttgtcctag

SEQ ID NO: 33262 - DNA, 22 bp, Homo sapiens
cggcatccccacttcctcctgc

SEQ ID NO: 33263 - DNA, 22 bp, Homo sapiens
cctggccgacatggtgaaacgc

SEQ ID NO: 33264 - DNA, 22 bp, Homo sapiens
aggtatatattctggtccttat

SEQ ID NO: 33265 - DNA, 19 bp, Homo sapiens
tggctctgtcgaaggcaca

SEQ ID NO: 33266 - DNA, 22 bp, Homo sapiens
atgccactgcgctccagcctgg

SEQ ID NO: 33267 - DNA, 22 bp, Homo sapiens
agggcgctgaaatactaacatg

SEQ ID NO: 33268 - DNA, 22 bp, Homo sapiens
attaaagctatccagtcatgaa

SEQ ID NO: 33269 - DNA, 22 bp, Homo sapiens
acagtatagggcttatattgta

SEQ ID NO: 33270 - DNA, 22 bp, Homo sapiens
actggggtttaggcctgggcaa

SEQ ID NO: 33271 - DNA, 22 bp, Homo sapiens
ttattgaaggaactgaaataaa

SEQ ID NO: 33272 - DNA, 22 bp, Homo sapiens
atggtgtttataggcaaagatc

SEQ ID NO: 33273 - DNA, 22 bp, Homo sapiens
gttaggtagaagtttactttga

SEQ ID NO: 33274 - DNA, 22 bp, Homo sapiens
ttggttttgaaatagcttattg

SEQ ID NO: 33275 - DNA, 22 bp, Homo sapiens
tccagcttataggtagatttaa

SEQ ID NO: 33276 - DNA, 22 bp, Homo sapiens
tcaagggcaaatgctacctata

SEQ ID NO: 33277 - DNA, 22 bp, Homo sapiens
tctgtgaagctctgaacagcag

SEQ ID NO: 33278 - DNA, 22 bp, Homo sapiens
ttgcatgttccaaagaattttg

SEQ ID NO: 33279 - DNA, 22 bp, Homo sapiens
gaccttgtgatccacccgcctt

SEQ ID NO: 33280 - DNA, 22 bp, Homo sapiens
tccttaggaaaatgatgagggg

SEQ ID NO: 33281 - DNA, 22 bp, Homo sapiens
gggctgagacgatggggtcttc

SEQ ID NO: 33282 - DNA, 19 bp, Homo sapiens
gactcacaccttccgctgt

SEQ ID NO: 33283 - DNA, 22 bp, Homo sapiens
cgcccaggctggagtgcagtgg

SEQ ID NO: 33284 - DNA, 20 bp, Homo sapiens
aggaaaaatggaaactggag

SEQ ID NO: 33285 - DNA, 22 bp, Homo sapiens
cttagctgcgggccctcctcgc

SEQ ID NO: 33286 - DNA, 22 bp, Homo sapiens
ctggcaggttatagagctgccc

SEQ ID NO: 33287 - DNA, 22 bp, Homo sapiens
aggacctactgatatcttagca

SEQ ID NO: 33288 - DNA, 22 bp, Homo sapiens
gcccccgtagtagatgaggcgc

SEQ ID NO: 33289 - DNA, 22 bp, Homo sapiens
tccagtttccaatcactgcacg

SEQ ID NO: 33290 - DNA, 22 bp, Homo sapiens
ttctcccatctcagtcttacat

SEQ ID NO: 33291 - DNA, 22 bp, Homo sapiens
cccaggaattggaggctgcagt

SEQ ID NO: 33292 - DNA, 22 bp, Homo sapiens
gcccttacagggtggtcagcca

SEQ ID NO: 33293 - DNA, 22 bp, Homo sapiens
tggaggctggagtgcagtggcg

SEQ ID NO: 33294 - DNA, 22 bp, Homo sapiens
gggggagagacgagcggctctg

SEQ ID NO: 33295 - DNA, 19 bp, Homo sapiens
ttttggaaatgtgaacagc

SEQ ID NO: 33296 - DNA, 22 bp, Homo sapiens
gcgagaaactaagtgccctttg

SEQ ID NO: 33297 - DNA, 22 bp, Homo sapiens
tgtacacatggtgtacactccc

SEQ ID NO: 33298 - DNA, 20 bp, Homo sapiens
ctgccgaccacagccatgga

SEQ ID NO: 33299 - DNA, 22 bp, Homo sapiens
tggggacttgccttgttgctca

SEQ ID NO: 33300 - DNA, 22 bp, Homo sapiens
tcctgaagaaggcagatatttg

SEQ ID NO: 33301 - DNA, 22 bp, Homo sapiens
gcccaggctggagtgcagtggt

SEQ ID NO: 33302 - DNA, 22 bp, Homo sapiens
gcagaagcacaggtgacgggcc

SEQ ID NO: 33303 - DNA, 22 bp, Homo sapiens
ggcttggaccagtcacagtggt

SEQ ID NO: 33304 - DNA, 22 bp, Homo sapiens
tactgtactgcagttctgcaaa

SEQ ID NO: 33305 - DNA, 22 bp, Homo sapiens
cctcggtttccacatctgtaca

SEQ ID NO: 33306 - DNA, 22 bp, Homo sapiens
tggcttccccggagtgacatgt

SEQ ID NO: 33307 - DNA, 22 bp, Homo sapiens
gctgcgccggatcccacgttcc

SEQ ID NO: 33308 - DNA, 19 bp, Homo sapiens
actgcactttagcctgggc

SEQ ID NO: 33309 - DNA, 22 bp, Homo sapiens
ccaggggggcgtagatgctggg

SEQ ID NO: 33310 - DNA, 22 bp, Homo sapiens
acagacaagtagttcagacaag

SEQ ID NO: 33311 - DNA, 21 bp, Homo sapiens
tctgccagctgaagaggtgga

SEQ ID NO: 33312 - DNA, 22 bp, Homo sapiens
aatccttatttgtctagttcca

SEQ ID NO: 33313 - DNA, 22 bp, Homo sapiens
gattgagtctgaggatgctgca

SEQ ID NO: 33314 - DNA, 22 bp, Homo sapiens
tttctcctcatgactggttgtg

SEQ ID NO: 33315 - DNA, 22 bp, Homo sapiens
tcctgagccctactctagacga

SEQ ID NO: 33316 - DNA, 22 bp, Homo sapiens
cagagatgtgatccagctgtct

SEQ ID NO: 33317 - DNA, 22 bp, Homo sapiens
tcaggggcttgaggtgcatgtc

SEQ ID NO: 33318 - DNA, 22 bp, Homo sapiens
acccagggctcaagcgtaggca

SEQ ID NO: 33319 - DNA, 22 bp, Homo sapiens
aaggccttgccgaaggatgcca

SEQ ID NO: 33320 - DNA, 22 bp, Homo sapiens
ggcctgcctcacagtcagcacc

SEQ ID NO: 33321 - DNA, 18 bp, Homo sapiens
tccaccgcgtgcacctct

SEQ ID NO: 33322 - DNA, 22 bp, Homo sapiens
agcctgggccctgcctcttctc

SEQ ID NO: 33323 - DNA, 22 bp, Homo sapiens
ctacattaaattggcttactta

SEQ ID NO: 33324 - DNA, 22 bp, Homo sapiens
attcttcctcatcaatctgtag

SEQ ID NO: 33325 - DNA, 22 bp, Homo sapiens
tcaaatgaagacagttgacttg

SEQ ID NO: 33326 - DNA, 22 bp, Homo sapiens
gggagaagaatgtgtcaattgt

SEQ ID NO: 33327 - DNA, 22 bp, Homo sapiens
caccagcagcggtgtgagggtg

SEQ ID NO: 33328 - DNA, 22 bp, Homo sapiens
agggaattcactggaacgccct

SEQ ID NO: 33329 - DNA, 23 bp, Homo sapiens
ctggggctttcaaatctgggcag

SEQ ID NO: 33330 - DNA, 22 bp, Homo sapiens
tctaccctgcggtcttggggca

SEQ ID NO: 33331 - DNA, 22 bp, Homo sapiens
tttgatccgttgctggtgagga

SEQ ID NO: 33332 - DNA, 20 bp, Homo sapiens
tgtgatgggttctttcctgg

SEQ ID NO: 33333 - DNA, 22 bp, Homo sapiens
ttttaagctacaagagacatat

SEQ ID NO: 33334 - DNA, 22 bp, Homo sapiens
cgtcatcacggcaagcatctcc

SEQ ID NO: 33335 - DNA, 22 bp, Homo sapiens
acgatgatgaaagagaacattc

SEQ ID NO: 33336 - DNA, 22 bp, Homo sapiens
atgctaaggcccaggagaaaat

SEQ ID NO: 33337 - DNA, 22 bp, Homo sapiens
aggtggggaggagtgtctcttt

SEQ ID NO: 33338 - DNA, 22 bp, Homo sapiens
aggctctgtcaggcggagcagc

SEQ ID NO: 33339 - DNA, 22 bp, Homo sapiens
attgtgtcctcattgaccttca

SEQ ID NO: 33340 - DNA, 22 bp, Homo sapiens
cagggcctcctaaggcatctaa

SEQ ID NO: 33341 - DNA, 22 bp, Homo sapiens
ccaccgccatggcgttgtacag

SEQ ID NO: 33342 - DNA, 22 bp, Homo sapiens
tacaaagtcttgggttctaggc

SEQ ID NO: 33343 - DNA, 22 bp, Homo sapiens
gtgccgcgacgcagtcggtgcc

SEQ ID NO: 33344 - DNA, 22 bp, Homo sapiens
gatcctggagctccatcactat

SEQ ID NO: 33345 - DNA, 22 bp, Homo sapiens
cccaggaagtggaggttgcagt

SEQ ID NO: 33346 - DNA, 22 bp, Homo sapiens
gtgtaagtatctttgtatcttt

SEQ ID NO: 33347 - DNA, 22 bp, Homo sapiens
cttctacacgtggctgtgccaa

SEQ ID NO: 33348 - DNA, 22 bp, Homo sapiens
ggcttcagtggccagagatgat

SEQ ID NO: 33349 - DNA, 22 bp, Homo sapiens
aaggctcggcaatgtgcggctc

SEQ ID NO: 33350 - DNA, 22 bp, Homo sapiens
aagaggttgtctgtgatgagtt

SEQ ID NO: 33351 - DNA, 22 bp, Homo sapiens
cccaggggttctgagcagcagc

SEQ ID NO: 33352 - DNA, 22 bp, Homo sapiens
caggccagggttgagaagagaa

SEQ ID NO: 33353 - DNA, 22 bp, Homo sapiens
tgctcgccccacatgccctcat

SEQ ID NO: 33354 - DNA, 22 bp, Homo sapiens
cattccttaacgtggggagtct

SEQ ID NO: 33355 - DNA, 22 bp, Homo sapiens
ccttctagcaaatcaacataaa

SEQ ID NO: 33356 - DNA, 22 bp, Homo sapiens
cactgcactccagcactccagc

SEQ ID NO: 33357 - DNA, 23 bp, Homo sapiens
tctcccaagcctggcaggggcac

SEQ ID NO: 33358 - DNA, 22 bp, Homo sapiens
actctggccatcttggaccttg

SEQ ID NO: 33359 - DNA, 22 bp, Homo sapiens
tacagctgcaagggtttctggg

SEQ ID NO: 33360 - DNA, 22 bp, Homo sapiens
gggttcagtccctcttgctact

SEQ ID NO: 33361 - DNA, 22 bp, Homo sapiens
tagcaaaggatgactatgtacc

SEQ ID NO: 33362 - DNA, 22 bp, Homo sapiens
aaggggtgagcagaggcttcgc

SEQ ID NO: 33363 - DNA, 22 bp, Homo sapiens
tgatctcctgaccttgtaatcc

SEQ ID NO: 33364 - DNA, 22 bp, Homo sapiens
agggagatcgaccgtgttatat

SEQ ID NO: 33365 - DNA, 22 bp, Homo sapiens
ttacaaagtttaaggtggcact

SEQ ID NO: 33366 - DNA, 22 bp, Homo sapiens
cacagcggcctccgatgctgat

SEQ ID NO: 33367 - DNA, 22 bp, Homo sapiens
acacagggctgcgcctgacccc

SEQ ID NO: 33368 - DNA, 22 bp, Homo sapiens
gttgaggtgatgccagccctgc

SEQ ID NO: 33369 - DNA, 22 bp, Homo sapiens
aaagtgctgggattacaagcgt

SEQ ID NO: 33370 - DNA, 22 bp, Homo sapiens
tctgcatattgttaatggaatg

SEQ ID NO: 33371 - DNA, 21 bp, Homo sapiens
ctctgaatcctgcttctcagt

SEQ ID NO: 33372 - DNA, 22 bp, Homo sapiens
ttccatacgactgaggtctcgg

SEQ ID NO: 33373 - DNA, 22 bp, Homo sapiens
ttggagaggcagtcttgctctg

SEQ ID NO: 33374 - DNA, 22 bp, Homo sapiens
atctgtcttttaatgttaatgc

SEQ ID NO: 33375 - DNA, 22 bp, Homo sapiens
gaatttcctctaaacccctgag

SEQ ID NO: 33376 - DNA, 22 bp, Homo sapiens
gaccctctagatggaagcactg

SEQ ID NO: 33377 - DNA, 22 bp, Homo sapiens
tcttgggggactttggcatgga

SEQ ID NO: 33378 - DNA, 22 bp, Homo sapiens
ggccctctttagacagagtagg

SEQ ID NO: 33379 - DNA, 22 bp, Homo sapiens
ttgaatctgggtacttgtaata

SEQ ID NO: 33380 - DNA, 20 bp, Homo sapiens
tgcctataaagggccaggta

SEQ ID NO: 33381 - DNA, 22 bp, Homo sapiens
ctgcaagctacccctagcatca

SEQ ID NO: 33382 - DNA, 22 bp, Homo sapiens
tacagctgctggtgctccatgc

SEQ ID NO: 33383 - DNA, 22 bp, Homo sapiens
gtggtggatgtctgtaatctca

SEQ ID NO: 33384 - DNA, 22 bp, Homo sapiens
tgtgattgtagtatacatatta

SEQ ID NO: 33385 - DNA, 22 bp, Homo sapiens
ggagtgactcacagctgggaca

SEQ ID NO: 33386 - DNA, 22 bp, Homo sapiens
gagatggagtctttttctgtca

SEQ ID NO: 33387 - DNA, 22 bp, Homo sapiens
acaatgaagctccactgagctt

SEQ ID NO: 33388 - DNA, 22 bp, Homo sapiens
gtgagcagagatcgcgtgattg

SEQ ID NO: 33389 - DNA, 22 bp, Homo sapiens
cagtctctaaatcaatctgaat

SEQ ID NO: 33390 - DNA, 22 bp, Homo sapiens
tatccgtgatgtttataaacca

SEQ ID NO: 33391 - DNA, 22 bp, Homo sapiens
ttgtgaaacattcatggatttg

SEQ ID NO: 33392 - DNA, 22 bp, Homo sapiens
gtggtgagattgctggatcaaa

SEQ ID NO: 33393 - DNA, 22 bp, Homo sapiens
aagaggtaaccatagcaaccac

SEQ ID NO: 33394 - DNA, 22 bp, Homo sapiens
cactgcactccagcctgggtga

SEQ ID NO: 33395 - DNA, 22 bp, Homo sapiens
ctttggaacacccagctctgtg

SEQ ID NO: 33396 - DNA, 22 bp, Homo sapiens
aaagtgctgggattataggcat

SEQ ID NO: 33397 - DNA, 17 bp, Homo sapiens
aatctgtttacagtcag

SEQ ID NO: 33398 - DNA, 22 bp, Homo sapiens
tccctgaggatggttgtattta

SEQ ID NO: 33399 - DNA, 22 bp, Homo sapiens
ggcatctggatctgcttctccc

SEQ ID NO: 33400 - DNA, 22 bp, Homo sapiens
tctgttgactcctagcagccat

SEQ ID NO: 33401 - DNA, 22 bp, Homo sapiens
gtactagagatgtgtgcgggta

SEQ ID NO: 33402 - DNA, 22 bp, Homo sapiens
ggcctctgccccgcggggctcg

SEQ ID NO: 33403 - DNA, 20 bp, Homo sapiens
tcagccattccttacctttc

SEQ ID NO: 33404 - DNA, 22 bp, Homo sapiens
gcggcgcctgggacccgccagc

SEQ ID NO: 33405 - DNA, 22 bp, Homo sapiens
gtgctgtttgggagaaggttct

SEQ ID NO: 33406 - DNA, 19 bp, Homo sapiens
ggcatggggtccggggacc

SEQ ID NO: 33407 - DNA, 22 bp, Homo sapiens
tgtgaagaattaatgtgaatca

SEQ ID NO: 33408 - DNA, 22 bp, Homo sapiens
ttctttgcccatgtttcctaag

SEQ ID NO: 33409 - DNA, 22 bp, Homo sapiens
agtgaccgaggcacttggcaac

SEQ ID NO: 33410 - DNA, 22 bp, Homo sapiens
gggagctggagctggaagactc

SEQ ID NO: 33411 - DNA, 21 bp, Homo sapiens
gaccccagaccagcagacaca

SEQ ID NO: 33412 - DNA, 22 bp, Homo sapiens
tggggtcagcaggcctggcctg

SEQ ID NO: 33413 - DNA, 22 bp, Homo sapiens
ggccgtgctccaaagtcatcgt

SEQ ID NO: 33414 - DNA, 22 bp, Homo sapiens
ctggcagagttgggtctcaaat

SEQ ID NO: 33415 - DNA, 22 bp, Homo sapiens
tggtggctcacacctgtaatcc

SEQ ID NO: 33416 - DNA, 19 bp, Homo sapiens
gggaatgatggaagacttc

SEQ ID NO: 33417 - DNA, 22 bp, Homo sapiens
tcaggaggcggaggttgcagtg

SEQ ID NO: 33418 - DNA, 22 bp, Homo sapiens
atctgagtcaaatatttcattt

SEQ ID NO: 33419 - DNA, 22 bp, Homo sapiens
ctgcttctagcaccaagtccct

SEQ ID NO: 33420 - DNA, 23 bp, Homo sapiens
aggtaggttattgctgctacctg

SEQ ID NO: 33421 - DNA, 22 bp, Homo sapiens
tattgtccaataggatgttcct

SEQ ID NO: 33422 - DNA, 22 bp, Homo sapiens
ctcctgagctctgaggaagctt

SEQ ID NO: 33423 - DNA, 22 bp, Homo sapiens
agcatggccatctgggccgtcc

SEQ ID NO: 33424 - DNA, 22 bp, Homo sapiens
ctgcaccgtgtctcgggctgcc

SEQ ID NO: 33425 - DNA, 22 bp, Homo sapiens
aggctgtgtgctccttatgaga

SEQ ID NO: 33426 - DNA, 22 bp, Homo sapiens
ttccgagtctccaaggggttgt

SEQ ID NO: 33427 - DNA, 22 bp, Homo sapiens
ctgtatttcttggacagttgct

SEQ ID NO: 33428 - DNA, 20 bp, Homo sapiens
agagatggggtatcaccgta

SEQ ID NO: 33429 - DNA, 22 bp, Homo sapiens
tcccagaaccctgccaggtcct

SEQ ID NO: 33430 - DNA, 20 bp, Homo sapiens
tgggatcgaatcaagtctgt

SEQ ID NO: 33431 - DNA, 22 bp, Homo sapiens
cacccaggctggattgcagtgg

SEQ ID NO: 33432 - DNA, 22 bp, Homo sapiens
gtccctgagcctggcatttccc

SEQ ID NO: 33433 - DNA, 22 bp, Homo sapiens
gagccaagctcttctccatgag

SEQ ID NO: 33434 - DNA, 22 bp, Homo sapiens
cgtgccactgcactctagcctg

SEQ ID NO: 33435 - DNA, 22 bp, Homo sapiens
ccacccttgggttcggaggccg

SEQ ID NO: 33436 - DNA, 22 bp, Homo sapiens
cagcagcattgctctggattcc

SEQ ID NO: 33437 - DNA, 22 bp, Homo sapiens
agaaggacccggtgggagatga

SEQ ID NO: 33438 - DNA, 22 bp, Homo sapiens
ctcagcttttcccggataggtg

SEQ ID NO: 33439 - DNA, 22 bp, Homo sapiens
tcccgtaggttgctgtagtcgg

SEQ ID NO: 33440 - DNA, 22 bp, Homo sapiens
ctgccctggggggcctccttgc

SEQ ID NO: 33441 - DNA, 20 bp, Homo sapiens
tgtcattcttctttcacagg

SEQ ID NO: 33442 - DNA, 22 bp, Homo sapiens
accgtgtctgacactttgggcg

SEQ ID NO: 33443 - DNA, 21 bp, Homo sapiens
cactccacttagaacagggtt

SEQ ID NO: 33444 - DNA, 22 bp, Homo sapiens
gggatcgtcatggaaagtgcta

SEQ ID NO: 33445 - DNA, 22 bp, Homo sapiens
actgcactccagcctgggtgat

SEQ ID NO: 33446 - DNA, 22 bp, Homo sapiens
ccaaggccttgaaggcgcgggg

SEQ ID NO: 33447 - DNA, 21 bp, Homo sapiens
tggtaggtactggcttcaggc

SEQ ID NO: 33448 - DNA, 22 bp, Homo sapiens
tccccagcttgctacttctgct

SEQ ID NO: 33449 - DNA, 22 bp, Homo sapiens
atgccacttcattccagcctcg

SEQ ID NO: 33450 - DNA, 22 bp, Homo sapiens
gctggcagacttcctctggaac

SEQ ID NO: 33451 - DNA, 22 bp, Homo sapiens
ttcctcaggctgctttcacata

SEQ ID NO: 33452 - DNA, 22 bp, Homo sapiens
caggaagctgtgaaggagacgg

SEQ ID NO: 33453 - DNA, 22 bp, Homo sapiens
gtgacaggccactgcggctctg

SEQ ID NO: 33454 - DNA, 22 bp, Homo sapiens
gagccaggggtcagctccgagg

SEQ ID NO: 33455 - DNA, 22 bp, Homo sapiens
aagtccaggtcctcattccatc

SEQ ID NO: 33456 - DNA, 22 bp, Homo sapiens
agaggggcccggttctccgtct

SEQ ID NO: 33457 - DNA, 22 bp, Homo sapiens
tctgaggctgaatggactccgt

SEQ ID NO: 33458 - DNA, 22 bp, Homo sapiens
tgtccttatctccaaacaatca

SEQ ID NO: 33459 - DNA, 22 bp, Homo sapiens
cctacagttatattcttgattg

SEQ ID NO: 33460 - DNA, 22 bp, Homo sapiens
ccaggaggcagaagttgcagtg

SEQ ID NO: 33461 - DNA, 22 bp, Homo sapiens
cctcgacctccccaggctcagg

SEQ ID NO: 33462 - DNA, 22 bp, Homo sapiens
ttttctgtttgcttcaagacat

SEQ ID NO: 33463 - DNA, 22 bp, Homo sapiens
tagcaccggcagtggtaggtgc

SEQ ID NO: 33464 - DNA, 22 bp, Homo sapiens
atgctctctgtcctgctcagag

SEQ ID NO: 33465 - DNA, 22 bp, Homo sapiens
ggaggtgactggatcatgggca

SEQ ID NO: 33466 - DNA, 22 bp, Homo sapiens
ttgaaaagttttgaaacactct

SEQ ID NO: 33467 - DNA, 22 bp, Homo sapiens
ttccggaaggttctctagaatt

SEQ ID NO: 33468 - DNA, 22 bp, Homo sapiens
agtgctgggctatctactgcta

SEQ ID NO: 33469 - DNA, 22 bp, Homo sapiens
aacggctgtggctggcggcagc

SEQ ID NO: 33470 - DNA, 22 bp, Homo sapiens
tctggtgtcagtattctttgaa

SEQ ID NO: 33471 - DNA, 22 bp, Homo sapiens
aagcacctgcaccggtcgcctt

SEQ ID NO: 33472 - DNA, 21 bp, Homo sapiens
ccagagcctgagaggattatg

SEQ ID NO: 33473 - DNA, 22 bp, Homo sapiens
gtcgtggtcagacaccagaaaa

SEQ ID NO: 33474 - DNA, 22 bp, Homo sapiens
ttcaggaagtgctgcctggtgt

SEQ ID NO: 33475 - DNA, 22 bp, Homo sapiens
tgacatttcctagtgctttgtg

SEQ ID NO: 33476 - DNA, 22 bp, Homo sapiens
gcttctcaattctcaccctcca

SEQ ID NO: 33477 - DNA, 22 bp, Homo sapiens
aaaatatgtataactcttctgc

SEQ ID NO: 33478 - DNA, 22 bp, Homo sapiens
tccaggctttggggcaggagcg

SEQ ID NO: 33479 - DNA, 21 bp, Homo sapiens
agatcctggggtctggggagg

SEQ ID NO: 33480 - DNA, 22 bp, Homo sapiens
tcttcctgtcaatgagaattaa

SEQ ID NO: 33481 - DNA, 22 bp, Homo sapiens
ggagctcctggcagtgacagag

SEQ ID NO: 33482 - DNA, 22 bp, Homo sapiens
ggaacagttgcgtcatgggcct

SEQ ID NO: 33483 - DNA, 20 bp, Homo sapiens
tgatatggtttggctgtgtt

SEQ ID NO: 33484 - DNA, 22 bp, Homo sapiens
ggaggctctgaccatttaccca

SEQ ID NO: 33485 - DNA, 22 bp, Homo sapiens
tgttcttaggtatttgacagtc

SEQ ID NO: 33486 - DNA, 22 bp, Homo sapiens
taaggctatcttttgagtgtgt

SEQ ID NO: 33487 - DNA, 22 bp, Homo sapiens
tgttatcctcagctcacctcta

SEQ ID NO: 33488 - DNA, 22 bp, Homo sapiens
atagttttaaaacctcaggaag

SEQ ID NO: 33489 - DNA, 22 bp, Homo sapiens
gtccacagctctgaggtctccc

SEQ ID NO: 33490 - DNA, 22 bp, Homo sapiens
atggatttgcttatacacatgt

SEQ ID NO: 33491 - DNA, 22 bp, Homo sapiens
ctgctcttcacactacacccgt

SEQ ID NO: 33492 - DNA, 22 bp, Homo sapiens
gctgctctccaagcctccttga

SEQ ID NO: 33493 - DNA, 22 bp, Homo sapiens
ggtccccgtggaggctggagcg

SEQ ID NO: 33494 - DNA, 22 bp, Homo sapiens
caggtgcctcaggatgagacaa

SEQ ID NO: 33495 - DNA, 20 bp, Homo sapiens
cgcccagtgcggttctgacc

SEQ ID NO: 33496 - DNA, 22 bp, Homo sapiens
gagggccctggctggctccagc

SEQ ID NO: 33497 - DNA, 22 bp, Homo sapiens
ttctccctgtcctatcaagact

SEQ ID NO: 33498 - DNA, 22 bp, Homo sapiens
cccacgtcgaacttgctccaga

SEQ ID NO: 33499 - DNA, 22 bp, Homo sapiens
tttgtgaataggttggcttcca

SEQ ID NO: 33500 - DNA, 22 bp, Homo sapiens
ttgtccttcttcattcagtccc

SEQ ID NO: 33501 - DNA, 22 bp, Homo sapiens
tctcgatctcctgaccttgtga

SEQ ID NO: 33502 - DNA, 22 bp, Homo sapiens
ctagttctagatccctgaggaa

SEQ ID NO: 33503 - DNA, 22 bp, Homo sapiens
tcctgggacaagccgtggaagt

SEQ ID NO: 33504 - DNA, 22 bp, Homo sapiens
ctgaagcagggagtgatgaagt

SEQ ID NO: 33505 - DNA, 22 bp, Homo sapiens
gcttggcccattgatcagctgg

SEQ ID NO: 33506 - DNA, 22 bp, Homo sapiens
cctgcacagccggacccctgct

SEQ ID NO: 33507 - DNA, 22 bp, Homo sapiens
tgttgatttgtgggctgcaaaa

SEQ ID NO: 33508 - DNA, 20 bp, Homo sapiens
aggggcacctgcgacggggc

SEQ ID NO: 33509 - DNA, 22 bp, Homo sapiens
ttccactctacacactgctggc

SEQ ID NO: 33510 - DNA, 22 bp, Homo sapiens
gcaggtggatcacctgaggtca

SEQ ID NO: 33511 - DNA, 22 bp, Homo sapiens
gctgcacagacttgctcattta

SEQ ID NO: 33512 - DNA, 22 bp, Homo sapiens
gggcagagactcagaaacagaa

SEQ ID NO: 33513 - DNA, 23 bp, Homo sapiens
agctataaaatctgtgacagcag

SEQ ID NO: 33514 - DNA, 22 bp, Homo sapiens
tgagatggagccactgcactct

SEQ ID NO: 33515 - DNA, 22 bp, Homo sapiens
tgtggccattcttgaggtcgac

SEQ ID NO: 33516 - DNA, 22 bp, Homo sapiens
acttaccagagaggatccgccc

SEQ ID NO: 33517 - DNA, 22 bp, Homo sapiens
acggcaggctcagagctggaat

SEQ ID NO: 33518 - DNA, 22 bp, Homo sapiens
tccgggcaactgaagggaggtt

SEQ ID NO: 33519 - DNA, 22 bp, Homo sapiens
gtcagtgtcttaacagagatta

SEQ ID NO: 33520 - DNA, 22 bp, Homo sapiens
aagagaattctggttttcctat

SEQ ID NO: 33521 - DNA, 22 bp, Homo sapiens
ggcgtttcaccatgttgaccag

SEQ ID NO: 33522 - DNA, 22 bp, Homo sapiens
tggtgctgccaggctcctgcca

SEQ ID NO: 33523 - DNA, 22 bp, Homo sapiens
gagccccaccctagacattctg

SEQ ID NO: 33524 - DNA, 22 bp, Homo sapiens
ggaggtagcctcaaaagcagct

SEQ ID NO: 33525 - DNA, 22 bp, Homo sapiens
cagcctgccgtcagccaggtag

SEQ ID NO: 33526 - DNA, 22 bp, Homo sapiens
agcttgtgtttttctaagtatc

SEQ ID NO: 33527 - DNA, 22 bp, Homo sapiens
tgtttcctttctggtgagcata

SEQ ID NO: 33528 - DNA, 22 bp, Homo sapiens
tctttggatggaaattggagtc

SEQ ID NO: 33529 - DNA, 22 bp, Homo sapiens
caagtagaacagagctaccttg

SEQ ID NO: 33530 - DNA, 20 bp, Homo sapiens
gggaagtcccgcctgtcttc

SEQ ID NO: 33531 - DNA, 22 bp, Homo sapiens
ttgggcctctcaaagtgctggg

SEQ ID NO: 33532 - DNA, 22 bp, Homo sapiens
gtgggacaaggatgaagatatt

SEQ ID NO: 33533 - DNA, 22 bp, Homo sapiens
caaatgaatatttccatgggtt

SEQ ID NO: 33534 - DNA, 22 bp, Homo sapiens
aggtaggcctgacgctggggtg

SEQ ID NO: 33535 - DNA, 22 bp, Homo sapiens
tgccctctttctgtacagctcc

SEQ ID NO: 33536 - DNA, 22 bp, Homo sapiens
agcaacccgtccttgggggact

SEQ ID NO: 33537 - DNA, 22 bp, Homo sapiens
atggatggaactctgctgtggt

SEQ ID NO: 33538 - DNA, 22 bp, Homo sapiens
gtaggtcagacataagaggaca

SEQ ID NO: 33539 - DNA, 22 bp, Homo sapiens
aaccaccattctctcctcttcc

SEQ ID NO: 33540 - DNA, 22 bp, Homo sapiens
cggggttcatccatgctgtggc

SEQ ID NO: 33541 - DNA, 22 bp, Homo sapiens
gaggtggctgcttgctgggaaa

SEQ ID NO: 33542 - DNA, 22 bp, Homo sapiens
gactggaaagcctgtcctcaga

SEQ ID NO: 33543 - DNA, 22 bp, Homo sapiens
gacccacctcaccaagcatgtg

SEQ ID NO: 33544 - DNA, 22 bp, Homo sapiens
agaggcagtatacaatccgagc

SEQ ID NO: 33545 - DNA, 22 bp, Homo sapiens
aaactgaggctcccgagggtgt

SEQ ID NO: 33546 - DNA, 22 bp, Homo sapiens
tcaccttgtgatccgcccacct

SEQ ID NO: 33547 - DNA, 22 bp, Homo sapiens
tctcagaacctcagtttgctct

SEQ ID NO: 33548 - DNA, 22 bp, Homo sapiens
gaattttattactagtcaactg

SEQ ID NO: 33549 - DNA, 16 bp, Homo sapiens
gcgcctcctcggcctc

SEQ ID NO: 33550 - DNA, 22 bp, Homo sapiens
aaggttcctctctccacccagc

SEQ ID NO: 33551 - DNA, 22 bp, Homo sapiens
ggctggtgttgagtgcctgtag

SEQ ID NO: 33552 - DNA, 22 bp, Homo sapiens
tcagtgcacccaattctctcca

SEQ ID NO: 33553 - DNA, 18 bp, Homo sapiens
ttcacaagggcttggttt

SEQ ID NO: 33554 - DNA, 19 bp, Homo sapiens
cttgaaactactgttgaga

SEQ ID NO: 33555 - DNA, 22 bp, Homo sapiens
aggatttctgtgcctggaaaat

SEQ ID NO: 33556 - DNA, 22 bp, Homo sapiens
gttgcctaggctggtcttgaac

SEQ ID NO: 33557 - DNA, 22 bp, Homo sapiens
ggggcaggagcccttcttcagc

SEQ ID NO: 33558 - DNA, 22 bp, Homo sapiens
taactctgaatcctcacagcag

SEQ ID NO: 33559 - DNA, 22 bp, Homo sapiens
tacatttataaggcttctctgt

SEQ ID NO: 33560 - DNA, 22 bp, Homo sapiens
accctactaaatgtggtatgtc

SEQ ID NO: 33561 - DNA, 22 bp, Homo sapiens
aaggctgagacagcacaggtcc

SEQ ID NO: 33562 - DNA, 22 bp, Homo sapiens
agtgccctttacaacttcttga

SEQ ID NO: 33563 - DNA, 22 bp, Homo sapiens
taaacgtgcttcatatttttag

SEQ ID NO: 33564 - DNA, 22 bp, Homo sapiens
cccaggaggcagatgttgcagt

SEQ ID NO: 33565 - DNA, 22 bp, Homo sapiens
tgtcctcatcctccagtctgtc

SEQ ID NO: 33566 - DNA, 22 bp, Homo sapiens
ggagtgcaatggcgtgatctca

SEQ ID NO: 33567 - DNA, 22 bp, Homo sapiens
aattcacatccgaccaggtcaa

SEQ ID NO: 33568 - DNA, 22 bp, Homo sapiens
tccagcccaggctggagtgtag

SEQ ID NO: 33569 - DNA, 22 bp, Homo sapiens
gttctgagtcctcctttgaagg

SEQ ID NO: 33570 - DNA, 22 bp, Homo sapiens
tgataaacttagaaagaatgtt

SEQ ID NO: 33571 - DNA, 22 bp, Homo sapiens
gtgcgtcctgggggctgggtcg

SEQ ID NO: 33572 - DNA, 22 bp, Homo sapiens
ttttctagggtgctaaatgaac

SEQ ID NO: 33573 - DNA, 22 bp, Homo sapiens
ctgccttttaaagccagtgtta

SEQ ID NO: 33574 - DNA, 22 bp, Homo sapiens
ataatggtagatgtccacgcag

SEQ ID NO: 33575 - DNA, 22 bp, Homo sapiens
ggagggcagagtcccctgctga

SEQ ID NO: 33576 - DNA, 23 bp, Homo sapiens
ggggcctgcaccggtctgcgcgg

SEQ ID NO: 33577 - DNA, 22 bp, Homo sapiens
ccaggctgctgttggtgtccgc

SEQ ID NO: 33578 - DNA, 22 bp, Homo sapiens
gtgggggctggaaatcttgcca

SEQ ID NO: 33579 - DNA, 22 bp, Homo sapiens
acccgatgttggtgctctagta

SEQ ID NO: 33580 - DNA, 22 bp, Homo sapiens
aggaagatgtgcaaagttggaa

SEQ ID NO: 33581 - DNA, 22 bp, Homo sapiens
tttctataaaaagtgctaggat

SEQ ID NO: 33582 - DNA, 22 bp, Homo sapiens
gtgaaatatttaacgtccaggt

SEQ ID NO: 33583 - DNA, 22 bp, Homo sapiens
tgcctccctggcaagtctctcc

SEQ ID NO: 33584 - DNA, 22 bp, Homo sapiens
tcccgttgatgacggtgcatcc

SEQ ID NO: 33585 - DNA, 22 bp, Homo sapiens
aacatgatttcatgcatttaga

SEQ ID NO: 33586 - DNA, 22 bp, Homo sapiens
acaattctgatggtttcccagt

SEQ ID NO: 33587 - DNA, 22 bp, Homo sapiens
accattgccccctagtgtctgt

SEQ ID NO: 33588 - DNA, 22 bp, Homo sapiens
cagatgtacatgaagggcaatg

SEQ ID NO: 33589 - DNA, 22 bp, Homo sapiens
tgacagaactcattctcaccaa

SEQ ID NO: 33590 - DNA, 22 bp, Homo sapiens
accttcaggtgagcacacagat

SEQ ID NO: 33591 - DNA, 22 bp, Homo sapiens
tgccatagcaatggtaagctga

SEQ ID NO: 33592 - DNA, 22 bp, Homo sapiens
ggatgttctggggttctcttgt

SEQ ID NO: 33593 - DNA, 22 bp, Homo sapiens
tctagctctgcttatcatggct

SEQ ID NO: 33594 - DNA, 23 bp, Homo sapiens
aatgggtgcaactatccatgaca

SEQ ID NO: 33595 - DNA, 22 bp, Homo sapiens
gacccggctccaggcccagcag

SEQ ID NO: 33596 - DNA, 22 bp, Homo sapiens
tttaagaagttatgttataaat

SEQ ID NO: 33597 - DNA, 22 bp, Homo sapiens
ctcgcggcgcccgaagcccttg

SEQ ID NO: 33598 - DNA, 22 bp, Homo sapiens
ctgggaggcagaggttgcagtg

SEQ ID NO: 33599 - DNA, 22 bp, Homo sapiens
tgtactgtatcattgcaacttt

SEQ ID NO: 33600 - DNA, 22 bp, Homo sapiens
ctgtggctctcagaggctgctg

SEQ ID NO: 33601 - DNA, 23 bp, Homo sapiens
agcaatctgtgtttcagcaagcc

SEQ ID NO: 33602 - DNA, 22 bp, Homo sapiens
cgcgaggtggaggttgcagtga

SEQ ID NO: 33603 - DNA, 22 bp, Homo sapiens
agacggctggcagtgagcggct

SEQ ID NO: 33604 - DNA, 22 bp, Homo sapiens
tttccctgtgaatatttaaaga

SEQ ID NO: 33605 - DNA, 22 bp, Homo sapiens
atatttgcattttaaacaggca

SEQ ID NO: 33606 - DNA, 22 bp, Homo sapiens
tatttcttttcgtgacttattg

SEQ ID NO: 33607 - DNA, 22 bp, Homo sapiens
ggaagaaaggtggacaacaggt

SEQ ID NO: 33608 - DNA, 22 bp, Homo sapiens
gttgagtgggttaggatgctga

SEQ ID NO: 33609 - DNA, 22 bp, Homo sapiens
atgttgactcagagtgagggta

SEQ ID NO: 33610 - DNA, 22 bp, Homo sapiens
tcaccggcagacgtggcctgat

SEQ ID NO: 33611 - DNA, 22 bp, Homo sapiens
gaacgggtgcagccatgggccc

SEQ ID NO: 33612 - DNA, 22 bp, Homo sapiens
ctgtggtcatgagtccttccat

SEQ ID NO: 33613 - DNA, 22 bp, Homo sapiens
cttccttctcactagcagcgcc

SEQ ID NO: 33614 - DNA, 22 bp, Homo sapiens
aagcctggcacattggagtctg

SEQ ID NO: 33615 - DNA, 18 bp, Homo sapiens
aggagcggctgcggctgc

SEQ ID NO: 33616 - DNA, 22 bp, Homo sapiens
gacggagctggttgctgcggct

SEQ ID NO: 33617 - DNA, 20 bp, Homo sapiens
ttgagcagcagtgctgtgtc

SEQ ID NO: 33618 - DNA, 23 bp, Homo sapiens
tgaatgtttattctcggtgcaga

SEQ ID NO: 33619 - DNA, 22 bp, Homo sapiens
agtatgtcagagtgaaaatggt

SEQ ID NO: 33620 - DNA, 22 bp, Homo sapiens
caggaaggggctcactctggcc

SEQ ID NO: 33621 - DNA, 22 bp, Homo sapiens
atgtttaaagggttgagaaata

SEQ ID NO: 33622 - DNA, 22 bp, Homo sapiens
aggctagaggcttctggcttca

SEQ ID NO: 33623 - DNA, 22 bp, Homo sapiens
gcacatccaatgattgttttga

SEQ ID NO: 33624 - DNA, 22 bp, Homo sapiens
gggcaccttgggtctcaggcaa

SEQ ID NO: 33625 - DNA, 22 bp, Homo sapiens
cacttgttggtggtgaaatcac

SEQ ID NO: 33626 - DNA, 22 bp, Homo sapiens
ctgctttgcatagctgccagag

SEQ ID NO: 33627 - DNA, 22 bp, Homo sapiens
tcttaattctgtgtcttcacta

SEQ ID NO: 33628 - DNA, 22 bp, Homo sapiens
tgtttacagctgatcaggcatc

SEQ ID NO: 33629 - DNA, 22 bp, Homo sapiens
ttgagtgtactttagtcatctg

SEQ ID NO: 33630 - DNA, 22 bp, Homo sapiens
gcttctgagttcttgcttaata

SEQ ID NO: 33631 - DNA, 22 bp, Homo sapiens
tgaagactcagaagctaagata

SEQ ID NO: 33632 - DNA, 22 bp, Homo sapiens
cagggtgacaagtggcaaggag

SEQ ID NO: 33633 - DNA, 22 bp, Homo sapiens
cttcaggggtgttagttttgtg

SEQ ID NO: 33634 - DNA, 22 bp, Homo sapiens
atctattttaaatggcagtaaa

SEQ ID NO: 33635 - DNA, 22 bp, Homo sapiens
ggccggggcctgctcgcctgtg

SEQ ID NO: 33636 - DNA, 23 bp, Homo sapiens
catcatgcaatcttgggatttct

SEQ ID NO: 33637 - DNA, 22 bp, Homo sapiens
gcccaggaggcagaggttgtgg

SEQ ID NO: 33638 - DNA, 22 bp, Homo sapiens
gactcgctcccttttgtcttat

SEQ ID NO: 33639 - DNA, 18 bp, Homo sapiens
ccctgccagctcccagca

SEQ ID NO: 33640 - DNA, 22 bp, Homo sapiens
ccaggtgtgctctgcagtggat

SEQ ID NO: 33641 - DNA, 22 bp, Homo sapiens
acttttaaatgagtttcagttg

SEQ ID NO: 33642 - DNA, 22 bp, Homo sapiens
agcaggagtttgatgcttttat

SEQ ID NO: 33643 - DNA, 21 bp, Homo sapiens
ggagtttttctggaagggact

SEQ ID NO: 33644 - DNA, 22 bp, Homo sapiens
ttttcatttttgtagatgcaag

SEQ ID NO: 33645 - DNA, 22 bp, Homo sapiens
aaagcctcccaggttatgagta

SEQ ID NO: 33646 - DNA, 22 bp, Homo sapiens
ggttggacactaggtaggagcg

SEQ ID NO: 33647 - DNA, 22 bp, Homo sapiens
aacaattactaccaaggcctgt

SEQ ID NO: 33648 - DNA, 22 bp, Homo sapiens
cagcagtgtacaaggtgtcaga

SEQ ID NO: 33649 - DNA, 22 bp, Homo sapiens
ggacgcttaccagtaacgactt

SEQ ID NO: 33650 - DNA, 22 bp, Homo sapiens
cctcggggcaccgcggcctgct

SEQ ID NO: 33651 - DNA, 22 bp, Homo sapiens
aagcatttcaggtagagatatt

SEQ ID NO: 33652 - DNA, 22 bp, Homo sapiens
actgcacttcagcctgggtgtc

SEQ ID NO: 33653 - DNA, 19 bp, Homo sapiens
acccagcccaggagtggca

SEQ ID NO: 33654 - DNA, 17 bp, Homo sapiens
ccctcactcctgccggg

SEQ ID NO: 33655 - DNA, 22 bp, Homo sapiens
ttatagcagcatgatttacaat

SEQ ID NO: 33656 - DNA, 22 bp, Homo sapiens
aagtctctcacatatctggtcc

SEQ ID NO: 33657 - DNA, 22 bp, Homo sapiens
aatgctctttaacctattctga

SEQ ID NO: 33658 - DNA, 22 bp, Homo sapiens
atttcagtattatacaactgct

SEQ ID NO: 33659 - DNA, 22 bp, Homo sapiens
atcttctcatgtgtaatgaggt

SEQ ID NO: 33660 - DNA, 22 bp, Homo sapiens
tctgaatcgttcccatgcagga

SEQ ID NO: 33661 - DNA, 22 bp, Homo sapiens
gcacttgtggatttgatataca

SEQ ID NO: 33662 - DNA, 22 bp, Homo sapiens
attttttgttaactcaggatag

SEQ ID NO: 33663 - DNA, 22 bp, Homo sapiens
gaattcgggtactctaggccag

SEQ ID NO: 33664 - DNA, 22 bp, Homo sapiens
tgtgccataggcagcgtggcca

SEQ ID NO: 33665 - DNA, 19 bp, Homo sapiens
caccaagatggctctagtc

SEQ ID NO: 33666 - DNA, 22 bp, Homo sapiens
aggtccaaggtagggcccagac

SEQ ID NO: 33667 - DNA, 22 bp, Homo sapiens
attgttgggtctcactcctaga

SEQ ID NO: 33668 - DNA, 22 bp, Homo sapiens
aacagtgctgttataaatgtac

SEQ ID NO: 33669 - DNA, 22 bp, Homo sapiens
aagaaatgctgatgttggatgg

SEQ ID NO: 33670 - DNA, 22 bp, Homo sapiens
caaatcctcacctcatcatgaa

SEQ ID NO: 33671 - DNA, 22 bp, Homo sapiens
tccaggtgggctgcacccaggc

SEQ ID NO: 33672 - DNA, 22 bp, Homo sapiens
atttacaggtagaattttaagt

SEQ ID NO: 33673 - DNA, 22 bp, Homo sapiens
cctgcgcgtctgggtctgtctc

SEQ ID NO: 33674 - DNA, 22 bp, Homo sapiens
ctgaggcctctcccactccagc

SEQ ID NO: 33675 - DNA, 22 bp, Homo sapiens
caggaagaccagggctgtggct

SEQ ID NO: 33676 - DNA, 22 bp, Homo sapiens
cacctgccaaatggggatgctg

SEQ ID NO: 33677 - DNA, 22 bp, Homo sapiens
ctctctgggcccagttggcacc

SEQ ID NO: 33678 - DNA, 22 bp, Homo sapiens
ggctttctgtctgcgtctgtgt

SEQ ID NO: 33679 - DNA, 21 bp, Homo sapiens
agcctcaggttgttggttctt

SEQ ID NO: 33680 - DNA, 22 bp, Homo sapiens
tgcacgtgggctctctgctctt

SEQ ID NO: 33681 - DNA, 19 bp, Homo sapiens
aggctaaagagtcttgcgt

SEQ ID NO: 33682 - DNA, 22 bp, Homo sapiens
gcactttgcccctcctttggca

SEQ ID NO: 33683 - DNA, 22 bp, Homo sapiens
ccgggagcaggcgccaccgcca

SEQ ID NO: 33684 - DNA, 22 bp, Homo sapiens
aaatatcttaggagtatatgag

SEQ ID NO: 33685 - DNA, 22 bp, Homo sapiens
ggggcattgtgtctgggttcct

SEQ ID NO: 33686 - DNA, 22 bp, Homo sapiens
gtggcatgtgcctgtaatctca

SEQ ID NO: 33687 - DNA, 18 bp, Homo sapiens
tggttccttgaaggggca

SEQ ID NO: 33688 - DNA, 22 bp, Homo sapiens
agaacgtggaatgtggctcctt

SEQ ID NO: 33689 - DNA, 22 bp, Homo sapiens
accagcacttccagaggtcagg

SEQ ID NO: 33690 - DNA, 22 bp, Homo sapiens
tcactacaaccgctacctgaca

SEQ ID NO: 33691 - DNA, 18 bp, Homo sapiens
gacatagctcagagctca

SEQ ID NO: 33692 - DNA, 22 bp, Homo sapiens
ttggaagacaatgctgattctc

SEQ ID NO: 33693 - DNA, 22 bp, Homo sapiens
tttgagtagtgagactaggcag

SEQ ID NO: 33694 - DNA, 19 bp, Homo sapiens
cggtccatccgattttaca

SEQ ID NO: 33695 - DNA, 22 bp, Homo sapiens
actggggactctggccttttga

SEQ ID NO: 33696 - DNA, 22 bp, Homo sapiens
agccaatctggggagacgggag

SEQ ID NO: 33697 - DNA, 22 bp, Homo sapiens
cttgatgagtcagaactgaagg

SEQ ID NO: 33698 - DNA, 22 bp, Homo sapiens
aaagggaagttgcacatgttcc

SEQ ID NO: 33699 - DNA, 22 bp, Homo sapiens
ccctggctgcgtgatggatgaa

SEQ ID NO: 33700 - DNA, 22 bp, Homo sapiens
aggctggagtgcagttgcatga

SEQ ID NO: 33701 - DNA, 22 bp, Homo sapiens
tgtgtctcaagtcagagcatca

SEQ ID NO: 33702 - DNA, 22 bp, Homo sapiens
aggcaggaaaatcgcttgaacc

SEQ ID NO: 33703 - DNA, 22 bp, Homo sapiens
tgcctaggctggagtgtagtgg

SEQ ID NO: 33704 - DNA, 22 bp, Homo sapiens
caagcgtggctgctctgatgga

SEQ ID NO: 33705 - DNA, 22 bp, Homo sapiens
agagcacagggttttgtgccgg

SEQ ID NO: 33706 - DNA, 22 bp, Homo sapiens
ctggaaggagcccgggcggatc

SEQ ID NO: 33707 - DNA, 20 bp, Homo sapiens
tatgtgattttctcatcaat

SEQ ID NO: 33708 - DNA, 22 bp, Homo sapiens
atacaaaatatatactggagac

SEQ ID NO: 33709 - DNA, 22 bp, Homo sapiens
gcgggccaccttggagagcgct

SEQ ID NO: 33710 - DNA, 22 bp, Homo sapiens
atggactgggaggtcatcttct

SEQ ID NO: 33711 - DNA, 22 bp, Homo sapiens
accctcaacaaattcactctat

SEQ ID NO: 33712 - DNA, 22 bp, Homo sapiens
tgaagaaacgcagagaggtagg

SEQ ID NO: 33713 - DNA, 22 bp, Homo sapiens
ttttggctctgtctgtatcttt

SEQ ID NO: 33714 - DNA, 22 bp, Homo sapiens
gtctgctttgtctttcatgata

SEQ ID NO: 33715 - DNA, 22 bp, Homo sapiens
aaatgcaacgggctttccttat

SEQ ID NO: 33716 - DNA, 22 bp, Homo sapiens
acccagtgttgggcagaactgt

SEQ ID NO: 33717 - DNA, 22 bp, Homo sapiens
cactgcatggctgtgaggcagc

SEQ ID NO: 33718 - DNA, 22 bp, Homo sapiens
agcgccactgcactccagcctg

SEQ ID NO: 33719 - DNA, 22 bp, Homo sapiens
gagagtctaggaacctcatata

SEQ ID NO: 33720 - DNA, 18 bp, Homo sapiens
tggaggaaaaatctcatg

SEQ ID NO: 33721 - DNA, 22 bp, Homo sapiens
agtgactggtgtgaagttaaat

SEQ ID NO: 33722 - DNA, 19 bp, Homo sapiens
agccccttggtactgtcct

SEQ ID NO: 33723 - DNA, 20 bp, Homo sapiens
cagcctgcatcatctgcagc

SEQ ID NO: 33724 - DNA, 22 bp, Homo sapiens
gagacgtggcctttgcctgagc

SEQ ID NO: 33725 - DNA, 22 bp, Homo sapiens
ttcattcttttacatgtgaata

SEQ ID NO: 33726 - DNA, 22 bp, Homo sapiens
gggaaggccttgtcagcggatt

SEQ ID NO: 33727 - DNA, 22 bp, Homo sapiens
ggagttgattttggatatatta

SEQ ID NO: 33728 - DNA, 22 bp, Homo sapiens
ttgatcaaatcagctactgagg

SEQ ID NO: 33729 - DNA, 22 bp, Homo sapiens
ctcttcctagtgtgcagcgtgg

SEQ ID NO: 33730 - DNA, 22 bp, Homo sapiens
gaggtgatggttgcacaatgct

SEQ ID NO: 33731 - DNA, 22 bp, Homo sapiens
cccacacacatttatgatagga

SEQ ID NO: 33732 - DNA, 22 bp, Homo sapiens
ctcgtgatccgcccacctcagc

SEQ ID NO: 33733 - DNA, 22 bp, Homo sapiens
ctcttagtaatgccatgaagca

SEQ ID NO: 33734 - DNA, 22 bp, Homo sapiens
ggcaaggggtcaggctgagaca

SEQ ID NO: 33735 - DNA, 22 bp, Homo sapiens
gcagcctcaaactccccagctc

SEQ ID NO: 33736 - DNA, 22 bp, Homo sapiens
tgtacttgaacttgactgtaga

SEQ ID NO: 33737 - DNA, 22 bp, Homo sapiens
atgtaaactactgactacacta

SEQ ID NO: 33738 - DNA, 22 bp, Homo sapiens
gtggccgccaggtcctcgtcca

SEQ ID NO: 33739 - DNA, 22 bp, Homo sapiens
tagtttcatctccaccctgccc

SEQ ID NO: 33740 - DNA, 22 bp, Homo sapiens
acgggccttctcttcaggcgag

SEQ ID NO: 33741 - DNA, 23 bp, Homo sapiens
tgctggagaagcaaagttctgag

SEQ ID NO: 33742 - DNA, 22 bp, Homo sapiens
atacataattacttccgatgtt

SEQ ID NO: 33743 - DNA, 22 bp, Homo sapiens
aaaggctcagatgaggccctgg

SEQ ID NO: 33744 - DNA, 22 bp, Homo sapiens
aatgagatggaattcccgccta

SEQ ID NO: 33745 - DNA, 22 bp, Homo sapiens
ataaaagatcccttctgagctc

SEQ ID NO: 33746 - DNA, 22 bp, Homo sapiens
gtctctcaaaactagaagagaa

SEQ ID NO: 33747 - DNA, 22 bp, Homo sapiens
taaaatttgtccctgagtgttg

SEQ ID NO: 33748 - DNA, 22 bp, Homo sapiens
gtgtgtcccttggaacctcagc

SEQ ID NO: 33749 - DNA, 22 bp, Homo sapiens
gcagagatctgagaaggctgcc

SEQ ID NO: 33750 - DNA, 22 bp, Homo sapiens
cggggccctggggctgaaggtc

SEQ ID NO: 33751 - DNA, 22 bp, Homo sapiens
gatttttatataaagtgagaaa

SEQ ID NO: 33752 - DNA, 22 bp, Homo sapiens
ttcattttctttcacgctgctg

SEQ ID NO: 33753 - DNA, 22 bp, Homo sapiens
agcattccacactgaagtctgc

SEQ ID NO: 33754 - DNA, 22 bp, Homo sapiens
tgagcttccctcctgcactaca

SEQ ID NO: 33755 - DNA, 22 bp, Homo sapiens
tcccgcttcttccgaatcgcga

SEQ ID NO: 33756 - DNA, 22 bp, Homo sapiens
gaatatcccgctatgcaaagta

SEQ ID NO: 33757 - DNA, 22 bp, Homo sapiens
gttgggttaaccaggatgtcaa

SEQ ID NO: 33758 - DNA, 22 bp, Homo sapiens
ggtgcagaggagccagctgggg

SEQ ID NO: 33759 - DNA, 22 bp, Homo sapiens
tgcaggcctggactgatgtggt

SEQ ID NO: 33760 - DNA, 22 bp, Homo sapiens
cattgcaacttcaaactcctgg

SEQ ID NO: 33761 - DNA, 22 bp, Homo sapiens
tcgaaataatttagaatataga

SEQ ID NO: 33762 - DNA, 22 bp, Homo sapiens
tggccaccaccaatacttgcct

SEQ ID NO: 33763 - DNA, 22 bp, Homo sapiens
ctgatctcaagtgatccaccca

SEQ ID NO: 33764 - DNA, 22 bp, Homo sapiens
tgaggcaggtggattacaaggt

SEQ ID NO: 33765 - DNA, 22 bp, Homo sapiens
gcttccggagccaaaaggcccc

SEQ ID NO: 33766 - DNA, 22 bp, Homo sapiens
tgggtgagcggctgcacacccg

SEQ ID NO: 33767 - DNA, 22 bp, Homo sapiens
ggtaccaccaattcagctgcca

SEQ ID NO: 33768 - DNA, 22 bp, Homo sapiens
tgttggagcccgagtcagggag

SEQ ID NO: 33769 - DNA, 22 bp, Homo sapiens
agagcaattctcaaggaggtgt

SEQ ID NO: 33770 - DNA, 22 bp, Homo sapiens
ccatgaattcactccatgctag

SEQ ID NO: 33771 - DNA, 22 bp, Homo sapiens
gggcagccgcgtgacctgccag

SEQ ID NO: 33772 - DNA, 22 bp, Homo sapiens
gtggcaggagggcatcacttgg

SEQ ID NO: 33773 - DNA, 22 bp, Homo sapiens
ctgggatccacgggctcccaag

SEQ ID NO: 33774 - DNA, 22 bp, Homo sapiens
tgcgaccctagccccctcactt

SEQ ID NO: 33775 - DNA, 22 bp, Homo sapiens
aaggcaggatgggaaaagattt

SEQ ID NO: 33776 - DNA, 22 bp, Homo sapiens
gctcccagtctgatggaggaga

SEQ ID NO: 33777 - DNA, 22 bp, Homo sapiens
cagaggtagcatgctgtggctt

SEQ ID NO: 33778 - DNA, 22 bp, Homo sapiens
ccaggaggcggaggttgcagtg

SEQ ID NO: 33779 - DNA, 22 bp, Homo sapiens
gttcagaaattaggagaataaa

SEQ ID NO: 33780 - DNA, 22 bp, Homo sapiens
tggcatctttgtcccagaagct

SEQ ID NO: 33781 - DNA, 22 bp, Homo sapiens
tgtgactaggcctgagctcttg

SEQ ID NO: 33782 - DNA, 22 bp, Homo sapiens
aagtagttaggaacattctctc

SEQ ID NO: 33783 - DNA, 22 bp, Homo sapiens
ttttgcaatgagatgcttgtca

SEQ ID NO: 33784 - DNA, 22 bp, Homo sapiens
tgttatcagagagaggtgctgt

SEQ ID NO: 33785 - DNA, 22 bp, Homo sapiens
ggccagaagttggaaaagagcc

SEQ ID NO: 33786 - DNA, 17 bp, Homo sapiens
gacctcaggtgatctgc

SEQ ID NO: 33787 - DNA, 20 bp, Homo sapiens
gggcaaggaaacagccccca

SEQ ID NO: 33788 - DNA, 22 bp, Homo sapiens
aaagaaatagatggcatttaaa

SEQ ID NO: 33789 - DNA, 22 bp, Homo sapiens
ccacaccatcgtttttacctta

SEQ ID NO: 33790 - DNA, 22 bp, Homo sapiens
cctcttcaggcactcgaaggcc

SEQ ID NO: 33791 - DNA, 22 bp, Homo sapiens
cttgtctgctataaaaatccag

SEQ ID NO: 33792 - DNA, 21 bp, Homo sapiens
acagtaagacagggcatttgc

SEQ ID NO: 33793 - DNA, 22 bp, Homo sapiens
aatatttcttctaaagcccttt

SEQ ID NO: 33794 - DNA, 22 bp, Homo sapiens
gtggagaggaacccagctctgt

SEQ ID NO: 33795 - DNA, 22 bp, Homo sapiens
cccagctcttcaagtcaccccc

SEQ ID NO: 33796 - DNA, 22 bp, Homo sapiens
ggctcaatgcaacttctgcctc

SEQ ID NO: 33797 - DNA, 22 bp, Homo sapiens
ccagtggctacaggggggttga

SEQ ID NO: 33798 - DNA, 22 bp, Homo sapiens
aggggcgtgctcttccccgacg

SEQ ID NO: 33799 - DNA, 22 bp, Homo sapiens
gctggggaggcagcagagaaca

SEQ ID NO: 33800 - DNA, 22 bp, Homo sapiens
cttgtattaggaagaatgcttt

SEQ ID NO: 33801 - DNA, 22 bp, Homo sapiens
ttcaggcccagcacagcgcgtg

SEQ ID NO: 33802 - DNA, 22 bp, Homo sapiens
gcctccccaagcagcagggatt

SEQ ID NO: 33803 - DNA, 22 bp, Homo sapiens
cattaaacaaccttgaatcaat

SEQ ID NO: 33804 - DNA, 22 bp, Homo sapiens
gttattgaggtggagtctcact

SEQ ID NO: 33805 - DNA, 22 bp, Homo sapiens
cccaggaggtggaggctgcagt

SEQ ID NO: 33806 - DNA, 22 bp, Homo sapiens
cctgacgaaaggcgtgctggag

SEQ ID NO: 33807 - DNA, 22 bp, Homo sapiens
aggccagcctgcccaaagctgc

SEQ ID NO: 33808 - DNA, 22 bp, Homo sapiens
ctcactgcaagctctgcctccc

SEQ ID NO: 33809 - DNA, 22 bp, Homo sapiens
gcaggcggaggttgcagtgagc

SEQ ID NO: 33810 - DNA, 22 bp, Homo sapiens
ttgtgctgtgagaatgctcatt

SEQ ID NO: 33811 - DNA, 22 bp, Homo sapiens
gaccttgtgatctgcccacctt

SEQ ID NO: 33812 - DNA, 19 bp, Homo sapiens
aggattccagaacagtgtt

SEQ ID NO: 33813 - DNA, 22 bp, Homo sapiens
tggaagaatatgggggtacaga

SEQ ID NO: 33814 - DNA, 22 bp, Homo sapiens
ggcctggcagagcgcgcggctg

SEQ ID NO: 33815 - DNA, 22 bp, Homo sapiens
ggaggtcccaggcctggcagca

SEQ ID NO: 33816 - DNA, 22 bp, Homo sapiens
ggcatgagcacgaagtggtacc

SEQ ID NO: 33817 - DNA, 22 bp, Homo sapiens
tagaactaagagttatcattta

SEQ ID NO: 33818 - DNA, 22 bp, Homo sapiens
gtgaccaatattatgctaatta

SEQ ID NO: 33819 - DNA, 22 bp, Homo sapiens
ccctaagaagcaaagtgatacc

SEQ ID NO: 33820 - DNA, 22 bp, Homo sapiens
ccacgacgagtcatcagggcga

SEQ ID NO: 33821 - DNA, 22 bp, Homo sapiens
gattcactcatattttacgttt

SEQ ID NO: 33822 - DNA, 22 bp, Homo sapiens
tcccagattcctgctcttatat

SEQ ID NO: 33823 - DNA, 22 bp, Homo sapiens
gccatcatatcccctgtgacct

SEQ ID NO: 33824 - DNA, 22 bp, Homo sapiens
ggtgtagctctgtgtcccactg

SEQ ID NO: 33825 - DNA, 22 bp, Homo sapiens
agggccagcactcctggcagga

SEQ ID NO: 33826 - DNA, 22 bp, Homo sapiens
cccaggaggcagagcttgcagt

SEQ ID NO: 33827 - DNA, 19 bp, Homo sapiens
gggcaaagtgatcgtcctg

SEQ ID NO: 33828 - DNA, 19 bp, Homo sapiens
tgcctgctgtattccagag

SEQ ID NO: 33829 - DNA, 22 bp, Homo sapiens
tgcactccaggctgggtgacag

SEQ ID NO: 33830 - DNA, 22 bp, Homo sapiens
ccagcagagcatggggaggaag

SEQ ID NO: 33831 - DNA, 19 bp, Homo sapiens
tctcacagctctactatgt

SEQ ID NO: 33832 - DNA, 22 bp, Homo sapiens
aggaaaatggaccagagttgtt

SEQ ID NO: 33833 - DNA, 22 bp, Homo sapiens
gagctgagaagcagcgcttgat

SEQ ID NO: 33834 - DNA, 22 bp, Homo sapiens
ttaccaaatgaaatagagattt

SEQ ID NO: 33835 - DNA, 22 bp, Homo sapiens
tcctggtgctgacacccatagc

SEQ ID NO: 33836 - DNA, 22 bp, Homo sapiens
cctttgatttcccccgtctcag

SEQ ID NO: 33837 - DNA, 22 bp, Homo sapiens
gatgcacggtcatgtcttttca

SEQ ID NO: 33838 - DNA, 22 bp, Homo sapiens
tgtctattcccccacctccgtt

SEQ ID NO: 33839 - DNA, 22 bp, Homo sapiens
gtgtgggctgcagaggcacagc

SEQ ID NO: 33840 - DNA, 22 bp, Homo sapiens
gagtccaagctagagccactca

SEQ ID NO: 33841 - DNA, 22 bp, Homo sapiens
ggaggtggagctggaagttcca

SEQ ID NO: 33842 - DNA, 17 bp, Homo sapiens
ggcctgcacctcctgct

SEQ ID NO: 33843 - DNA, 22 bp, Homo sapiens
caggtgtgccgggagcagtttg

SEQ ID NO: 33844 - DNA, 21 bp, Homo sapiens
cttccccaggctggtctgtat

SEQ ID NO: 33845 - DNA, 22 bp, Homo sapiens
acagtcaaatgtctatcttctt

SEQ ID NO: 33846 - DNA, 22 bp, Homo sapiens
gcgtggcttagagtggggtacc

SEQ ID NO: 33847 - DNA, 22 bp, Homo sapiens
agaggaggctctgggatcgtcc

SEQ ID NO: 33848 - DNA, 22 bp, Homo sapiens
ttccacattccttacattcata

SEQ ID NO: 33849 - DNA, 22 bp, Homo sapiens
ctgtcctgtgctttttactgtc

SEQ ID NO: 33850 - DNA, 18 bp, Homo sapiens
tgagaggctattttttgc

SEQ ID NO: 33851 - DNA, 22 bp, Homo sapiens
gcagtatctatgtgatgggttg

SEQ ID NO: 33852 - DNA, 22 bp, Homo sapiens
tagtcagtgcacagacacttgt

SEQ ID NO: 33853 - DNA, 22 bp, Homo sapiens
ggtgggagagctctgtctccag

SEQ ID NO: 33854 - DNA, 22 bp, Homo sapiens
tttgcttcacaagtatggttct

SEQ ID NO: 33855 - DNA, 22 bp, Homo sapiens
acacatcctgaccaagttcagg

SEQ ID NO: 33856 - DNA, 22 bp, Homo sapiens
gttatataagacaaatcagagt

SEQ ID NO: 33857 - DNA, 22 bp, Homo sapiens
atctagattaggtataagagct

SEQ ID NO: 33858 - DNA, 22 bp, Homo sapiens
ccggcgaccgctgtcggaggcg

SEQ ID NO: 33859 - DNA, 22 bp, Homo sapiens
ccaaagaaacccaagctcaggg

SEQ ID NO: 33860 - DNA, 22 bp, Homo sapiens
actcagtacatctggagttggc

SEQ ID NO: 33861 - DNA, 22 bp, Homo sapiens
ttgaggcaggtccgggtccttc

SEQ ID NO: 33862 - DNA, 22 bp, Homo sapiens
ttagtattaggatcatatttga

SEQ ID NO: 33863 - DNA, 22 bp, Homo sapiens
cagtgcacgggccagtcctgcc

SEQ ID NO: 33864 - DNA, 22 bp, Homo sapiens
tccacgctgtgtgaccttgggc

SEQ ID NO: 33865 - DNA, 22 bp, Homo sapiens
tgaaggacagcagtggctccaa

SEQ ID NO: 33866 - DNA, 22 bp, Homo sapiens
gtggggacgggatggctcactg

SEQ ID NO: 33867 - DNA, 22 bp, Homo sapiens
tgcagaaacaagccatcattca

SEQ ID NO: 33868 - DNA, 22 bp, Homo sapiens
ggagaagcagcttcttgatgaa

SEQ ID NO: 33869 - DNA, 22 bp, Homo sapiens
aaatcggttggttcaaggtaat

SEQ ID NO: 33870 - DNA, 22 bp, Homo sapiens
tcatctaagagtcttacattta

SEQ ID NO: 33871 - DNA, 22 bp, Homo sapiens
gggggggtcttcagacctcaga

SEQ ID NO: 33872 - DNA, 23 bp, Homo sapiens
tatgaactgcattgctggtgtgt

SEQ ID NO: 33873 - DNA, 22 bp, Homo sapiens
cgcggaggaggtcaggaggtga

SEQ ID NO: 33874 - DNA, 22 bp, Homo sapiens
tccttcagcctcccagctcaaa

SEQ ID NO: 33875 - DNA, 22 bp, Homo sapiens
aggtctgtttaacaaagtcagg

SEQ ID NO: 33876 - DNA, 22 bp, Homo sapiens
acatatgcgatcataggatgca

SEQ ID NO: 33877 - DNA, 22 bp, Homo sapiens
gggaagtgatggagccaggatt

SEQ ID NO: 33878 - DNA, 22 bp, Homo sapiens
gagaaagcttctttcccacagg

SEQ ID NO: 33879 - DNA, 22 bp, Homo sapiens
cctggtgcaggtgtgttgccag

SEQ ID NO: 33880 - DNA, 22 bp, Homo sapiens
gggacttcatagctaggcactt

SEQ ID NO: 33881 - DNA, 22 bp, Homo sapiens
cctaggagttcgaagctgcagt

SEQ ID NO: 33882 - DNA, 22 bp, Homo sapiens
agaagccaccagctgaggaaga

SEQ ID NO: 33883 - DNA, 22 bp, Homo sapiens
cagccccatggtgtgctccagc

SEQ ID NO: 33884 - DNA, 22 bp, Homo sapiens
cagggtttcaccatgttagcag

SEQ ID NO: 33885 - DNA, 22 bp, Homo sapiens
ggggagatgcttaggtccgggg

SEQ ID NO: 33886 - DNA, 22 bp, Homo sapiens
tgagctgtctgaatggtgagga

SEQ ID NO: 33887 - DNA, 22 bp, Homo sapiens
tgtggtgccgagagtctggacg

SEQ ID NO: 33888 - DNA, 22 bp, Homo sapiens
agagaggtctcaggagaaacca

SEQ ID NO: 33889 - DNA, 21 bp, Homo sapiens
gccagcggccgccctccagga

SEQ ID NO: 33890 - DNA, 20 bp, Homo sapiens
gctctgtggtttgagtctcc

SEQ ID NO: 33891 - DNA, 22 bp, Homo sapiens
catcccctgatgctcttgagta

SEQ ID NO: 33892 - DNA, 22 bp, Homo sapiens
cataaaaggtagcagtttgaaa

SEQ ID NO: 33893 - DNA, 22 bp, Homo sapiens
tggcacgacaattggcaccaat

SEQ ID NO: 33894 - DNA, 22 bp, Homo sapiens
cagggagtgtacaccatgtgta

SEQ ID NO: 33895 - DNA, 23 bp, Homo sapiens
tgtgggcgcattgtaagggtagc

SEQ ID NO: 33896 - DNA, 22 bp, Homo sapiens
cctgggcctctcaaagtgctgg

SEQ ID NO: 33897 - DNA, 23 bp, Homo sapiens
aaataggagtatctggatcatga

SEQ ID NO: 33898 - DNA, 22 bp, Homo sapiens
atgccactgcgctctagcctgg

SEQ ID NO: 33899 - DNA, 22 bp, Homo sapiens
acacttggagcaacacttatgg

SEQ ID NO: 33900 - DNA, 22 bp, Homo sapiens
cgcaactcagcaacttaactgc

SEQ ID NO: 33901 - DNA, 23 bp, Homo sapiens
tgttccagatacgccttttcctc

SEQ ID NO: 33902 - DNA, 22 bp, Homo sapiens
caattgtcagtgctgtttaaat

SEQ ID NO: 33903 - DNA, 22 bp, Homo sapiens
tcctgagataaatctcatgtga

SEQ ID NO: 33904 - DNA, 22 bp, Homo sapiens
tcttgcacttcatgaatatgtt

SEQ ID NO: 33905 - DNA, 22 bp, Homo sapiens
gccaggaaagggaattccctga

SEQ ID NO: 33906 - DNA, 22 bp, Homo sapiens
tttcttctatgtgtgatatttt

SEQ ID NO: 33907 - DNA, 22 bp, Homo sapiens
tggggaaaatgcttgtagtcag

SEQ ID NO: 33908 - DNA, 22 bp, Homo sapiens
ctgtggctctttagttgagcac

SEQ ID NO: 33909 - DNA, 22 bp, Homo sapiens
aacagcgacgtcctccccaaca

SEQ ID NO: 33910 - DNA, 21 bp, Homo sapiens
gtggttctagagaaacagaat

SEQ ID NO: 33911 - DNA, 22 bp, Homo sapiens
gtggcccaggctggagtgcagt

SEQ ID NO: 33912 - DNA, 22 bp, Homo sapiens
gcctcctggggtgccatcatct

SEQ ID NO: 33913 - DNA, 22 bp, Homo sapiens
caattcccagctgccgggctgc

SEQ ID NO: 33914 - DNA, 18 bp, Homo sapiens
tgctgatggtccattagt

SEQ ID NO: 33915 - DNA, 22 bp, Homo sapiens
gggcagatcacctgaggtcagg

SEQ ID NO: 33916 - DNA, 22 bp, Homo sapiens
agatgcagtggttaacaataca

SEQ ID NO: 33917 - DNA, 22 bp, Homo sapiens
cctgggaggctgaggctgcagt

SEQ ID NO: 33918 - DNA, 20 bp, Homo sapiens
gctgaggtggaggaaggaga

SEQ ID NO: 33919 - DNA, 23 bp, Homo sapiens
cagagctggcttcatgggtgtgc

SEQ ID NO: 33920 - DNA, 22 bp, Homo sapiens
atccaccctgtggtggctttct

SEQ ID NO: 33921 - DNA, 22 bp, Homo sapiens
tgaggatgtctgtattttgcct

SEQ ID NO: 33922 - DNA, 20 bp, Homo sapiens
gctgaggggtctatggcata

SEQ ID NO: 33923 - DNA, 19 bp, Homo sapiens
ctgtccttggctgcactgt

SEQ ID NO: 33924 - DNA, 22 bp, Homo sapiens
agaggtgagtcattacctagtg

SEQ ID NO: 33925 - DNA, 23 bp, Homo sapiens
cagtctgcagcccacttgggcag

SEQ ID NO: 33926 - DNA, 22 bp, Homo sapiens
tgagccaagttcacaccattgc

SEQ ID NO: 33927 - DNA, 22 bp, Homo sapiens
ttatttttaaaagttcacacag

SEQ ID NO: 33928 - DNA, 22 bp, Homo sapiens
cctccccacagcccaggagact

SEQ ID NO: 33929 - DNA, 22 bp, Homo sapiens
gtatgtgctgagctttccccgc

SEQ ID NO: 33930 - DNA, 22 bp, Homo sapiens
tgccctttatttctggggcaga

SEQ ID NO: 33931 - DNA, 22 bp, Homo sapiens
gctcagacctgtaatcttagca

SEQ ID NO: 33932 - DNA, 21 bp, Homo sapiens
aggcatgagccctgcatggac

SEQ ID NO: 33933 - DNA, 22 bp, Homo sapiens
aaggtggaggttgcagtgagct

SEQ ID NO: 33934 - DNA, 22 bp, Homo sapiens
gaagctgagctgaggcatgttg

SEQ ID NO: 33935 - DNA, 22 bp, Homo sapiens
gctggaggatggactggaagaa

SEQ ID NO: 33936 - DNA, 23 bp, Homo sapiens
caccccaccctgaggaggaggga

SEQ ID NO: 33937 - DNA, 22 bp, Homo sapiens
ttcatagtgtttccttccagtg

SEQ ID NO: 33938 - DNA, 16 bp, Homo sapiens
cttggtgttggcagag

SEQ ID NO: 33939 - DNA, 22 bp, Homo sapiens
gaggccaaggtgggcagatcac

SEQ ID NO: 33940 - DNA, 22 bp, Homo sapiens
ataaaatttgctactgttaaat

SEQ ID NO: 33941 - DNA, 22 bp, Homo sapiens
ggcagggagtggagactcccta

SEQ ID NO: 33942 - DNA, 22 bp, Homo sapiens
gaccttgtgatccacctgcctt

SEQ ID NO: 33943 - DNA, 22 bp, Homo sapiens
ctctgcctgtctcatcctgcaa

SEQ ID NO: 33944 - DNA, 22 bp, Homo sapiens
ggccttggttccaaagcaggca

SEQ ID NO: 33945 - DNA, 22 bp, Homo sapiens
gtagttctgcagtgtcacctga

SEQ ID NO: 33946 - DNA, 22 bp, Homo sapiens
gtgaattacatgtatttttaag

SEQ ID NO: 33947 - DNA, 22 bp, Homo sapiens
cacatttttactgccaacttaa

SEQ ID NO: 33948 - DNA, 22 bp, Homo sapiens
gagctctgactgctgggtgaca

SEQ ID NO: 33949 - DNA, 22 bp, Homo sapiens
gtctccccagggccctcttcat

SEQ ID NO: 33950 - DNA, 22 bp, Homo sapiens
cagtgacgtaaactgcatgtgc

SEQ ID NO: 33951 - DNA, 22 bp, Homo sapiens
cccccaaagtttgcacggataa

SEQ ID NO: 33952 - DNA, 22 bp, Homo sapiens
gtagaggggtgattctgtgaga

SEQ ID NO: 33953 - DNA, 22 bp, Homo sapiens
gctcactgcaagctctgcctcc

SEQ ID NO: 33954 - DNA, 21 bp, Homo sapiens
atatcaatacagcaggacttc

SEQ ID NO: 33955 - DNA, 22 bp, Homo sapiens
agtggcctggagccccgcctgg

SEQ ID NO: 33956 - DNA, 22 bp, Homo sapiens
ggagtgaatcactagatgcaga

SEQ ID NO: 33957 - DNA, 22 bp, Homo sapiens
gggtcgggcaggcgccctcgtc

SEQ ID NO: 33958 - DNA, 19 bp, Homo sapiens
ctgggatgtctcctcccag

SEQ ID NO: 33959 - DNA, 22 bp, Homo sapiens
gccactgagcccggccattgtt

SEQ ID NO: 33960 - DNA, 22 bp, Homo sapiens
gtcccgcattgggcattcctgg

SEQ ID NO: 33961 - DNA, 22 bp, Homo sapiens
tgctggtaccgcgcctccgcca

SEQ ID NO: 33962 - DNA, 22 bp, Homo sapiens
ctgggggcagcaagaagccatg

SEQ ID NO: 33963 - DNA, 21 bp, Homo sapiens
tgactgaggcttcttcacaca

SEQ ID NO: 33964 - DNA, 22 bp, Homo sapiens
ttggaacatgccggggtccagg

SEQ ID NO: 33965 - DNA, 22 bp, Homo sapiens
aaaaagtattggccatggttga

SEQ ID NO: 33966 - DNA, 22 bp, Homo sapiens
gacctcgtgatctgccggcctt

SEQ ID NO: 33967 - DNA, 22 bp, Homo sapiens
catgcctgtaatcccagcactt

SEQ ID NO: 33968 - DNA, 22 bp, Homo sapiens
gtgccactgataaatcagaatg

SEQ ID NO: 33969 - DNA, 22 bp, Homo sapiens
tgagtggacacctgcttcttta

SEQ ID NO: 33970 - DNA, 22 bp, Homo sapiens
gtacacaaagtgagacttgata

SEQ ID NO: 33971 - DNA, 22 bp, Homo sapiens
ttttcctttgattcccagatgt

SEQ ID NO: 33972 - DNA, 22 bp, Homo sapiens
aggagctgtcagagtgccagag

SEQ ID NO: 33973 - DNA, 22 bp, Homo sapiens
agaaaatgtgaacttgtgaatt

SEQ ID NO: 33974 - DNA, 22 bp, Homo sapiens
caggttggagatctgtctatgg

SEQ ID NO: 33975 - DNA, 22 bp, Homo sapiens
ggattgaaggcccttaactgat

SEQ ID NO: 33976 - DNA, 22 bp, Homo sapiens
ctggggtcagggatcagagagc

SEQ ID NO: 33977 - DNA, 22 bp, Homo sapiens
attcccagatttatattgatag

SEQ ID NO: 33978 - DNA, 20 bp, Homo sapiens
acgtggccaccagtggctta

SEQ ID NO: 33979 - DNA, 16 bp, Homo sapiens
tgggtgggaggagcgg

SEQ ID NO: 33980 - DNA, 22 bp, Homo sapiens
ccactgccctgcaaaagctgga

SEQ ID NO: 33981 - DNA, 22 bp, Homo sapiens
ggtaacttagctcatggctgtg

SEQ ID NO: 33982 - DNA, 22 bp, Homo sapiens
tgctggacagggcacggcccat

SEQ ID NO: 33983 - DNA, 22 bp, Homo sapiens
cacagtcctgccagagggcctt

SEQ ID NO: 33984 - DNA, 22 bp, Homo sapiens
tgagtgaccagaagtccccctc

SEQ ID NO: 33985 - DNA, 22 bp, Homo sapiens
cctggggccccgagccagaagc

SEQ ID NO: 33986 - DNA, 22 bp, Homo sapiens
ttgcatcttctggttgagcccc

SEQ ID NO: 33987 - DNA, 22 bp, Homo sapiens
tgaagcaaattgtttagcctga

SEQ ID NO: 33988 - DNA, 22 bp, Homo sapiens
ggtgggaggactgtttgaggca

SEQ ID NO: 33989 - DNA, 22 bp, Homo sapiens
gaagttctttatagcagtgtga

SEQ ID NO: 33990 - DNA, 22 bp, Homo sapiens
gatctcagacaggtggacaggg

SEQ ID NO: 33991 - DNA, 22 bp, Homo sapiens
acttcttcttcagctgggggat

SEQ ID NO: 33992 - DNA, 22 bp, Homo sapiens
tgttaaatgctcagctcgggga

SEQ ID NO: 33993 - DNA, 22 bp, Homo sapiens
agctggaattacaggcacgcac

SEQ ID NO: 33994 - DNA, 22 bp, Homo sapiens
tggtatgaccgtggtgcaagca

SEQ ID NO: 33995 - DNA, 22 bp, Homo sapiens
tttgaggttagctagcagatca

SEQ ID NO: 33996 - DNA, 22 bp, Homo sapiens
cctgtctctgcagggccctgcc

SEQ ID NO: 33997 - DNA, 22 bp, Homo sapiens
cacggcctgtaaggacccagga

SEQ ID NO: 33998 - DNA, 22 bp, Homo sapiens
aagccaatgctagcccacatgc

SEQ ID NO: 33999 - DNA, 22 bp, Homo sapiens
aattttctggtgtgtaatgaag

SEQ ID NO: 34000 - DNA, 22 bp, Homo sapiens
ctggggaacgcagcgagcagcg

SEQ ID NO: 34001 - DNA, 22 bp, Homo sapiens
tgtgactggttgtcccgctttc

SEQ ID NO: 34002 - DNA, 22 bp, Homo sapiens
acgtgcaggatctggttggcga

SEQ ID NO: 34003 - DNA, 22 bp, Homo sapiens
aagtgctgagactacaggcatg

SEQ ID NO: 34004 - DNA, 23 bp, Homo sapiens
gcctgggagttgcgatctgcccg

SEQ ID NO: 34005 - DNA, 22 bp, Homo sapiens
tagctcaaaggttaagtgtgga

SEQ ID NO: 34006 - DNA, 22 bp, Homo sapiens
agcccaggctggagtgcagtgg

SEQ ID NO: 34007 - DNA, 22 bp, Homo sapiens
taaagggtaggttttactgtaa

SEQ ID NO: 34008 - DNA, 22 bp, Homo sapiens
aaacttgagccaagggcttggg

SEQ ID NO: 34009 - DNA, 22 bp, Homo sapiens
cccaactactctcaggcagctt

SEQ ID NO: 34010 - DNA, 22 bp, Homo sapiens
cctcttctaggacgtccttgtg

SEQ ID NO: 34011 - DNA, 22 bp, Homo sapiens
ccttttatagatcagtgtgtta

SEQ ID NO: 34012 - DNA, 22 bp, Homo sapiens
ctggtctggctacccagcgaat

SEQ ID NO: 34013 - DNA, 22 bp, Homo sapiens
gcctgtcccgcaccggagcccg

SEQ ID NO: 34014 - DNA, 20 bp, Homo sapiens
ggccggggagctctccaggg

SEQ ID NO: 34015 - DNA, 22 bp, Homo sapiens
gcccaggctggagttcagtggt

SEQ ID NO: 34016 - DNA, 22 bp, Homo sapiens
ctcattgcaacctccgcctccc

SEQ ID NO: 34017 - DNA, 22 bp, Homo sapiens
gcacatgaggctgtctttgtct

SEQ ID NO: 34018 - DNA, 22 bp, Homo sapiens
caggtgagaggcggtcctgcat

SEQ ID NO: 34019 - DNA, 22 bp, Homo sapiens
ggagtagctgcattccgagcac

SEQ ID NO: 34020 - DNA, 22 bp, Homo sapiens
gcagggcacaaggacgcacagg

SEQ ID NO: 34021 - DNA, 22 bp, Homo sapiens
tggtggacgatgcccagctgga

SEQ ID NO: 34022 - DNA, 22 bp, Homo sapiens
tggcacagactgggccaaggaa

SEQ ID NO: 34023 - DNA, 22 bp, Homo sapiens
ctctggaggtggaggttgcagt

SEQ ID NO: 34024 - DNA, 22 bp, Homo sapiens
tcccaccttccgtggaacccgt

SEQ ID NO: 34025 - DNA, 22 bp, Homo sapiens
tgagctgtgtcttggtgagagt

SEQ ID NO: 34026 - DNA, 22 bp, Homo sapiens
agacccaggattggggctgccg

SEQ ID NO: 34027 - DNA, 22 bp, Homo sapiens
gacctcgtgatccgcccgcttt

SEQ ID NO: 34028 - DNA, 22 bp, Homo sapiens
cacctagggtttcgcctttctt

SEQ ID NO: 34029 - DNA, 22 bp, Homo sapiens
ggccaattccaggagccggcgg

SEQ ID NO: 34030 - DNA, 22 bp, Homo sapiens
agtggctgagtgactgtgactc

SEQ ID NO: 34031 - DNA, 23 bp, Homo sapiens
actgcagtcttgatctcctgggc

SEQ ID NO: 34032 - DNA, 22 bp, Homo sapiens
ggctccaccctgcttccagaag

SEQ ID NO: 34033 - DNA, 22 bp, Homo sapiens
tgatcaaaacattactccacca

SEQ ID NO: 34034 - DNA, 22 bp, Homo sapiens
gctggaaatgattaaatggtga

SEQ ID NO: 34035 - DNA, 22 bp, Homo sapiens
gccagtgcctcgccgcgctcct

SEQ ID NO: 34036 - DNA, 20 bp, Homo sapiens
agcagagtgcccatcccgga

SEQ ID NO: 34037 - DNA, 22 bp, Homo sapiens
ttatatgtttctgtttggaggc

SEQ ID NO: 34038 - DNA, 22 bp, Homo sapiens
caagatcttcctcaatagacct

SEQ ID NO: 34039 - DNA, 22 bp, Homo sapiens
cccgggaggtggagcttgcagt

SEQ ID NO: 34040 - DNA, 21 bp, Homo sapiens
acatggactgtgaatggggac

SEQ ID NO: 34041 - DNA, 22 bp, Homo sapiens
tatctaataaatctgataagta

SEQ ID NO: 34042 - DNA, 22 bp, Homo sapiens
ctgcactgagcatctaacctta

SEQ ID NO: 34043 - DNA, 22 bp, Homo sapiens
ggagaggcttccagagtcgtgc

SEQ ID NO: 34044 - DNA, 21 bp, Homo sapiens
gaacccagcagcagtgctctg

SEQ ID NO: 34045 - DNA, 22 bp, Homo sapiens
tctgactcccatattccacttc

SEQ ID NO: 34046 - DNA, 22 bp, Homo sapiens
gagggtggtggcttaaggtgct

SEQ ID NO: 34047 - DNA, 22 bp, Homo sapiens
cccttagaattttgtagttatt

SEQ ID NO: 34048 - DNA, 22 bp, Homo sapiens
ctccacagctgtaaatataggg

SEQ ID NO: 34049 - DNA, 22 bp, Homo sapiens
acacggcactttaggaaggggc

SEQ ID NO: 34050 - DNA, 22 bp, Homo sapiens
tcatcagggatattggcctgaa

SEQ ID NO: 34051 - DNA, 22 bp, Homo sapiens
ctgtctgcaggatagtaccctc

SEQ ID NO: 34052 - DNA, 22 bp, Homo sapiens
ggacaagcctgtgagtgggttt

SEQ ID NO: 34053 - DNA, 19 bp, Homo sapiens
tgttgtctaccatgaagtc

SEQ ID NO: 34054 - DNA, 22 bp, Homo sapiens
aatgttgtgcatgtattttgta

SEQ ID NO: 34055 - DNA, 22 bp, Homo sapiens
tccaccatgtaacaagctctgt

SEQ ID NO: 34056 - DNA, 22 bp, Homo sapiens
atagtggggacaggatggttgg

SEQ ID NO: 34057 - DNA, 18 bp, Homo sapiens
gaaagatgaacttttttc

SEQ ID NO: 34058 - DNA, 22 bp, Homo sapiens
gctggagaggatcccaaagcca

SEQ ID NO: 34059 - DNA, 22 bp, Homo sapiens
ttccagctaactcacatccctt

SEQ ID NO: 34060 - DNA, 22 bp, Homo sapiens
gatgctgagagattggagacta

SEQ ID NO: 34061 - DNA, 22 bp, Homo sapiens
ctcactgcaagctcagcctccc

SEQ ID NO: 34062 - DNA, 22 bp, Homo sapiens
gtgcctgcaggtgccggcttca

SEQ ID NO: 34063 - DNA, 22 bp, Homo sapiens
gccaccctggacgcactgttcg

SEQ ID NO: 34064 - DNA, 22 bp, Homo sapiens
ggggtctcactatgttacccag

SEQ ID NO: 34065 - DNA, 21 bp, Homo sapiens
agctgcctccacttctgaggc

SEQ ID NO: 34066 - DNA, 22 bp, Homo sapiens
cagttccctccgccagcacttc

SEQ ID NO: 34067 - DNA, 22 bp, Homo sapiens
ccaccgccttggcgtgttcccc

SEQ ID NO: 34068 - DNA, 22 bp, Homo sapiens
ccaggtaggagagtcaacatgt

SEQ ID NO: 34069 - DNA, 22 bp, Homo sapiens
gcccgcagagatctttaacaaa

SEQ ID NO: 34070 - DNA, 22 bp, Homo sapiens
aaagtgctgggattacaggcat

SEQ ID NO: 34071 - DNA, 22 bp, Homo sapiens
ttgtgaatagtgccgcaataaa

SEQ ID NO: 34072 - DNA, 18 bp, Homo sapiens
ctgtaccaccctgagggc

SEQ ID NO: 34073 - DNA, 22 bp, Homo sapiens
tgggattcaccatgggcttcag

SEQ ID NO: 34074 - DNA, 22 bp, Homo sapiens
ctggacacactggagtctggca

SEQ ID NO: 34075 - DNA, 22 bp, Homo sapiens
ctaaagtgccaggaatacaggt

SEQ ID NO: 34076 - DNA, 22 bp, Homo sapiens
agggtcctgggtgcagttgctt

SEQ ID NO: 34077 - DNA, 22 bp, Homo sapiens
gctaggttggggaagttctcct

SEQ ID NO: 34078 - DNA, 22 bp, Homo sapiens
ctgaaggatgtgtggtgggagt

SEQ ID NO: 34079 - DNA, 22 bp, Homo sapiens
cccagcaggtcggtgctgcctg

SEQ ID NO: 34080 - DNA, 22 bp, Homo sapiens
agcgcttgccgcactccaagca

SEQ ID NO: 34081 - DNA, 22 bp, Homo sapiens
aatgtgaggccttggtagttat

SEQ ID NO: 34082 - DNA, 22 bp, Homo sapiens
tagtgaatgggggttatgagac

SEQ ID NO: 34083 - DNA, 22 bp, Homo sapiens
caccaaagtcgcttctgtcgtc

SEQ ID NO: 34084 - DNA, 21 bp, Homo sapiens
attctttgatgtgcaataagt

SEQ ID NO: 34085 - DNA, 22 bp, Homo sapiens
tcttggattttaatggatcaaa

SEQ ID NO: 34086 - DNA, 22 bp, Homo sapiens
cccaggaggtggagcttgcagt

SEQ ID NO: 34087 - DNA, 22 bp, Homo sapiens
ggtgggccacggcataacgggc

SEQ ID NO: 34088 - DNA, 22 bp, Homo sapiens
gtccgtagtggctgatgctttg

SEQ ID NO: 34089 - DNA, 22 bp, Homo sapiens
cctgttgtttactgcagtgagt

SEQ ID NO: 34090 - DNA, 22 bp, Homo sapiens
acatcatttgtctgtagctgaa

SEQ ID NO: 34091 - DNA, 20 bp, Homo sapiens
cagtgcattgcttctgattt

SEQ ID NO: 34092 - DNA, 22 bp, Homo sapiens
gacagctccagctcctccaggc

SEQ ID NO: 34093 - DNA, 22 bp, Homo sapiens
gaggcagaggttgcagtgagct

SEQ ID NO: 34094 - DNA, 22 bp, Homo sapiens
aagggcctgccagctcttcatg

SEQ ID NO: 34095 - DNA, 22 bp, Homo sapiens
cccaggagttagaggttgtggt

SEQ ID NO: 34096 - DNA, 22 bp, Homo sapiens
tgggggtgtcctggtgcacaca

SEQ ID NO: 34097 - DNA, 22 bp, Homo sapiens
tgctttgtgacagattagtttt

SEQ ID NO: 34098 - DNA, 22 bp, Homo sapiens
atgggtcagttcagtggccaac

SEQ ID NO: 34099 - DNA, 22 bp, Homo sapiens
agcagagcaaagctcagaaatg

SEQ ID NO: 34100 - DNA, 22 bp, Homo sapiens
gctcaagccttctgcccacctc

SEQ ID NO: 34101 - DNA, 22 bp, Homo sapiens
tgtctgcctgcgggccggcaca

SEQ ID NO: 34102 - DNA, 22 bp, Homo sapiens
ttggtttccttaacagcctaaa

SEQ ID NO: 34103 - DNA, 22 bp, Homo sapiens
ctgttcccggtggccgggccag

SEQ ID NO: 34104 - DNA, 22 bp, Homo sapiens
aacccacaaaggatttcagctc

SEQ ID NO: 34105 - DNA, 22 bp, Homo sapiens
caatttgattaataccatactt

SEQ ID NO: 34106 - DNA, 22 bp, Homo sapiens
aggcgggttcagggctgccatg

SEQ ID NO: 34107 - DNA, 22 bp, Homo sapiens
gaggcaaagcatgtggctcagg

SEQ ID NO: 34108 - DNA, 16 bp, Homo sapiens
aggcgaaggttcattt

SEQ ID NO: 34109 - DNA, 22 bp, Homo sapiens
actgcgtggggagctgtgacta

SEQ ID NO: 34110 - DNA, 22 bp, Homo sapiens
caaatactacgattcttgcagt

SEQ ID NO: 34111 - DNA, 22 bp, Homo sapiens
atatattttttgagacagagtc

SEQ ID NO: 34112 - DNA, 22 bp, Homo sapiens
tcctcagtcacggtagcacatt

SEQ ID NO: 34113 - DNA, 22 bp, Homo sapiens
ccaggctggagtgcaatggcat

SEQ ID NO: 34114 - DNA, 22 bp, Homo sapiens
gagcaacacgcagtagtatacg

SEQ ID NO: 34115 - DNA, 22 bp, Homo sapiens
actccacatttgaacacagttc

SEQ ID NO: 34116 - DNA, 22 bp, Homo sapiens
caaagtgctgggattataggca

SEQ ID NO: 34117 - DNA, 22 bp, Homo sapiens
tgacaggaaacatgcagtgatt

SEQ ID NO: 34118 - DNA, 22 bp, Homo sapiens
gccagcagcttcttctcatcct

SEQ ID NO: 34119 - DNA, 22 bp, Homo sapiens
caggaggacatactggctcaca

SEQ ID NO: 34120 - DNA, 22 bp, Homo sapiens
gtccaggcctgcctctgaggag

SEQ ID NO: 34121 - DNA, 22 bp, Homo sapiens
ggtggctgcaatggctaacttc

SEQ ID NO: 34122 - DNA, 22 bp, Homo sapiens
gacccaggggcagggagaaagt

SEQ ID NO: 34123 - DNA, 22 bp, Homo sapiens
ttgaggcctgctggaaggtgtt

SEQ ID NO: 34124 - DNA, 22 bp, Homo sapiens
ttcagacatgcaggctgaggct

SEQ ID NO: 34125 - DNA, 22 bp, Homo sapiens
ttccagtcacaaaacatattaa

SEQ ID NO: 34126 - DNA, 22 bp, Homo sapiens
gggaagatagtgttgagggccc

SEQ ID NO: 34127 - DNA, 22 bp, Homo sapiens
ataatacatggttgatcttttc

SEQ ID NO: 34128 - DNA, 22 bp, Homo sapiens
tggcacttttcccagttttggt

SEQ ID NO: 34129 - DNA, 22 bp, Homo sapiens
gatccgaatcattgctctttta

SEQ ID NO: 34130 - DNA, 22 bp, Homo sapiens
cttgcagtttaggtcctctgtg

SEQ ID NO: 34131 - DNA, 22 bp, Homo sapiens
aaccaccaccgtaatttaccca

SEQ ID NO: 34132 - DNA, 22 bp, Homo sapiens
caaagtgctgggattacaggct

SEQ ID NO: 34133 - DNA, 22 bp, Homo sapiens
ttgattatagactcactaatct

SEQ ID NO: 34134 - DNA, 22 bp, Homo sapiens
tgggaagggtcaacagctggaa

SEQ ID NO: 34135 - DNA, 22 bp, Homo sapiens
caaagctggaaaaggaggctgg

SEQ ID NO: 34136 - DNA, 22 bp, Homo sapiens
tggattgtaacatagagtaaat

SEQ ID NO: 34137 - DNA, 22 bp, Homo sapiens
ctgagcctcctgcttctatttc

SEQ ID NO: 34138 - DNA, 22 bp, Homo sapiens
cctggaggcggaggttgcagtg

SEQ ID NO: 34139 - DNA, 22 bp, Homo sapiens
ctgctttagacggctttcgctg

SEQ ID NO: 34140 - DNA, 22 bp, Homo sapiens
agtccaaagcagatgagggcca

SEQ ID NO: 34141 - DNA, 22 bp, Homo sapiens
gggcagcagccactcatttagc

SEQ ID NO: 34142 - DNA, 22 bp, Homo sapiens
tggaaccatcaaagagatcctg

SEQ ID NO: 34143 - DNA, 22 bp, Homo sapiens
tagaggatgatccttccttgcc

SEQ ID NO: 34144 - DNA, 22 bp, Homo sapiens
ctatcacagagggttgttttga

SEQ ID NO: 34145 - DNA, 22 bp, Homo sapiens
ctctcgccagcggggctgcgct

SEQ ID NO: 34146 - DNA, 22 bp, Homo sapiens
ctgtaatcccagctactcggga

SEQ ID NO: 34147 - DNA, 22 bp, Homo sapiens
attctaatggcagagactcctg

SEQ ID NO: 34148 - DNA, 22 bp, Homo sapiens
cagctcacccatcacgtctgct

SEQ ID NO: 34149 - DNA, 22 bp, Homo sapiens
cgtaggtggctcagcacctggg

SEQ ID NO: 34150 - DNA, 22 bp, Homo sapiens
caactccctgtggggtactggg

SEQ ID NO: 34151 - DNA, 22 bp, Homo sapiens
acccacaacagctctaggaagt

SEQ ID NO: 34152 - DNA, 22 bp, Homo sapiens
gggagtgggtttggcctaggcc

SEQ ID NO: 34153 - DNA, 22 bp, Homo sapiens
cagggaaagtcccaccccacac

SEQ ID NO: 34154 - DNA, 22 bp, Homo sapiens
cttctcttcctttgtcaactga

SEQ ID NO: 34155 - DNA, 22 bp, Homo sapiens
agcgagtgggtcagcgttgcag

SEQ ID NO: 34156 - DNA, 22 bp, Homo sapiens
acccaggccattggcaagagtc

SEQ ID NO: 34157 - DNA, 22 bp, Homo sapiens
catagcggtattccacgtggtt

SEQ ID NO: 34158 - DNA, 22 bp, Homo sapiens
tcgcccaggctggaagtgcagt

SEQ ID NO: 34159 - DNA, 23 bp, Homo sapiens
actctcaggttctttccagcagg

SEQ ID NO: 34160 - DNA, 22 bp, Homo sapiens
ctggtagtttgcaaaatggtgt

SEQ ID NO: 34161 - DNA, 21 bp, Homo sapiens
cctcaagtgcctcctgctgct

SEQ ID NO: 34162 - DNA, 22 bp, Homo sapiens
tctcgctctgtcgcccaggctg

SEQ ID NO: 34163 - DNA, 22 bp, Homo sapiens
atggtcaccttgggagcctgct

SEQ ID NO: 34164 - DNA, 22 bp, Homo sapiens
tcacagagaaatgtggcacaaa

SEQ ID NO: 34165 - DNA, 22 bp, Homo sapiens
gccgtgtcatctgcgggtggca

SEQ ID NO: 34166 - DNA, 22 bp, Homo sapiens
cgtcacttcttagtctattttc

SEQ ID NO: 34167 - DNA, 22 bp, Homo sapiens
acccaggagacggaggtgcagt

SEQ ID NO: 34168 - DNA, 22 bp, Homo sapiens
ggtgttcaaatgaacacatgca

SEQ ID NO: 34169 - DNA, 22 bp, Homo sapiens
tggagggcatgctgtccatggg

SEQ ID NO: 34170 - DNA, 23 bp, Homo sapiens
ttgggcaaatcactaacgtctcc

SEQ ID NO: 34171 - DNA, 22 bp, Homo sapiens
ccaagggcgcctccgttccccc

SEQ ID NO: 34172 - DNA, 22 bp, Homo sapiens
gggctgtaggagctggaatggg

SEQ ID NO: 34173 - DNA, 22 bp, Homo sapiens
ctcattgcccagatccccacag

SEQ ID NO: 34174 - DNA, 22 bp, Homo sapiens
acaactccttcttgggtcctgg

SEQ ID NO: 34175 - DNA, 22 bp, Homo sapiens
agtgggaattttctcccaggga

SEQ ID NO: 34176 - DNA, 22 bp, Homo sapiens
gagcccaggagtttgatgctgc

SEQ ID NO: 34177 - DNA, 22 bp, Homo sapiens
cactcagctgagccctcagccc

SEQ ID NO: 34178 - DNA, 22 bp, Homo sapiens
gcttcaaactgagcttcaagtg

SEQ ID NO: 34179 - DNA, 22 bp, Homo sapiens
agtgccaaatcgagggctctga

SEQ ID NO: 34180 - DNA, 22 bp, Homo sapiens
tttggcggggcaattctgaagc

SEQ ID NO: 34181 - DNA, 22 bp, Homo sapiens
tggcaaaatgagcaattacttt

SEQ ID NO: 34182 - DNA, 22 bp, Homo sapiens
gaaaaggcctggggcaaagtgt

SEQ ID NO: 34183 - DNA, 22 bp, Homo sapiens
ttaggatttgaaaaggggcaga

SEQ ID NO: 34184 - DNA, 22 bp, Homo sapiens
ccttgtttctctcccagataag

SEQ ID NO: 34185 - DNA, 22 bp, Homo sapiens
gacactctttcctcttctggaa

SEQ ID NO: 34186 - DNA, 22 bp, Homo sapiens
ccctggctgataccggaaaggc

SEQ ID NO: 34187 - DNA, 22 bp, Homo sapiens
aagaatgagctcaaagatctta

SEQ ID NO: 34188 - DNA, 22 bp, Homo sapiens
catttctgggagacatgctaga

SEQ ID NO: 34189 - DNA, 22 bp, Homo sapiens
tgtctgggagactgatcacccg

SEQ ID NO: 34190 - DNA, 22 bp, Homo sapiens
caccatttagtagcaagagctc

SEQ ID NO: 34191 - DNA, 22 bp, Homo sapiens
ctcagcactttggaaggctgat

SEQ ID NO: 34192 - DNA, 22 bp, Homo sapiens
cagtcaccttgaggactcagac

SEQ ID NO: 34193 - DNA, 22 bp, Homo sapiens
tggcaggcgggagccatagagg

SEQ ID NO: 34194 - DNA, 22 bp, Homo sapiens
atgttctacagatggaaagggg

SEQ ID NO: 34195 - DNA, 22 bp, Homo sapiens
gggcatggtggcaggcacctgt

SEQ ID NO: 34196 - DNA, 22 bp, Homo sapiens
ttactcgtgacaatgtccttga

SEQ ID NO: 34197 - DNA, 22 bp, Homo sapiens
tctgctttcttactaaaaatga

SEQ ID NO: 34198 - DNA, 21 bp, Homo sapiens
cagtggcacgatttcggctca

SEQ ID NO: 34199 - DNA, 22 bp, Homo sapiens
aacatagaataaatgagttagg

SEQ ID NO: 34200 - DNA, 22 bp, Homo sapiens
gaactttataactgtaaatgtc

SEQ ID NO: 34201 - DNA, 22 bp, Homo sapiens
tttcccaggctggaatgcagtg

SEQ ID NO: 34202 - DNA, 22 bp, Homo sapiens
tcccagaaacgcatatgttcat

SEQ ID NO: 34203 - DNA, 22 bp, Homo sapiens
tgcaaatgtgttttaaaccaaa

SEQ ID NO: 34204 - DNA, 22 bp, Homo sapiens
gcccagtggtaaaagcaggcct

SEQ ID NO: 34205 - DNA, 22 bp, Homo sapiens
ttattagagtgctttgagaaag

SEQ ID NO: 34206 - DNA, 22 bp, Homo sapiens
tcagtctttccctccctcagtt

SEQ ID NO: 34207 - DNA, 22 bp, Homo sapiens
tggtatttctgtgcccagctca

SEQ ID NO: 34208 - DNA, 22 bp, Homo sapiens
gtggcttggaccagtcacagtg

SEQ ID NO: 34209 - DNA, 22 bp, Homo sapiens
tatctatgtgctctgacctctc

SEQ ID NO: 34210 - DNA, 22 bp, Homo sapiens
agggaagcagcagccgcctgtc

SEQ ID NO: 34211 - DNA, 22 bp, Homo sapiens
agggaagaaaatccatcgctgc

SEQ ID NO: 34212 - DNA, 23 bp, Homo sapiens
aaactacaacgccaggcactgag

SEQ ID NO: 34213 - DNA, 22 bp, Homo sapiens
tctgccgtgcgaggtcccacca

SEQ ID NO: 34214 - DNA, 22 bp, Homo sapiens
ttctcttacattttctcagcct

SEQ ID NO: 34215 - DNA, 22 bp, Homo sapiens
tcatggcttttattatgttgag

SEQ ID NO: 34216 - DNA, 22 bp, Homo sapiens
tgggaagaggggtataaagaag

SEQ ID NO: 34217 - DNA, 22 bp, Homo sapiens
cagcgtctcgttgtgggcctcg

SEQ ID NO: 34218 - DNA, 22 bp, Homo sapiens
cattctctctacttgttttcaa

SEQ ID NO: 34219 - DNA, 22 bp, Homo sapiens
gtgcatgtcggggtgcatgtca

SEQ ID NO: 34220 - DNA, 18 bp, Homo sapiens
catgggtgacaggtggat

SEQ ID NO: 34221 - DNA, 22 bp, Homo sapiens
agcctggcctgggcaggcacat

SEQ ID NO: 34222 - DNA, 22 bp, Homo sapiens
tgcttgaacccaggaagtggag

SEQ ID NO: 34223 - DNA, 22 bp, Homo sapiens
taatggattaacgtccctgtcg

SEQ ID NO: 34224 - DNA, 22 bp, Homo sapiens
atgatactctaggtgatttaca

SEQ ID NO: 34225 - DNA, 22 bp, Homo sapiens
ccaggagttggaagctgccatg

SEQ ID NO: 34226 - DNA, 22 bp, Homo sapiens
acatggcaaaaccccgtttcta

SEQ ID NO: 34227 - DNA, 19 bp, Homo sapiens
cgcgccgtcgggtccagcc

SEQ ID NO: 34228 - DNA, 23 bp, Homo sapiens
aacgacagctacaggcatcccac

SEQ ID NO: 34229 - DNA, 22 bp, Homo sapiens
tagcataacaggtaagagtgag

SEQ ID NO: 34230 - DNA, 22 bp, Homo sapiens
gttgaggagcaagcatgtgtct

SEQ ID NO: 34231 - DNA, 22 bp, Homo sapiens
ggcctcttatctggctcctgca

SEQ ID NO: 34232 - DNA, 22 bp, Homo sapiens
gcgcactgggcgcacgcgtagg

SEQ ID NO: 34233 - DNA, 22 bp, Homo sapiens
ggggccttggatctgtgccccg

SEQ ID NO: 34234 - DNA, 22 bp, Homo sapiens
ggagcagggaattacagcgcag

SEQ ID NO: 34235 - DNA, 22 bp, Homo sapiens
ttggccatctaagcccagccac

SEQ ID NO: 34236 - DNA, 22 bp, Homo sapiens
gctgctttgtctgtaaaatgga

SEQ ID NO: 34237 - DNA, 22 bp, Homo sapiens
cgaggcggcggaagtgcccgta

SEQ ID NO: 34238 - DNA, 22 bp, Homo sapiens
gtacactccccctgtgaagttg

SEQ ID NO: 34239 - DNA, 22 bp, Homo sapiens
ccatgtacatgaacacggcggc

SEQ ID NO: 34240 - DNA, 22 bp, Homo sapiens
ttgcccaggctggagtgcagta

SEQ ID NO: 34241 - DNA, 22 bp, Homo sapiens
cttttgattgagcagtttcaaa

SEQ ID NO: 34242 - DNA, 22 bp, Homo sapiens
actattagcatatcatgaatgg

SEQ ID NO: 34243 - DNA, 22 bp, Homo sapiens
gagacctcttggtatcgctagg

SEQ ID NO: 34244 - DNA, 22 bp, Homo sapiens
cccagccaaaagcaagtttacc

SEQ ID NO: 34245 - DNA, 22 bp, Homo sapiens
gcggcggagacagcaggaagcc

SEQ ID NO: 34246 - DNA, 22 bp, Homo sapiens
aagagggaaattgttggctgct

SEQ ID NO: 34247 - DNA, 22 bp, Homo sapiens
acccatccagtgtccctgctag

SEQ ID NO: 34248 - DNA, 23 bp, Homo sapiens
ctcctggtgctgctatcaggggt

SEQ ID NO: 34249 - DNA, 22 bp, Homo sapiens
acctggacacctgctgtcatct

SEQ ID NO: 34250 - DNA, 22 bp, Homo sapiens
tagcagaagttgcaaactaggg

SEQ ID NO: 34251 - DNA, 22 bp, Homo sapiens
cagctttgccaagtaaggtctt

SEQ ID NO: 34252 - DNA, 20 bp, Homo sapiens
tgagacccgctgacaagttc

SEQ ID NO: 34253 - DNA, 22 bp, Homo sapiens
gcgggttgaagggcgcatcgaa

SEQ ID NO: 34254 - DNA, 21 bp, Homo sapiens
tggtacaccttgcctgtcaga

SEQ ID NO: 34255 - DNA, 22 bp, Homo sapiens
actgcactccagcctgggtgac

SEQ ID NO: 34256 - DNA, 18 bp, Homo sapiens
atggtctcatactgggag

SEQ ID NO: 34257 - DNA, 22 bp, Homo sapiens
aagtataatcaaagcagggcta

SEQ ID NO: 34258 - DNA, 22 bp, Homo sapiens
cctgcttaacattgccatgaca

SEQ ID NO: 34259 - DNA, 22 bp, Homo sapiens
tcacagtgttaaacctttcttt

SEQ ID NO: 34260 - DNA, 22 bp, Homo sapiens
aacagctttgtatacagtaact

SEQ ID NO: 34261 - DNA, 22 bp, Homo sapiens
ttcttctccgaggagggctggt

SEQ ID NO: 34262 - DNA, 22 bp, Homo sapiens
atgcagaagactgaaaagctga

SEQ ID NO: 34263 - DNA, 22 bp, Homo sapiens
cttggaggtggaagttgcagtg

SEQ ID NO: 34264 - DNA, 22 bp, Homo sapiens
tgaggcactccaggatgctgtt

SEQ ID NO: 34265 - DNA, 22 bp, Homo sapiens
tcacccaggctggagtgcagtg

SEQ ID NO: 34266 - DNA, 22 bp, Homo sapiens
tctcccaggcaggagtgcagtg

SEQ ID NO: 34267 - DNA, 18 bp, Homo sapiens
cccggctaatttttggta

SEQ ID NO: 34268 - DNA, 22 bp, Homo sapiens
ggttccccaggcggcccttgga

SEQ ID NO: 34269 - DNA, 22 bp, Homo sapiens
ttaggctgttcttgtgttgtta

SEQ ID NO: 34270 - DNA, 23 bp, Homo sapiens
agcagccagagatcctcggccct

SEQ ID NO: 34271 - DNA, 22 bp, Homo sapiens
agtggcaggatctcggttcact

SEQ ID NO: 34272 - DNA, 22 bp, Homo sapiens
agtccaggcattccagccattc

SEQ ID NO: 34273 - DNA, 22 bp, Homo sapiens
tgtctcatctcttaaccccact

SEQ ID NO: 34274 - DNA, 22 bp, Homo sapiens
acccaggctggcgtgcagtggc

SEQ ID NO: 34275 - DNA, 22 bp, Homo sapiens
tggttcagttgcacaggctgtt

SEQ ID NO: 34276 - DNA, 22 bp, Homo sapiens
catggcagctcctccagtgtga

SEQ ID NO: 34277 - DNA, 22 bp, Homo sapiens
gagaggtggaggttgcagtgag

SEQ ID NO: 34278 - DNA, 22 bp, Homo sapiens
cgatggtatcggccagccccgg

SEQ ID NO: 34279 - DNA, 22 bp, Homo sapiens
ttccatcattaacaccacaagg

SEQ ID NO: 34280 - DNA, 22 bp, Homo sapiens
cgtgcgcctcagcctcgtgcgc

SEQ ID NO: 34281 - DNA, 22 bp, Homo sapiens
caggctggagttcagtggtgtg

SEQ ID NO: 34282 - DNA, 22 bp, Homo sapiens
aagccctggcgggtggagggcc

SEQ ID NO: 34283 - DNA, 22 bp, Homo sapiens
aaatgtaagtctttgtttctta

SEQ ID NO: 34284 - DNA, 22 bp, Homo sapiens
attcacctttccccaaaatgag

SEQ ID NO: 34285 - DNA, 22 bp, Homo sapiens
gctgggacaacaggtgagcacc

SEQ ID NO: 34286 - DNA, 22 bp, Homo sapiens
tgaacatgctgttgatggcctg

SEQ ID NO: 34287 - DNA, 22 bp, Homo sapiens
cttcccaccaaagcccttgttg

SEQ ID NO: 34288 - DNA, 22 bp, Homo sapiens
gctgctctcagagctcatgctg

SEQ ID NO: 34289 - DNA, 22 bp, Homo sapiens
tccgccaggactgagggcccat

SEQ ID NO: 34290 - DNA, 22 bp, Homo sapiens
tgattcatcagaataggagttt

SEQ ID NO: 34291 - DNA, 22 bp, Homo sapiens
cgagagatgggttggcaggggc

SEQ ID NO: 34292 - DNA, 22 bp, Homo sapiens
ctcattgcagctgcattactgt

SEQ ID NO: 34293 - DNA, 22 bp, Homo sapiens
tgcctaggctggagtgcaatgg

SEQ ID NO: 34294 - DNA, 22 bp, Homo sapiens
tgctgggggtagctctgcgtag

SEQ ID NO: 34295 - DNA, 22 bp, Homo sapiens
tcagggctgcagaagaggcagg

SEQ ID NO: 34296 - DNA, 22 bp, Homo sapiens
gacaggtgctaagggacctggc

SEQ ID NO: 34297 - DNA, 22 bp, Homo sapiens
cagcagagaaattacatatttg

SEQ ID NO: 34298 - DNA, 22 bp, Homo sapiens
agagggcattaactctgtcttg

SEQ ID NO: 34299 - DNA, 22 bp, Homo sapiens
tccctgatgccttgatccgtgg

SEQ ID NO: 34300 - DNA, 22 bp, Homo sapiens
ggctctgtgtctccacccaaat

SEQ ID NO: 34301 - DNA, 22 bp, Homo sapiens
caggttcaagcgattctcctgc

SEQ ID NO: 34302 - DNA, 22 bp, Homo sapiens
tttgggcaggcttttccctaga

SEQ ID NO: 34303 - DNA, 22 bp, Homo sapiens
aggctgtagtgcatgtgctatg

SEQ ID NO: 34304 - DNA, 22 bp, Homo sapiens
ggagaggggaacttgttgcttg

SEQ ID NO: 34305 - DNA, 22 bp, Homo sapiens
tcaagcaattctcctgcctcag

SEQ ID NO: 34306 - DNA, 22 bp, Homo sapiens
tctgagacaggaagtggagggt

SEQ ID NO: 34307 - DNA, 22 bp, Homo sapiens
gcagatggatgtggacggcgcc

SEQ ID NO: 34308 - DNA, 22 bp, Homo sapiens
ctctcctattgtgtggtaagga

SEQ ID NO: 34309 - DNA, 22 bp, Homo sapiens
aatcacacaaaggcaacttttg

SEQ ID NO: 34310 - DNA, 22 bp, Homo sapiens
agcttgtgctggaattacatgt

SEQ ID NO: 34311 - DNA, 22 bp, Homo sapiens
gatggcacacagacatccccgc

SEQ ID NO: 34312 - DNA, 22 bp, Homo sapiens
tttctggcagcgggacaggggt

SEQ ID NO: 34313 - DNA, 20 bp, Homo sapiens
ttcatgggagcaaagaggcc

SEQ ID NO: 34314 - DNA, 22 bp, Homo sapiens
gcaggtctgttgattacagtca

SEQ ID NO: 34315 - DNA, 22 bp, Homo sapiens
gatatcatgggaaggtgtactt

SEQ ID NO: 34316 - DNA, 22 bp, Homo sapiens
taggtagctttggcgtttcttg

SEQ ID NO: 34317 - DNA, 22 bp, Homo sapiens
caatttctaacattccatggat

SEQ ID NO: 34318 - DNA, 22 bp, Homo sapiens
cggtctcccgtgtgtgtgcgct

SEQ ID NO: 34319 - DNA, 22 bp, Homo sapiens
agcctagggttctgatgtcact

SEQ ID NO: 34320 - DNA, 22 bp, Homo sapiens
tcctccccaaagcccagcctgg

SEQ ID NO: 34321 - DNA, 22 bp, Homo sapiens
gttcaagaccagcctggccaac

SEQ ID NO: 34322 - DNA, 19 bp, Homo sapiens
acacagggatcagagggtt

SEQ ID NO: 34323 - DNA, 21 bp, Homo sapiens
ctggccactgcacctcttcct

SEQ ID NO: 34324 - DNA, 19 bp, Homo sapiens
tctcaattctccccactgc

SEQ ID NO: 34325 - DNA, 22 bp, Homo sapiens
ctgtccttccagccgaaatcta

SEQ ID NO: 34326 - DNA, 16 bp, Homo sapiens
tggggatggggaagag

SEQ ID NO: 34327 - DNA, 22 bp, Homo sapiens
agctgctgagccaggctgatgt

SEQ ID NO: 34328 - DNA, 22 bp, Homo sapiens
ccaggctggagtgcagtggcac

SEQ ID NO: 34329 - DNA, 22 bp, Homo sapiens
aacagcttgctgcaccttaata

SEQ ID NO: 34330 - DNA, 22 bp, Homo sapiens
caggctggagtgcagtggtgcc

SEQ ID NO: 34331 - DNA, 22 bp, Homo sapiens
aggcactgtgcagtcccaagca

SEQ ID NO: 34332 - DNA, 18 bp, Homo sapiens
acctgattggcgcagccc

SEQ ID NO: 34333 - DNA, 22 bp, Homo sapiens
ctccagtgcttctagaaaatac

SEQ ID NO: 34334 - DNA, 22 bp, Homo sapiens
actggacagaggaaatatggag

SEQ ID NO: 34335 - DNA, 22 bp, Homo sapiens
gtgcacatcgtgcaggtttgtt

SEQ ID NO: 34336 - DNA, 22 bp, Homo sapiens
tgatcaggtctgaacagggagg

SEQ ID NO: 34337 - DNA, 22 bp, Homo sapiens
cccattcatcctcgcttccttc

SEQ ID NO: 34338 - DNA, 22 bp, Homo sapiens
aatgtcaaaggctatacattca

SEQ ID NO: 34339 - DNA, 21 bp, Homo sapiens
gcccacagtgaggaggatccc

SEQ ID NO: 34340 - DNA, 22 bp, Homo sapiens
aacccgagggccccaggctcgg

SEQ ID NO: 34341 - DNA, 22 bp, Homo sapiens
agaggccggccgagcccatggg

SEQ ID NO: 34342 - DNA, 22 bp, Homo sapiens
atttgattgtgtctgagacgat

SEQ ID NO: 34343 - DNA, 22 bp, Homo sapiens
cttcctttgctgttcggaggtt

SEQ ID NO: 34344 - DNA, 22 bp, Homo sapiens
tgaagtcagggattccatgaag

SEQ ID NO: 34345 - DNA, 22 bp, Homo sapiens
tgcgcctgtaagtccagagtcc

SEQ ID NO: 34346 - DNA, 22 bp, Homo sapiens
ctccccattatgcagtcattat

SEQ ID NO: 34347 - DNA, 19 bp, Homo sapiens
ggggcctgtgatggtcaca

SEQ ID NO: 34348 - DNA, 22 bp, Homo sapiens
gaaacactcaatttagtaattc

SEQ ID NO: 34349 - DNA, 22 bp, Homo sapiens
tgtctcctcggctgtccagcca

SEQ ID NO: 34350 - DNA, 22 bp, Homo sapiens
ccaggctagaaactgaggcaca

SEQ ID NO: 34351 - DNA, 22 bp, Homo sapiens
ttgaggtccccagtacccactg

SEQ ID NO: 34352 - DNA, 14 bp, Homo sapiens
gcaggcggatcact

SEQ ID NO: 34353 - DNA, 23 bp, Homo sapiens
ggagcctccggtgtgtgagaggc

SEQ ID NO: 34354 - DNA, 20 bp, Homo sapiens
gtgcaatggctcagtctcag

SEQ ID NO: 34355 - DNA, 22 bp, Homo sapiens
aatccctccccaggcaagtcct

SEQ ID NO: 34356 - DNA, 22 bp, Homo sapiens
ttttctaacatctagtaatttg

SEQ ID NO: 34357 - DNA, 22 bp, Homo sapiens
ctgctgggatagaagtatctca

SEQ ID NO: 34358 - DNA, 22 bp, Homo sapiens
ctgattctcctcaagactttcg

SEQ ID NO: 34359 - DNA, 23 bp, Homo sapiens
aaacttgctatggctgaaatcat

SEQ ID NO: 34360 - DNA, 22 bp, Homo sapiens
ttctccgctaagttctctgcag

SEQ ID NO: 34361 - DNA, 22 bp, Homo sapiens
accaccttcctgcgtgtctctt

SEQ ID NO: 34362 - DNA, 22 bp, Homo sapiens
tgtgtggattcatctcaaagag

SEQ ID NO: 34363 - DNA, 22 bp, Homo sapiens
aggccaggaatccttgtcccag

SEQ ID NO: 34364 - DNA, 22 bp, Homo sapiens
tgacagaggagctggaatgatt

SEQ ID NO: 34365 - DNA, 22 bp, Homo sapiens
tgaatatgtgactttgatttca

SEQ ID NO: 34366 - DNA, 22 bp, Homo sapiens
gcagatgtgtcctggagggagg

SEQ ID NO: 34367 - DNA, 22 bp, Homo sapiens
tctttcttgtgggtgccctttt

SEQ ID NO: 34368 - DNA, 22 bp, Homo sapiens
gggactggagtagaggccggtg

SEQ ID NO: 34369 - DNA, 22 bp, Homo sapiens
ataataacaatgccagatgcct

SEQ ID NO: 34370 - DNA, 22 bp, Homo sapiens
atttcatactaaggctcaaaaa

SEQ ID NO: 34371 - DNA, 22 bp, Homo sapiens
aattgaaaatattgtagaccat

SEQ ID NO: 34372 - DNA, 22 bp, Homo sapiens
ttgagcatctgaggattttcct

SEQ ID NO: 34373 - DNA, 22 bp, Homo sapiens
tcccaagtagatgggaatacag

SEQ ID NO: 34374 - DNA, 22 bp, Homo sapiens
gtcaccagtgctaagaggtgga

SEQ ID NO: 34375 - DNA, 22 bp, Homo sapiens
tgagaattacaaatgagtcaca

SEQ ID NO: 34376 - DNA, 22 bp, Homo sapiens
ctcctgggaaaggctggacaca

SEQ ID NO: 34377 - DNA, 22 bp, Homo sapiens
gggtcgcttggagaggcttcct

SEQ ID NO: 34378 - DNA, 22 bp, Homo sapiens
gttcagtcacgtgcccaagttc

SEQ ID NO: 34379 - DNA, 22 bp, Homo sapiens
cctgacaggcggaggctgcagt

SEQ ID NO: 34380 - DNA, 21 bp, Homo sapiens
acctgagctccacctcctgcc

SEQ ID NO: 34381 - DNA, 22 bp, Homo sapiens
tcagtgtgaattcaggagccta

SEQ ID NO: 34382 - DNA, 22 bp, Homo sapiens
tggcgcgacgtgccccctgctt

SEQ ID NO: 34383 - DNA, 22 bp, Homo sapiens
gcagcgaggtgatgaaatagct

SEQ ID NO: 34384 - DNA, 22 bp, Homo sapiens
tgagaaacacaggcatgaatag

SEQ ID NO: 34385 - DNA, 22 bp, Homo sapiens
taggtataggattctaggttgg

SEQ ID NO: 34386 - DNA, 22 bp, Homo sapiens
ggtgtcagactttgcatatcct

SEQ ID NO: 34387 - DNA, 19 bp, Homo sapiens
ccacagcctgctgtcttcc

SEQ ID NO: 34388 - DNA, 22 bp, Homo sapiens
caggcactgtgctgagctctgc

SEQ ID NO: 34389 - DNA, 22 bp, Homo sapiens
tgtgacactggccatctgggtt

SEQ ID NO: 34390 - DNA, 22 bp, Homo sapiens
ctatggtgatagaaatcagaat

SEQ ID NO: 34391 - DNA, 22 bp, Homo sapiens
aaagcttaccttttcagtcttt

SEQ ID NO: 34392 - DNA, 22 bp, Homo sapiens
aggaaaacagaccaaggagctc

SEQ ID NO: 34393 - DNA, 22 bp, Homo sapiens
tgttgcccaggttctctcctgc

SEQ ID NO: 34394 - DNA, 22 bp, Homo sapiens
ttatcacttatgagctttttgc

SEQ ID NO: 34395 - DNA, 22 bp, Homo sapiens
accctggaggtggaggtgcagt

SEQ ID NO: 34396 - DNA, 22 bp, Homo sapiens
tggagccagcggcctgctgagg

SEQ ID NO: 34397 - DNA, 22 bp, Homo sapiens
tccagaaggccacccggggatg

SEQ ID NO: 34398 - DNA, 22 bp, Homo sapiens
aaattctgatttaataagtgta

SEQ ID NO: 34399 - DNA, 22 bp, Homo sapiens
tccagggagagccgctgctcca

SEQ ID NO: 34400 - DNA, 22 bp, Homo sapiens
tggtctgctgaacagccgtatc

SEQ ID NO: 34401 - DNA, 15 bp, Homo sapiens
tctagttttgaagac

SEQ ID NO: 34402 - DNA, 22 bp, Homo sapiens
ggaggagcatgagagggtagtg

SEQ ID NO: 34403 - DNA, 20 bp, Homo sapiens
ctcttccggaggggcgctcc

SEQ ID NO: 34404 - DNA, 22 bp, Homo sapiens
gtgtatgttctacttaatatta

SEQ ID NO: 34405 - DNA, 22 bp, Homo sapiens
gggagcaagccggaggtactgt

SEQ ID NO: 34406 - DNA, 22 bp, Homo sapiens
gcccaggagttcaagtctagtg

SEQ ID NO: 34407 - DNA, 22 bp, Homo sapiens
gaaaagagacagggtgggtgat

SEQ ID NO: 34408 - DNA, 22 bp, Homo sapiens
ctgggaggcggaggttgtagtg

SEQ ID NO: 34409 - DNA, 22 bp, Homo sapiens
cgggcgcactccgggcagctgt

SEQ ID NO: 34410 - DNA, 21 bp, Homo sapiens
tttcttaggctctaaaatgac

SEQ ID NO: 34411 - DNA, 22 bp, Homo sapiens
atgccaggaacaaacagtggtg

SEQ ID NO: 34412 - DNA, 22 bp, Homo sapiens
atggaatgtttatacacagttg

SEQ ID NO: 34413 - DNA, 22 bp, Homo sapiens
atgttgtgtttgactgttaccc

SEQ ID NO: 34414 - DNA, 22 bp, Homo sapiens
tgagacgaagtcttgctctgtt

SEQ ID NO: 34415 - DNA, 22 bp, Homo sapiens
ggaaggcagaggtgtcgtgggg

SEQ ID NO: 34416 - DNA, 22 bp, Homo sapiens
gggcagccccagcgcgttggct

SEQ ID NO: 34417 - DNA, 20 bp, Homo sapiens
tatttctgggcaaccattta

SEQ ID NO: 34418 - DNA, 22 bp, Homo sapiens
ctgctcagtaatagtcctatct

SEQ ID NO: 34419 - DNA, 22 bp, Homo sapiens
tattttgtgccatgcactgcct

SEQ ID NO: 34420 - DNA, 22 bp, Homo sapiens
acaaagtgaattgcatcgagtt

SEQ ID NO: 34421 - DNA, 22 bp, Homo sapiens
agcaggaaggggatgatgggca

SEQ ID NO: 34422 - DNA, 22 bp, Homo sapiens
aaccccgctcaggctgggtgag

SEQ ID NO: 34423 - DNA, 22 bp, Homo sapiens
attgcactccagcctgggtgac

SEQ ID NO: 34424 - DNA, 22 bp, Homo sapiens
ttctcttttcaccagttgctaa

SEQ ID NO: 34425 - DNA, 22 bp, Homo sapiens
gactttgtgccaaacgccagaa

SEQ ID NO: 34426 - DNA, 21 bp, Homo sapiens
tggcggggacttgtggctgcc

SEQ ID NO: 34427 - DNA, 21 bp, Homo sapiens
aagaggaagcattatggcata

SEQ ID NO: 34428 - DNA, 22 bp, Homo sapiens
ccgggcctcgggacaccgggta

SEQ ID NO: 34429 - DNA, 22 bp, Homo sapiens
tgagcccagagatctgagctat

SEQ ID NO: 34430 - DNA, 22 bp, Homo sapiens
tgatgaccgccaacgtttaggt

SEQ ID NO: 34431 - DNA, 22 bp, Homo sapiens
gcggtcggcagaggggctctgc

SEQ ID NO: 34432 - DNA, 22 bp, Homo sapiens
aagaggagaaaggctggctttg

SEQ ID NO: 34433 - DNA, 22 bp, Homo sapiens
tgcgggtcccagggtcacaggc

SEQ ID NO: 34434 - DNA, 19 bp, Homo sapiens
tctgaagaattagagagca

SEQ ID NO: 34435 - DNA, 22 bp, Homo sapiens
gttggctatgagagctttagtg

SEQ ID NO: 34436 - DNA, 17 bp, Homo sapiens
tggctctgtcctcagct

SEQ ID NO: 34437 - DNA, 22 bp, Homo sapiens
gcagttagtgaagcagcttaga

SEQ ID NO: 34438 - DNA, 22 bp, Homo sapiens
cagtgcccgccgccgttcctgg

SEQ ID NO: 34439 - DNA, 22 bp, Homo sapiens
tttacttcatttccagtgagga

SEQ ID NO: 34440 - DNA, 22 bp, Homo sapiens
aagtggactaatacaaggacta

SEQ ID NO: 34441 - DNA, 22 bp, Homo sapiens
tttgtcttatccaatctctcag

SEQ ID NO: 34442 - DNA, 22 bp, Homo sapiens
tttcaacagatctgtcttcagg

SEQ ID NO: 34443 - DNA, 20 bp, Homo sapiens
ccagagctgatggctgcccg

SEQ ID NO: 34444 - DNA, 22 bp, Homo sapiens
actgttgaagtgccagcttgat

SEQ ID NO: 34445 - DNA, 22 bp, Homo sapiens
ggaggcccagaaggaagcccag

SEQ ID NO: 34446 - DNA, 22 bp, Homo sapiens
agtggccctggagtgactcgta

SEQ ID NO: 34447 - DNA, 22 bp, Homo sapiens
accatgtcatttattggccaaa

SEQ ID NO: 34448 - DNA, 22 bp, Homo sapiens
ctgaggctggagtgcagtggtg

SEQ ID NO: 34449 - DNA, 22 bp, Homo sapiens
tgcaccctcatcagtcaaatgg

SEQ ID NO: 34450 - DNA, 22 bp, Homo sapiens
acgtcttcgttggcagagattt

SEQ ID NO: 34451 - DNA, 22 bp, Homo sapiens
cctcagctcccatgagatctgc

SEQ ID NO: 34452 - DNA, 18 bp, Homo sapiens
gcctggcttcggagccgc

SEQ ID NO: 34453 - DNA, 22 bp, Homo sapiens
ggctttgggggtgtccaagaaa

SEQ ID NO: 34454 - DNA, 23 bp, Homo sapiens
agagtacagtggcgccatctcag

SEQ ID NO: 34455 - DNA, 23 bp, Homo sapiens
ggagtgcaatggcgccatctcgg

SEQ ID NO: 34456 - DNA, 22 bp, Homo sapiens
cccatgcaccctctaagaagga

SEQ ID NO: 34457 - DNA, 22 bp, Homo sapiens
ctgtaatcccagctacctggga

SEQ ID NO: 34458 - DNA, 22 bp, Homo sapiens
ggagtgcagtggcgtgatctca

SEQ ID NO: 34459 - DNA, 22 bp, Homo sapiens
tctgagctgggtcttgacagct

SEQ ID NO: 34460 - DNA, 22 bp, Homo sapiens
ggctccctgcaacctccgcctc

SEQ ID NO: 34461 - DNA, 22 bp, Homo sapiens
aaggaggttatcccagtggact

SEQ ID NO: 34462 - DNA, 22 bp, Homo sapiens
atgattgaaaatgacattgcca

SEQ ID NO: 34463 - DNA, 22 bp, Homo sapiens
cgaggaggaaacgcggagaact

SEQ ID NO: 34464 - DNA, 22 bp, Homo sapiens
tgttagtcagacacacctaaat

SEQ ID NO: 34465 - DNA, 22 bp, Homo sapiens
gcaggcagaggtggaggagaca

SEQ ID NO: 34466 - DNA, 22 bp, Homo sapiens
ctggagggctgcagcgaggctg

SEQ ID NO: 34467 - DNA, 22 bp, Homo sapiens
ccagtgacttgccaggtggatc

SEQ ID NO: 34468 - DNA, 22 bp, Homo sapiens
tactagttcccagctaaaagta

SEQ ID NO: 34469 - DNA, 22 bp, Homo sapiens
gctatgggatgtgctgtggatg

SEQ ID NO: 34470 - DNA, 22 bp, Homo sapiens
tctggcttcgcagctcccagcc

SEQ ID NO: 34471 - DNA, 19 bp, Homo sapiens
gactccaactttaagcatg

SEQ ID NO: 34472 - DNA, 22 bp, Homo sapiens
tgggagtgtaaattagttcaac

SEQ ID NO: 34473 - DNA, 20 bp, Homo sapiens
gccaacgcgctggggctgcc

SEQ ID NO: 34474 - DNA, 22 bp, Homo sapiens
gaaactctcgcatcctgggaac

SEQ ID NO: 34475 - DNA, 22 bp, Homo sapiens
gcagtggggcaatcatagctca

SEQ ID NO: 34476 - DNA, 19 bp, Homo sapiens
gggcttggggctgaagcct

SEQ ID NO: 34477 - DNA, 22 bp, Homo sapiens
ccaggtagccaaggggtctggg

SEQ ID NO: 34478 - DNA, 22 bp, Homo sapiens
aggcggaagatggccccataga

SEQ ID NO: 34479 - DNA, 22 bp, Homo sapiens
tgtgagttattttcaggagttt

SEQ ID NO: 34480 - DNA, 22 bp, Homo sapiens
ttgtgctgactgcgcccagctc

SEQ ID NO: 34481 - DNA, 22 bp, Homo sapiens
ttacatgtttatgggggtacat

SEQ ID NO: 34482 - DNA, 22 bp, Homo sapiens
gatgcgggcccgctccactgcc

SEQ ID NO: 34483 - DNA, 22 bp, Homo sapiens
tgtatgaggcatacatcaggca

SEQ ID NO: 34484 - DNA, 22 bp, Homo sapiens
agccagggacgctgcaggctac

SEQ ID NO: 34485 - DNA, 23 bp, Homo sapiens
tcggtgggcgtggaggccgaggc

SEQ ID NO: 34486 - DNA, 22 bp, Homo sapiens
tgagtgtggggaatgtcatgag

SEQ ID NO: 34487 - DNA, 22 bp, Homo sapiens
tagaaaagccccagctggaggg

SEQ ID NO: 34488 - DNA, 22 bp, Homo sapiens
ggggccgaccgcggttcaggcc

SEQ ID NO: 34489 - DNA, 22 bp, Homo sapiens
acctttcagtgccctttctgtc

SEQ ID NO: 34490 - DNA, 22 bp, Homo sapiens
actgggccaggtgtgggtgagt

SEQ ID NO: 34491 - DNA, 22 bp, Homo sapiens
ccacaagtttgttgattgaaac

SEQ ID NO: 34492 - DNA, 22 bp, Homo sapiens
gcttagtcaattataaataggc

SEQ ID NO: 34493 - DNA, 22 bp, Homo sapiens
aaggcggggggatcacgaggtc

SEQ ID NO: 34494 - DNA, 22 bp, Homo sapiens
gggggaagaaagaacatggcat

SEQ ID NO: 34495 - DNA, 22 bp, Homo sapiens
caggccggggcggcgccatctt

SEQ ID NO: 34496 - DNA, 22 bp, Homo sapiens
gtgcaaacatcatagagtgtac

SEQ ID NO: 34497 - DNA, 22 bp, Homo sapiens
tgtagatattaattattccttt

SEQ ID NO: 34498 - DNA, 22 bp, Homo sapiens
tcagtgttaatcagtggtacct

SEQ ID NO: 34499 - DNA, 22 bp, Homo sapiens
tctgctctgtggcttcagctaa

SEQ ID NO: 34500 - DNA, 23 bp, Homo sapiens
cgcccagcctcagtgacctgggc

SEQ ID NO: 34501 - DNA, 22 bp, Homo sapiens
ttgacctatgtttcttcatctg

SEQ ID NO: 34502 - DNA, 22 bp, Homo sapiens
gaaaattattgaaaatggctct

SEQ ID NO: 34503 - DNA, 22 bp, Homo sapiens
tatgttgcaccaacctaataat

SEQ ID NO: 34504 - DNA, 22 bp, Homo sapiens
atacaaagtattaatcctggat

SEQ ID NO: 34505 - DNA, 22 bp, Homo sapiens
ggagctgttcaggactgcttca

SEQ ID NO: 34506 - DNA, 22 bp, Homo sapiens
aaagtgctaggattacaagcgt

SEQ ID NO: 34507 - DNA, 22 bp, Homo sapiens
agcggcgccgagcttggccagg

SEQ ID NO: 34508 - DNA, 22 bp, Homo sapiens
gctgctaagcgtttctgttcca

SEQ ID NO: 34509 - DNA, 22 bp, Homo sapiens
gacccttagaatgtgatcttat

SEQ ID NO: 34510 - DNA, 22 bp, Homo sapiens
tgtgtacttccccctgacctgt

SEQ ID NO: 34511 - DNA, 22 bp, Homo sapiens
cccactgtttccctgaggctct

SEQ ID NO: 34512 - DNA, 22 bp, Homo sapiens
cacagcctcctctggctcacgg

SEQ ID NO: 34513 - DNA, 22 bp, Homo sapiens
gtagtctgaacagtaattttgt

SEQ ID NO: 34514 - DNA, 22 bp, Homo sapiens
gcctggactgttctaccatttt

SEQ ID NO: 34515 - DNA, 22 bp, Homo sapiens
tcctggcttgtcacatctacgt

SEQ ID NO: 34516 - DNA, 22 bp, Homo sapiens
taacatttaaatttttcacata

SEQ ID NO: 34517 - DNA, 22 bp, Homo sapiens
tgagtgactccactggggcaga

SEQ ID NO: 34518 - DNA, 22 bp, Homo sapiens
ctctagtagctgagattacagg

SEQ ID NO: 34519 - DNA, 22 bp, Homo sapiens
agagtggagagaaacaactctg

SEQ ID NO: 34520 - DNA, 22 bp, Homo sapiens
aaatggaagctatttatgattc

SEQ ID NO: 34521 - DNA, 22 bp, Homo sapiens
ctcactgcaacctccgcctcct

SEQ ID NO: 34522 - DNA, 22 bp, Homo sapiens
cagaagactgcagggaagggac

SEQ ID NO: 34523 - DNA, 22 bp, Homo sapiens
gcctgttctccagcatccaggt

SEQ ID NO: 34524 - DNA, 22 bp, Homo sapiens
aagagggctgcaatcttattgc

SEQ ID NO: 34525 - DNA, 22 bp, Homo sapiens
tctgtagtaggttgtagttctt

SEQ ID NO: 34526 - DNA, 22 bp, Homo sapiens
ggggtctgggcttagctggaat

SEQ ID NO: 34527 - DNA, 22 bp, Homo sapiens
agagtggctctgctgggcacag

SEQ ID NO: 34528 - DNA, 22 bp, Homo sapiens
aacactgctgctgggttctgtg

SEQ ID NO: 34529 - DNA, 22 bp, Homo sapiens
ttgcagatgaagaaactgaagc

SEQ ID NO: 34530 - DNA, 22 bp, Homo sapiens
ccaggctggagtatagtggcgc

SEQ ID NO: 34531 - DNA, 22 bp, Homo sapiens
ttaagtaacttgtccaaatgag

SEQ ID NO: 34532 - DNA, 22 bp, Homo sapiens
gcatgcaatctatccttaggaa

SEQ ID NO: 34533 - DNA, 22 bp, Homo sapiens
cagtggcaggatttcagctcag

SEQ ID NO: 34534 - DNA, 22 bp, Homo sapiens
tctgtggcccaagtgatggctg

SEQ ID NO: 34535 - DNA, 21 bp, Homo sapiens
agtggctctcagcttgctaag

SEQ ID NO: 34536 - DNA, 22 bp, Homo sapiens
tctctcttttttgaacccgctc

SEQ ID NO: 34537 - DNA, 17 bp, Homo sapiens
tccttcagtgcctctgc

SEQ ID NO: 34538 - DNA, 22 bp, Homo sapiens
tgatttatgcattatactgttg

SEQ ID NO: 34539 - DNA, 22 bp, Homo sapiens
ccattgtaaattctgtggaagt

SEQ ID NO: 34540 - DNA, 22 bp, Homo sapiens
cgccaggcttggtagctcatgc

SEQ ID NO: 34541 - DNA, 22 bp, Homo sapiens
attgggatgccggctgataaga

SEQ ID NO: 34542 - DNA, 22 bp, Homo sapiens
gtcctggggattatagagtgtt

SEQ ID NO: 34543 - DNA, 22 bp, Homo sapiens
gccttgtttcattacacgtggt

SEQ ID NO: 34544 - DNA, 22 bp, Homo sapiens
aggccctattcaatggggccca

SEQ ID NO: 34545 - DNA, 22 bp, Homo sapiens
ctcactgcaagctccacctctt

SEQ ID NO: 34546 - DNA, 22 bp, Homo sapiens
cccattcttcatacaagtctaa

SEQ ID NO: 34547 - DNA, 22 bp, Homo sapiens
tcagtggagagcttccaggatt

SEQ ID NO: 34548 - DNA, 22 bp, Homo sapiens
tgccttgtccttcgtcagggct

SEQ ID NO: 34549 - DNA, 22 bp, Homo sapiens
ttcctccagccatgattgtaaa

SEQ ID NO: 34550 - DNA, 19 bp, Homo sapiens
ccttgtctggtgaaggact

SEQ ID NO: 34551 - DNA, 22 bp, Homo sapiens
ttctcatgaaactcgcttcctc

SEQ ID NO: 34552 - DNA, 22 bp, Homo sapiens
gggagctgaaggagccggcggg

SEQ ID NO: 34553 - DNA, 23 bp, Homo sapiens
aggaaagcattcatttttaccat

SEQ ID NO: 34554 - DNA, 22 bp, Homo sapiens
atttagaactttgtttgccaat

SEQ ID NO: 34555 - DNA, 22 bp, Homo sapiens
agggaaattaatgtgagcaatg

SEQ ID NO: 34556 - DNA, 22 bp, Homo sapiens
acccgggaggcaggagtcatag

SEQ ID NO: 34557 - DNA, 22 bp, Homo sapiens
taaggcaggaactggctgtttt

SEQ ID NO: 34558 - DNA, 22 bp, Homo sapiens
gacaggcttccactatgttgcc

SEQ ID NO: 34559 - DNA, 22 bp, Homo sapiens
agtccccctctgagcccaggga

SEQ ID NO: 34560 - DNA, 22 bp, Homo sapiens
gtgtgtctcccaagaaggccca

SEQ ID NO: 34561 - DNA, 22 bp, Homo sapiens
atggcagcggagctggaaatga

SEQ ID NO: 34562 - DNA, 22 bp, Homo sapiens
tgaccctgagagctgaatggct

SEQ ID NO: 34563 - DNA, 22 bp, Homo sapiens
tcaacagtggcaaagaggcacg

SEQ ID NO: 34564 - DNA, 22 bp, Homo sapiens
gagggagggactagcattctct

SEQ ID NO: 34565 - DNA, 22 bp, Homo sapiens
tgctcttcacagtttcagcatc

SEQ ID NO: 34566 - DNA, 22 bp, Homo sapiens
ggatattaatctgtgtcatttc

SEQ ID NO: 34567 - DNA, 22 bp, Homo sapiens
tcagccccacggggtcagccaa

SEQ ID NO: 34568 - DNA, 22 bp, Homo sapiens
cccaccagtacagatggtagat

SEQ ID NO: 34569 - DNA, 22 bp, Homo sapiens
ccacgcatccctccacagagag

SEQ ID NO: 34570 - DNA, 22 bp, Homo sapiens
ttgcttgaacccaggaagtgga

SEQ ID NO: 34571 - DNA, 22 bp, Homo sapiens
gagagagctctgtgcctgggat

SEQ ID NO: 34572 - DNA, 18 bp, Homo sapiens
ggtgagggagctggaagc

SEQ ID NO: 34573 - DNA, 22 bp, Homo sapiens
caccaggaggacaggcccctac

SEQ ID NO: 34574 - DNA, 22 bp, Homo sapiens
ttccggacgcccgtcttccagc

SEQ ID NO: 34575 - DNA, 22 bp, Homo sapiens
aagtaaatatctgtagtcttta

SEQ ID NO: 34576 - DNA, 22 bp, Homo sapiens
gctgtatgtttatttgggaatt

SEQ ID NO: 34577 - DNA, 22 bp, Homo sapiens
agatggagtctcactcttgttg

SEQ ID NO: 34578 - DNA, 22 bp, Homo sapiens
cagccctcctaccctgccaggc

SEQ ID NO: 34579 - DNA, 22 bp, Homo sapiens
ggctgtggagctgcagagttgg

SEQ ID NO: 34580 - DNA, 22 bp, Homo sapiens
aaattacagccttgggtagctt

SEQ ID NO: 34581 - DNA, 22 bp, Homo sapiens
acctggaacttggtcatttttc

SEQ ID NO: 34582 - DNA, 22 bp, Homo sapiens
acccaagttttccatgcctgtt

SEQ ID NO: 34583 - DNA, 22 bp, Homo sapiens
cttgacactgtcactcaggcca

SEQ ID NO: 34584 - DNA, 22 bp, Homo sapiens
tagatgcttgttcagaaatagg

SEQ ID NO: 34585 - DNA, 22 bp, Homo sapiens
ttttggccacatccttttgagt

SEQ ID NO: 34586 - DNA, 21 bp, Homo sapiens
ccaccaggtcttctgctcggg

SEQ ID NO: 34587 - DNA, 22 bp, Homo sapiens
tcctccactttgtctagcaaca

SEQ ID NO: 34588 - DNA, 22 bp, Homo sapiens
ttgtggttaaccgcacattttt

SEQ ID NO: 34589 - DNA, 22 bp, Homo sapiens
tcggggtctttgacacgctctg

SEQ ID NO: 34590 - DNA, 22 bp, Homo sapiens
caggagtgttgattgctcagga

SEQ ID NO: 34591 - DNA, 22 bp, Homo sapiens
aggaggtctcactatgttgccc

SEQ ID NO: 34592 - DNA, 22 bp, Homo sapiens
acactgtgtgacttctgagact

SEQ ID NO: 34593 - DNA, 22 bp, Homo sapiens
ataaaaactgacccatcctttg

SEQ ID NO: 34594 - DNA, 22 bp, Homo sapiens
ctgagatggagttttgctcttg

SEQ ID NO: 34595 - DNA, 22 bp, Homo sapiens
ctagtgcaatgatgaatacaag

SEQ ID NO: 34596 - DNA, 22 bp, Homo sapiens
ttggaggcaatgggaaggaggc

SEQ ID NO: 34597 - DNA, 19 bp, Homo sapiens
ctgctgccggagactcgtc

SEQ ID NO: 34598 - DNA, 19 bp, Homo sapiens
agggaatccggctgaggga

SEQ ID NO: 34599 - DNA, 22 bp, Homo sapiens
gacctcatgatccacctgcctt

SEQ ID NO: 34600 - DNA, 23 bp, Homo sapiens
gttttacaggtgagaaaatggag

SEQ ID NO: 34601 - DNA, 22 bp, Homo sapiens
atgccactgcactccagcctag

SEQ ID NO: 34602 - DNA, 22 bp, Homo sapiens
tcaacaccacaatttcttaact

SEQ ID NO: 34603 - DNA, 22 bp, Homo sapiens
tgagccagaggaggctgtgtgg

SEQ ID NO: 34604 - DNA, 22 bp, Homo sapiens
cagggccagggacacgctgtca

SEQ ID NO: 34605 - DNA, 16 bp, Homo sapiens
atgctgctattagagg

SEQ ID NO: 34606 - DNA, 22 bp, Homo sapiens
aaaagagcttggttgattttgc

SEQ ID NO: 34607 - DNA, 22 bp, Homo sapiens
aaaagtaattgcggtttttgct

SEQ ID NO: 34608 - DNA, 20 bp, Homo sapiens
accccagtgtgtgcctcaag

SEQ ID NO: 34609 - DNA, 22 bp, Homo sapiens
gtgcagttgtggacatgacaac

SEQ ID NO: 34610 - DNA, 22 bp, Homo sapiens
tcgcaccattgcactccagcca

SEQ ID NO: 34611 - DNA, 22 bp, Homo sapiens
cgggtcccctcgggaggctgct

SEQ ID NO: 34612 - DNA, 18 bp, Homo sapiens
agctccatctgtcagcat

SEQ ID NO: 34613 - DNA, 22 bp, Homo sapiens
tgatctttggtaatctggcaca

SEQ ID NO: 34614 - DNA, 22 bp, Homo sapiens
taggatttaataaaagaataga

SEQ ID NO: 34615 - DNA, 22 bp, Homo sapiens
ttctgattgctgatgaggccca

SEQ ID NO: 34616 - DNA, 22 bp, Homo sapiens
cctggcaggtggcgccctcggc

SEQ ID NO: 34617 - DNA, 22 bp, Homo sapiens
acctggccagtggggccgcgct

SEQ ID NO: 34618 - DNA, 22 bp, Homo sapiens
tgtctccaccatcatcttacca

SEQ ID NO: 34619 - DNA, 22 bp, Homo sapiens
tcaggctcaggttaggggccaa

SEQ ID NO: 34620 - DNA, 19 bp, Homo sapiens
aggtggctgaaactacaga

SEQ ID NO: 34621 - DNA, 20 bp, Homo sapiens
ggcagagggcctgggagaag

SEQ ID NO: 34622 - DNA, 22 bp, Homo sapiens
tgttcagaacaaaggtaaatga

SEQ ID NO: 34623 - DNA, 22 bp, Homo sapiens
tttcataatactgtacatgaaa

SEQ ID NO: 34624 - DNA, 22 bp, Homo sapiens
cagagctgtccaaaccctgaca

SEQ ID NO: 34625 - DNA, 22 bp, Homo sapiens
cttcagctcttggtaaatgttt

SEQ ID NO: 34626 - DNA, 22 bp, Homo sapiens
tgatctggtcctactgtgggca

SEQ ID NO: 34627 - DNA, 22 bp, Homo sapiens
cagctacaaatacttttgtatg

SEQ ID NO: 34628 - DNA, 22 bp, Homo sapiens
acctcctccaaggagccatagg

SEQ ID NO: 34629 - DNA, 22 bp, Homo sapiens
tactaattgttcacacttgttt

SEQ ID NO: 34630 - DNA, 22 bp, Homo sapiens
ggtcgagtcacttgttgccttt

SEQ ID NO: 34631 - DNA, 23 bp, Homo sapiens
cgtcttgtcctcgggcgcctggg

SEQ ID NO: 34632 - DNA, 22 bp, Homo sapiens
gagcatcgctgagatcccagac

SEQ ID NO: 34633 - DNA, 22 bp, Homo sapiens
agcctggtttaagcattttata

SEQ ID NO: 34634 - DNA, 22 bp, Homo sapiens
gcaccaccaccatcggcacctc

SEQ ID NO: 34635 - DNA, 22 bp, Homo sapiens
gtatcacttttgagagtgagaa

SEQ ID NO: 34636 - DNA, 22 bp, Homo sapiens
ggcaagaaccacaattactttt

SEQ ID NO: 34637 - DNA, 22 bp, Homo sapiens
ccctcgtgcatccatcatttag

SEQ ID NO: 34638 - DNA, 22 bp, Homo sapiens
tcctgggccctccggatcaggt

SEQ ID NO: 34639 - DNA, 22 bp, Homo sapiens
ggaggacaggggctgcagcaca

SEQ ID NO: 34640 - DNA, 22 bp, Homo sapiens
atgaaatatcttgaagaaattc

SEQ ID NO: 34641 - DNA, 22 bp, Homo sapiens
gcctgcagggcctgggcctacc

SEQ ID NO: 34642 - DNA, 22 bp, Homo sapiens
tttatagcagcatgatttatag

SEQ ID NO: 34643 - DNA, 22 bp, Homo sapiens
gaggccaactttggagaacagg

SEQ ID NO: 34644 - DNA, 22 bp, Homo sapiens
gtagcagagggcccaggtaact

SEQ ID NO: 34645 - DNA, 22 bp, Homo sapiens
aaaggacacacaggaggtgtct

SEQ ID NO: 34646 - DNA, 22 bp, Homo sapiens
gtggggtctgtcctcttctggg

SEQ ID NO: 34647 - DNA, 22 bp, Homo sapiens
ggtgtccacattccctggcagg

SEQ ID NO: 34648 - DNA, 22 bp, Homo sapiens
agacaaagaaaccgtagaagca

SEQ ID NO: 34649 - DNA, 22 bp, Homo sapiens
ttggatttgtctaccagggaat

SEQ ID NO: 34650 - DNA, 22 bp, Homo sapiens
ttaaacatttatggaggcagca

SEQ ID NO: 34651 - DNA, 22 bp, Homo sapiens
agcctgcgatcccacctggcct

SEQ ID NO: 34652 - DNA, 22 bp, Homo sapiens
cgcccaggctggagagcagtgg

SEQ ID NO: 34653 - DNA, 21 bp, Homo sapiens
caatggcgagatcttggctca

SEQ ID NO: 34654 - DNA, 22 bp, Homo sapiens
tccttgactgtgaggaactagc

SEQ ID NO: 34655 - DNA, 22 bp, Homo sapiens
tgggggagctcagtccagccca

SEQ ID NO: 34656 - DNA, 22 bp, Homo sapiens
actgccaatggtagtttgatgg

SEQ ID NO: 34657 - DNA, 22 bp, Homo sapiens
actgcactcctgcctgggtaac

SEQ ID NO: 34658 - DNA, 17 bp, Homo sapiens
gggcagggactcctggg

SEQ ID NO: 34659 - DNA, 22 bp, Homo sapiens
attctaaatcagagagctctgt

SEQ ID NO: 34660 - DNA, 22 bp, Homo sapiens
atcaagggcgcgtggttcggcg

SEQ ID NO: 34661 - DNA, 22 bp, Homo sapiens
ggggaaggaaagttattagcag

SEQ ID NO: 34662 - DNA, 22 bp, Homo sapiens
agatgctgggatgcttggatgg

SEQ ID NO: 34663 - DNA, 22 bp, Homo sapiens
agagaagagtcttgtcaaatta

SEQ ID NO: 34664 - DNA, 22 bp, Homo sapiens
gcccagcccagaaaggttcgga

SEQ ID NO: 34665 - DNA, 22 bp, Homo sapiens
gcctggattccttgtttctcag

SEQ ID NO: 34666 - DNA, 22 bp, Homo sapiens
tggagagttctgtagatatcta

SEQ ID NO: 34667 - DNA, 22 bp, Homo sapiens
ctgcgtgcatgtctgcgtgcat

SEQ ID NO: 34668 - DNA, 22 bp, Homo sapiens
tgaaggtgggaattcaccaggt

SEQ ID NO: 34669 - DNA, 22 bp, Homo sapiens
ccctctacagggaagcgctttc

SEQ ID NO: 34670 - DNA, 22 bp, Homo sapiens
tgagaaacttgccaagcatctc

SEQ ID NO: 34671 - DNA, 22 bp, Homo sapiens
atgtggcaccgatctttagcca

SEQ ID NO: 34672 - DNA, 22 bp, Homo sapiens
tgagcctgggagatggaggctg

SEQ ID NO: 34673 - DNA, 21 bp, Homo sapiens
ttaaagcctccctcataagga

SEQ ID NO: 34674 - DNA, 22 bp, Homo sapiens
tggatgctgtaggacacgctct

SEQ ID NO: 34675 - DNA, 19 bp, Homo sapiens
ggcttcgaggctggggaag

SEQ ID NO: 34676 - DNA, 22 bp, Homo sapiens
ctggcctcggcagcaggaacag

SEQ ID NO: 34677 - DNA, 22 bp, Homo sapiens
tttgctgcctctcccagctccc

SEQ ID NO: 34678 - DNA, 22 bp, Homo sapiens
tggagccagagcgcagcctggg

SEQ ID NO: 34679 - DNA, 22 bp, Homo sapiens
gggctgtgaggtgagaacttac

SEQ ID NO: 34680 - DNA, 19 bp, Homo sapiens
gctgaggtggaggaaggag

SEQ ID NO: 34681 - DNA, 22 bp, Homo sapiens
cacattggcaaacggggttgca

SEQ ID NO: 34682 - DNA, 22 bp, Homo sapiens
gaggactgaaacttacaggaaa

SEQ ID NO: 34683 - DNA, 22 bp, Homo sapiens
tgtctattaattccacataaaa

SEQ ID NO: 34684 - DNA, 22 bp, Homo sapiens
gcccttctgctgttaggtagcc

SEQ ID NO: 34685 - DNA, 22 bp, Homo sapiens
ccctgtgggaactcctgagttg

SEQ ID NO: 34686 - DNA, 22 bp, Homo sapiens
gggaaacaacaaagtatctatg

SEQ ID NO: 34687 - DNA, 22 bp, Homo sapiens
tacttttcctggaaccactgct

SEQ ID NO: 34688 - DNA, 22 bp, Homo sapiens
gctgctgggatcctgggtctca

SEQ ID NO: 34689 - DNA, 22 bp, Homo sapiens
cgcatgagacctgccggccatc

SEQ ID NO: 34690 - DNA, 22 bp, Homo sapiens
agcatttatcttttgtttgagt

SEQ ID NO: 34691 - DNA, 22 bp, Homo sapiens
tcacgtgagggacctgtgtctg

SEQ ID NO: 34692 - DNA, 22 bp, Homo sapiens
gctagtgcagggaaatctttgg

SEQ ID NO: 34693 - DNA, 20 bp, Homo sapiens
ataaaataactgccacaaga

SEQ ID NO: 34694 - DNA, 22 bp, Homo sapiens
caatagtgtctgcttgtttcta

SEQ ID NO: 34695 - DNA, 22 bp, Homo sapiens
cggggacacactggcagctcct

SEQ ID NO: 34696 - DNA, 22 bp, Homo sapiens
tttgagctgggaggctgaagga

SEQ ID NO: 34697 - DNA, 22 bp, Homo sapiens
caattgacaatgacagtgtcaa

SEQ ID NO: 34698 - DNA, 22 bp, Homo sapiens
tggctcatgcctgtaatcttag

SEQ ID NO: 34699 - DNA, 22 bp, Homo sapiens
aagctgttgttcatcctgaatt

SEQ ID NO: 34700 - DNA, 22 bp, Homo sapiens
agtgtattctgcatgggagact

SEQ ID NO: 34701 - DNA, 22 bp, Homo sapiens
cctggctcctacgggtattttg

SEQ ID NO: 34702 - DNA, 22 bp, Homo sapiens
gtggatggccctgcacacaggt

SEQ ID NO: 34703 - DNA, 22 bp, Homo sapiens
tccaaggagcagtcttcaacct

SEQ ID NO: 34704 - DNA, 22 bp, Homo sapiens
cttctgagatgttgttttacag

SEQ ID NO: 34705 - DNA, 22 bp, Homo sapiens
gcatggcttcggggtgctgcct

SEQ ID NO: 34706 - DNA, 22 bp, Homo sapiens
acccatacacacatatttatgt

SEQ ID NO: 34707 - DNA, 22 bp, Homo sapiens
attataggcttgagccaccgtg

SEQ ID NO: 34708 - DNA, 22 bp, Homo sapiens
tttggcatgggctatttgcttt

SEQ ID NO: 34709 - DNA, 22 bp, Homo sapiens
gggaaagaccttcctggggtgt

SEQ ID NO: 34710 - DNA, 22 bp, Homo sapiens
ttgcagttttgacagaccaaat

SEQ ID NO: 34711 - DNA, 22 bp, Homo sapiens
ctgcaccctcaaactcctgggc

SEQ ID NO: 34712 - DNA, 23 bp, Homo sapiens
acctgtctgcctcccaccatcaa

SEQ ID NO: 34713 - DNA, 22 bp, Homo sapiens
agacggattacctgaggtcagg

SEQ ID NO: 34714 - DNA, 22 bp, Homo sapiens
ttgtgaatagtgccgcaatgaa

SEQ ID NO: 34715 - DNA, 22 bp, Homo sapiens
gaggcggaggttgcagtgagcc

SEQ ID NO: 34716 - DNA, 22 bp, Homo sapiens
agctgtcaccaggagccggacc

SEQ ID NO: 34717 - DNA, 22 bp, Homo sapiens
ttaggcctttgattggggtgct

SEQ ID NO: 34718 - DNA, 22 bp, Homo sapiens
tgaaggggttcagcatgggggt

SEQ ID NO: 34719 - DNA, 22 bp, Homo sapiens
tcaacgcatgctccaagaaaga

SEQ ID NO: 34720 - DNA, 22 bp, Homo sapiens
tgctgagcttccactgcttctg

SEQ ID NO: 34721 - DNA, 22 bp, Homo sapiens
ccggagtgtctggcctgctggg

SEQ ID NO: 34722 - DNA, 22 bp, Homo sapiens
cctgattcagtggtgcccagag

SEQ ID NO: 34723 - DNA, 20 bp, Homo sapiens
gaaatgtacacattaccaca

SEQ ID NO: 34724 - DNA, 22 bp, Homo sapiens
agaatccctggggagctgcagc

SEQ ID NO: 34725 - DNA, 22 bp, Homo sapiens
ggagtgcggtggcaccatctca

SEQ ID NO: 34726 - DNA, 22 bp, Homo sapiens
cacagctgtgagaagggagcct

SEQ ID NO: 34727 - DNA, 22 bp, Homo sapiens
atccccactgctgctggtgtag

SEQ ID NO: 34728 - DNA, 22 bp, Homo sapiens
tgtctcttttcaagctaccctt

SEQ ID NO: 34729 - DNA, 22 bp, Homo sapiens
tctgtgctaggcagcctggccc

SEQ ID NO: 34730 - DNA, 22 bp, Homo sapiens
aagtggcagttcaggaagcaga

SEQ ID NO: 34731 - DNA, 22 bp, Homo sapiens
tttatagcagcatgatttataa

SEQ ID NO: 34732 - DNA, 22 bp, Homo sapiens
tgggaggccgaggcaggtggat

SEQ ID NO: 34733 - DNA, 22 bp, Homo sapiens
ctcactgcaagctccgcctccc

SEQ ID NO: 34734 - DNA, 22 bp, Homo sapiens
tctgccttgtttgagctttgac

SEQ ID NO: 34735 - DNA, 22 bp, Homo sapiens
caatagtaaattacggaggaga

SEQ ID NO: 34736 - DNA, 22 bp, Homo sapiens
atggctctgttttttatgctct

SEQ ID NO: 34737 - DNA, 22 bp, Homo sapiens
catccaggctggagtacagtgg

SEQ ID NO: 34738 - DNA, 22 bp, Homo sapiens
tccgggagctgaacgtcttgcg

SEQ ID NO: 34739 - DNA, 23 bp, Homo sapiens
gcctgccgcctggctgagaactg

SEQ ID NO: 34740 - DNA, 22 bp, Homo sapiens
gtctatgatattttgttatagc

SEQ ID NO: 34741 - DNA, 22 bp, Homo sapiens
tttagattgtgacctcccccca

SEQ ID NO: 34742 - DNA, 22 bp, Homo sapiens
agaacagaggccttatgtttca

SEQ ID NO: 34743 - DNA, 22 bp, Homo sapiens
ctccccccacagtgttcttgcc

SEQ ID NO: 34744 - DNA, 22 bp, Homo sapiens
agctggtgctcggggagctggc

SEQ ID NO: 34745 - DNA, 22 bp, Homo sapiens
tttgcattgcattaagtattct

SEQ ID NO: 34746 - DNA, 22 bp, Homo sapiens
aaattagtgcaccaggttgaag

SEQ ID NO: 34747 - DNA, 22 bp, Homo sapiens
ccacgggcagatgtggttggtt

SEQ ID NO: 34748 - DNA, 22 bp, Homo sapiens
ggtcgctgtgtaggttcagcta

SEQ ID NO: 34749 - DNA, 22 bp, Homo sapiens
tgggcgacagagcaagactccg

SEQ ID NO: 34750 - DNA, 22 bp, Homo sapiens
tgggtgacagagcaagactctg

SEQ ID NO: 34751 - DNA, 21 bp, Homo sapiens
cgggaaggaggttctgaccct

SEQ ID NO: 34752 - DNA, 22 bp, Homo sapiens
attgagaagaaaatctaatata

SEQ ID NO: 34753 - DNA, 22 bp, Homo sapiens
attaagtgttttacatacatta

SEQ ID NO: 34754 - DNA, 22 bp, Homo sapiens
ggacttgagccgctcggagttc

SEQ ID NO: 34755 - DNA, 22 bp, Homo sapiens
tcggagctgtagatgaaaccct

SEQ ID NO: 34756 - DNA, 22 bp, Homo sapiens
gcctccggagtcacagtgtctt

SEQ ID NO: 34757 - DNA, 23 bp, Homo sapiens
aggttatgattatagagcgagga

SEQ ID NO: 34758 - DNA, 22 bp, Homo sapiens
tccttgaaaggggctgcagggc

SEQ ID NO: 34759 - DNA, 22 bp, Homo sapiens
tgtcttcaggagtaaatatcat

SEQ ID NO: 34760 - DNA, 22 bp, Homo sapiens
ggtgttgcagttgaagactggt

SEQ ID NO: 34761 - DNA, 22 bp, Homo sapiens
ctttttcctcgtagagcctaat

SEQ ID NO: 34762 - DNA, 22 bp, Homo sapiens
gaggggctgccctggtgtcagg

SEQ ID NO: 34763 - DNA, 22 bp, Homo sapiens
ttccgagggctcggcggccgcc

SEQ ID NO: 34764 - DNA, 22 bp, Homo sapiens
cggggcgagcagacggcggcaa

SEQ ID NO: 34765 - DNA, 22 bp, Homo sapiens
gacctggcaactgtagcttctg

SEQ ID NO: 34766 - DNA, 22 bp, Homo sapiens
gggtaggccgtgggtcaccagg

SEQ ID NO: 34767 - DNA, 22 bp, Homo sapiens
aggcttttctccagaatgtact

SEQ ID NO: 34768 - DNA, 21 bp, Homo sapiens
ggcctcccggaccgcagcgcc

SEQ ID NO: 34769 - DNA, 22 bp, Homo sapiens
ctgtccctgagcaactcctgtt

SEQ ID NO: 34770 - DNA, 22 bp, Homo sapiens
ctgaatccacacaaggtgatgg

SEQ ID NO: 34771 - DNA, 22 bp, Homo sapiens
cccacaggtgtgagcttgctgg

SEQ ID NO: 34772 - DNA, 22 bp, Homo sapiens
cagtggcgtgatctctgctcac

SEQ ID NO: 34773 - DNA, 23 bp, Homo sapiens
tgaggcaggcggatcacgaggtc

SEQ ID NO: 34774 - DNA, 22 bp, Homo sapiens
tggcctcggcatccagcaagag

SEQ ID NO: 34775 - DNA, 22 bp, Homo sapiens
accctaataatcacagactagt

SEQ ID NO: 34776 - DNA, 22 bp, Homo sapiens
gtggcccatcacgtttcgcctt

SEQ ID NO: 34777 - DNA, 23 bp, Homo sapiens
actcgtggaattctctgcgatcg

SEQ ID NO: 34778 - DNA, 22 bp, Homo sapiens
gcacctgcctgggactgaagat

SEQ ID NO: 34779 - DNA, 22 bp, Homo sapiens
ctcgcatgccctgcctcatcca

SEQ ID NO: 34780 - DNA, 22 bp, Homo sapiens
cacgaatggaagggtcttggct

SEQ ID NO: 34781 - DNA, 22 bp, Homo sapiens
tgggttcacgccattctcctgc

SEQ ID NO: 34782 - DNA, 22 bp, Homo sapiens
gagtcggaggcaggagacctgg

SEQ ID NO: 34783 - DNA, 19 bp, Homo sapiens
agaatcccaggccccactg

SEQ ID NO: 34784 - DNA, 22 bp, Homo sapiens
gcgagcctctggagtcctctgg

SEQ ID NO: 34785 - DNA, 17 bp, Homo sapiens
tcttggccagcttgctg

SEQ ID NO: 34786 - DNA, 20 bp, Homo sapiens
ttgttagaggaatgccatag

SEQ ID NO: 34787 - DNA, 22 bp, Homo sapiens
tgatgcaattagattgtaattt

SEQ ID NO: 34788 - DNA, 22 bp, Homo sapiens
ccaagctacttaggagtctgag

SEQ ID NO: 34789 - DNA, 22 bp, Homo sapiens
gaccttgtgatccagccacctt

SEQ ID NO: 34790 - DNA, 22 bp, Homo sapiens
aggtaaacaggagaaaatgaga

SEQ ID NO: 34791 - DNA, 22 bp, Homo sapiens
cactgcagcctcaaattcctgg

SEQ ID NO: 34792 - DNA, 22 bp, Homo sapiens
cccagggagagcgcggaggcgg

SEQ ID NO: 34793 - DNA, 22 bp, Homo sapiens
ggggaccctcaggactgcgtct

SEQ ID NO: 34794 - DNA, 22 bp, Homo sapiens
gctgggctgcgtcggggaagcc

SEQ ID NO: 34795 - DNA, 22 bp, Homo sapiens
acaactttgacccttgttctta

SEQ ID NO: 34796 - DNA, 22 bp, Homo sapiens
tcatcataatatggaatcttgt

SEQ ID NO: 34797 - DNA, 22 bp, Homo sapiens
gggctccgcccttggctgagct

SEQ ID NO: 34798 - DNA, 23 bp, Homo sapiens
caccactttctccttctccttgg

SEQ ID NO: 34799 - DNA, 22 bp, Homo sapiens
agtccgcctgctgccgtggcag

SEQ ID NO: 34800 - DNA, 22 bp, Homo sapiens
ggtgacggggcccaggtttcct

SEQ ID NO: 34801 - DNA, 22 bp, Homo sapiens
ggggtgtggacggctgtgccag

SEQ ID NO: 34802 - DNA, 22 bp, Homo sapiens
caaatgtataaatgtactttct

SEQ ID NO: 34803 - DNA, 22 bp, Homo sapiens
tgggccacacacagaagaatca

SEQ ID NO: 34804 - DNA, 22 bp, Homo sapiens
tgctccagcaccaagagctcca

SEQ ID NO: 34805 - DNA, 23 bp, Homo sapiens
agcctcttgtggatggtcagcga

SEQ ID NO: 34806 - DNA, 22 bp, Homo sapiens
agtgaatgtccccgcgggtcag

SEQ ID NO: 34807 - DNA, 22 bp, Homo sapiens
ctccaacgaggctggggtacaa

SEQ ID NO: 34808 - DNA, 22 bp, Homo sapiens
tgggtactcctattagttcagt

SEQ ID NO: 34809 - DNA, 22 bp, Homo sapiens
tagcttatcccacagtgcccag

SEQ ID NO: 34810 - DNA, 22 bp, Homo sapiens
gtggcccaggttggagtgcagt

SEQ ID NO: 34811 - DNA, 22 bp, Homo sapiens
aggagccagtggagttcctgcc

SEQ ID NO: 34812 - DNA, 22 bp, Homo sapiens
gggacatctttctagtcagggt

SEQ ID NO: 34813 - DNA, 22 bp, Homo sapiens
tgtgtctgtgtatacacggcat

SEQ ID NO: 34814 - DNA, 22 bp, Homo sapiens
aagtgctgggattacaggtgtc

SEQ ID NO: 34815 - DNA, 18 bp, Homo sapiens
atgagaggtgtcagaaga

SEQ ID NO: 34816 - DNA, 22 bp, Homo sapiens
tccttagacaaagagtgggctt

SEQ ID NO: 34817 - DNA, 22 bp, Homo sapiens
gcagctcaaaggccacggacgg

SEQ ID NO: 34818 - DNA, 22 bp, Homo sapiens
catccgcatgcaagtgctgtcc

SEQ ID NO: 34819 - DNA, 22 bp, Homo sapiens
gagcacgttgaagcgcactgtc

SEQ ID NO: 34820 - DNA, 22 bp, Homo sapiens
gagaaatatggctcagttccac

SEQ ID NO: 34821 - DNA, 22 bp, Homo sapiens
acatgtttaagtttgttatatg

SEQ ID NO: 34822 - DNA, 22 bp, Homo sapiens
gttactcttgagaggctgaggt

SEQ ID NO: 34823 - DNA, 19 bp, Homo sapiens
gcctatgtcttcaaatcat

SEQ ID NO: 34824 - DNA, 22 bp, Homo sapiens
aaacactcatgtgttactctcc

SEQ ID NO: 34825 - DNA, 22 bp, Homo sapiens
tgctccatgcgctcggccggcg

SEQ ID NO: 34826 - DNA, 22 bp, Homo sapiens
agaaatatgctgattagatgaa

SEQ ID NO: 34827 - DNA, 22 bp, Homo sapiens
gcagctattgtctcctgggccc

SEQ ID NO: 34828 - DNA, 22 bp, Homo sapiens
attctggacaaggcaagctcct

SEQ ID NO: 34829 - DNA, 22 bp, Homo sapiens
gtgggggagatgcttaggtccg

SEQ ID NO: 34830 - DNA, 22 bp, Homo sapiens
tggaacgtcgtaatgttggtta

SEQ ID NO: 34831 - DNA, 22 bp, Homo sapiens
caagtctgacctctgggtgaag

SEQ ID NO: 34832 - DNA, 22 bp, Homo sapiens
cggagcctgcttgttgcagctg

SEQ ID NO: 34833 - DNA, 22 bp, Homo sapiens
tactgcactccagcctgggtga

SEQ ID NO: 34834 - DNA, 18 bp, Homo sapiens
agtgtcagctgcagctca

SEQ ID NO: 34835 - DNA, 22 bp, Homo sapiens
tagccgggtgttgtgtcatgca

SEQ ID NO: 34836 - DNA, 22 bp, Homo sapiens
cacccaggctggagagcagtgg

SEQ ID NO: 34837 - DNA, 22 bp, Homo sapiens
tgtttgagttctagcgcattta

SEQ ID NO: 34838 - DNA, 22 bp, Homo sapiens
ataatggaggaagctatgtgga

SEQ ID NO: 34839 - DNA, 22 bp, Homo sapiens
ctcagatctttcccattttccc

SEQ ID NO: 34840 - DNA, 22 bp, Homo sapiens
tggaaagaaagtaaaggcgtat

SEQ ID NO: 34841 - DNA, 22 bp, Homo sapiens
aagtgatgctacgactttgaca

SEQ ID NO: 34842 - DNA, 22 bp, Homo sapiens
tctctggactcgagcttactca

SEQ ID NO: 34843 - DNA, 22 bp, Homo sapiens
cagggccagcgtctcgggctat

SEQ ID NO: 34844 - DNA, 22 bp, Homo sapiens
agaaagtgcttccctttggtga

SEQ ID NO: 34845 - DNA, 22 bp, Homo sapiens
ggtgccacagctacatcctaga

SEQ ID NO: 34846 - DNA, 22 bp, Homo sapiens
atggaaggctttatgactcaaa

SEQ ID NO: 34847 - DNA, 23 bp, Homo sapiens
agagtgcagagatatgcttgtgt

SEQ ID NO: 34848 - DNA, 22 bp, Homo sapiens
atgtttttggaaatgggaacat

SEQ ID NO: 34849 - DNA, 22 bp, Homo sapiens
ctgtccccacccaaatctcatc

SEQ ID NO: 34850 - DNA, 22 bp, Homo sapiens
agggctggagccacagctggga

SEQ ID NO: 34851 - DNA, 22 bp, Homo sapiens
ttccagagagttattcccctgg

SEQ ID NO: 34852 - DNA, 22 bp, Homo sapiens
ggctgagtctgtgacccatgcg

SEQ ID NO: 34853 - DNA, 22 bp, Homo sapiens
accacctcatcaagctggattg

SEQ ID NO: 34854 - DNA, 18 bp, Homo sapiens
cagctgccagctcatgga

SEQ ID NO: 34855 - DNA, 22 bp, Homo sapiens
gaaaaggcagagttccggggaa

SEQ ID NO: 34856 - DNA, 22 bp, Homo sapiens
gacctggtccttgtactttgaa

SEQ ID NO: 34857 - DNA, 22 bp, Homo sapiens
tcctgggatcaagtgatcctcc

SEQ ID NO: 34858 - DNA, 22 bp, Homo sapiens
aagactgtgtctatggctactc

SEQ ID NO: 34859 - DNA, 22 bp, Homo sapiens
atcatcctagaaggaagctagg

SEQ ID NO: 34860 - DNA, 22 bp, Homo sapiens
tgtgtgattgcaggagatgtgg

SEQ ID NO: 34861 - DNA, 22 bp, Homo sapiens
ggccagcctggggctcccagac

SEQ ID NO: 34862 - DNA, 22 bp, Homo sapiens
ctgtgcgtaagtagccaaaata

SEQ ID NO: 34863 - DNA, 22 bp, Homo sapiens
gaaggagccgagctcttcccca

SEQ ID NO: 34864 - DNA, 21 bp, Homo sapiens
ccgtgctcggctatggaccac

SEQ ID NO: 34865 - DNA, 21 bp, Homo sapiens
tctgcaccccagcctgagtga

SEQ ID NO: 34866 - DNA, 22 bp, Homo sapiens
gcacagagagggaaggtaactt

SEQ ID NO: 34867 - DNA, 22 bp, Homo sapiens
ctggaggccactgtacagattg

SEQ ID NO: 34868 - DNA, 22 bp, Homo sapiens
cagcctggtccccggctcaccc

SEQ ID NO: 34869 - DNA, 22 bp, Homo sapiens
tctgcgttgctcacgctgggag

SEQ ID NO: 34870 - DNA, 22 bp, Homo sapiens
ctggctttgatcagagtgacct

SEQ ID NO: 34871 - DNA, 22 bp, Homo sapiens
aggccagcagcatgacggcatc

SEQ ID NO: 34872 - DNA, 22 bp, Homo sapiens
cttctggcgttggaggtctgag

SEQ ID NO: 34873 - DNA, 22 bp, Homo sapiens
actgggcctgattgggtcggag

SEQ ID NO: 34874 - DNA, 22 bp, Homo sapiens
ctggcaggtggaggttgcagtg

SEQ ID NO: 34875 - DNA, 22 bp, Homo sapiens
tcacccctccattctctcatgt

SEQ ID NO: 34876 - DNA, 22 bp, Homo sapiens
gggcatgtcccgctgtgcaccg

SEQ ID NO: 34877 - DNA, 22 bp, Homo sapiens
gggtattaaaatgaaggagaaa

SEQ ID NO: 34878 - DNA, 22 bp, Homo sapiens
cctgtaactccttggctcaagt

SEQ ID NO: 34879 - DNA, 22 bp, Homo sapiens
agtggctttgttccgtatggca

SEQ ID NO: 34880 - DNA, 22 bp, Homo sapiens
tgttttaagctctagaagggga

SEQ ID NO: 34881 - DNA, 22 bp, Homo sapiens
ctggagcaaaagtgactcctct

SEQ ID NO: 34882 - DNA, 22 bp, Homo sapiens
gagctgggcctgcgagtgctgc

SEQ ID NO: 34883 - DNA, 22 bp, Homo sapiens
gtgtgtccaaggcacggatgac

SEQ ID NO: 34884 - DNA, 22 bp, Homo sapiens
catccagtgggacagagaaacc

SEQ ID NO: 34885 - DNA, 22 bp, Homo sapiens
cccagacccagagggaggcagg

SEQ ID NO: 34886 - DNA, 22 bp, Homo sapiens
ttgctcagtggcagggctggta

SEQ ID NO: 34887 - DNA, 22 bp, Homo sapiens
gcaccgccttggaccgcccgct

SEQ ID NO: 34888 - DNA, 22 bp, Homo sapiens
tcagacaactctggaggctggc

SEQ ID NO: 34889 - DNA, 22 bp, Homo sapiens
tctaatcctatggtggggaggg

SEQ ID NO: 34890 - DNA, 22 bp, Homo sapiens
cttttcattgtttgtacatgca

SEQ ID NO: 34891 - DNA, 22 bp, Homo sapiens
agagttgaagtataatagggat

SEQ ID NO: 34892 - DNA, 22 bp, Homo sapiens
atggccaggcacctctggctga

SEQ ID NO: 34893 - DNA, 22 bp, Homo sapiens
gaggcacagagtaggtgcacac

SEQ ID NO: 34894 - DNA, 22 bp, Homo sapiens
cccagcagtagagctcatatgg

SEQ ID NO: 34895 - DNA, 22 bp, Homo sapiens
caggaaggcgcggctgtgcctg

SEQ ID NO: 34896 - DNA, 22 bp, Homo sapiens
gccatgggcaaatgcagagctg

SEQ ID NO: 34897 - DNA, 22 bp, Homo sapiens
gcccagtagttcaaggttgcag

SEQ ID NO: 34898 - DNA, 22 bp, Homo sapiens
gcaaatacatgttgagcaccta

SEQ ID NO: 34899 - DNA, 22 bp, Homo sapiens
ttcttcatgggttcttttagga

SEQ ID NO: 34900 - DNA, 18 bp, Homo sapiens
tcactgggtgtatgtggc

SEQ ID NO: 34901 - DNA, 22 bp, Homo sapiens
gggctgggattgcttgctgtga

SEQ ID NO: 34902 - DNA, 22 bp, Homo sapiens
acatcttttactctggttcggg

SEQ ID NO: 34903 - DNA, 22 bp, Homo sapiens
catcagaacgtgagctccttgt

SEQ ID NO: 34904 - DNA, 22 bp, Homo sapiens
acggtgctgggtattggggttc

SEQ ID NO: 34905 - DNA, 22 bp, Homo sapiens
tcactgcaagctccacctcccg

SEQ ID NO: 34906 - DNA, 22 bp, Homo sapiens
gcaggagaacaaagcaagctgc

SEQ ID NO: 34907 - DNA, 20 bp, Homo sapiens
caagggtttgcattggcttt

SEQ ID NO: 34908 - DNA, 22 bp, Homo sapiens
tcgggctgctcgctgcggaact

SEQ ID NO: 34909 - DNA, 22 bp, Homo sapiens
aaaacgatgtttaaaagctctg

SEQ ID NO: 34910 - DNA, 22 bp, Homo sapiens
cgacgggctcggtccgcttcct

SEQ ID NO: 34911 - DNA, 22 bp, Homo sapiens
ggaggaggggtgactgaatgct

SEQ ID NO: 34912 - DNA, 22 bp, Homo sapiens
tgcccaggctggagtacagtgg

SEQ ID NO: 34913 - DNA, 23 bp, Homo sapiens
ggcctcagtgatgatgggttaaa

SEQ ID NO: 34914 - DNA, 22 bp, Homo sapiens
aagtgctgggattacaggcatg

SEQ ID NO: 34915 - DNA, 19 bp, Homo sapiens
agtcctggcctgggggacc

SEQ ID NO: 34916 - DNA, 22 bp, Homo sapiens
tgtagtagcattcacgaagtgt

SEQ ID NO: 34917 - DNA, 22 bp, Homo sapiens
ggagacagggttgaaccacgca

SEQ ID NO: 34918 - DNA, 22 bp, Homo sapiens
ctgagctcaagcgatcctccca

SEQ ID NO: 34919 - DNA, 21 bp, Homo sapiens
gacattgcatggtggcctctt

SEQ ID NO: 34920 - DNA, 22 bp, Homo sapiens
actccacaccacgggggccgcc

SEQ ID NO: 34921 - DNA, 22 bp, Homo sapiens
gcgcggcctcacccctcggtga

SEQ ID NO: 34922 - DNA, 22 bp, Homo sapiens
ggagaccagaaggaagcttcga

SEQ ID NO: 34923 - DNA, 22 bp, Homo sapiens
tctcaagcttgttggtatgttt

SEQ ID NO: 34924 - DNA, 22 bp, Homo sapiens
tgtgctggagatcagcttattt

SEQ ID NO: 34925 - DNA, 22 bp, Homo sapiens
atgcagccccctggtgcccggg

SEQ ID NO: 34926 - DNA, 18 bp, Homo sapiens
tgggaagaaattcttctc

SEQ ID NO: 34927 - DNA, 22 bp, Homo sapiens
gcgccccatctacagtactttt

SEQ ID NO: 34928 - DNA, 22 bp, Homo sapiens
agggtggcactggtggctctat

SEQ ID NO: 34929 - DNA, 22 bp, Homo sapiens
tgtcaagccccagctgtcacgc

SEQ ID NO: 34930 - DNA, 22 bp, Homo sapiens
tggtagtcggcctcggtggctc

SEQ ID NO: 34931 - DNA, 22 bp, Homo sapiens
aaggccctgtctccaaatacag

SEQ ID NO: 34932 - DNA, 23 bp, Homo sapiens
tctgtgtctccacccaaatctca

SEQ ID NO: 34933 - DNA, 22 bp, Homo sapiens
tcacagctctgtcaattttata

SEQ ID NO: 34934 - DNA, 22 bp, Homo sapiens
ttcaccttgaatatgtcttaaa

SEQ ID NO: 34935 - DNA, 22 bp, Homo sapiens
tgcttttagctagtaactagta

SEQ ID NO: 34936 - DNA, 22 bp, Homo sapiens
gtctatatattgcttgaataat

SEQ ID NO: 34937 - DNA, 22 bp, Homo sapiens
gtgacatggtttgccgtccctg

SEQ ID NO: 34938 - DNA, 22 bp, Homo sapiens
acctctgtacctcctctgacag

SEQ ID NO: 34939 - DNA, 22 bp, Homo sapiens
cacattccttacattcatagag

SEQ ID NO: 34940 - DNA, 22 bp, Homo sapiens
gttgcagatgtggaactcgtgc

SEQ ID NO: 34941 - DNA, 22 bp, Homo sapiens
gaggcctcagcctgccctgaac

SEQ ID NO: 34942 - DNA, 23 bp, Homo sapiens
ttgcttgagcccaggaagtggag

SEQ ID NO: 34943 - DNA, 22 bp, Homo sapiens
gcaaaagtacagccggatttct

SEQ ID NO: 34944 - DNA, 18 bp, Homo sapiens
acttcccagatgagggga

SEQ ID NO: 34945 - DNA, 22 bp, Homo sapiens
cgtggggcgggtggacacttgc

SEQ ID NO: 34946 - DNA, 22 bp, Homo sapiens
gcaggtctatcaggctgcaggt

SEQ ID NO: 34947 - DNA, 22 bp, Homo sapiens
gaggaggcttccgggaggcacg

SEQ ID NO: 34948 - DNA, 22 bp, Homo sapiens
gggccccaagaacctcctcctg

SEQ ID NO: 34949 - DNA, 22 bp, Homo sapiens
aatgccttggagagcctagagg

SEQ ID NO: 34950 - DNA, 22 bp, Homo sapiens
aatggaatacctaggtggccca

SEQ ID NO: 34951 - DNA, 22 bp, Homo sapiens
gacagctgcatcctcagacaca

SEQ ID NO: 34952 - DNA, 22 bp, Homo sapiens
gcgtctcaaggcccccaggcca

SEQ ID NO: 34953 - DNA, 22 bp, Homo sapiens
gagtgcagtggcgtgatctctg

SEQ ID NO: 34954 - DNA, 22 bp, Homo sapiens
tgctgctcagaacccctgggct

SEQ ID NO: 34955 - DNA, 18 bp, Homo sapiens
taatccatatgctttgcc

SEQ ID NO: 34956 - DNA, 22 bp, Homo sapiens
atgggatgatcacctgagctca

SEQ ID NO: 34957 - DNA, 22 bp, Homo sapiens
cccaggaggttgaggctgcagt

SEQ ID NO: 34958 - DNA, 17 bp, Homo sapiens
ttaaggtggatcagcac

SEQ ID NO: 34959 - DNA, 22 bp, Homo sapiens
caggagtgtctccacacagcaa

SEQ ID NO: 34960 - DNA, 22 bp, Homo sapiens
gggtctcctaatggaggatgac

SEQ ID NO: 34961 - DNA, 22 bp, Homo sapiens
tgcttgtgacagaactgtgtcc

SEQ ID NO: 34962 - DNA, 22 bp, Homo sapiens
gaggtaacactgttcagtgggc

SEQ ID NO: 34963 - DNA, 22 bp, Homo sapiens
gatagtcacctcccttaacttt

SEQ ID NO: 34964 - DNA, 22 bp, Homo sapiens
atgtgtattacctcgattgtga

SEQ ID NO: 34965 - DNA, 22 bp, Homo sapiens
tcatgcctggaatctcaccact

SEQ ID NO: 34966 - DNA, 22 bp, Homo sapiens
ttatacagggagtttccctgca

SEQ ID NO: 34967 - DNA, 22 bp, Homo sapiens
aactcagatgtttggctacctt

SEQ ID NO: 34968 - DNA, 19 bp, Homo sapiens
gatgctcattcaggtggaa

SEQ ID NO: 34969 - DNA, 22 bp, Homo sapiens
gacgccgtgtcccggcactctt

SEQ ID NO: 34970 - DNA, 22 bp, Homo sapiens
gaggtagacttcttggaagtag

SEQ ID NO: 34971 - DNA, 22 bp, Homo sapiens
acgttttctagagaatatgcag

SEQ ID NO: 34972 - DNA, 22 bp, Homo sapiens
aggcgcctgcgggatccttgcc

SEQ ID NO: 34973 - DNA, 23 bp, Homo sapiens
tgctaattggacttgattctgca

SEQ ID NO: 34974 - DNA, 22 bp, Homo sapiens
tgtgctctgactttctcctggt

SEQ ID NO: 34975 - DNA, 22 bp, Homo sapiens
cactgcactccagcctgggtca

SEQ ID NO: 34976 - DNA, 22 bp, Homo sapiens
agccaagcactcaactcctgga

SEQ ID NO: 34977 - DNA, 22 bp, Homo sapiens
tcaggcaatctgacagctggag

SEQ ID NO: 34978 - DNA, 22 bp, Homo sapiens
aaagatcacgtcccaggactcg

SEQ ID NO: 34979 - DNA, 22 bp, Homo sapiens
tacactgtttgaactgtggtcg

SEQ ID NO: 34980 - DNA, 22 bp, Homo sapiens
actttatttcctattgcatcca

SEQ ID NO: 34981 - DNA, 22 bp, Homo sapiens
ccggtcccaggtgccccggtga

SEQ ID NO: 34982 - DNA, 22 bp, Homo sapiens
ttcagaagagacactgtgacag

SEQ ID NO: 34983 - DNA, 22 bp, Homo sapiens
taagtcgtggatgattcttcgg

SEQ ID NO: 34984 - DNA, 22 bp, Homo sapiens
tgctgggattacagtcatgagc

SEQ ID NO: 34985 - DNA, 22 bp, Homo sapiens
gccatcctgatgacaggccact

SEQ ID NO: 34986 - DNA, 20 bp, Homo sapiens
tctgccacgtctggtgactg

SEQ ID NO: 34987 - DNA, 22 bp, Homo sapiens
tgagccatgggactccaaggga

SEQ ID NO: 34988 - DNA, 22 bp, Homo sapiens
tttcaggacacctttaaaaacg

SEQ ID NO: 34989 - DNA, 22 bp, Homo sapiens
ctgaggaaggctgggggcatcc

SEQ ID NO: 34990 - DNA, 22 bp, Homo sapiens
atcaacatgtcataaagtgaaa

SEQ ID NO: 34991 - DNA, 22 bp, Homo sapiens
ctgccctttgaaagaacgtctt

SEQ ID NO: 34992 - DNA, 22 bp, Homo sapiens
cttgcacgtcagatcttcctca

SEQ ID NO: 34993 - DNA, 22 bp, Homo sapiens
gtgattttctcctcctagaagt

SEQ ID NO: 34994 - DNA, 22 bp, Homo sapiens
aatgaattgcagtactgacttg

SEQ ID NO: 34995 - DNA, 22 bp, Homo sapiens
tttgccctttctgagcctcatc

SEQ ID NO: 34996 - DNA, 22 bp, Homo sapiens
actgcaacctccacctcctggg

SEQ ID NO: 34997 - DNA, 22 bp, Homo sapiens
caagggaattgtgtgtgagagg

SEQ ID NO: 34998 - DNA, 22 bp, Homo sapiens
cctactctgagcgcctccgcat

SEQ ID NO: 34999 - DNA, 19 bp, Homo sapiens
ctctggagtcattgctccc

SEQ ID NO: 35000 - DNA, 22 bp, Homo sapiens
gttactcttccccggggtctgg

SEQ ID NO: 35001 - DNA, 22 bp, Homo sapiens
ccactgcactccagcctgccaa

SEQ ID NO: 35002 - DNA, 22 bp, Homo sapiens
cccagttttctgattgaagagc

SEQ ID NO: 35003 - DNA, 22 bp, Homo sapiens
tcctcattcttggtgcatcaaa

SEQ ID NO: 35004 - DNA, 23 bp, Homo sapiens
tgagctgggcctgcaggggtctc

SEQ ID NO: 35005 - DNA, 22 bp, Homo sapiens
gataccagacagggagggagaa

SEQ ID NO: 35006 - DNA, 22 bp, Homo sapiens
actcatgtaagcggaatgtagt

SEQ ID NO: 35007 - DNA, 22 bp, Homo sapiens
aagaggttgtacctaaagtgtt

SEQ ID NO: 35008 - DNA, 22 bp, Homo sapiens
gccaccccataggtgttaggtg

SEQ ID NO: 35009 - DNA, 22 bp, Homo sapiens
gtttacttgtgccttggcttaa

SEQ ID NO: 35010 - DNA, 22 bp, Homo sapiens
gcagcctgggcaacagagtgag

SEQ ID NO: 35011 - DNA, 22 bp, Homo sapiens
agccactttagataccatctta

SEQ ID NO: 35012 - DNA, 22 bp, Homo sapiens
aacttgccaagagctttgctag

SEQ ID NO: 35013 - DNA, 22 bp, Homo sapiens
gaggcggaggttgcagtgagct

SEQ ID NO: 35014 - DNA, 22 bp, Homo sapiens
atgatggctaggctggttttga

SEQ ID NO: 35015 - DNA, 22 bp, Homo sapiens
cctggcctttgaacgctagact

SEQ ID NO: 35016 - DNA, 22 bp, Homo sapiens
atgctattgaaaagaaataaga

SEQ ID NO: 35017 - DNA, 22 bp, Homo sapiens
cagatagctgtaaataaatgga

SEQ ID NO: 35018 - DNA, 22 bp, Homo sapiens
atggggagctcaccacctgttt

SEQ ID NO: 35019 - DNA, 22 bp, Homo sapiens
caggctggagtgcaatgacgcc

SEQ ID NO: 35020 - DNA, 22 bp, Homo sapiens
tggagacacaggaccagactgc

SEQ ID NO: 35021 - DNA, 22 bp, Homo sapiens
tggtcttagctggaaggaggga

SEQ ID NO: 35022 - DNA, 22 bp, Homo sapiens
attaagtgactaaagtaatgct

SEQ ID NO: 35023 - DNA, 22 bp, Homo sapiens
cttagagatgggttttacttag

SEQ ID NO: 35024 - DNA, 22 bp, Homo sapiens
tgaggaaacttacaaggcagaa

SEQ ID NO: 35025 - DNA, 22 bp, Homo sapiens
cctgcagacacttgtccagcaa

SEQ ID NO: 35026 - DNA, 22 bp, Homo sapiens
tcttgaatctaatgcagtttct

SEQ ID NO: 35027 - DNA, 22 bp, Homo sapiens
gaggcctcatgaggtgagcatt

SEQ ID NO: 35028 - DNA, 22 bp, Homo sapiens
tctttgctattgtgagtagtgc

SEQ ID NO: 35029 - DNA, 22 bp, Homo sapiens
ttgccttgttattctctcagaa

SEQ ID NO: 35030 - DNA, 19 bp, Homo sapiens
tgagggtgagctttggaga

SEQ ID NO: 35031 - DNA, 22 bp, Homo sapiens
agattgtcattgacgatgagca

SEQ ID NO: 35032 - DNA, 22 bp, Homo sapiens
atgaggtgggagaatcacttga

SEQ ID NO: 35033 - DNA, 22 bp, Homo sapiens
ctagggtcaggggcctgcgtcg

SEQ ID NO: 35034 - DNA, 23 bp, Homo sapiens
gggggccgtcctggggattatag

SEQ ID NO: 35035 - DNA, 22 bp, Homo sapiens
gccactgtggtcctcccatgat

SEQ ID NO: 35036 - DNA, 22 bp, Homo sapiens
tgccagctgcttgtcccccaca

SEQ ID NO: 35037 - DNA, 22 bp, Homo sapiens
gcactggccgcacgcgtagggc

SEQ ID NO: 35038 - DNA, 21 bp, Homo sapiens
ccaggccaggcctacggggat

SEQ ID NO: 35039 - DNA, 22 bp, Homo sapiens
ttagatttgtagtgagttcaga

SEQ ID NO: 35040 - DNA, 22 bp, Homo sapiens
cctgcctactgagttttatatt

SEQ ID NO: 35041 - DNA, 22 bp, Homo sapiens
gtcctgtgagattcatgctcaa

SEQ ID NO: 35042 - DNA, 22 bp, Homo sapiens
aggctcagatccttgtgtcctg

SEQ ID NO: 35043 - DNA, 22 bp, Homo sapiens
tcaccaggctagagtgcagtgg

SEQ ID NO: 35044 - DNA, 22 bp, Homo sapiens
cctccaaccataggtccagggg

SEQ ID NO: 35045 - DNA, 22 bp, Homo sapiens
acatggcgggagtttcagatac

SEQ ID NO: 35046 - DNA, 22 bp, Homo sapiens
gccaggcgggtctcaaactcct

SEQ ID NO: 35047 - DNA, 22 bp, Homo sapiens
tggtacacatgtccaaggtcag

SEQ ID NO: 35048 - DNA, 22 bp, Homo sapiens
tgcctgtggaaaggctggtgct

SEQ ID NO: 35049 - DNA, 22 bp, Homo sapiens
cgggcagcggcgtggccatggt

SEQ ID NO: 35050 - DNA, 22 bp, Homo sapiens
gccagggttcgaatccgtatgg

SEQ ID NO: 35051 - DNA, 22 bp, Homo sapiens
ggactgggaatcagggagatgc

SEQ ID NO: 35052 - DNA, 22 bp, Homo sapiens
tttacctttgtgggtctccctc

SEQ ID NO: 35053 - DNA, 22 bp, Homo sapiens
cctgaggatgccagcatgggtg

SEQ ID NO: 35054 - DNA, 22 bp, Homo sapiens
aaaaaattatcatagttcctga

SEQ ID NO: 35055 - DNA, 22 bp, Homo sapiens
tggatggctgtggtctttgccc

SEQ ID NO: 35056 - DNA, 22 bp, Homo sapiens
gatgctgagaggtggagggaac

SEQ ID NO: 35057 - DNA, 20 bp, Homo sapiens
tcagccttgaatgcttgaaa

SEQ ID NO: 35058 - DNA, 22 bp, Homo sapiens
cttcctctgtggccagagtgta

SEQ ID NO: 35059 - DNA, 22 bp, Homo sapiens
ccagagctgattcctgggactt

SEQ ID NO: 35060 - DNA, 22 bp, Homo sapiens
agcaagattgaggcttcctcag

SEQ ID NO: 35061 - DNA, 22 bp, Homo sapiens
gagcaggaaggccagaagggtc

SEQ ID NO: 35062 - DNA, 22 bp, Homo sapiens
ccctgccttgtctgggctaggt

SEQ ID NO: 35063 - DNA, 22 bp, Homo sapiens
ggctcacgcaattatcccggcc

SEQ ID NO: 35064 - DNA, 21 bp, Homo sapiens
cgtgactgggtccgtctggct

SEQ ID NO: 35065 - DNA, 22 bp, Homo sapiens
cctcctgcacctccaggaactc

SEQ ID NO: 35066 - DNA, 22 bp, Homo sapiens
atatatttgagaatattcatga

SEQ ID NO: 35067 - DNA, 22 bp, Homo sapiens
tgatcagcatcttcccagctcg

SEQ ID NO: 35068 - DNA, 22 bp, Homo sapiens
aggaattgtgttgtagtggaga

SEQ ID NO: 35069 - DNA, 22 bp, Homo sapiens
taccagggaacagggatattaa

SEQ ID NO: 35070 - DNA, 22 bp, Homo sapiens
ttagatttacaagcactgttta

SEQ ID NO: 35071 - DNA, 22 bp, Homo sapiens
atacctgtgtatccacaagcgt

SEQ ID NO: 35072 - DNA, 22 bp, Homo sapiens
ggagtttgcctattgcttttgg

SEQ ID NO: 35073 - DNA, 22 bp, Homo sapiens
aggtcaagggagctgagggcca

SEQ ID NO: 35074 - DNA, 22 bp, Homo sapiens
gatctggaatctgaaggctgag

SEQ ID NO: 35075 - DNA, 22 bp, Homo sapiens
tctcacatgcaaacagtccaca

SEQ ID NO: 35076 - DNA, 22 bp, Homo sapiens
actgggctcaagtgattgtcct

SEQ ID NO: 35077 - DNA, 22 bp, Homo sapiens
ggagagtggattccagctgtat

SEQ ID NO: 35078 - DNA, 22 bp, Homo sapiens
tagagcaatgctctactccttg

SEQ ID NO: 35079 - DNA, 22 bp, Homo sapiens
tccacaaggcagctcctccagg

SEQ ID NO: 35080 - DNA, 22 bp, Homo sapiens
aatcacttagaacccaggaagt

SEQ ID NO: 35081 - DNA, 22 bp, Homo sapiens
accctcttgagggaagcacttt

SEQ ID NO: 35082 - DNA, 22 bp, Homo sapiens
gctggctgacagatttggggtg

SEQ ID NO: 35083 - DNA, 22 bp, Homo sapiens
gaatcccttgcattatcccttt

SEQ ID NO: 35084 - DNA, 22 bp, Homo sapiens
tacttttagcctatttgattct

SEQ ID NO: 35085 - DNA, 23 bp, Homo sapiens
gtctctagagtgtggagcaaaga

SEQ ID NO: 35086 - DNA, 22 bp, Homo sapiens
aatgtgagccaatgcccgtggg

SEQ ID NO: 35087 - DNA, 22 bp, Homo sapiens
gggacgtgagtgaagaaggtct

SEQ ID NO: 35088 - DNA, 22 bp, Homo sapiens
gctgcctacgcttgagccctgg

SEQ ID NO: 35089 - DNA, 22 bp, Homo sapiens
aactgaggtatctgctgtgttt

SEQ ID NO: 35090 - DNA, 22 bp, Homo sapiens
agcgggctcacccggttgttgt

SEQ ID NO: 35091 - DNA, 22 bp, Homo sapiens
ctgaagaggctccgcccacaag

SEQ ID NO: 35092 - DNA, 23 bp, Homo sapiens
ccagtgattgcctggaaggaggt

SEQ ID NO: 35093 - DNA, 22 bp, Homo sapiens
tcccgtcttgctgttgtctgcg

SEQ ID NO: 35094 - DNA, 22 bp, Homo sapiens
tagcagtattccggaatacttt

SEQ ID NO: 35095 - DNA, 22 bp, Homo sapiens
ccctggaggttgaggctgcagt

SEQ ID NO: 35096 - DNA, 22 bp, Homo sapiens
accactgcccatggtgaaaact

SEQ ID NO: 35097 - DNA, 22 bp, Homo sapiens
taagagaccgatattcttaagt

SEQ ID NO: 35098 - DNA, 22 bp, Homo sapiens
ggctgggcctctccctcagctg

SEQ ID NO: 35099 - DNA, 22 bp, Homo sapiens
ccttacctgattgctggcatcc

SEQ ID NO: 35100 - DNA, 22 bp, Homo sapiens
tgagaacggatactaagggctg

SEQ ID NO: 35101 - DNA, 22 bp, Homo sapiens
gttgaaatcctaaccccctagt

SEQ ID NO: 35102 - DNA, 21 bp, Homo sapiens
tagcccttctccacctcgccc

SEQ ID NO: 35103 - DNA, 22 bp, Homo sapiens
aggagagctggtgtctggaatc

SEQ ID NO: 35104 - DNA, 22 bp, Homo sapiens
aacgcccgtggttgccaaggta

SEQ ID NO: 35105 - DNA, 22 bp, Homo sapiens
gttcacagtttctaatcccagc

SEQ ID NO: 35106 - DNA, 22 bp, Homo sapiens
agtgctgtctccttcccccggg

SEQ ID NO: 35107 - DNA, 22 bp, Homo sapiens
ttttccttcatatcccttatgt

SEQ ID NO: 35108 - DNA, 22 bp, Homo sapiens
tgtttcttacgtttttagaggc

SEQ ID NO: 35109 - DNA, 22 bp, Homo sapiens
tttgaaatatgtgtcttttgaa

SEQ ID NO: 35110 - DNA, 22 bp, Homo sapiens
ttgcatagtgctgaggttcggg

SEQ ID NO: 35111 - DNA, 22 bp, Homo sapiens
ggaagctctgcctagatttcag

SEQ ID NO: 35112 - DNA, 22 bp, Homo sapiens
ttatgggagcaattggggaggt

SEQ ID NO: 35113 - DNA, 18 bp, Homo sapiens
gtgactgccccaaaaggc

SEQ ID NO: 35114 - DNA, 22 bp, Homo sapiens
cctgtcacctaggtactgagca

SEQ ID NO: 35115 - DNA, 22 bp, Homo sapiens
caggagtccatctggcctggtg

SEQ ID NO: 35116 - DNA, 22 bp, Homo sapiens
tgttgattagtgtttagactta

SEQ ID NO: 35117 - DNA, 22 bp, Homo sapiens
gattgggggtcaggctcaggtc

SEQ ID NO: 35118 - DNA, 22 bp, Homo sapiens
tctctcaggctggagtgcagtg

SEQ ID NO: 35119 - DNA, 22 bp, Homo sapiens
gggccggagctgggtcccgcgc

SEQ ID NO: 35120 - DNA, 22 bp, Homo sapiens
cggctggtgtcgggcacagcaa

SEQ ID NO: 35121 - DNA, 22 bp, Homo sapiens
cctggcactgctgaagtcctgg

SEQ ID NO: 35122 - DNA, 22 bp, Homo sapiens
gcataaactccaaaaggcaggg

SEQ ID NO: 35123 - DNA, 22 bp, Homo sapiens
ttcattcttcagagctgcgctt

SEQ ID NO: 35124 - DNA, 22 bp, Homo sapiens
ttccaaagaagttcacatttac

SEQ ID NO: 35125 - DNA, 19 bp, Homo sapiens
taggaccctggtggccccc

SEQ ID NO: 35126 - DNA, 22 bp, Homo sapiens
taaatcttctacatcatcataa

SEQ ID NO: 35127 - DNA, 22 bp, Homo sapiens
catgctgggtaaaggtggtgaa

SEQ ID NO: 35128 - DNA, 22 bp, Homo sapiens
aggagcagaccgtagtcctgca

SEQ ID NO: 35129 - DNA, 22 bp, Homo sapiens
aaaagtaattgtggtttttgct

SEQ ID NO: 35130 - DNA, 22 bp, Homo sapiens
tcaagagttggtcaaatccaaa

SEQ ID NO: 35131 - DNA, 22 bp, Homo sapiens
aagtcacactagacaactgagg

SEQ ID NO: 35132 - DNA, 22 bp, Homo sapiens
tagaacctccacaggacctcca

SEQ ID NO: 35133 - DNA, 22 bp, Homo sapiens
agggatggagtgcggcccggac

SEQ ID NO: 35134 - DNA, 22 bp, Homo sapiens
aagccctggacggcccttcccc

SEQ ID NO: 35135 - DNA, 22 bp, Homo sapiens
aatctcagctcatgcaattcca

SEQ ID NO: 35136 - DNA, 22 bp, Homo sapiens
gctgaaggcccggaggacaggg

SEQ ID NO: 35137 - DNA, 22 bp, Homo sapiens
gtcttgatctcctgaccttgtg

SEQ ID NO: 35138 - DNA, 22 bp, Homo sapiens
gcttccacctactaaatgccac

SEQ ID NO: 35139 - DNA, 22 bp, Homo sapiens
aaggaatttgaggctgcagtga

SEQ ID NO: 35140 - DNA, 18 bp, Homo sapiens
taggttacagccagccag

SEQ ID NO: 35141 - DNA, 22 bp, Homo sapiens
tccactgctacaacctcccaga

SEQ ID NO: 35142 - DNA, 22 bp, Homo sapiens
caaagtgctaggattacaggcc

SEQ ID NO: 35143 - DNA, 22 bp, Homo sapiens
cttgcctacttgtcaaccagca

SEQ ID NO: 35144 - DNA, 22 bp, Homo sapiens
atatgcagtctcttgcccttct

SEQ ID NO: 35145 - DNA, 22 bp, Homo sapiens
atgcacctgaactccatcagct

SEQ ID NO: 35146 - DNA, 22 bp, Homo sapiens
cctgccctgctcactgtcggta

SEQ ID NO: 35147 - DNA, 22 bp, Homo sapiens
ggaccaggactggtggtatctc

SEQ ID NO: 35148 - DNA, 22 bp, Homo sapiens
agcccaggagtttgaggctgtg

SEQ ID NO: 35149 - DNA, 22 bp, Homo sapiens
tgtcaccatgcgaggctaattt

SEQ ID NO: 35150 - DNA, 22 bp, Homo sapiens
tctctctgcagcccgggacact

SEQ ID NO: 35151 - DNA, 22 bp, Homo sapiens
agttggagtgaacatgagattg

SEQ ID NO: 35152 - DNA, 22 bp, Homo sapiens
ggtagccaatttaaacatttcc

SEQ ID NO: 35153 - DNA, 22 bp, Homo sapiens
tgcaagctgacatccagagaga

SEQ ID NO: 35154 - DNA, 22 bp, Homo sapiens
ggcgtggggccttctgcccgct

SEQ ID NO: 35155 - DNA, 20 bp, Homo sapiens
ctgtggaattttaccatgcg

SEQ ID NO: 35156 - DNA, 22 bp, Homo sapiens
tctggctctggagtccacctgc

SEQ ID NO: 35157 - DNA, 22 bp, Homo sapiens
tgacttgtctctttgggagaca

SEQ ID NO: 35158 - DNA, 22 bp, Homo sapiens
aggtggagaagagatgggcagt

SEQ ID NO: 35159 - DNA, 22 bp, Homo sapiens
agctacctgatccttcttctga

SEQ ID NO: 35160 - DNA, 22 bp, Homo sapiens
tcaggcagtagaattgcttgaa

SEQ ID NO: 35161 - DNA, 22 bp, Homo sapiens
cccagagcatgtgctgcctttg

SEQ ID NO: 35162 - DNA, 22 bp, Homo sapiens
tttctgagaaattaaacacttt

SEQ ID NO: 35163 - DNA, 22 bp, Homo sapiens
tgcaggctcttggtgacgtggg

SEQ ID NO: 35164 - DNA, 22 bp, Homo sapiens
ctacccttaagtttctgtgggg

SEQ ID NO: 35165 - DNA, 22 bp, Homo sapiens
cgagagttagctaggagtcaca

SEQ ID NO: 35166 - DNA, 22 bp, Homo sapiens
ggcaatagttgtgggttcttta

SEQ ID NO: 35167 - DNA, 22 bp, Homo sapiens
gggatgcagactacagggctta

SEQ ID NO: 35168 - DNA, 22 bp, Homo sapiens
catgaaattgtattggcctcaa

SEQ ID NO: 35169 - DNA, 22 bp, Homo sapiens
atatccagcagcaggtgagtat

SEQ ID NO: 35170 - DNA, 22 bp, Homo sapiens
gaaccattgttgaaaagaatag

SEQ ID NO: 35171 - DNA, 22 bp, Homo sapiens
aggaggcagtctgtcccttagc

SEQ ID NO: 35172 - DNA, 22 bp, Homo sapiens
attcacatttagcctctgacat

SEQ ID NO: 35173 - DNA, 22 bp, Homo sapiens
ttcagcccaggagttggaggct

SEQ ID NO: 35174 - DNA, 23 bp, Homo sapiens
ggctgggagctccgggtgcacgt

SEQ ID NO: 35175 - DNA, 23 bp, Homo sapiens
tcaagtaatactcccatcttggc

SEQ ID NO: 35176 - DNA, 22 bp, Homo sapiens
gcggcggcggtcattgagcatg

SEQ ID NO: 35177 - DNA, 22 bp, Homo sapiens
aggtttctttatgctgctagaa

SEQ ID NO: 35178 - DNA, 22 bp, Homo sapiens
gggtccctggaattacttgaca

SEQ ID NO: 35179 - DNA, 22 bp, Homo sapiens
cccaggccccagggcttgtcag

SEQ ID NO: 35180 - DNA, 20 bp, Homo sapiens
tttctccggtcttgagatcc

SEQ ID NO: 35181 - DNA, 22 bp, Homo sapiens
tttaaaaaactagtctgagtct

SEQ ID NO: 35182 - DNA, 22 bp, Homo sapiens
gatgtgtttccaggatttgttt

SEQ ID NO: 35183 - DNA, 22 bp, Homo sapiens
gcaaacaaggacatacatcctg

SEQ ID NO: 35184 - DNA, 22 bp, Homo sapiens
caggctgatcagggctgggatg

SEQ ID NO: 35185 - DNA, 19 bp, Homo sapiens
gggtcccaaaagatgtgct

SEQ ID NO: 35186 - DNA, 22 bp, Homo sapiens
tttgattgcaatagttttatga

SEQ ID NO: 35187 - DNA, 19 bp, Homo sapiens
tccaggggctccacctcct

SEQ ID NO: 35188 - DNA, 22 bp, Homo sapiens
ggatgtttgctagcattcctgg

SEQ ID NO: 35189 - DNA, 21 bp, Homo sapiens
ctcccagggtgactgttcaac

SEQ ID NO: 35190 - DNA, 22 bp, Homo sapiens
ggcgccagcactgcagcgcctc

SEQ ID NO: 35191 - DNA, 22 bp, Homo sapiens
tctgagtggactgtcctgcagg

SEQ ID NO: 35192 - DNA, 22 bp, Homo sapiens
tgtaagtagtaatggaaggaca

SEQ ID NO: 35193 - DNA, 22 bp, Homo sapiens
tcaatcacgtgttccatgttct

SEQ ID NO: 35194 - DNA, 22 bp, Homo sapiens
ccaccagctgcatatgcacgta

SEQ ID NO: 35195 - DNA, 22 bp, Homo sapiens
tgaggctccttgtagagagtgg

SEQ ID NO: 35196 - DNA, 22 bp, Homo sapiens
atcagagtgtaagttctttcct

SEQ ID NO: 35197 - DNA, 22 bp, Homo sapiens
gcttggaagtaggattgggaga

SEQ ID NO: 35198 - DNA, 22 bp, Homo sapiens
tgtccaggctaaagtgcagtgg

SEQ ID NO: 35199 - DNA, 22 bp, Homo sapiens
agatgtgagaatcaagtgacca

SEQ ID NO: 35200 - DNA, 22 bp, Homo sapiens
tagcacagggctcctcaaccca

SEQ ID NO: 35201 - DNA, 22 bp, Homo sapiens
agaaacgcctgtgaaattatct

SEQ ID NO: 35202 - DNA, 22 bp, Homo sapiens
ggagctgaggacactacatttt

SEQ ID NO: 35203 - DNA, 22 bp, Homo sapiens
aagcactttatgtcaatgtcct

SEQ ID NO: 35204 - DNA, 22 bp, Homo sapiens
tggtggcgggcagggccgtcac

SEQ ID NO: 35205 - DNA, 22 bp, Homo sapiens
gcaccctgtcaaaatggaccaa

SEQ ID NO: 35206 - DNA, 22 bp, Homo sapiens
acatttttcacatttgtagggt

SEQ ID NO: 35207 - DNA, 22 bp, Homo sapiens
aaagaaggtagggctggtgact

SEQ ID NO: 35208 - DNA, 22 bp, Homo sapiens
attcactgaatttcatgattat

SEQ ID NO: 35209 - DNA, 20 bp, Homo sapiens
gccactgggcaccagcaggg

SEQ ID NO: 35210 - DNA, 22 bp, Homo sapiens
ggccactgctctccagcctggg

SEQ ID NO: 35211 - DNA, 22 bp, Homo sapiens
taacaatacccattctaattac

SEQ ID NO: 35212 - DNA, 22 bp, Homo sapiens
agcagcagtatccttccccggc

SEQ ID NO: 35213 - DNA, 22 bp, Homo sapiens
agggctctgagtgggaaagagg

SEQ ID NO: 35214 - DNA, 22 bp, Homo sapiens
gcccagcacctctctcagggtt

SEQ ID NO: 35215 - DNA, 22 bp, Homo sapiens
tctagggtgtataaggaagcct

SEQ ID NO: 35216 - DNA, 21 bp, Homo sapiens
ctggaggcaggtggtgccagg

SEQ ID NO: 35217 - DNA, 22 bp, Homo sapiens
gtagcccacctggggagggcga

SEQ ID NO: 35218 - DNA, 22 bp, Homo sapiens
ttgaagaaccatctgtgccact

SEQ ID NO: 35219 - DNA, 22 bp, Homo sapiens
gccccagcctcccgagtagctg

SEQ ID NO: 35220 - DNA, 22 bp, Homo sapiens
catgatctggtcctactgtggg

SEQ ID NO: 35221 - DNA, 22 bp, Homo sapiens
ttaagggccattatggatgggt

SEQ ID NO: 35222 - DNA, 22 bp, Homo sapiens
gatggtgcaggtgaagtgctgg

SEQ ID NO: 35223 - DNA, 22 bp, Homo sapiens
attggtggtgaggacatgccag

SEQ ID NO: 35224 - DNA, 22 bp, Homo sapiens
agatcacagtggcaactccctt

SEQ ID NO: 35225 - DNA, 22 bp, Homo sapiens
ccaggagtgcagggatggtatc

SEQ ID NO: 35226 - DNA, 22 bp, Homo sapiens
aggtgggcgctgctcccgctgg

SEQ ID NO: 35227 - DNA, 22 bp, Homo sapiens
ttagccaggggagcagcttgtc

SEQ ID NO: 35228 - DNA, 22 bp, Homo sapiens
ttgtaacaggtactaaataact

SEQ ID NO: 35229 - DNA, 22 bp, Homo sapiens
gaggttggggctgcagtgagct

SEQ ID NO: 35230 - DNA, 22 bp, Homo sapiens
tttatgtagttacggactatca

SEQ ID NO: 35231 - DNA, 22 bp, Homo sapiens
ttacatccaggaaggtgggagc

SEQ ID NO: 35232 - DNA, 22 bp, Homo sapiens
gggcgccgtgggaaacagccgg

SEQ ID NO: 35233 - DNA, 22 bp, Homo sapiens
gctgatagactgaatgttggga

SEQ ID NO: 35234 - DNA, 22 bp, Homo sapiens
ttccacaatggttaagctcgtt

SEQ ID NO: 35235 - DNA, 22 bp, Homo sapiens
tgagacttaagaggtcatgttg

SEQ ID NO: 35236 - DNA, 22 bp, Homo sapiens
gctgtgtatcagatgccacggg

SEQ ID NO: 35237 - DNA, 22 bp, Homo sapiens
tccattatacttctgattcaaa

SEQ ID NO: 35238 - DNA, 22 bp, Homo sapiens
tcctgccttgcctgggacatca

SEQ ID NO: 35239 - DNA, 22 bp, Homo sapiens
cccaagaggtggaggttgcagt

SEQ ID NO: 35240 - DNA, 22 bp, Homo sapiens
cttcatagtgagtttaatgatg

SEQ ID NO: 35241 - DNA, 22 bp, Homo sapiens
taattgtaaagtagtagtacag

SEQ ID NO: 35242 - DNA, 22 bp, Homo sapiens
cccaggcttttctcttgcccca

SEQ ID NO: 35243 - DNA, 21 bp, Homo sapiens
tcttttctcagctttgtggtt

SEQ ID NO: 35244 - DNA, 21 bp, Homo sapiens
cgcagagcgaacttgcggcgc

SEQ ID NO: 35245 - DNA, 22 bp, Homo sapiens
ccacctgagataagagagctca

SEQ ID NO: 35246 - DNA, 22 bp, Homo sapiens
tagaggccgaatgctgagctgg

SEQ ID NO: 35247 - DNA, 22 bp, Homo sapiens
atagaatatgacttttagatcc

SEQ ID NO: 35248 - DNA, 22 bp, Homo sapiens
tcttgccgcgcaggcgcagttc

SEQ ID NO: 35249 - DNA, 20 bp, Homo sapiens
tcacatcctctcccaacatg

SEQ ID NO: 35250 - DNA, 22 bp, Homo sapiens
tgggcttaggtcggaggcggcc

SEQ ID NO: 35251 - DNA, 22 bp, Homo sapiens
tgaaatgtgttctagtgttttg

SEQ ID NO: 35252 - DNA, 22 bp, Homo sapiens
gaatgcagatggctggtgtatg

SEQ ID NO: 35253 - DNA, 22 bp, Homo sapiens
tagtttaggatccaatctaaga

SEQ ID NO: 35254 - DNA, 22 bp, Homo sapiens
ctgggaggcggaggttgcagtg

SEQ ID NO: 35255 - DNA, 22 bp, Homo sapiens
ttctgcaggctgtacaagaagc

SEQ ID NO: 35256 - DNA, 22 bp, Homo sapiens
aagaaatgtgaatattgaatag

SEQ ID NO: 35257 - DNA, 22 bp, Homo sapiens
tcttcccccgtgctccagtgca

SEQ ID NO: 35258 - DNA, 22 bp, Homo sapiens
ttagtctctttgcattgccata

SEQ ID NO: 35259 - DNA, 22 bp, Homo sapiens
aggagatggagctcagtgggca

SEQ ID NO: 35260 - DNA, 22 bp, Homo sapiens
atgcacacgtaccctacaaggc

SEQ ID NO: 35261 - DNA, 22 bp, Homo sapiens
tctcccaagcctggcaggggca

SEQ ID NO: 35262 - DNA, 22 bp, Homo sapiens
gggctagcctcttccctgctcc

SEQ ID NO: 35263 - DNA, 22 bp, Homo sapiens
gttttagataaagctgtccttg

SEQ ID NO: 35264 - DNA, 22 bp, Homo sapiens
tacaacaatttccacattagaa

SEQ ID NO: 35265 - DNA, 22 bp, Homo sapiens
tgtaatattgtagtgacagtac

SEQ ID NO: 35266 - DNA, 22 bp, Homo sapiens
ttatttaatgtgatctgaagag

SEQ ID NO: 35267 - DNA, 21 bp, Homo sapiens
acacaggcagtgtcccgaggt

SEQ ID NO: 35268 - DNA, 22 bp, Homo sapiens
agttgttcgtggtggattcgct

SEQ ID NO: 35269 - DNA, 22 bp, Homo sapiens
gccaggacctcagatgcagggc

SEQ ID NO: 35270 - DNA, 22 bp, Homo sapiens
gtcatcatcaggcagatgctgc

SEQ ID NO: 35271 - DNA, 22 bp, Homo sapiens
actcggggtggagagagcggtg

SEQ ID NO: 35272 - DNA, 22 bp, Homo sapiens
ctgctccccagcctgcgccttt

SEQ ID NO: 35273 - DNA, 22 bp, Homo sapiens
ctttaattgtagctcccataat

SEQ ID NO: 35274 - DNA, 22 bp, Homo sapiens
tcttcccagaggaggtgccagc

SEQ ID NO: 35275 - DNA, 22 bp, Homo sapiens
ggcgtgggcgaggtgctctatc

SEQ ID NO: 35276 - DNA, 22 bp, Homo sapiens
tgctgggctggggcctcagacc

SEQ ID NO: 35277 - DNA, 22 bp, Homo sapiens
ttagggttacaccagcctcctg

SEQ ID NO: 35278 - DNA, 22 bp, Homo sapiens
agggcagagctgtctaaatggc

SEQ ID NO: 35279 - DNA, 22 bp, Homo sapiens
tggcccgaagatccgagggtca

SEQ ID NO: 35280 - DNA, 22 bp, Homo sapiens
gagcccgagcgcgtacccggcg

SEQ ID NO: 35281 - DNA, 22 bp, Homo sapiens
tatcactacacctggctaatta

SEQ ID NO: 35282 - DNA, 22 bp, Homo sapiens
gggaggttgaggctgcagtgag

SEQ ID NO: 35283 - DNA, 22 bp, Homo sapiens
gccagaagcacatgagaggtga

SEQ ID NO: 35284 - DNA, 22 bp, Homo sapiens
actgggcctacccagattggca

SEQ ID NO: 35285 - DNA, 22 bp, Homo sapiens
tgcgcctctaatctcgggcgtc

SEQ ID NO: 35286 - DNA, 22 bp, Homo sapiens
ttaaatattatgttgtctgcaa

SEQ ID NO: 35287 - DNA, 22 bp, Homo sapiens
ggaggagacagtaaaaagcacg

SEQ ID NO: 35288 - DNA, 22 bp, Homo sapiens
gaccactggggtgagggccatc

SEQ ID NO: 35289 - DNA, 22 bp, Homo sapiens
atgattgaccatctgctgggct

SEQ ID NO: 35290 - DNA, 22 bp, Homo sapiens
ggtttattgttaataagtttga

SEQ ID NO: 35291 - DNA, 21 bp, Homo sapiens
aaccaagccagccagcctctc

SEQ ID NO: 35292 - DNA, 22 bp, Homo sapiens
taactaggattacaagcgtgcg

SEQ ID NO: 35293 - DNA, 22 bp, Homo sapiens
gaaagtgctctctctatacaca

SEQ ID NO: 35294 - DNA, 23 bp, Homo sapiens
tcatgcccaggctccagatgtca

SEQ ID NO: 35295 - DNA, 22 bp, Homo sapiens
catttacatttaaggttaatat

SEQ ID NO: 35296 - DNA, 22 bp, Homo sapiens
tcagtgccatgggcagacaggc

SEQ ID NO: 35297 - DNA, 22 bp, Homo sapiens
agcccttagtacatttctcaag

SEQ ID NO: 35298 - DNA, 22 bp, Homo sapiens
aaagtgctgggattacaagtgt

SEQ ID NO: 35299 - DNA, 22 bp, Homo sapiens
ggcatcgtcctgggcataggga

SEQ ID NO: 35300 - DNA, 22 bp, Homo sapiens
ggctctgtaagtgttgcaggta

SEQ ID NO: 35301 - DNA, 22 bp, Homo sapiens
tgcctgcctaggaagctgtgaa

SEQ ID NO: 35302 - DNA, 22 bp, Homo sapiens
actgttttctgtaaagggccag

SEQ ID NO: 35303 - DNA, 22 bp, Homo sapiens
tggacaggcaagcaagacatac

SEQ ID NO: 35304 - DNA, 22 bp, Homo sapiens
ttggatccatctcaggcatagg

SEQ ID NO: 35305 - DNA, 22 bp, Homo sapiens
caggaggattgcttgaggccag

SEQ ID NO: 35306 - DNA, 22 bp, Homo sapiens
ttgatacccaagtgttatgggt

SEQ ID NO: 35307 - DNA, 22 bp, Homo sapiens
tcactgcaacctccacctcccg

SEQ ID NO: 35308 - DNA, 22 bp, Homo sapiens
tgtgcggggaagggctcactca

SEQ ID NO: 35309 - DNA, 22 bp, Homo sapiens
ctgaggggtcgtgggagcccag

SEQ ID NO: 35310 - DNA, 22 bp, Homo sapiens
atttttctctttccactgagat

SEQ ID NO: 35311 - DNA, 22 bp, Homo sapiens
ctgggcctggggctgttgagag

SEQ ID NO: 35312 - DNA, 22 bp, Homo sapiens
accttgaccttgagcacctgtt

SEQ ID NO: 35313 - DNA, 22 bp, Homo sapiens
ctgtaacctcctctttccattc

SEQ ID NO: 35314 - DNA, 22 bp, Homo sapiens
ctggtttgtcttgggaggatgt

SEQ ID NO: 35315 - DNA, 22 bp, Homo sapiens
gaagatgttatggagagctcag

SEQ ID NO: 35316 - DNA, 22 bp, Homo sapiens
cgtgtacagtctatcttttttc

SEQ ID NO: 35317 - DNA, 22 bp, Homo sapiens
tgccgtggggctgaggctggag

SEQ ID NO: 35318 - DNA, 22 bp, Homo sapiens
ccggctactcgggaggctgacg

SEQ ID NO: 35319 - DNA, 22 bp, Homo sapiens
cagagactggagtgcagtggcg

SEQ ID NO: 35320 - DNA, 22 bp, Homo sapiens
cactgcacttcagcctgggtga

SEQ ID NO: 35321 - DNA, 22 bp, Homo sapiens
tggaggtaggacgaagaactct

SEQ ID NO: 35322 - DNA, 18 bp, Homo sapiens
acgtgctgtgccttttgc

SEQ ID NO: 35323 - DNA, 22 bp, Homo sapiens
agcaccgttcaaacccaggtta

SEQ ID NO: 35324 - DNA, 22 bp, Homo sapiens
ttcagacaggcagctgggctgg

SEQ ID NO: 35325 - DNA, 22 bp, Homo sapiens
tggacacaaagatcaaatattg

SEQ ID NO: 35326 - DNA, 22 bp, Homo sapiens
tcttttgtgattctttagttac

SEQ ID NO: 35327 - DNA, 22 bp, Homo sapiens
tcatctccatacggtctcgcag

SEQ ID NO: 35328 - DNA, 19 bp, Homo sapiens
gagcagtgaggaccaccag

SEQ ID NO: 35329 - DNA, 22 bp, Homo sapiens
tgcagcacttgccaaactaact

SEQ ID NO: 35330 - DNA, 22 bp, Homo sapiens
tcaaaccagccttgcatcccag

SEQ ID NO: 35331 - DNA, 22 bp, Homo sapiens
agaagcctgttgagagggccgt

SEQ ID NO: 35332 - DNA, 22 bp, Homo sapiens
gagcactgagctggaattggag

SEQ ID NO: 35333 - DNA, 22 bp, Homo sapiens
ctgctcctgtccagcagggcca

SEQ ID NO: 35334 - DNA, 22 bp, Homo sapiens
tgacagtgcgggtacatcatag

SEQ ID NO: 35335 - DNA, 22 bp, Homo sapiens
tcggagcgtcactggctggagg

SEQ ID NO: 35336 - DNA, 22 bp, Homo sapiens
ttgttgtcattgtagaggattt

SEQ ID NO: 35337 - DNA, 22 bp, Homo sapiens
gctgacctcgtccaggcgcttc

SEQ ID NO: 35338 - DNA, 22 bp, Homo sapiens
cctttcctgtgtccttttaagg

SEQ ID NO: 35339 - DNA, 22 bp, Homo sapiens
gggcttggcacatgggctcagc

SEQ ID NO: 35340 - DNA, 22 bp, Homo sapiens
cggcatgggcgtccccctcact

SEQ ID NO: 35341 - DNA, 22 bp, Homo sapiens
tcttgggcaatttctctagagg

SEQ ID NO: 35342 - DNA, 22 bp, Homo sapiens
cacagagatggtctggcaggtg

SEQ ID NO: 35343 - DNA, 21 bp, Homo sapiens
ggtgctcgctgatgaggagtg

SEQ ID NO: 35344 - DNA, 22 bp, Homo sapiens
gggcgcatcacctgaggtcagg

SEQ ID NO: 35345 - DNA, 22 bp, Homo sapiens
atcagtgtgtcaaaagcacaaa

SEQ ID NO: 35346 - DNA, 22 bp, Homo sapiens
gggtggtggccagcagtgggca

SEQ ID NO: 35347 - DNA, 22 bp, Homo sapiens
tgggactcactcttttggccag

SEQ ID NO: 35348 - DNA, 22 bp, Homo sapiens
agttggcttcaaaggcagagag

SEQ ID NO: 35349 - DNA, 22 bp, Homo sapiens
agaggctgcacttgctcatgat

SEQ ID NO: 35350 - DNA, 22 bp, Homo sapiens
ctggcctggcgcagtggctcac

SEQ ID NO: 35351 - DNA, 22 bp, Homo sapiens
tgatggctgtagggtccggggc

SEQ ID NO: 35352 - DNA, 22 bp, Homo sapiens
agatgtgtttctagttcctgca

SEQ ID NO: 35353 - DNA, 22 bp, Homo sapiens
tccagcagtccatgtgagacac

SEQ ID NO: 35354 - DNA, 22 bp, Homo sapiens
ttcccttaaattatggcatcta

SEQ ID NO: 35355 - DNA, 22 bp, Homo sapiens
atgtttttaaatagacttacag

SEQ ID NO: 35356 - DNA, 22 bp, Homo sapiens
ttaaactgcttgaattgggttt

SEQ ID NO: 35357 - DNA, 22 bp, Homo sapiens
ttgactgtgatgggctcagctg

SEQ ID NO: 35358 - DNA, 22 bp, Homo sapiens
cccaggagttggaggctgcagt

SEQ ID NO: 35359 - DNA, 22 bp, Homo sapiens
acggtgaccaagcatcaccgag

SEQ ID NO: 35360 - DNA, 22 bp, Homo sapiens
ctcagcactgacccaggagatg

SEQ ID NO: 35361 - DNA, 22 bp, Homo sapiens
gcagtgccgaaggtagtggttg

SEQ ID NO: 35362 - DNA, 22 bp, Homo sapiens
tgcagtggcgccatctcagctc

SEQ ID NO: 35363 - DNA, 22 bp, Homo sapiens
gaggtggccaagcgaggaaggg

SEQ ID NO: 35364 - DNA, 22 bp, Homo sapiens
cttgatctacatagtgaaaccc

SEQ ID NO: 35365 - DNA, 22 bp, Homo sapiens
atgaattgaggaaaacagtcgt

SEQ ID NO: 35366 - DNA, 22 bp, Homo sapiens
gtcctaccatgaattcactcca

SEQ ID NO: 35367 - DNA, 22 bp, Homo sapiens
atgtctgtttgctgagcccggc

SEQ ID NO: 35368 - DNA, 22 bp, Homo sapiens
ttgagcaatgtcactgaggctt

SEQ ID NO: 35369 - DNA, 22 bp, Homo sapiens
aagaataagaggatttagaaca

SEQ ID NO: 35370 - DNA, 22 bp, Homo sapiens
tgacagtattgatggcaggatt

SEQ ID NO: 35371 - DNA, 22 bp, Homo sapiens
gctgcagggagctggaaggctc

SEQ ID NO: 35372 - DNA, 22 bp, Homo sapiens
tatgccactgctctccatccta

SEQ ID NO: 35373 - DNA, 22 bp, Homo sapiens
tcagcctccgaaagtgctggga

SEQ ID NO: 35374 - DNA, 22 bp, Homo sapiens
agcataagttggtacagccact

SEQ ID NO: 35375 - DNA, 22 bp, Homo sapiens
catagagtgatgtaaggtatgt

SEQ ID NO: 35376 - DNA, 22 bp, Homo sapiens
atgctatgtaactggcagatag

SEQ ID NO: 35377 - DNA, 18 bp, Homo sapiens
gaccccgggatctgtcga

SEQ ID NO: 35378 - DNA, 22 bp, Homo sapiens
aaatttgtattccttttccgta

SEQ ID NO: 35379 - DNA, 22 bp, Homo sapiens
tctttcattctagtctgaggtt

SEQ ID NO: 35380 - DNA, 22 bp, Homo sapiens
gccatgcttggtatgctgtgag

SEQ ID NO: 35381 - DNA, 22 bp, Homo sapiens
tttgtggcaggagcggagaccg

SEQ ID NO: 35382 - DNA, 22 bp, Homo sapiens
ctgaattatttaaggtgaaggg

SEQ ID NO: 35383 - DNA, 22 bp, Homo sapiens
cctgggggccaggaaggtgtga

SEQ ID NO: 35384 - DNA, 22 bp, Homo sapiens
ttcagatgattagaatagtatt

SEQ ID NO: 35385 - DNA, 22 bp, Homo sapiens
ctccaggccatggctgcggagg

SEQ ID NO: 35386 - DNA, 22 bp, Homo sapiens
aggcaacttttggggatgatgg

SEQ ID NO: 35387 - DNA, 22 bp, Homo sapiens
tgattttctccattgtaaattc

SEQ ID NO: 35388 - DNA, 22 bp, Homo sapiens
tgagatgtaaggtatgcttact

SEQ ID NO: 35389 - DNA, 22 bp, Homo sapiens
gttgtgaatagtgccgcaataa

SEQ ID NO: 35390 - DNA, 22 bp, Homo sapiens
tgtgttcagaatttgctgcttt

SEQ ID NO: 35391 - DNA, 22 bp, Homo sapiens
tggaaatgtttcttgagctcag

SEQ ID NO: 35392 - DNA, 22 bp, Homo sapiens
ttggagttctgggcacagctgc

SEQ ID NO: 35393 - DNA, 22 bp, Homo sapiens
aagaagcaggtcacagacaggg

SEQ ID NO: 35394 - DNA, 22 bp, Homo sapiens
ttccgaacccggatctgctgct

SEQ ID NO: 35395 - DNA, 22 bp, Homo sapiens
cctcagacccctgctgagcttc

SEQ ID NO: 35396 - DNA, 22 bp, Homo sapiens
gtgctggatgaaataactggaa

SEQ ID NO: 35397 - DNA, 22 bp, Homo sapiens
cactgcagcctcgctctcctga

SEQ ID NO: 35398 - DNA, 22 bp, Homo sapiens
agcactgtgagcaccagcacgc

SEQ ID NO: 35399 - DNA, 22 bp, Homo sapiens
catggcattgcataacggggct

SEQ ID NO: 35400 - DNA, 22 bp, Homo sapiens
accagcctggccaacatggtga

SEQ ID NO: 35401 - DNA, 20 bp, Homo sapiens
tcccccactgtttctgctac

SEQ ID NO: 35402 - DNA, 22 bp, Homo sapiens
tcacttcccagacggggtggca

SEQ ID NO: 35403 - DNA, 22 bp, Homo sapiens
cctctgtgtgatgcgcaaagta

SEQ ID NO: 35404 - DNA, 22 bp, Homo sapiens
cccgggttgtccgcgcgtccgg

SEQ ID NO: 35405 - DNA, 22 bp, Homo sapiens
agccaggatggtctcgatcggc

SEQ ID NO: 35406 - DNA, 22 bp, Homo sapiens
aaagtgcttcctttttgagggt

SEQ ID NO: 35407 - DNA, 19 bp, Homo sapiens
gataggcagccatgagccc

SEQ ID NO: 35408 - DNA, 22 bp, Homo sapiens
actgcaacctccgcctgccagg

SEQ ID NO: 35409 - DNA, 22 bp, Homo sapiens
cgcggtggcggcctccagcgcc

SEQ ID NO: 35410 - DNA, 22 bp, Homo sapiens
gagtagaactggttatctaata

SEQ ID NO: 35411 - DNA, 16 bp, Homo sapiens
cgagtgaagccttttc

SEQ ID NO: 35412 - DNA, 18 bp, Homo sapiens
ctgtacttcagcctgggt

SEQ ID NO: 35413 - DNA, 22 bp, Homo sapiens
catcctctccagcagtggagtg

SEQ ID NO: 35414 - DNA, 22 bp, Homo sapiens
agtggagcttttcctatcagag

SEQ ID NO: 35415 - DNA, 22 bp, Homo sapiens
gttgacagtgaccctgaaagca

SEQ ID NO: 35416 - DNA, 22 bp, Homo sapiens
actgcacttcagcctgggtgac

SEQ ID NO: 35417 - DNA, 22 bp, Homo sapiens
actcatgtcctaggagtaaagc

SEQ ID NO: 35418 - DNA, 22 bp, Homo sapiens
gccacctcggctttctctgctc

SEQ ID NO: 35419 - DNA, 22 bp, Homo sapiens
ggccactgacctacatctgggg

SEQ ID NO: 35420 - DNA, 22 bp, Homo sapiens
gacctcgtgatctgccagcctt

SEQ ID NO: 35421 - DNA, 22 bp, Homo sapiens
atgcagtggcttcagtgtcagt

SEQ ID NO: 35422 - DNA, 17 bp, Homo sapiens
aggaggccctggcgttt

SEQ ID NO: 35423 - DNA, 22 bp, Homo sapiens
tcacagacccttgctgagctct

SEQ ID NO: 35424 - DNA, 22 bp, Homo sapiens
tgggtggcagcttcagcatgtt

SEQ ID NO: 35425 - DNA, 21 bp, Homo sapiens
tctgatggtagatgagatgtg

SEQ ID NO: 35426 - DNA, 22 bp, Homo sapiens
gcctacatttcccagttgaatg

SEQ ID NO: 35427 - DNA, 22 bp, Homo sapiens
ttatttaaaagtggtaagattc

SEQ ID NO: 35428 - DNA, 22 bp, Homo sapiens
aatattatacagtcaacctctt

SEQ ID NO: 35429 - DNA, 22 bp, Homo sapiens
ggtcaggagcccttggccccct

SEQ ID NO: 35430 - DNA, 22 bp, Homo sapiens
ttttttgttgggtagaacggaa

SEQ ID NO: 35431 - DNA, 22 bp, Homo sapiens
tgtatattctgcctaaaagctt

SEQ ID NO: 35432 - DNA, 22 bp, Homo sapiens
ggggatggaggcgtgtggtcct

SEQ ID NO: 35433 - DNA, 22 bp, Homo sapiens
tggtgccatcatagctcactgc

SEQ ID NO: 35434 - DNA, 22 bp, Homo sapiens
tgcagcaccgtcccactggcta

SEQ ID NO: 35435 - DNA, 22 bp, Homo sapiens
ggggcccctcggacacgtgcgg

SEQ ID NO: 35436 - DNA, 22 bp, Homo sapiens
ggcctcgcggcttctggtggct

SEQ ID NO: 35437 - DNA, 22 bp, Homo sapiens
acagttaataagtagtaagtca

SEQ ID NO: 35438 - DNA, 22 bp, Homo sapiens
ccttcccacattccttacatgc

SEQ ID NO: 35439 - DNA, 22 bp, Homo sapiens
tgctcattggcgatctgaggga

SEQ ID NO: 35440 - DNA, 21 bp, Homo sapiens
gggcagaggggcctcctgggt

SEQ ID NO: 35441 - DNA, 22 bp, Homo sapiens
aataaacaaaggacaaggaggt

SEQ ID NO: 35442 - DNA, 22 bp, Homo sapiens
gcatatgatcacgtgtgtcggt

SEQ ID NO: 35443 - DNA, 22 bp, Homo sapiens
agacactgttctcacatgcttg

SEQ ID NO: 35444 - DNA, 22 bp, Homo sapiens
gggctgcactagggcaaggtga

SEQ ID NO: 35445 - DNA, 22 bp, Homo sapiens
ctgggtggcagagcctgcagtg

SEQ ID NO: 35446 - DNA, 22 bp, Homo sapiens
tggttaagtccagaaaggaagc

SEQ ID NO: 35447 - DNA, 22 bp, Homo sapiens
gcgttggggaccccgaagctgg

SEQ ID NO: 35448 - DNA, 19 bp, Homo sapiens
atgtacccagtgtcaatcc

SEQ ID NO: 35449 - DNA, 22 bp, Homo sapiens
tgagatcattgacttgttcctg

SEQ ID NO: 35450 - DNA, 22 bp, Homo sapiens
atcctcagagaacgaacacaat

SEQ ID NO: 35451 - DNA, 17 bp, Homo sapiens
acctattgatctgtcac

SEQ ID NO: 35452 - DNA, 22 bp, Homo sapiens
tgggaacagaggacttgactgt

SEQ ID NO: 35453 - DNA, 22 bp, Homo sapiens
cacactgtctttatgagctgta

SEQ ID NO: 35454 - DNA, 22 bp, Homo sapiens
ttgggctcaggagtttgagacc

SEQ ID NO: 35455 - DNA, 22 bp, Homo sapiens
agctacagtcggaaggacagac

SEQ ID NO: 35456 - DNA, 22 bp, Homo sapiens
atcattatcctcctatttgcct

SEQ ID NO: 35457 - DNA, 22 bp, Homo sapiens
atggcagaatatctgcatcgca

SEQ ID NO: 35458 - DNA, 22 bp, Homo sapiens
ctgtctgaatcctaagcttcct

SEQ ID NO: 35459 - DNA, 22 bp, Homo sapiens
aaagcagaggttgcagtgagct

SEQ ID NO: 35460 - DNA, 18 bp, Homo sapiens
tccagttttcccagcatc

SEQ ID NO: 35461 - DNA, 22 bp, Homo sapiens
ggaactgaatgtctcggtataa

SEQ ID NO: 35462 - DNA, 16 bp, Homo sapiens
gcagaggaaaggggag

SEQ ID NO: 35463 - DNA, 20 bp, Homo sapiens
attagagctacatggctaca

SEQ ID NO: 35464 - DNA, 21 bp, Homo sapiens
ctagcccctactccaagttga

SEQ ID NO: 35465 - DNA, 22 bp, Homo sapiens
atacatgcgccatgttggtgtg

SEQ ID NO: 35466 - DNA, 22 bp, Homo sapiens
ttacatgtggtgtgaagaagag

SEQ ID NO: 35467 - DNA, 22 bp, Homo sapiens
aggggtgacacatatcagtgca

SEQ ID NO: 35468 - DNA, 22 bp, Homo sapiens
tctgtcacccagagtgcagtgg

SEQ ID NO: 35469 - DNA, 22 bp, Homo sapiens
ctggcaagaaatatatatctta

SEQ ID NO: 35470 - DNA, 22 bp, Homo sapiens
cctggagagctcgggccaggca

SEQ ID NO: 35471 - DNA, 22 bp, Homo sapiens
agcctattccaggatgagctca

SEQ ID NO: 35472 - DNA, 22 bp, Homo sapiens
taggctgggaagaaagattctc

SEQ ID NO: 35473 - DNA, 22 bp, Homo sapiens
aaattagtcatgttgtattact

SEQ ID NO: 35474 - DNA, 22 bp, Homo sapiens
ggaggctgaggcaggcggatca

SEQ ID NO: 35475 - DNA, 22 bp, Homo sapiens
aagccaggttccatggaggagc

SEQ ID NO: 35476 - DNA, 22 bp, Homo sapiens
ggaggggatttagtagatgcta

SEQ ID NO: 35477 - DNA, 22 bp, Homo sapiens
gtgctcatagatgatgctcttt

SEQ ID NO: 35478 - DNA, 22 bp, Homo sapiens
caccagtgtttacctgtgacaa

SEQ ID NO: 35479 - DNA, 22 bp, Homo sapiens
aatcagaaattgagggtctggt

SEQ ID NO: 35480 - DNA, 22 bp, Homo sapiens
atgcccctggcctggggaacat

SEQ ID NO: 35481 - DNA, 22 bp, Homo sapiens
tccgaggccaaagctgtgaata

SEQ ID NO: 35482 - DNA, 19 bp, Homo sapiens
caggcctcttaccctctct

SEQ ID NO: 35483 - DNA, 23 bp, Homo sapiens
gcagaggagcaagctggacacca

SEQ ID NO: 35484 - DNA, 22 bp, Homo sapiens
atgaaaacggaccagagctatt

SEQ ID NO: 35485 - DNA, 22 bp, Homo sapiens
cactgctacctctgcctcccgg

SEQ ID NO: 35486 - DNA, 22 bp, Homo sapiens
acatcccatgcgcatctggcaa

SEQ ID NO: 35487 - DNA, 22 bp, Homo sapiens
gagccaggaggcagagactgca

SEQ ID NO: 35488 - DNA, 22 bp, Homo sapiens
caccgcggagtgatggagaaac

SEQ ID NO: 35489 - DNA, 22 bp, Homo sapiens
aaccagactctccaaaggcaaa

SEQ ID NO: 35490 - DNA, 22 bp, Homo sapiens
tgtgggagaaggaagcaagctg

SEQ ID NO: 35491 - DNA, 22 bp, Homo sapiens
tcagacattattttcaagataa

SEQ ID NO: 35492 - DNA, 22 bp, Homo sapiens
cttgggaggcagaggttgcagt

SEQ ID NO: 35493 - DNA, 22 bp, Homo sapiens
cacgttaacagctaacagatga

SEQ ID NO: 35494 - DNA, 22 bp, Homo sapiens
aactaatacattaatacatgtg

SEQ ID NO: 35495 - DNA, 22 bp, Homo sapiens
gtgcacttgatctagacagatt

SEQ ID NO: 35496 - DNA, 22 bp, Homo sapiens
gtaggccatggtggttgtctct

SEQ ID NO: 35497 - DNA, 22 bp, Homo sapiens
agcgtgaattagttggtacaca

SEQ ID NO: 35498 - DNA, 22 bp, Homo sapiens
acttgtgttaccaaggtttggt

SEQ ID NO: 35499 - DNA, 22 bp, Homo sapiens
ctgagatctttatacgaggcac

SEQ ID NO: 35500 - DNA, 22 bp, Homo sapiens
gtctttcttaaacaacagaaca

SEQ ID NO: 35501 - DNA, 22 bp, Homo sapiens
ctggggtccttgccatgtgtca

SEQ ID NO: 35502 - DNA, 22 bp, Homo sapiens
agcctgggcaacagagcaaaac

SEQ ID NO: 35503 - DNA, 22 bp, Homo sapiens
tcagtgcagggtgggagagaga

SEQ ID NO: 35504 - DNA, 22 bp, Homo sapiens
acactgatgttggccctggtca

SEQ ID NO: 35505 - DNA, 22 bp, Homo sapiens
ccatcacagtccccatcgtgat

SEQ ID NO: 35506 - DNA, 22 bp, Homo sapiens
tgtggactcgcatggctgaggc

SEQ ID NO: 35507 - DNA, 22 bp, Homo sapiens
ccctgctgtgtagcggaggaac

SEQ ID NO: 35508 - DNA, 22 bp, Homo sapiens
tacgcctgtaatcccagcactt

SEQ ID NO: 35509 - DNA, 22 bp, Homo sapiens
tgtaggagtccaatcaggagac

SEQ ID NO: 35510 - DNA, 22 bp, Homo sapiens
ccagtgtatttttgggacctgc

SEQ ID NO: 35511 - DNA, 22 bp, Homo sapiens
cccacgttgaaccgcttacaga

SEQ ID NO: 35512 - DNA, 22 bp, Homo sapiens
gggcttcagttctgaccatctt

SEQ ID NO: 35513 - DNA, 22 bp, Homo sapiens
tggattcacaccattctcctgc

SEQ ID NO: 35514 - DNA, 22 bp, Homo sapiens
ctggtgggagataattgaatca

SEQ ID NO: 35515 - DNA, 22 bp, Homo sapiens
ctggaaggcggaggttgtagtg

SEQ ID NO: 35516 - DNA, 22 bp, Homo sapiens
gatggcctcatggctgcaggcc

SEQ ID NO: 35517 - DNA, 22 bp, Homo sapiens
gctttggacaataactgctttt

SEQ ID NO: 35518 - DNA, 22 bp, Homo sapiens
tgaggcaggacttgcataaagt

SEQ ID NO: 35519 - DNA, 22 bp, Homo sapiens
taaagattgctcaaaactgtga

SEQ ID NO: 35520 - DNA, 22 bp, Homo sapiens
agatttggtgtctggttgatat

SEQ ID NO: 35521 - DNA, 22 bp, Homo sapiens
gctctgagtcacactgccctgt

SEQ ID NO: 35522 - DNA, 22 bp, Homo sapiens
ttgcatcagaattacttggagg

SEQ ID NO: 35523 - DNA, 22 bp, Homo sapiens
tgagataatcatgtgatttcat

SEQ ID NO: 35524 - DNA, 22 bp, Homo sapiens
attgctaggaacaggttgcacc

SEQ ID NO: 35525 - DNA, 22 bp, Homo sapiens
ggcggaggttgcagtaagccga

SEQ ID NO: 35526 - DNA, 22 bp, Homo sapiens
cgggcaaggcgagactaggccc

SEQ ID NO: 35527 - DNA, 20 bp, Homo sapiens
gtctccactgggggttaacc

SEQ ID NO: 35528 - DNA, 22 bp, Homo sapiens
tttccagaaataccatttggtg

SEQ ID NO: 35529 - DNA, 22 bp, Homo sapiens
cccggacagaggggcagagtgt

SEQ ID NO: 35530 - DNA, 22 bp, Homo sapiens
ccgtggtcacctgagctccttg

SEQ ID NO: 35531 - DNA, 22 bp, Homo sapiens
aaagtgctgtgattacaggcat

SEQ ID NO: 35532 - DNA, 22 bp, Homo sapiens
tagctttgtttatcaaggggca

SEQ ID NO: 35533 - DNA, 22 bp, Homo sapiens
aattatggtcactgttcctggg

SEQ ID NO: 35534 - DNA, 22 bp, Homo sapiens
ttcctgcgcccttctcgcccgc

SEQ ID NO: 35535 - DNA, 22 bp, Homo sapiens
gggcggatcacctgaggtcagg

SEQ ID NO: 35536 - DNA, 22 bp, Homo sapiens
agattcttgagtagctgtgctt

SEQ ID NO: 35537 - DNA, 22 bp, Homo sapiens
gtccagttgtatgtccagtgtc

SEQ ID NO: 35538 - DNA, 22 bp, Homo sapiens
aggacgctctcgctgaacttct

SEQ ID NO: 35539 - DNA, 16 bp, Homo sapiens
cttgtctgttgctcat

SEQ ID NO: 35540 - DNA, 22 bp, Homo sapiens
tggggagtgatgcctcggataa

SEQ ID NO: 35541 - DNA, 22 bp, Homo sapiens
gaatttaagaggatgaatctgt

SEQ ID NO: 35542 - DNA, 22 bp, Homo sapiens
ctgtcaggtttcccggctcacg

SEQ ID NO: 35543 - DNA, 22 bp, Homo sapiens
tgcatgagcgaatgtgtcctgt

SEQ ID NO: 35544 - DNA, 21 bp, Homo sapiens
ttgttcctatctgcctcctgc

SEQ ID NO: 35545 - DNA, 22 bp, Homo sapiens
taggcaagtggaccagaggttt

SEQ ID NO: 35546 - DNA, 22 bp, Homo sapiens
gcaccactacactccagcctgg

SEQ ID NO: 35547 - DNA, 22 bp, Homo sapiens
agacagggtgatcgcttgagcc

SEQ ID NO: 35548 - DNA, 22 bp, Homo sapiens
gggtaattggggccttgcagtg

SEQ ID NO: 35549 - DNA, 22 bp, Homo sapiens
ggcaggaggtgagtggcgggtg

SEQ ID NO: 35550 - DNA, 22 bp, Homo sapiens
ctgtatctgtgttggatgagtt

SEQ ID NO: 35551 - DNA, 22 bp, Homo sapiens
taggcctggatctctgggagca

SEQ ID NO: 35552 - DNA, 22 bp, Homo sapiens
acagagcaatgcgtgttctcta

SEQ ID NO: 35553 - DNA, 22 bp, Homo sapiens
caaagtgctaggattataggtg

SEQ ID NO: 35554 - DNA, 22 bp, Homo sapiens
tttgccagtattttattgatga

SEQ ID NO: 35555 - DNA, 19 bp, Homo sapiens
tctagttttgagagacttc

SEQ ID NO: 35556 - DNA, 21 bp, Homo sapiens
tgctccaggagggggcagtcc

SEQ ID NO: 35557 - DNA, 22 bp, Homo sapiens
tcttagaaattccccagtggct

SEQ ID NO: 35558 - DNA, 22 bp, Homo sapiens
gaggccacggaagggagctgtg

SEQ ID NO: 35559 - DNA, 22 bp, Homo sapiens
tctgttgcaatgtgcatggtga

SEQ ID NO: 35560 - DNA, 22 bp, Homo sapiens
gcctggccgggtcttggatttt

SEQ ID NO: 35561 - DNA, 22 bp, Homo sapiens
aagcagatctgatagggccctg

SEQ ID NO: 35562 - DNA, 22 bp, Homo sapiens
aagatgcggttgaccatggtgt

SEQ ID NO: 35563 - DNA, 22 bp, Homo sapiens
tcactacaacctccgcctcctg

SEQ ID NO: 35564 - DNA, 21 bp, Homo sapiens
ctacttaagtaggggattagg

SEQ ID NO: 35565 - DNA, 19 bp, Homo sapiens
ggggcccggggtctgcgag

SEQ ID NO: 35566 - DNA, 22 bp, Homo sapiens
agttgcagacgcagagatgttg

SEQ ID NO: 35567 - DNA, 22 bp, Homo sapiens
attgtaaatagtgccacaataa

SEQ ID NO: 35568 - DNA, 22 bp, Homo sapiens
tgggcagggagctggaaccaca

SEQ ID NO: 35569 - DNA, 22 bp, Homo sapiens
caggctggagtgcagtggcgct

SEQ ID NO: 35570 - DNA, 22 bp, Homo sapiens
gcaggatgagtgagtacattta

SEQ ID NO: 35571 - DNA, 22 bp, Homo sapiens
acggcttcttgactgtgggttg

SEQ ID NO: 35572 - DNA, 22 bp, Homo sapiens
ccctgctgtcaggtgctgggag

SEQ ID NO: 35573 - DNA, 22 bp, Homo sapiens
cgtctggcttctccacggtaaa

SEQ ID NO: 35574 - DNA, 22 bp, Homo sapiens
agcccaggtccagttcactgca

SEQ ID NO: 35575 - DNA, 22 bp, Homo sapiens
tgcaatctcggcactttgggag

SEQ ID NO: 35576 - DNA, 22 bp, Homo sapiens
ttcaatttgtgctaaggcaccg

SEQ ID NO: 35577 - DNA, 22 bp, Homo sapiens
ctgagatggagtttcgctcttc

SEQ ID NO: 35578 - DNA, 22 bp, Homo sapiens
ggccctgggccctctagcttgt

SEQ ID NO: 35579 - DNA, 22 bp, Homo sapiens
ctgtgctgggtccttcttttga

SEQ ID NO: 35580 - DNA, 22 bp, Homo sapiens
agaatgggggctacaggccaca

SEQ ID NO: 35581 - DNA, 22 bp, Homo sapiens
tagccgggtgtggtggaactcc

SEQ ID NO: 35582 - DNA, 22 bp, Homo sapiens
gctgtagtgaatggccgcgttc

SEQ ID NO: 35583 - DNA, 22 bp, Homo sapiens
aaagcactgcacatatatttgc

SEQ ID NO: 35584 - DNA, 22 bp, Homo sapiens
acacagagccaaaccatatcac

SEQ ID NO: 35585 - DNA, 22 bp, Homo sapiens
tgttccagatttagccaaccga

SEQ ID NO: 35586 - DNA, 23 bp, Homo sapiens
ctgtggtgaggccctagaatctg

SEQ ID NO: 35587 - DNA, 22 bp, Homo sapiens
tagatgaccttgtgttaggcaa

SEQ ID NO: 35588 - DNA, 22 bp, Homo sapiens
tttggtaagtacccacctgggt

SEQ ID NO: 35589 - DNA, 22 bp, Homo sapiens
gcgagggcacgcggttgaaggc

SEQ ID NO: 35590 - DNA, 22 bp, Homo sapiens
aaacatctactgtaggctggag

SEQ ID NO: 35591 - DNA, 22 bp, Homo sapiens
gcaggtggatcaccacgtcagg

SEQ ID NO: 35592 - DNA, 23 bp, Homo sapiens
ccactagcacctgttcaacttct

SEQ ID NO: 35593 - DNA, 22 bp, Homo sapiens
atttaagggatttggagaccaa

SEQ ID NO: 35594 - DNA, 22 bp, Homo sapiens
cactgcactccatcctgggaaa

SEQ ID NO: 35595 - DNA, 22 bp, Homo sapiens
tgccgctccaggtctcgcggtg

SEQ ID NO: 35596 - DNA, 22 bp, Homo sapiens
cctcgggctgaggctcccaggc

SEQ ID NO: 35597 - DNA, 22 bp, Homo sapiens
aggtgcttggctcgtgcacaca

SEQ ID NO: 35598 - DNA, 22 bp, Homo sapiens
cccgagcctcggtttcttttct

SEQ ID NO: 35599 - DNA, 22 bp, Homo sapiens
agctgaacgtgcttctgcagca

SEQ ID NO: 35600 - DNA, 22 bp, Homo sapiens
agatgctgctccacaggccagg

SEQ ID NO: 35601 - DNA, 22 bp, Homo sapiens
tgaaatgattatatggtgtttg

SEQ ID NO: 35602 - DNA, 22 bp, Homo sapiens
cactgcactccagcttgggcaa

SEQ ID NO: 35603 - DNA, 22 bp, Homo sapiens
cgtgctgggtctgcggggccgt

SEQ ID NO: 35604 - DNA, 17 bp, Homo sapiens
ttcttttctgagccttg

SEQ ID NO: 35605 - DNA, 22 bp, Homo sapiens
tctgcaccatcgtatgcttaat

SEQ ID NO: 35606 - DNA, 22 bp, Homo sapiens
aatataacacagatggcctgtt

SEQ ID NO: 35607 - DNA, 22 bp, Homo sapiens
gcacttcaccactgtcctggtt

SEQ ID NO: 35608 - DNA, 18 bp, Homo sapiens
tctgccccagccgcactg

SEQ ID NO: 35609 - DNA, 22 bp, Homo sapiens
ccatccttgtcatcttcatgtt

SEQ ID NO: 35610 - DNA, 22 bp, Homo sapiens
gaggggtccaggaggcacttac

SEQ ID NO: 35611 - DNA, 22 bp, Homo sapiens
aatttcggttcaaggcccagtt

SEQ ID NO: 35612 - DNA, 22 bp, Homo sapiens
tttggaggggaagaccttggag

SEQ ID NO: 35613 - DNA, 22 bp, Homo sapiens
ctccagattccgtttattcagg

SEQ ID NO: 35614 - DNA, 22 bp, Homo sapiens
ttaattctgcctttcatgtaac

SEQ ID NO: 35615 - DNA, 22 bp, Homo sapiens
gctgtcttgctcactcttgcag

SEQ ID NO: 35616 - DNA, 22 bp, Homo sapiens
tattgacagtgactattggtag

SEQ ID NO: 35617 - DNA, 22 bp, Homo sapiens
gcccatgaggtggaggctgcag

SEQ ID NO: 35618 - DNA, 22 bp, Homo sapiens
ggcaaaaaccataattactttt

SEQ ID NO: 35619 - DNA, 22 bp, Homo sapiens
atggcatttgaatctgtctttt

SEQ ID NO: 35620 - DNA, 17 bp, Homo sapiens
gagacccccactacacc

SEQ ID NO: 35621 - DNA, 22 bp, Homo sapiens
gtatagaaacccagaaagatag

SEQ ID NO: 35622 - DNA, 22 bp, Homo sapiens
aactcaggagtttaaggctgca

SEQ ID NO: 35623 - DNA, 22 bp, Homo sapiens
ttcagcagtgcagacacccagt

SEQ ID NO: 35624 - DNA, 22 bp, Homo sapiens
tgttttaagggtcaactgtcac

SEQ ID NO: 35625 - DNA, 22 bp, Homo sapiens
agggagcattgtgacatatcac

SEQ ID NO: 35626 - DNA, 22 bp, Homo sapiens
ctgccgtgtttttcatgttaaa

SEQ ID NO: 35627 - DNA, 22 bp, Homo sapiens
ctcagattgtttgcctcgcagt

SEQ ID NO: 35628 - DNA, 22 bp, Homo sapiens
tgagggaatattgatagatccg

SEQ ID NO: 35629 - DNA, 22 bp, Homo sapiens
cctgagtagctggaattaaagg

SEQ ID NO: 35630 - DNA, 22 bp, Homo sapiens
taaatgttgtaagtacatctaa

SEQ ID NO: 35631 - DNA, 22 bp, Homo sapiens
atgcgagtgatgcagagtggct

SEQ ID NO: 35632 - DNA, 21 bp, Homo sapiens
tttgtggaattctcactcttc

SEQ ID NO: 35633 - DNA, 22 bp, Homo sapiens
tcagattgttggagccaaacag

SEQ ID NO: 35634 - DNA, 22 bp, Homo sapiens
cttctcggccgtgtggatgcgc

SEQ ID NO: 35635 - DNA, 22 bp, Homo sapiens
tctttggtttctgtctctgtaa

SEQ ID NO: 35636 - DNA, 22 bp, Homo sapiens
atacagggacatccagtttttc

SEQ ID NO: 35637 - DNA, 22 bp, Homo sapiens
tttgcttgttcaagatttctgt

SEQ ID NO: 35638 - DNA, 22 bp, Homo sapiens
tccttaggcaatttgggagagt

SEQ ID NO: 35639 - DNA, 22 bp, Homo sapiens
cgtcccgggttcacgccattct

SEQ ID NO: 35640 - DNA, 22 bp, Homo sapiens
gaccttgtgatccgcccgcctt

SEQ ID NO: 35641 - DNA, 22 bp, Homo sapiens
taggtttaggagtgaaggtgaa

SEQ ID NO: 35642 - DNA, 22 bp, Homo sapiens
acagtccagcctagtatgtata

SEQ ID NO: 35643 - DNA, 22 bp, Homo sapiens
gaggagctgcccgtgtgtctgc

SEQ ID NO: 35644 - DNA, 22 bp, Homo sapiens
aggttatcatcagttgagcact

SEQ ID NO: 35645 - DNA, 22 bp, Homo sapiens
gcttttcatgacaactcagcga

SEQ ID NO: 35646 - DNA, 22 bp, Homo sapiens
aaaagtcttggggaaggccagg

SEQ ID NO: 35647 - DNA, 22 bp, Homo sapiens
actcttgattgatttagtcttt

SEQ ID NO: 35648 - DNA, 22 bp, Homo sapiens
cccaggctggagtgtaatggtg

SEQ ID NO: 35649 - DNA, 22 bp, Homo sapiens
tacaaaggaggtgcatagaaca

SEQ ID NO: 35650 - DNA, 22 bp, Homo sapiens
tagtgccctcccctttgggata

SEQ ID NO: 35651 - DNA, 22 bp, Homo sapiens
actgaataaggtgaatgctctg

SEQ ID NO: 35652 - DNA, 22 bp, Homo sapiens
cttaatctcacctgcaaagtcc

SEQ ID NO: 35653 - DNA, 22 bp, Homo sapiens
cgcgcggccttgtggggcttgt

SEQ ID NO: 35654 - DNA, 19 bp, Homo sapiens
aggagcactgccagcacca

SEQ ID NO: 35655 - DNA, 22 bp, Homo sapiens
cttcctcctccatctcgaaggc

SEQ ID NO: 35656 - DNA, 22 bp, Homo sapiens
tttaatcaggcaaagcataata

SEQ ID NO: 35657 - DNA, 22 bp, Homo sapiens
tgtgcctagttctgtatttaca

SEQ ID NO: 35658 - DNA, 22 bp, Homo sapiens
gccgggaccaaggccacggagc

SEQ ID NO: 35659 - DNA, 22 bp, Homo sapiens
ccgcgccacccattcccactga

SEQ ID NO: 35660 - DNA, 22 bp, Homo sapiens
gctggcaaggtgctggagggcc

SEQ ID NO: 35661 - DNA, 22 bp, Homo sapiens
aggactgggtgcagagggcatc

SEQ ID NO: 35662 - DNA, 22 bp, Homo sapiens
tggcccttgttcaaatatgtca

SEQ ID NO: 35663 - DNA, 22 bp, Homo sapiens
aggggagagttaatgtgaatgt

SEQ ID NO: 35664 - DNA, 22 bp, Homo sapiens
gtcagaggggcagctgccaggc

SEQ ID NO: 35665 - DNA, 22 bp, Homo sapiens
agagtccctcttcccaggaggc

SEQ ID NO: 35666 - DNA, 22 bp, Homo sapiens
agcccggcttccccggttgcta

SEQ ID NO: 35667 - DNA, 22 bp, Homo sapiens
agagcactttcgagagccggag

SEQ ID NO: 35668 - DNA, 22 bp, Homo sapiens
cctgagagcattccacactgaa

SEQ ID NO: 35669 - DNA, 22 bp, Homo sapiens
cactgcactccagcctggcgac

SEQ ID NO: 35670 - DNA, 23 bp, Homo sapiens
ggatggacgtgatgccttagcca

SEQ ID NO: 35671 - DNA, 22 bp, Homo sapiens
ggcctctcttgggacagctgtc

SEQ ID NO: 35672 - DNA, 22 bp, Homo sapiens
acatttatataactcactagga

SEQ ID NO: 35673 - DNA, 22 bp, Homo sapiens
tgtctggtgggttgacaggcag

SEQ ID NO: 35674 - DNA, 22 bp, Homo sapiens
tagcacagcttcttgatgtcac

SEQ ID NO: 35675 - DNA, 22 bp, Homo sapiens
ctccgcttgtgtatacctccaa

SEQ ID NO: 35676 - DNA, 22 bp, Homo sapiens
aagggggcggcagccagtggaa

SEQ ID NO: 35677 - DNA, 22 bp, Homo sapiens
ggcagggcaggaaagtcaggaa

SEQ ID NO: 35678 - DNA, 22 bp, Homo sapiens
caaagtgggtgccctgatgctc

SEQ ID NO: 35679 - DNA, 22 bp, Homo sapiens
ttaagctagtgaagtccctcaa

SEQ ID NO: 35680 - DNA, 22 bp, Homo sapiens
gctcactgcaagctccgcctcc

SEQ ID NO: 35681 - DNA, 22 bp, Homo sapiens
ctcgttgctgaagccaaagtca

SEQ ID NO: 35682 - DNA, 22 bp, Homo sapiens
ctgctaaacctctctgagagct

SEQ ID NO: 35683 - DNA, 22 bp, Homo sapiens
cattctgaccctatgatttaag

SEQ ID NO: 35684 - DNA, 22 bp, Homo sapiens
taatactgtatactgcaaattt

SEQ ID NO: 35685 - DNA, 22 bp, Homo sapiens
ctgcacatgtccctaagtgtca

SEQ ID NO: 35686 - DNA, 22 bp, Homo sapiens
tctcctggagcccagatgctgg

SEQ ID NO: 35687 - DNA, 22 bp, Homo sapiens
catggcggtcaggatgtaggtg

SEQ ID NO: 35688 - DNA, 22 bp, Homo sapiens
gagaaagctaaataagttgatt

SEQ ID NO: 35689 - DNA, 17 bp, Homo sapiens
gagattttcgtcctgaa

SEQ ID NO: 35690 - DNA, 22 bp, Homo sapiens
ctgggcgcgtcccctgaggcgg

SEQ ID NO: 35691 - DNA, 22 bp, Homo sapiens
ggagagggtaggggtcctgccc

SEQ ID NO: 35692 - DNA, 22 bp, Homo sapiens
ttgatgtaggtttatctattgt

SEQ ID NO: 35693 - DNA, 22 bp, Homo sapiens
gggcaggaacaaatcaaatgat

SEQ ID NO: 35694 - DNA, 21 bp, Homo sapiens
ggccccgcagacccagcacgt

SEQ ID NO: 35695 - DNA, 22 bp, Homo sapiens
ggctgagctccaagtattccat

SEQ ID NO: 35696 - DNA, 22 bp, Homo sapiens
cattctaggcctggcttgggcc

SEQ ID NO: 35697 - DNA, 22 bp, Homo sapiens
gagaacagaagcattcctaatt

SEQ ID NO: 35698 - DNA, 22 bp, Homo sapiens
tggctcctcacgtcctcagagc

SEQ ID NO: 35699 - DNA, 22 bp, Homo sapiens
cagccccacacggtctagctct

SEQ ID NO: 35700 - DNA, 22 bp, Homo sapiens
ccgggctggagtgcaatggctc

SEQ ID NO: 35701 - DNA, 22 bp, Homo sapiens
atcaagagcacagtgctggcat

SEQ ID NO: 35702 - DNA, 22 bp, Homo sapiens
aaagtgctgggattccaggcgt

SEQ ID NO: 35703 - DNA, 22 bp, Homo sapiens
gtggcatctcagaggccaagaa

SEQ ID NO: 35704 - DNA, 22 bp, Homo sapiens
tggacaacatagtgagacctca

SEQ ID NO: 35705 - DNA, 22 bp, Homo sapiens
accagctagggtagcacatctc

SEQ ID NO: 35706 - DNA, 22 bp, Homo sapiens
ctgagctcacgccattctcctt

SEQ ID NO: 35707 - DNA, 21 bp, Homo sapiens
ttagaagctaatgcagctggt

SEQ ID NO: 35708 - DNA, 22 bp, Homo sapiens
cagcctttgggtcagaagattc

SEQ ID NO: 35709 - DNA, 22 bp, Homo sapiens
tttacagcagcatgatttataa

SEQ ID NO: 35710 - DNA, 22 bp, Homo sapiens
ctgggaggcggagcttgcagtg

SEQ ID NO: 35711 - DNA, 22 bp, Homo sapiens
atttttggctgttgtcagaggt

SEQ ID NO: 35712 - DNA, 22 bp, Homo sapiens
tcccagagctctggaggttgga

SEQ ID NO: 35713 - DNA, 22 bp, Homo sapiens
tggaatgtcagctacaagaggg

SEQ ID NO: 35714 - DNA, 22 bp, Homo sapiens
gggagtgtgcacacatggtata

SEQ ID NO: 35715 - DNA, 22 bp, Homo sapiens
tgtcatctgcgggtggcactgc

SEQ ID NO: 35716 - DNA, 22 bp, Homo sapiens
ccagaaaaatcctcccttgtcc

SEQ ID NO: 35717 - DNA, 22 bp, Homo sapiens
cacgggagacgtgatcttggac

SEQ ID NO: 35718 - DNA, 22 bp, Homo sapiens
cggatcctcagtcgtgcgggag

SEQ ID NO: 35719 - DNA, 22 bp, Homo sapiens
attttctctttgtatatgctag

SEQ ID NO: 35720 - DNA, 22 bp, Homo sapiens
aaactgtcctcccgaggtttcc

SEQ ID NO: 35721 - DNA, 22 bp, Homo sapiens
cttgtagacccctggactcacg

SEQ ID NO: 35722 - DNA, 22 bp, Homo sapiens
gctgccttgccctcttcccata

SEQ ID NO: 35723 - DNA, 22 bp, Homo sapiens
tctctggttatgtcattaagca

SEQ ID NO: 35724 - DNA, 22 bp, Homo sapiens
gtggctcacacctgtaatccca

SEQ ID NO: 35725 - DNA, 22 bp, Homo sapiens
cacagagctggaaaggctgggc

SEQ ID NO: 35726 - DNA, 22 bp, Homo sapiens
gaggtgggcggatcacaaggtc

SEQ ID NO: 35727 - DNA, 22 bp, Homo sapiens
gggatctgggacaacaggtggt

SEQ ID NO: 35728 - DNA, 22 bp, Homo sapiens
agttcaacaccagcctgaccaa

SEQ ID NO: 35729 - DNA, 22 bp, Homo sapiens
tctccgatcacaggttttcaat

SEQ ID NO: 35730 - DNA, 22 bp, Homo sapiens
ccagggtggcgtagatgctggg

SEQ ID NO: 35731 - DNA, 22 bp, Homo sapiens
tgacagtgaacaggttaccact

SEQ ID NO: 35732 - DNA, 19 bp, Homo sapiens
gccgggcccgggttggccg

SEQ ID NO: 35733 - DNA, 19 bp, Homo sapiens
gagaaagcaggcacagcac

SEQ ID NO: 35734 - DNA, 22 bp, Homo sapiens
ggtgccaggctgtagtcagggt

SEQ ID NO: 35735 - DNA, 22 bp, Homo sapiens
tggagtgcaatagtaataaggt

SEQ ID NO: 35736 - DNA, 22 bp, Homo sapiens
tgagcctgagttcaaggctgca

SEQ ID NO: 35737 - DNA, 22 bp, Homo sapiens
gcggtagctcaagcttgtaatc

SEQ ID NO: 35738 - DNA, 22 bp, Homo sapiens
tttcttaggctctaaaatgact

SEQ ID NO: 35739 - DNA, 23 bp, Homo sapiens
acagcaagaggaccagatgtgag

SEQ ID NO: 35740 - DNA, 22 bp, Homo sapiens
cctttaggagtgaggaccgagc

SEQ ID NO: 35741 - DNA, 22 bp, Homo sapiens
atgttggagtcgtaaggcatgg

SEQ ID NO: 35742 - DNA, 22 bp, Homo sapiens
agaccactaaaactttctctat

SEQ ID NO: 35743 - DNA, 22 bp, Homo sapiens
cacaaccatgcacagctaattt

SEQ ID NO: 35744 - DNA, 18 bp, Homo sapiens
cttgttcttctcttggcg

SEQ ID NO: 35745 - DNA, 22 bp, Homo sapiens
agatacattgttctaagcattg

SEQ ID NO: 35746 - DNA, 19 bp, Homo sapiens
tcctgcctggggccgcctg

SEQ ID NO: 35747 - DNA, 22 bp, Homo sapiens
attggccatttgcatgtattat

SEQ ID NO: 35748 - DNA, 22 bp, Homo sapiens
caagcaccatgtgctccatgtt

SEQ ID NO: 35749 - DNA, 22 bp, Homo sapiens
ctgcagtatgagctacccaggt

SEQ ID NO: 35750 - DNA, 22 bp, Homo sapiens
aagaggtagcagtcacaaaaga

SEQ ID NO: 35751 - DNA, 22 bp, Homo sapiens
tcacagagatgaacttttgata

SEQ ID NO: 35752 - DNA, 22 bp, Homo sapiens
cccactgctgcgccgggcgccg

SEQ ID NO: 35753 - DNA, 22 bp, Homo sapiens
aggaagttagtaaattatgtgc

SEQ ID NO: 35754 - DNA, 17 bp, Homo sapiens
gtaaggcttgcagatgc

SEQ ID NO: 35755 - DNA, 22 bp, Homo sapiens
actgcattctttatcccacaac

SEQ ID NO: 35756 - DNA, 22 bp, Homo sapiens
gttgctcaggcaggagtacagt

SEQ ID NO: 35757 - DNA, 22 bp, Homo sapiens
tcttctatcctcagcccctgcc

SEQ ID NO: 35758 - DNA, 22 bp, Homo sapiens
ttgcccaggctggagtgcagtg

SEQ ID NO: 35759 - DNA, 22 bp, Homo sapiens
ggctccccaggtccaggagctg

SEQ ID NO: 35760 - DNA, 22 bp, Homo sapiens
tgagcctgtcattattcagaga

SEQ ID NO: 35761 - DNA, 20 bp, Homo sapiens
aactcctagcctcaagtgat

SEQ ID NO: 35762 - DNA, 22 bp, Homo sapiens
aacagtgtttttcttcagcact

SEQ ID NO: 35763 - DNA, 22 bp, Homo sapiens
tggtatcgtgttggcactcagt

SEQ ID NO: 35764 - DNA, 20 bp, Homo sapiens
tgttctgtcgtctttcttca

SEQ ID NO: 35765 - DNA, 18 bp, Homo sapiens
gcactgaggaaaacctct

SEQ ID NO: 35766 - DNA, 22 bp, Homo sapiens
gacctccgtgtacacctcccag

SEQ ID NO: 35767 - DNA, 22 bp, Homo sapiens
atcgatcccgcgtaaggccccg

SEQ ID NO: 35768 - DNA, 22 bp, Homo sapiens
tgcctaggctggagtgcagtga

SEQ ID NO: 35769 - DNA, 22 bp, Homo sapiens
aagctggagtgcagtgcaatgg

SEQ ID NO: 35770 - DNA, 22 bp, Homo sapiens
aggtggaaatggctttcctagg

SEQ ID NO: 35771 - DNA, 22 bp, Homo sapiens
tctgcaacattcctctccccac

SEQ ID NO: 35772 - DNA, 20 bp, Homo sapiens
ttgagcttttagtacagaca

SEQ ID NO: 35773 - DNA, 23 bp, Homo sapiens
tcatttggacaaggcacagcaga

SEQ ID NO: 35774 - DNA, 22 bp, Homo sapiens
cttgagtcatataaagacagag

SEQ ID NO: 35775 - DNA, 22 bp, Homo sapiens
tccaagatctacagcagtttag

SEQ ID NO: 35776 - DNA, 23 bp, Homo sapiens
atgtttgcagtaacccatcctgg

SEQ ID NO: 35777 - DNA, 22 bp, Homo sapiens
ccctctgcatacaggcgaggag

SEQ ID NO: 35778 - DNA, 22 bp, Homo sapiens
tcaccaccagaagagctattct

SEQ ID NO: 35779 - DNA, 22 bp, Homo sapiens
tcttacccggcaacgtgtgtcg

SEQ ID NO: 35780 - DNA, 22 bp, Homo sapiens
tgattaatatcaccaccattgg

SEQ ID NO: 35781 - DNA, 21 bp, Homo sapiens
tgctgggtttgcccatcaggc

SEQ ID NO: 35782 - DNA, 22 bp, Homo sapiens
ggaggcggaagttgcagtgagc

SEQ ID NO: 35783 - DNA, 22 bp, Homo sapiens
aagttactggcaagggctgcag

SEQ ID NO: 35784 - DNA, 22 bp, Homo sapiens
agaacctcaattatttttgcac

SEQ ID NO: 35785 - DNA, 22 bp, Homo sapiens
gaggctgaggcaggaggatcac

SEQ ID NO: 35786 - DNA, 22 bp, Homo sapiens
agcttgacagacagatggtagc

SEQ ID NO: 35787 - DNA, 22 bp, Homo sapiens
ttagtttataattcatttctgt

SEQ ID NO: 35788 - DNA, 22 bp, Homo sapiens
ccctaaaagtctcattttccag

SEQ ID NO: 35789 - DNA, 22 bp, Homo sapiens
ttatgatttgccacagattggt

SEQ ID NO: 35790 - DNA, 22 bp, Homo sapiens
agtcttagaactacagtgccta

SEQ ID NO: 35791 - DNA, 22 bp, Homo sapiens
tccacagtggttgaactagtaa

SEQ ID NO: 35792 - DNA, 22 bp, Homo sapiens
gcggctgccgagacaagccggt

SEQ ID NO: 35793 - DNA, 22 bp, Homo sapiens
cgctgataaacgtcacgttccc

SEQ ID NO: 35794 - DNA, 22 bp, Homo sapiens
tccagctgttccatcagctctt

SEQ ID NO: 35795 - DNA, 22 bp, Homo sapiens
agagtactgctgctgggtactg

SEQ ID NO: 35796 - DNA, 22 bp, Homo sapiens
tactgcgccttcaccaagcggc

SEQ ID NO: 35797 - DNA, 22 bp, Homo sapiens
gagggggctagcgcagtgccca

SEQ ID NO: 35798 - DNA, 22 bp, Homo sapiens
ctcctctttagccccagctgga

SEQ ID NO: 35799 - DNA, 22 bp, Homo sapiens
gtcagatctttggggatgctgt

SEQ ID NO: 35800 - DNA, 22 bp, Homo sapiens
gtttatggactgtgtatgttat

SEQ ID NO: 35801 - DNA, 22 bp, Homo sapiens
gcagccagagggggtgtgatca

SEQ ID NO: 35802 - DNA, 22 bp, Homo sapiens
tactaggaagcagctgcattgg

SEQ ID NO: 35803 - DNA, 22 bp, Homo sapiens
catgagatttgggaggggccag

SEQ ID NO: 35804 - DNA, 22 bp, Homo sapiens
agcatagagtcctgagggcagg

SEQ ID NO: 35805 - DNA, 20 bp, Homo sapiens
tgcagcacgggccctttcca

SEQ ID NO: 35806 - DNA, 22 bp, Homo sapiens
ggcggagcttgcagtgagccga

SEQ ID NO: 35807 - DNA, 22 bp, Homo sapiens
ggttgcaaactcctgggatcaa

SEQ ID NO: 35808 - DNA, 22 bp, Homo sapiens
acattaaaattgggtggggtaa

SEQ ID NO: 35809 - DNA, 22 bp, Homo sapiens
agtccaggactgtttcagctga

SEQ ID NO: 35810 - DNA, 22 bp, Homo sapiens
tgagccaagatcatgccgttgt

SEQ ID NO: 35811 - DNA, 22 bp, Homo sapiens
cctggtgctgctatcaggggta

SEQ ID NO: 35812 - DNA, 18 bp, Homo sapiens
gctctgcaggtgctcggt

SEQ ID NO: 35813 - DNA, 22 bp, Homo sapiens
gtgtggtcgaagttctcccgga

SEQ ID NO: 35814 - DNA, 22 bp, Homo sapiens
ctgggaggcagaggttgtagtg

SEQ ID NO: 35815 - DNA, 22 bp, Homo sapiens
aaagtgctgggattacaggctt

SEQ ID NO: 35816 - DNA, 22 bp, Homo sapiens
ccgcccacactaaatatgagcg

SEQ ID NO: 35817 - DNA, 22 bp, Homo sapiens
aggaggggttctcgggtgctga

SEQ ID NO: 35818 - DNA, 22 bp, Homo sapiens
ctgccaggattctgtgaacccc

SEQ ID NO: 35819 - DNA, 22 bp, Homo sapiens
aatctgagggaacttgaactcc

SEQ ID NO: 35820 - DNA, 22 bp, Homo sapiens
ggtgctggacacgtggcactcc

SEQ ID NO: 35821 - DNA, 22 bp, Homo sapiens
ttgctcttgaaaattgatgctg

SEQ ID NO: 35822 - DNA, 22 bp, Homo sapiens
gagtggctattgatccgtgatg

SEQ ID NO: 35823 - DNA, 22 bp, Homo sapiens
gcaaatgctaaagtgtagagac

SEQ ID NO: 35824 - DNA, 18 bp, Homo sapiens
tcctttctccctcatctt

SEQ ID NO: 35825 - DNA, 22 bp, Homo sapiens
tgtatgttgggtcaaagtacat

SEQ ID NO: 35826 - DNA, 22 bp, Homo sapiens
ctcccagccttcgccagtctga

SEQ ID NO: 35827 - DNA, 22 bp, Homo sapiens
gcagagctgggatatgaaccca

SEQ ID NO: 35828 - DNA, 22 bp, Homo sapiens
catctgctgttccttggactca

SEQ ID NO: 35829 - DNA, 22 bp, Homo sapiens
gccaatgacagtctcagttctg

SEQ ID NO: 35830 - DNA, 22 bp, Homo sapiens
agcaggcctgccacctcggggt

SEQ ID NO: 35831 - DNA, 22 bp, Homo sapiens
aaggtatatctgatccatgagg

SEQ ID NO: 35832 - DNA, 22 bp, Homo sapiens
atagggcctaaaaagtattgct

SEQ ID NO: 35833 - DNA, 22 bp, Homo sapiens
atcgcaagtttaaaaatctttg

SEQ ID NO: 35834 - DNA, 22 bp, Homo sapiens
cacccaggttggagtgcagtgg

SEQ ID NO: 35835 - DNA, 22 bp, Homo sapiens
cagtggctggttagggacagga

SEQ ID NO: 35836 - DNA, 21 bp, Homo sapiens
aggcttggatctagacaggcc

SEQ ID NO: 35837 - DNA, 22 bp, Homo sapiens
aaagaggcaatcaatgtagcaa

SEQ ID NO: 35838 - DNA, 22 bp, Homo sapiens
gctgcagtgagccaagatcgtg

SEQ ID NO: 35839 - DNA, 22 bp, Homo sapiens
taactgattcctttttgaaaat

SEQ ID NO: 35840 - DNA, 21 bp, Homo sapiens
gttgtggttggggctgcagct

SEQ ID NO: 35841 - DNA, 22 bp, Homo sapiens
ttgggctgaaccctgcagctga

SEQ ID NO: 35842 - DNA, 22 bp, Homo sapiens
ctgcgtgagcgtgcccgtcttg

SEQ ID NO: 35843 - DNA, 22 bp, Homo sapiens
gccagtggtcactgaggaagaa

SEQ ID NO: 35844 - DNA, 22 bp, Homo sapiens
ggcccagacccaagagtggtgg

SEQ ID NO: 35845 - DNA, 22 bp, Homo sapiens
aaacccagggttttgtcttccc

SEQ ID NO: 35846 - DNA, 22 bp, Homo sapiens
tctcagggctcagagctcaggc

SEQ ID NO: 35847 - DNA, 22 bp, Homo sapiens
tggggcagttaataaacattct

SEQ ID NO: 35848 - DNA, 22 bp, Homo sapiens
ctgggcaaattgtgccagctat

SEQ ID NO: 35849 - DNA, 22 bp, Homo sapiens
cgttgtttgagattttcagaat

SEQ ID NO: 35850 - DNA, 22 bp, Homo sapiens
tttctttatcatagcatctttg

SEQ ID NO: 35851 - DNA, 22 bp, Homo sapiens
cactgcaacctccatcttctgg

SEQ ID NO: 35852 - DNA, 22 bp, Homo sapiens
gcaggctgtctaaagttagagt

SEQ ID NO: 35853 - DNA, 22 bp, Homo sapiens
ttatagcagcatgatttataat

SEQ ID NO: 35854 - DNA, 22 bp, Homo sapiens
ggctgacttttatgcacactaa

SEQ ID NO: 35855 - DNA, 19 bp, Homo sapiens
gcgctttattgattgcaag

SEQ ID NO: 35856 - DNA, 22 bp, Homo sapiens
ttgcaattgctatggagagcgt

SEQ ID NO: 35857 - DNA, 22 bp, Homo sapiens
ccacagaattctgtctccagga

SEQ ID NO: 35858 - DNA, 22 bp, Homo sapiens
cctgtatttaaaaatattctaa

SEQ ID NO: 35859 - DNA, 22 bp, Homo sapiens
gggcggatcatttgaggtcagg

SEQ ID NO: 35860 - DNA, 22 bp, Homo sapiens
atacaatgattggttctcaccc

SEQ ID NO: 35861 - DNA, 22 bp, Homo sapiens
cgggttcacgccattctcctgc

SEQ ID NO: 35862 - DNA, 22 bp, Homo sapiens
cggaagagggacagcgccagcc

SEQ ID NO: 35863 - DNA, 22 bp, Homo sapiens
gctcggtggccagcctgaggcc

SEQ ID NO: 35864 - DNA, 22 bp, Homo sapiens
tggaagactcaaggtggtgaat

SEQ ID NO: 35865 - DNA, 22 bp, Homo sapiens
cagctggtgtcaggcactgcag

SEQ ID NO: 35866 - DNA, 22 bp, Homo sapiens
ttgtgctcctatgagaatctaa

SEQ ID NO: 35867 - DNA, 22 bp, Homo sapiens
gagatgggcgagaaggtggact

SEQ ID NO: 35868 - DNA, 22 bp, Homo sapiens
ggggtactggctggagccccac

SEQ ID NO: 35869 - DNA, 22 bp, Homo sapiens
acactgcagatgaaagcataag

SEQ ID NO: 35870 - DNA, 22 bp, Homo sapiens
aagaaggcggaccagaagggag

SEQ ID NO: 35871 - DNA, 22 bp, Homo sapiens
tccaaacgggagccaaatgagc

SEQ ID NO: 35872 - DNA, 22 bp, Homo sapiens
cccccagctctgctgggtcccg

SEQ ID NO: 35873 - DNA, 22 bp, Homo sapiens
tgctgttagtaaggaacatgac

SEQ ID NO: 35874 - DNA, 22 bp, Homo sapiens
gaataatcatgaaattcagtga

SEQ ID NO: 35875 - DNA, 22 bp, Homo sapiens
cagcaagtcatccaggatgatg

SEQ ID NO: 35876 - DNA, 18 bp, Homo sapiens
gcagtgaagaaagagctt

SEQ ID NO: 35877 - DNA, 22 bp, Homo sapiens
tggaagggagctggaatttgga

SEQ ID NO: 35878 - DNA, 22 bp, Homo sapiens
gtgggccttcaaccctgtctgg

SEQ ID NO: 35879 - DNA, 22 bp, Homo sapiens
ctgggcacagcgttgggctctt

SEQ ID NO: 35880 - DNA, 22 bp, Homo sapiens
aggaaggcttctttggtcttct

SEQ ID NO: 35881 - DNA, 21 bp, Homo sapiens
ctgtgatgttgccggggtagg

SEQ ID NO: 35882 - DNA, 22 bp, Homo sapiens
gccctgccctctcggcactcgc

SEQ ID NO: 35883 - DNA, 22 bp, Homo sapiens
tgggtgctctgcgaccgtaggg

SEQ ID NO: 35884 - DNA, 22 bp, Homo sapiens
gggaagagggagctggaatgat

SEQ ID NO: 35885 - DNA, 22 bp, Homo sapiens
aagtgctgggattataggcatg

SEQ ID NO: 35886 - DNA, 22 bp, Homo sapiens
aggtcacgtcctgtgatgtcat

SEQ ID NO: 35887 - DNA, 22 bp, Homo sapiens
tgtcatagtgtggtagcagtgg

SEQ ID NO: 35888 - DNA, 22 bp, Homo sapiens
gggtccagtagttggtggccgt

SEQ ID NO: 35889 - DNA, 20 bp, Homo sapiens
ggggcccaagccctcttgcc

SEQ ID NO: 35890 - DNA, 22 bp, Homo sapiens
actgatcaagggtttaatttta

SEQ ID NO: 35891 - DNA, 22 bp, Homo sapiens
gggcggggtggctcatgcctgt

SEQ ID NO: 35892 - DNA, 22 bp, Homo sapiens
atgccactgcacttcagcctgg

SEQ ID NO: 35893 - DNA, 22 bp, Homo sapiens
acacccaggctggcgtgcagtg

SEQ ID NO: 35894 - DNA, 22 bp, Homo sapiens
gaccttcttgctgtgtcctaac

SEQ ID NO: 35895 - DNA, 22 bp, Homo sapiens
ggaaatgacttggtgcttcgtt

SEQ ID NO: 35896 - DNA, 22 bp, Homo sapiens
aatttgtataaaatggtgtttt

SEQ ID NO: 35897 - DNA, 19 bp, Homo sapiens
ggagccgccgcccttcatt

SEQ ID NO: 35898 - DNA, 21 bp, Homo sapiens
accaccctgtttatccagagg

SEQ ID NO: 35899 - DNA, 22 bp, Homo sapiens
ttaggtattttgttatgtcagc

SEQ ID NO: 35900 - DNA, 22 bp, Homo sapiens
gtagggttggagagcacaacca

SEQ ID NO: 35901 - DNA, 22 bp, Homo sapiens
cccaaaggttgaggctgcagtg

SEQ ID NO: 35902 - DNA, 22 bp, Homo sapiens
attcatcaactgatagccatag

SEQ ID NO: 35903 - DNA, 22 bp, Homo sapiens
aaattgtaatgacttcacttga

SEQ ID NO: 35904 - DNA, 22 bp, Homo sapiens
cacccaggcaaggattctgcaa

SEQ ID NO: 35905 - DNA, 22 bp, Homo sapiens
cacatgaaggctggggtcgtga

SEQ ID NO: 35906 - DNA, 22 bp, Homo sapiens
tgggcttggtttctaggtaggt

SEQ ID NO: 35907 - DNA, 22 bp, Homo sapiens
gtgctccctccttcctcaagga

SEQ ID NO: 35908 - DNA, 23 bp, Homo sapiens
tgtcttcgactcctgcgtgcttc

SEQ ID NO: 35909 - DNA, 22 bp, Homo sapiens
gctgacccctacaggttgtgtt

SEQ ID NO: 35910 - DNA, 19 bp, Homo sapiens
ttcacattggaagaagtag

SEQ ID NO: 35911 - DNA, 22 bp, Homo sapiens
gaggcagaagttgcagtgagca

SEQ ID NO: 35912 - DNA, 22 bp, Homo sapiens
ggaggctgagaggtcgcagtgg

SEQ ID NO: 35913 - DNA, 20 bp, Homo sapiens
tttgagaccagtctgcccaa

SEQ ID NO: 35914 - DNA, 22 bp, Homo sapiens
ggattgcaacaagctagtttag

SEQ ID NO: 35915 - DNA, 22 bp, Homo sapiens
aggggttggacataagacagaa

SEQ ID NO: 35916 - DNA, 22 bp, Homo sapiens
actgcactccagcctcggggtc

SEQ ID NO: 35917 - DNA, 22 bp, Homo sapiens
ttcaccctggaccagaaattgg

SEQ ID NO: 35918 - DNA, 22 bp, Homo sapiens
attgcacttcagcctgggtgac

SEQ ID NO: 35919 - DNA, 22 bp, Homo sapiens
aggaaggactccatggtccgtc

SEQ ID NO: 35920 - DNA, 22 bp, Homo sapiens
atacttctttagcatattgaac

SEQ ID NO: 35921 - DNA, 22 bp, Homo sapiens
ctgccgttgtgaagctcttaga

SEQ ID NO: 35922 - DNA, 22 bp, Homo sapiens
tgttattgtcgctgcactggga

SEQ ID NO: 35923 - DNA, 22 bp, Homo sapiens
tgagacaggcttccttcttggg

SEQ ID NO: 35924 - DNA, 22 bp, Homo sapiens
aggtgactggtttatctggcag

SEQ ID NO: 35925 - DNA, 18 bp, Homo sapiens
gaggatggaaggagatgc

SEQ ID NO: 35926 - DNA, 22 bp, Homo sapiens
aggggcacgagtagagctctag

SEQ ID NO: 35927 - DNA, 22 bp, Homo sapiens
tcttgccacttcatcccctttc

SEQ ID NO: 35928 - DNA, 22 bp, Homo sapiens
acagtctgtcccccaggtgcta

SEQ ID NO: 35929 - DNA, 22 bp, Homo sapiens
gagaggaagccttctgtacttg

SEQ ID NO: 35930 - DNA, 22 bp, Homo sapiens
agcttgggcaacacagcaagac

SEQ ID NO: 35931 - DNA, 22 bp, Homo sapiens
agaaaacataggagacaggaaa

SEQ ID NO: 35932 - DNA, 22 bp, Homo sapiens
ccctttagcccctgcagagact

SEQ ID NO: 35933 - DNA, 22 bp, Homo sapiens
ccagctttatagcttcaaagga

SEQ ID NO: 35934 - DNA, 22 bp, Homo sapiens
tgtggctcaggcggcttctcct

SEQ ID NO: 35935 - DNA, 21 bp, Homo sapiens
gctcctggtgctgcgtggcgc

SEQ ID NO: 35936 - DNA, 22 bp, Homo sapiens
gctgaggtggaggaaggagacc

SEQ ID NO: 35937 - DNA, 22 bp, Homo sapiens
cggcccgctgcgagtgcaccgt

SEQ ID NO: 35938 - DNA, 22 bp, Homo sapiens
caggaacagggtgtcctggcag

SEQ ID NO: 35939 - DNA, 21 bp, Homo sapiens
acacaagcactcgtacatacg

SEQ ID NO: 35940 - DNA, 22 bp, Homo sapiens
ttgcccagagtcacccagctca

SEQ ID NO: 35941 - DNA, 22 bp, Homo sapiens
cctcaagtcattccggagacct

SEQ ID NO: 35942 - DNA, 22 bp, Homo sapiens
gtcccctgtccagggccagcca

SEQ ID NO: 35943 - DNA, 22 bp, Homo sapiens
ctgaggagaggtggcctgtgtt

SEQ ID NO: 35944 - DNA, 22 bp, Homo sapiens
ttgctgccttggagaagctcct

SEQ ID NO: 35945 - DNA, 22 bp, Homo sapiens
ttaataaagtatgaattggaaa

SEQ ID NO: 35946 - DNA, 23 bp, Homo sapiens
ctcaccaagcgccgccgctgtgt

SEQ ID NO: 35947 - DNA, 22 bp, Homo sapiens
agcgctgtgggcgtgcgaggag

SEQ ID NO: 35948 - DNA, 22 bp, Homo sapiens
cccaggaggcggaggttgcagt

SEQ ID NO: 35949 - DNA, 22 bp, Homo sapiens
ctctggagtgtctggccagggt

SEQ ID NO: 35950 - DNA, 22 bp, Homo sapiens
tctctttgcctgctgccatcca

SEQ ID NO: 35951 - DNA, 22 bp, Homo sapiens
tatccaattcaccattgatggg

SEQ ID NO: 35952 - DNA, 22 bp, Homo sapiens
tgtggctctcatgcactcccag

SEQ ID NO: 35953 - DNA, 16 bp, Homo sapiens
ccacctgcagctctca

SEQ ID NO: 35954 - DNA, 22 bp, Homo sapiens
taagggttcagaatgcagtggt

SEQ ID NO: 35955 - DNA, 22 bp, Homo sapiens
cgcccaggctggagtgcagtga

SEQ ID NO: 35956 - DNA, 22 bp, Homo sapiens
ggcatagatttctttaggttta

SEQ ID NO: 35957 - DNA, 22 bp, Homo sapiens
aggtaaatgtcagagcctttaa

SEQ ID NO: 35958 - DNA, 22 bp, Homo sapiens
tatcacagccttttggtgaggg

SEQ ID NO: 35959 - DNA, 20 bp, Homo sapiens
tcactgtaacatttgggggg

SEQ ID NO: 35960 - DNA, 22 bp, Homo sapiens
gtagagcagggagcaggaagct

SEQ ID NO: 35961 - DNA, 22 bp, Homo sapiens
gaatccctaagatttttataaa

SEQ ID NO: 35962 - DNA, 22 bp, Homo sapiens
cacctcaggcagcaaagtctca

SEQ ID NO: 35963 - DNA, 22 bp, Homo sapiens
tcagtgatttctggggtgaggg

SEQ ID NO: 35964 - DNA, 22 bp, Homo sapiens
ggatgttgattgaatggccatt

SEQ ID NO: 35965 - DNA, 22 bp, Homo sapiens
catagacagatggtaagaagct

SEQ ID NO: 35966 - DNA, 22 bp, Homo sapiens
atggccgcctgtccttcccgcc

SEQ ID NO: 35967 - DNA, 22 bp, Homo sapiens
gaggtaggtgtaggaggcctgc

SEQ ID NO: 35968 - DNA, 22 bp, Homo sapiens
tgtccaggctggagtgcagtgg

SEQ ID NO: 35969 - DNA, 22 bp, Homo sapiens
gggacaatggaggcctctctcc

SEQ ID NO: 35970 - DNA, 22 bp, Homo sapiens
gccctgtgcaggtgtgcagcag

SEQ ID NO: 35971 - DNA, 22 bp, Homo sapiens
gaagccttgaactgcaaacccc

SEQ ID NO: 35972 - DNA, 22 bp, Homo sapiens
agcatgcgcttgatcagctcca

SEQ ID NO: 35973 - DNA, 22 bp, Homo sapiens
atattgttagtaatatttcgaa

SEQ ID NO: 35974 - DNA, 23 bp, Homo sapiens
cagggccctgctcaatttctcca

SEQ ID NO: 35975 - DNA, 22 bp, Homo sapiens
tgctagtgtgtgagatgttcaa

SEQ ID NO: 35976 - DNA, 22 bp, Homo sapiens
cagcagcccacgcgtgctgtcc

SEQ ID NO: 35977 - DNA, 22 bp, Homo sapiens
aagcatgaatcgactcggcaac

SEQ ID NO: 35978 - DNA, 22 bp, Homo sapiens
tcgcttgaacccaggaagtgga

SEQ ID NO: 35979 - DNA, 22 bp, Homo sapiens
ctttggagaaaagttcttgggc

SEQ ID NO: 35980 - DNA, 22 bp, Homo sapiens
agtgtttgagtttgcggcattg

SEQ ID NO: 35981 - DNA, 22 bp, Homo sapiens
ctcagccccagcccagatagca

SEQ ID NO: 35982 - DNA, 22 bp, Homo sapiens
cagcagcagtggctgcagaaca

SEQ ID NO: 35983 - DNA, 22 bp, Homo sapiens
gccgggtgcagcgggcccgcca

SEQ ID NO: 35984 - DNA, 22 bp, Homo sapiens
ccctcccagatgggcttgaggt

SEQ ID NO: 35985 - DNA, 22 bp, Homo sapiens
tgctgctccccagcacacagca

SEQ ID NO: 35986 - DNA, 22 bp, Homo sapiens
ctctgtggtggagtgggtcacc

SEQ ID NO: 35987 - DNA, 22 bp, Homo sapiens
tcaactaactctattatttgaa

SEQ ID NO: 35988 - DNA, 22 bp, Homo sapiens
agcacctccagagcttgaagct

SEQ ID NO: 35989 - DNA, 22 bp, Homo sapiens
tgtgacctcatcttaactggaa

SEQ ID NO: 35990 - DNA, 22 bp, Homo sapiens
cccagcaaggccagctcagggc

SEQ ID NO: 35991 - DNA, 22 bp, Homo sapiens
tggaggccagaggtactgggac

SEQ ID NO: 35992 - DNA, 22 bp, Homo sapiens
tcgctgaggctgcacggctgcc

SEQ ID NO: 35993 - DNA, 22 bp, Homo sapiens
cctcacctcagtctgggcctca

SEQ ID NO: 35994 - DNA, 22 bp, Homo sapiens
ggaggtgggctaaggactctct

SEQ ID NO: 35995 - DNA, 19 bp, Homo sapiens
ctctgggcaagtcacttaa

SEQ ID NO: 35996 - DNA, 22 bp, Homo sapiens
tgatgcctaatatacttcaatt

SEQ ID NO: 35997 - DNA, 23 bp, Homo sapiens
gggtccagccaattccaaggaaa

SEQ ID NO: 35998 - DNA, 22 bp, Homo sapiens
ttcatgggtccagagccctggg

SEQ ID NO: 35999 - DNA, 22 bp, Homo sapiens
gtgcagagaggaccttggggag

SEQ ID NO: 36000 - DNA, 22 bp, Homo sapiens
aggtggcagatgggggtgctcg

SEQ ID NO: 36001 - DNA, 22 bp, Homo sapiens
cttcagctgcagttatgtttag

SEQ ID NO: 36002 - DNA, 22 bp, Homo sapiens
tcaggagtgccagtaccttttg

SEQ ID NO: 36003 - DNA, 22 bp, Homo sapiens
ttactggctgggcctgagggct

SEQ ID NO: 36004 - DNA, 22 bp, Homo sapiens
aagattttcagtgcctaaaaca

SEQ ID NO: 36005 - DNA, 22 bp, Homo sapiens
gagccagactgcctgaagctca

SEQ ID NO: 36006 - DNA, 23 bp, Homo sapiens
ctcaaccctagtaagggagtagg

SEQ ID NO: 36007 - DNA, 22 bp, Homo sapiens
tgagcacatgccagcccttctc

SEQ ID NO: 36008 - DNA, 19 bp, Homo sapiens
agggttacccgctgccacc

SEQ ID NO: 36009 - DNA, 22 bp, Homo sapiens
cccaggaggcagaagttgcagt

SEQ ID NO: 36010 - DNA, 22 bp, Homo sapiens
cctacctggggcaggcctcggg

SEQ ID NO: 36011 - DNA, 22 bp, Homo sapiens
atgtcttctctgtaggtaaatt

SEQ ID NO: 36012 - DNA, 20 bp, Homo sapiens
tgtccccaccaaaatttcat

SEQ ID NO: 36013 - DNA, 22 bp, Homo sapiens
cggaggttgaggctgcagtgag

SEQ ID NO: 36014 - DNA, 20 bp, Homo sapiens
atggggtgagtgacgccctc

SEQ ID NO: 36015 - DNA, 22 bp, Homo sapiens
gcgaggaggggtgctgggcccc

SEQ ID NO: 36016 - DNA, 22 bp, Homo sapiens
tggctccacaggccagggtgtg

SEQ ID NO: 36017 - DNA, 22 bp, Homo sapiens
acccacgaagatgagcggcatg

SEQ ID NO: 36018 - DNA, 22 bp, Homo sapiens
atgtatatgcatgcattcaaag

SEQ ID NO: 36019 - DNA, 22 bp, Homo sapiens
tcacagctcactgtagcctcga

SEQ ID NO: 36020 - DNA, 22 bp, Homo sapiens
cagccacttgtgatgctgggga

SEQ ID NO: 36021 - DNA, 19 bp, Homo sapiens
gagtattttccaacttggt

SEQ ID NO: 36022 - DNA, 22 bp, Homo sapiens
aacctcaaactcttgggcttaa

SEQ ID NO: 36023 - DNA, 22 bp, Homo sapiens
aaggtgggtggatcacgaggtc

SEQ ID NO: 36024 - DNA, 22 bp, Homo sapiens
gaatgcttggaacctgaagttc

SEQ ID NO: 36025 - DNA, 22 bp, Homo sapiens
ttaagtgcaaaaatgaaagtat

SEQ ID NO: 36026 - DNA, 22 bp, Homo sapiens
ttgtgaatggtgccgcaataaa

SEQ ID NO: 36027 - DNA, 22 bp, Homo sapiens
ggatgtcgaggatggggtagca

SEQ ID NO: 36028 - DNA, 22 bp, Homo sapiens
gccgggttcaagccattctcct

SEQ ID NO: 36029 - DNA, 22 bp, Homo sapiens
ttgtcttttgtgggaaatatgg

SEQ ID NO: 36030 - DNA, 22 bp, Homo sapiens
actcccagaacatgctcttctt

SEQ ID NO: 36031 - DNA, 22 bp, Homo sapiens
cccagcaggaggaggttgcagt

SEQ ID NO: 36032 - DNA, 22 bp, Homo sapiens
actctgctctgtatttcactgt

SEQ ID NO: 36033 - DNA, 17 bp, Homo sapiens
tggtagaatgacaggcc

SEQ ID NO: 36034 - DNA, 22 bp, Homo sapiens
aaagtaattgtggttcttgcca

SEQ ID NO: 36035 - DNA, 22 bp, Homo sapiens
tagcagtgtctaggtaggccat

SEQ ID NO: 36036 - DNA, 22 bp, Homo sapiens
tggcccagtatgtataatctta

SEQ ID NO: 36037 - DNA, 22 bp, Homo sapiens
acctcctggcctcaagcaatcc

SEQ ID NO: 36038 - DNA, 22 bp, Homo sapiens
cactgcactccagcttgggtga

SEQ ID NO: 36039 - DNA, 22 bp, Homo sapiens
gtcttagatttcaccgataatg

SEQ ID NO: 36040 - DNA, 22 bp, Homo sapiens
tatgtttggcctggcaatttca

SEQ ID NO: 36041 - DNA, 22 bp, Homo sapiens
ctcgcatccaggataccctgag

SEQ ID NO: 36042 - DNA, 22 bp, Homo sapiens
agtcccaacagcttacaaggaa

SEQ ID NO: 36043 - DNA, 22 bp, Homo sapiens
ctgggagtggtgacagctctcg

SEQ ID NO: 36044 - DNA, 22 bp, Homo sapiens
actttcttggtcccatgtttga

SEQ ID NO: 36045 - DNA, 22 bp, Homo sapiens
tgggcggactcgggcatggaat

SEQ ID NO: 36046 - DNA, 22 bp, Homo sapiens
gccttgtttctctcccagataa

SEQ ID NO: 36047 - DNA, 22 bp, Homo sapiens
atgaggcaggagtgcagtggca

SEQ ID NO: 36048 - DNA, 22 bp, Homo sapiens
tacataggtacagcctttttta

SEQ ID NO: 36049 - DNA, 22 bp, Homo sapiens
aactgctgacaagtgaccagtg

SEQ ID NO: 36050 - DNA, 22 bp, Homo sapiens
aagaagagaactggcatcctaa

SEQ ID NO: 36051 - DNA, 22 bp, Homo sapiens
cacttcaacctctgagtcctgg

SEQ ID NO: 36052 - DNA, 22 bp, Homo sapiens
aacccgtgatcctgactcccct

SEQ ID NO: 36053 - DNA, 22 bp, Homo sapiens
tagtatagattgaagcagatca

SEQ ID NO: 36054 - DNA, 22 bp, Homo sapiens
ttcacagcttaataaggctcag

SEQ ID NO: 36055 - DNA, 22 bp, Homo sapiens
gagctcattcattcattgcctg

SEQ ID NO: 36056 - DNA, 18 bp, Homo sapiens
gatcgggggcgccccaag

SEQ ID NO: 36057 - DNA, 22 bp, Homo sapiens
aagctgcagcacagagaggtgg

SEQ ID NO: 36058 - DNA, 22 bp, Homo sapiens
agtggaccagaagactgaagct

SEQ ID NO: 36059 - DNA, 22 bp, Homo sapiens
ggccgcggattttcccgctggc

SEQ ID NO: 36060 - DNA, 22 bp, Homo sapiens
ggtgggagagcttgctttgatg

SEQ ID NO: 36061 - DNA, 22 bp, Homo sapiens
ctttatgaaaacctgaattatg

SEQ ID NO: 36062 - DNA, 22 bp, Homo sapiens
cagtcactggaatagctgagga

SEQ ID NO: 36063 - DNA, 23 bp, Homo sapiens
tgcatggggctatactgctgttc

SEQ ID NO: 36064 - DNA, 22 bp, Homo sapiens
ttgcttcagagggagacacttt

SEQ ID NO: 36065 - DNA, 22 bp, Homo sapiens
gctcactgcaacctctgcctcc

SEQ ID NO: 36066 - DNA, 22 bp, Homo sapiens
aaagtgcttctctttggtgggt

SEQ ID NO: 36067 - DNA, 22 bp, Homo sapiens
gatataggttcatagtgttaca

SEQ ID NO: 36068 - DNA, 22 bp, Homo sapiens
cagcctgtagtctggtccaggt

SEQ ID NO: 36069 - DNA, 22 bp, Homo sapiens
tccacaggtccggcatgaacag

SEQ ID NO: 36070 - DNA, 22 bp, Homo sapiens
ttgcgcgcggctaggtctcggt

SEQ ID NO: 36071 - DNA, 22 bp, Homo sapiens
tgctgtgttactgagatccggc

SEQ ID NO: 36072 - DNA, 22 bp, Homo sapiens
cagggtgccaaagaacaaatat

SEQ ID NO: 36073 - DNA, 22 bp, Homo sapiens
caaagggaaaagccatgtgggc

SEQ ID NO: 36074 - DNA, 22 bp, Homo sapiens
tagtgtctcttcctgtttgaaa

SEQ ID NO: 36075 - DNA, 22 bp, Homo sapiens
tgtgacaagcattgtatattgg

SEQ ID NO: 36076 - DNA, 22 bp, Homo sapiens
taagagaatgttgtggctaggt

SEQ ID NO: 36077 - DNA, 22 bp, Homo sapiens
aaaatcttgtgacttaggaagg

SEQ ID NO: 36078 - DNA, 22 bp, Homo sapiens
cccgagtgtctactcactccca

SEQ ID NO: 36079 - DNA, 22 bp, Homo sapiens
ttaccacagtgcctgtctaatg

SEQ ID NO: 36080 - DNA, 22 bp, Homo sapiens
ttgcagatatttccgatgctat

SEQ ID NO: 36081 - DNA, 22 bp, Homo sapiens
gctcactgcaacctccgccttc

SEQ ID NO: 36082 - DNA, 23 bp, Homo sapiens
ttgcatagacatcctcatagatt

SEQ ID NO: 36083 - DNA, 22 bp, Homo sapiens
tccacgtgagcttcgtgtgcag

SEQ ID NO: 36084 - DNA, 22 bp, Homo sapiens
gagtgcaatggcatgatctggg

SEQ ID NO: 36085 - DNA, 22 bp, Homo sapiens
tataaactcctcttgcattcct

SEQ ID NO: 36086 - DNA, 22 bp, Homo sapiens
tgaacgcaggtccacatggctc

SEQ ID NO: 36087 - DNA, 22 bp, Homo sapiens
aggaatgacagatgtccgcacc

SEQ ID NO: 36088 - DNA, 22 bp, Homo sapiens
cactgcactccagcccgggcaa

SEQ ID NO: 36089 - DNA, 22 bp, Homo sapiens
cctgcctatgagacgttttgcc

SEQ ID NO: 36090 - DNA, 22 bp, Homo sapiens
gtcttgtcccagctctgccact

SEQ ID NO: 36091 - DNA, 22 bp, Homo sapiens
tgtcctcgtccgcctcgaactc

SEQ ID NO: 36092 - DNA, 22 bp, Homo sapiens
tgcctccaacagcccatcctag

SEQ ID NO: 36093 - DNA, 22 bp, Homo sapiens
tttggaaatgaccccgtctaag

SEQ ID NO: 36094 - DNA, 22 bp, Homo sapiens
cactgcactccagcctgggcaa

SEQ ID NO: 36095 - DNA, 19 bp, Homo sapiens
tgtccgtggccttctggat

SEQ ID NO: 36096 - DNA, 22 bp, Homo sapiens
cggccttggtcggcccacagct

SEQ ID NO: 36097 - DNA, 22 bp, Homo sapiens
gaacttggcctgtctgtctggc

SEQ ID NO: 36098 - DNA, 22 bp, Homo sapiens
ccggctcggcgaccaggctgaa

SEQ ID NO: 36099 - DNA, 22 bp, Homo sapiens
gtgggggcaggcagtgctagga

SEQ ID NO: 36100 - DNA, 22 bp, Homo sapiens
tctctagtctcctttaacctga

SEQ ID NO: 36101 - DNA, 22 bp, Homo sapiens
gccttattacctgcactttgaa

SEQ ID NO: 36102 - DNA, 22 bp, Homo sapiens
tctgccttttactagctggatg

SEQ ID NO: 36103 - DNA, 22 bp, Homo sapiens
ggcgggaagttcttgcccactt

SEQ ID NO: 36104 - DNA, 22 bp, Homo sapiens
ggctgatgggcatgagctgtca

SEQ ID NO: 36105 - DNA, 22 bp, Homo sapiens
tgcgttgcgctcctgcagcagg

SEQ ID NO: 36106 - DNA, 22 bp, Homo sapiens
acactccagggagggagggaat

SEQ ID NO: 36107 - DNA, 22 bp, Homo sapiens
ctgattgagaaggaaggggatc

SEQ ID NO: 36108 - DNA, 22 bp, Homo sapiens
ttgcactccagcccgagcaaca

SEQ ID NO: 36109 - DNA, 22 bp, Homo sapiens
tcgaatggcaaggaaagaggct

SEQ ID NO: 36110 - DNA, 22 bp, Homo sapiens
tctgagccagggtctcctccct

SEQ ID NO: 36111 - DNA, 22 bp, Homo sapiens
gctgtggcctggcgcagagctg

SEQ ID NO: 36112 - DNA, 18 bp, Homo sapiens
gatatggaaggccatgcc

SEQ ID NO: 36113 - DNA, 22 bp, Homo sapiens
gttccaggtggtcacagagctc

SEQ ID NO: 36114 - DNA, 22 bp, Homo sapiens
agttattactctttaacatatt

SEQ ID NO: 36115 - DNA, 22 bp, Homo sapiens
ttaggtcacatcggtgaccaaa

SEQ ID NO: 36116 - DNA, 22 bp, Homo sapiens
gccagatttacagatttgccct

SEQ ID NO: 36117 - DNA, 22 bp, Homo sapiens
agtgcaggccccaggccaggcc

SEQ ID NO: 36118 - DNA, 21 bp, Homo sapiens
tctcttcctccgcgccgccgc

SEQ ID NO: 36119 - DNA, 22 bp, Homo sapiens
cactgcccaccaagtggctggt

SEQ ID NO: 36120 - DNA, 22 bp, Homo sapiens
gggagccccacctcggtgcccg

SEQ ID NO: 36121 - DNA, 22 bp, Homo sapiens
tccagaatcaatagcagttatc

SEQ ID NO: 36122 - DNA, 22 bp, Homo sapiens
gggcctgctgcaggttcaggat

SEQ ID NO: 36123 - DNA, 18 bp, Homo sapiens
ccctcttgcacaaagcaa

SEQ ID NO: 36124 - DNA, 23 bp, Homo sapiens
ggaagctcacgtagtcctgcact

SEQ ID NO: 36125 - DNA, 22 bp, Homo sapiens
ggcaggaacacagatggtgccg

SEQ ID NO: 36126 - DNA, 22 bp, Homo sapiens
atcatgacatacttttgagaag

SEQ ID NO: 36127 - DNA, 22 bp, Homo sapiens
aggctctcaccctctgaccaga

SEQ ID NO: 36128 - DNA, 22 bp, Homo sapiens
aaagttctctatggtgtaaaaa

SEQ ID NO: 36129 - DNA, 22 bp, Homo sapiens
tctacatgcagcgaggggactt

SEQ ID NO: 36130 - DNA, 22 bp, Homo sapiens
ttttcctggagatggagttgtt

SEQ ID NO: 36131 - DNA, 22 bp, Homo sapiens
cgcaggtgaaagaggctgggca

SEQ ID NO: 36132 - DNA, 22 bp, Homo sapiens
aactcaaagatgcatgacgctt

SEQ ID NO: 36133 - DNA, 22 bp, Homo sapiens
ggtcagccttggatttggtagc

SEQ ID NO: 36134 - DNA, 22 bp, Homo sapiens
tccagctctgctgtgcgccggt

SEQ ID NO: 36135 - DNA, 22 bp, Homo sapiens
aaaagtaattgtggttttggcc

SEQ ID NO: 36136 - DNA, 22 bp, Homo sapiens
acatctagactcttgccctctt

SEQ ID NO: 36137 - DNA, 22 bp, Homo sapiens
agtcacagggggcccctgcaac

SEQ ID NO: 36138 - DNA, 22 bp, Homo sapiens
ttcccacattctttacattcat

SEQ ID NO: 36139 - DNA, 20 bp, Homo sapiens
tgctggaaattgttctagga

SEQ ID NO: 36140 - DNA, 19 bp, Homo sapiens
ccatggcaatgatctgatg

SEQ ID NO: 36141 - DNA, 22 bp, Homo sapiens
tcaagcggactgagatactctg

SEQ ID NO: 36142 - DNA, 21 bp, Homo sapiens
cagaggcctatcacagactcc

SEQ ID NO: 36143 - DNA, 22 bp, Homo sapiens
aagctgtagcttttcaaaacgt

SEQ ID NO: 36144 - DNA, 22 bp, Homo sapiens
tgatgggaggtgctgcaggacc

SEQ ID NO: 36145 - DNA, 22 bp, Homo sapiens
ggtgaggggctcctctgcccgg

SEQ ID NO: 36146 - DNA, 22 bp, Homo sapiens
tcccacacagcccgctcaccgg

SEQ ID NO: 36147 - DNA, 22 bp, Homo sapiens
agagggtgggcacgtgatggat

SEQ ID NO: 36148 - DNA, 22 bp, Homo sapiens
caggcagggagctggaaaggat

SEQ ID NO: 36149 - DNA, 22 bp, Homo sapiens
aaggatgattggtaatgacact

SEQ ID NO: 36150 - DNA, 22 bp, Homo sapiens
gtgtgaaagcttgtcctctgta

SEQ ID NO: 36151 - DNA, 22 bp, Homo sapiens
ccctcaggtgaaaggaaaaatt

SEQ ID NO: 36152 - DNA, 22 bp, Homo sapiens
gagccgaggcgcacagctcggg

SEQ ID NO: 36153 - DNA, 22 bp, Homo sapiens
tttttccacataccctaggcca

SEQ ID NO: 36154 - DNA, 22 bp, Homo sapiens
accagggaccgccacactgcaa

SEQ ID NO: 36155 - DNA, 18 bp, Homo sapiens
gcagctagccaggggggc

SEQ ID NO: 36156 - DNA, 22 bp, Homo sapiens
gacaggaggcagagctcaggtg

SEQ ID NO: 36157 - DNA, 22 bp, Homo sapiens
taacaactgctgaggtatttga

SEQ ID NO: 36158 - DNA, 22 bp, Homo sapiens
taatgtataacaaatactcatc

SEQ ID NO: 36159 - DNA, 22 bp, Homo sapiens
tctcgtgcaggccttgctcgga

SEQ ID NO: 36160 - DNA, 22 bp, Homo sapiens
acactctagagggaagcgcttt

SEQ ID NO: 36161 - DNA, 22 bp, Homo sapiens
gccgcggcactggcctggctcc

SEQ ID NO: 36162 - DNA, 22 bp, Homo sapiens
actgcacttcaccctgggtgac

SEQ ID NO: 36163 - DNA, 22 bp, Homo sapiens
ctaggctggagtgcagtggcac

SEQ ID NO: 36164 - DNA, 22 bp, Homo sapiens
agttgctgggaaagatttcagt

SEQ ID NO: 36165 - DNA, 22 bp, Homo sapiens
ttgctctgactggagtgcagtg

SEQ ID NO: 36166 - DNA, 22 bp, Homo sapiens
gctgatcacatttccaaaaccc

SEQ ID NO: 36167 - DNA, 22 bp, Homo sapiens
gggtcgctgccgctgctggacc

SEQ ID NO: 36168 - DNA, 22 bp, Homo sapiens
ttcctgggattattgtcaagca

SEQ ID NO: 36169 - DNA, 22 bp, Homo sapiens
cgtgtggtcccggcaaggcaag

SEQ ID NO: 36170 - DNA, 22 bp, Homo sapiens
agtgagagtattaatgtgaact

SEQ ID NO: 36171 - DNA, 22 bp, Homo sapiens
acacttggctctgagtcactac

SEQ ID NO: 36172 - DNA, 22 bp, Homo sapiens
tctgcgcgctgctggtaccgaa

SEQ ID NO: 36173 - DNA, 22 bp, Homo sapiens
aaaaatcacttttataggcagc

SEQ ID NO: 36174 - DNA, 22 bp, Homo sapiens
agccagggtctctcgctctgtt

SEQ ID NO: 36175 - DNA, 22 bp, Homo sapiens
atgttatgtctgggaaggggta

SEQ ID NO: 36176 - DNA, 22 bp, Homo sapiens
tctgggtccgggactgtggatg

SEQ ID NO: 36177 - DNA, 22 bp, Homo sapiens
tcttcctggatgggggttgatg

SEQ ID NO: 36178 - DNA, 22 bp, Homo sapiens
agcagcttgaggctggattcca

SEQ ID NO: 36179 - DNA, 22 bp, Homo sapiens
ctcaggacggccgggggagcct

SEQ ID NO: 36180 - DNA, 22 bp, Homo sapiens
ggttcacagtaaggtttgtgct

SEQ ID NO: 36181 - DNA, 22 bp, Homo sapiens
catgggtaagactcttttgccc

SEQ ID NO: 36182 - DNA, 22 bp, Homo sapiens
tgacagtaccactgaaagtctg

SEQ ID NO: 36183 - DNA, 23 bp, Homo sapiens
ctatttctcatagttcaggtctt

SEQ ID NO: 36184 - DNA, 22 bp, Homo sapiens
gagtcacatactatgtaataga

SEQ ID NO: 36185 - DNA, 22 bp, Homo sapiens
ctgattaaaaacaggttctgag

SEQ ID NO: 36186 - DNA, 22 bp, Homo sapiens
atcacagggtgaggattagacc

SEQ ID NO: 36187 - DNA, 22 bp, Homo sapiens
ttcagagaattggataattcgt

SEQ ID NO: 36188 - DNA, 22 bp, Homo sapiens
gtcaggactctgacccgtcccg

SEQ ID NO: 36189 - DNA, 22 bp, Homo sapiens
tccagctgaggtggcctctgtg

SEQ ID NO: 36190 - DNA, 22 bp, Homo sapiens
tctgacattttgagaatgacat

SEQ ID NO: 36191 - DNA, 22 bp, Homo sapiens
ctctgctgtgccgccagggcct

SEQ ID NO: 36192 - DNA, 22 bp, Homo sapiens
ggctcatatcccggccatcatt

SEQ ID NO: 36193 - DNA, 21 bp, Homo sapiens
gtgcggatgccgtcattgtca

SEQ ID NO: 36194 - DNA, 21 bp, Homo sapiens
tggtttatgtgcttagggtct

SEQ ID NO: 36195 - DNA, 18 bp, Homo sapiens
ctgcactcccgcctgggc

SEQ ID NO: 36196 - DNA, 22 bp, Homo sapiens
gttaaggctgagcaggacactg

SEQ ID NO: 36197 - DNA, 22 bp, Homo sapiens
aacactatctgccttacaggga

SEQ ID NO: 36198 - DNA, 22 bp, Homo sapiens
ccaggttggagttcagtggcgc

SEQ ID NO: 36199 - DNA, 20 bp, Homo sapiens
tttctgtgagaaacactgtt

SEQ ID NO: 36200 - DNA, 17 bp, Homo sapiens
cttcccaccatctcctg

SEQ ID NO: 36201 - DNA, 22 bp, Homo sapiens
tttaggttttttcacgtggcta

SEQ ID NO: 36202 - DNA, 22 bp, Homo sapiens
gaactcattagcctgctttcag

SEQ ID NO: 36203 - DNA, 22 bp, Homo sapiens
ttttctcttccctctggacctg

SEQ ID NO: 36204 - DNA, 22 bp, Homo sapiens
ctcgggcaccctggttctggtg

SEQ ID NO: 36205 - DNA, 21 bp, Homo sapiens
gacactgcttactctgaccta

SEQ ID NO: 36206 - DNA, 22 bp, Homo sapiens
atgtacataaaatgtataatga

SEQ ID NO: 36207 - DNA, 22 bp, Homo sapiens
ctggctctcaggctggtcccca

SEQ ID NO: 36208 - DNA, 21 bp, Homo sapiens
ggtgacacgtggccccgctct

SEQ ID NO: 36209 - DNA, 22 bp, Homo sapiens
gctactgattgaccttggagag

SEQ ID NO: 36210 - DNA, 22 bp, Homo sapiens
gggccaccccactgcccacgct

SEQ ID NO: 36211 - DNA, 22 bp, Homo sapiens
tagtcccggaactccttcaggt

SEQ ID NO: 36212 - DNA, 22 bp, Homo sapiens
aaatgcacaaagattttgcact

SEQ ID NO: 36213 - DNA, 22 bp, Homo sapiens
gagtcgagcagaaagccgtcgg

SEQ ID NO: 36214 - DNA, 22 bp, Homo sapiens
ataagattgtcatagtatggac

SEQ ID NO: 36215 - DNA, 22 bp, Homo sapiens
caaagtggaggctctggggcca

SEQ ID NO: 36216 - DNA, 22 bp, Homo sapiens
tggggatcataaattgatggag

SEQ ID NO: 36217 - DNA, 22 bp, Homo sapiens
tcgcccagctcatctcccacaa

SEQ ID NO: 36218 - DNA, 22 bp, Homo sapiens
ggcagacctctccagccccaca

SEQ ID NO: 36219 - DNA, 22 bp, Homo sapiens
attttctatgttgtaattgtta

SEQ ID NO: 36220 - DNA, 20 bp, Homo sapiens
agacagtgtggagattcctt

SEQ ID NO: 36221 - DNA, 22 bp, Homo sapiens
gcacggctaatttttgtatttt

SEQ ID NO: 36222 - DNA, 22 bp, Homo sapiens
tttgctattgtgaatagtgcca

SEQ ID NO: 36223 - DNA, 22 bp, Homo sapiens
cacttcattgggaccagggctg

SEQ ID NO: 36224 - DNA, 22 bp, Homo sapiens
ccacgtccagctaattttcgta

SEQ ID NO: 36225 - DNA, 22 bp, Homo sapiens
gtagtcccagctaccccggagg

SEQ ID NO: 36226 - DNA, 22 bp, Homo sapiens
gtcatcttgctgttttagatct

SEQ ID NO: 36227 - DNA, 22 bp, Homo sapiens
gacttctgaattcctatcaggt

(The sequence listing continues in the following parts.)

The invention claimed is:

1. An isolated nucleic acid, wherein the nucleic acid consists of a sequence selected from the group consisting of:
   (a) SEQ ID NO: 7002375;
   (b) an RNA encoded by (a);
   (c) a sequence at least 80% identical to (a) or (b) wherein the sequence is 19-24 nucleotides; and
   (d) the complement of any one of (a)-(c), wherein the complement is identical in length to (a).

2. An isolated nucleic acid, wherein the nucleic acid consists of a sequence selected from the group consisting of:
   (a) SEQ ID NO:6816665;
   (b) an RNA encoded by (a);
   (c) the complement of (a) or (b), wherein the complement is identical in length to (a).

3. A vector comprising a human insert, wherein the human insert consists of the nucleic acid of claim 1 or claim 2, and wherein the vector comprises no insert other than the nucleic acid of claim 1 or claim 2.

4. A probe comprising a human insert, wherein the human insert consists of the nucleic acid of claim 1 or claim 2, and wherein the probe comprises no insert other than the nucleic acid of claim 1 or claim 2.

* * * * *